United States Patent 11,739,335 (NUCLEIC ACIDS ENCODING CRISPR-ASSOCIATED PROTEINS AND USES THEREOF) - sequence listing, part 5

SEQ ID NO: 3662 - RNA, 3314 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3663 - RNA, 3725 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3664 - RNA, 4283 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3665 - RNA, 4262 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 3666 - RNA, 4452 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3667 - RNA, 5235 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3668 - RNA, 3507 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3669 - RNA, 4575 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3670 - RNA, 3651 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3671 - RNA, 4512 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3672 - RNA, 3594 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3673 - RNA, 4350 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3674 - RNA, 4383 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3675 - RNA, 3516 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3676 - RNA, 3594 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3677 - RNA, 3600 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3678 - RNA, 3300 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3679 - RNA, 3711 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3680 - RNA, 4269 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3681 - RNA, 4248 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3682 - RNA, 4433 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcagacaagaaauacagcauuggacuggauauagguacaaacuccguuggcugggccgugaucacagacgaguauaagguaccaucuaagaaauucaaggugcucgggaauacugauaggcauucaauuaaaaagaaccuuaucggagcgcuguuguuugacaguggcgaaacggcugaggccacccgguuaaaacgcacagcacgacguagauacacuaggcggaagaaucgcauuugcuaucugcaggaaaucuucagcaacgagauggccaaggucgaugacuccuuuuuccacagacuagaagagucuuuucucguggaggaagauaaaaagcaugagaggcacccgauauucgguaauaucguugacgaaguggcuuaccaugagaaauaucccaccauuuaccaucugcggaagaaacuugucgauucgacagacaaggcagaucugcgcuugaucuaucucgcccuggcucacaugauuaaauuucgagggcacuuccugaucgagggagaccucaacccugauaauucagacguggacaaguuauuuauacaacugguacagaccuacaaccagcuuuucgaagagaauccaauuaacgccagcggcguugaugcgaaggcaaucuugagugccagacuguccaaaucuaggcggcuagaaaaucucauugcucagcugcccggcgagaagaaaaacgggcuuuuuggaaaucugaucgccuugagccucggucugacuccuaacuucaaguccaauuuugacuuagcagaagaugcuaaacugcaacucucaaaggacacauacgaugacgaucuugacaaccuguuggcccagaucggcgaucaguaugcggaccuauuccuggccgcaaagaaccucagugaugcuauucugcuuagcgacauacugcgugugaauaccgagaucacgaaagccccauugucugcuuccaugauuaagcgcuacgacgagcaccaucaggaucucacucuguuaaaagcccuggucagacaacagcuacccgaaaaguauaaagagaucuucuuugaccagucaaagaacggguacgcaggauauauagauggcggugccagccaggaagaguucuacaaguuuauuaaaccuauccucgaaaagauggacgggaccgaggagcugcuugugaaauugaauagggaagaucugcuccggaagcaacgaacauucgacaacggaaguaucccacaccagauucaccugggcgagcuucaugcuauccugcgcagacaggaagauuuuuauccguucuugaaagacaauagggagaagauugaaaagauacucacuuuucggauccccuacuacgugggcccucuggcgcgcgggaacucuagauucgcauggaugaccaggaaauccgaggagacaauuaccccauggaauuuugaagaggucguugauaagggagccagcgcucaaucguucaucgaacguaugacgaacuuugacaaaaauuuacccaacgagaaggugcugccuaaacacucucuacucuaugaguacuucacuguauauaaugaacugacaaaggugaaauacgucaccgaggguaugcggaagccagccuuucuuuccggcgaacagaagaaagcaaucguggauuugcuguucaagacuaaccgaaaaguuacagugaagcagcucaaagaggacuauuucaagaagauugaauguuuugauucagucgagauaagugggguggaggacagauucaaugccagccugggaaccuaccaugacuuacugaaaaucauuaaggauaaagacuuucuugauaacgaagagaaugaagacaucuuggaggauauuguacucacgcugacccuauucgaagacagggagaugaucgaggaacgccugaagacauaugcucaccucuuugaugacaaaguuaugaagcagcugaagcggagaagguacacuggcuggggucgccuuucccgaaaauugauaaacgggauccgggauaagcaaucuggcaaaaccauucuggacuucuuaaagagcgauggauuugccaaccguaauuucaugcagcucauccaugacgauucacugacauuuaaagaggacauucagaaggcacaggugaguggccaaggggacucccuucacgaacacaucgcgaaccuggcuggaagccccgccauaaagaaagguauuuugcagacugucaagguggucgaugagcucgugaaaguuaugggcagacauaagccggaaaauaucgugauugagauggcaagggagaaccagaccacacagaaagggcaaaagaacucucgcgaacggaugaaaagaaucgaggaaggaauaaaggagcugggcucacagauccuaaaggagcacccuguagaaaauacccagcugcagaaugagaaacucuaccuguauuaccuucaaaacgguagggacauguaugucgaucaggaauuggacauuaaucgacugagugauuacgacguggaucauaucguuccccagagcuucuuaaaggacgauuccauugacaacaaagugcucacucgcucugauaagaaucgggggaaaucggacaacgucccaagcgaggaagugguaaagaagaugaaaaauuauuggagacaacugcuuaacgccaagcugaucacgcagaggaaauuugacaaucuaacaaaggcugagcguggcggacucuccgagcuggauaaagccggcuucauaaagcgccaguugguggaaacccggcagauuacuaagcacguugcacaaauccuggacucaagaaugaacaccaaauacgaugagaacgacaaguuaaucagggaagucaaagugauuacacucaagaguaaacuggugucugauuuucgaaaggacuuccaguucuauaagguccgggagaucaauaacuaccaccaugcucacgaugccuaccuuaaugcgguuguggggaccgcccugauuaaaaaguauccuaaauuggaaagcgaguuuguguacggagacuauaagguauacgauguccgcaaaaugauagcuaaguccgagcaggaaaucgguaaggcaacugccaaauauuucuuuuacucaaacauuaugaauuucuuuaagacagagaucacgcucgcuaacggcgaaauuagaaaaaggccccugaucgagaccaauggggaaacuggagagauagugugggacaagggccgggauuucgccacaguucgaaaagugcuaagcaugccacaggucaacaucgugaagaaaaccgagguucaaacagguggguuuucuaaggaauccauucugcccaagagaaauagugacaaacuuaucgcacgcaagaaagauugggacccuaagaaauauggcggauucgacagcccaacuguggcguacucuguacucgucguggccaagguggagaagggcaaauccaagaaacugaagucagucaaagaauugcuggggauuaccaucauggagaggaguagcuuugagaagaacccgauagauuucuuagaagcuaagggauacaaagagguuaagaaagaccucauuaucaagcugcccaaauauucgcuuuuugaacuggagaauggccguaagcggauguuggccuccgcuggugaacuccagaaggggaacgagcuggcacuaccuucuaaauacgugaauuuccuguaucuugccagccauuacgagaagcucaaaggaucaccagaagauaacgagcagaagcagcuguucguagaacaacacaaacauuauuuggacgagaucauugaacagauaagugaguuuuccaagagagugaucuuagcagaugccaaucuggacaaaguccucucugcuuacaacaagcacagggauaagcccauucgcgagcaggcggaaaacaucauucaccuguucacgcuuaccaaucugggcgccccugcagcuuuuaaauauuucgacacaacuaucgaucgaaagagauacaccagcacaaaagagguguuggacgccacucuaauacaucaauccaucaccggucuguacgaaacgcggauugaucucucacagcugggcggggacaagaggccagccgcuaccaaaaaggcaggacaggccaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3683 - RNA, 5216 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaaacuucaagauucugccaauagccaucgaccucggaguuaaaaauaccgguguguuuagcgcguucuaccagaagggcacaucccuugagaggcuggauaacaagaaugggaaaguauaugaauugucuaaggacucauacacuuuacugaugaacaaucggacggcucgccgacaucaacguagaggaauugauaggaaacagcuagugaagcggcucuuuaaacugaucuggaccgagcagcuuaaccuggaaugggacaaggauacacagcaagccauuaguuucuuguuuaaucgcagaggcuucagcuuuaucacugacgguuauuccccggaguaccucaacauaguccccgaacaggugaaggcaauccugauggauauuuucgacgauuauaauggggaggacgaucuggacucuuaccucaaauuagccaccgagcaggaaucgaagaucucagagauuuauaacaaacugaugcagaagauccuugaauuuaaauugaugaagcugugcacagauauaaaagacgacaagguuagcaccaagacucuaaaagagauuacaaguuacgaguucgaacuccuggcugauuaccuugcaaauuauuccgagucucugaagacccaaaaauuuagcuacacggacaagcagggaaacuugaaagaacucuccuauuaccaccaugauaaguauaauauccaggaguuccugaagaggcacgccacuauuaacgaccggaucuuagauacccugcucacagacgaucuugacaucuggaauuuuaacuucgaaaaauucgauuuugacaagaacgaggagaaacugcagaaucaagaagauaaggaccauauucaggcucacuugcaccauuucguguuugccgucaacaaaauaaagucagagauggcgaguggcggccgccaccgaagccaguacuuccaagaaaucacuaaugugcuagacgagaacaaucaucaggaaggguaucugaagaacuuuugugagaaucuccacaacaaaaaguacucuaaucuguccguuaaaaaccuuguaaaucugauuggaaacuugucaaaucucgagcugaagccuuuaagaaaauacuucaacgauaagauccacgcaaaggccgaccauugggaugaacagaaauuuaccgagacauauugccacuggauacugggugaauggagggugggcgucaaggaccaggauaaaaaggacggggcuaaauacagcuauaaggaucuauguaaugagcucaaacaaaaggugaccaaggccggacugguggacuuccuuuuggaacuggauccaugccggacgauucccccuuaccucgacaacaacaaucguaaaccacccaagugucagagucugauccuuaacccuaaauuucuggauaaucaguauccaaacuggcagcaauacuugcaggagcucaagaaacugcagucuauccagaauuauuuagacuccuucgagacugaucugaagguccuaaagagcucgaaagaccaaccguacuuuguugaauacaagucuuccaaccagcagauugcaucaggccagcgcgacuauaaagaucucgacgcuagaauccugcaauucauuuuugauagggugaaggccagugacgagcuuuugcugaaugaaauauacuuccaggcgaaaaagcucaagcagaaagccagcuccgagcuggagaaguuagaaucuagcaaaaagcuggaugagguaaucgcaaacucacaacuuagucagauuuugaaaucccagcauacaaaugguaucuucgaacaggggaccuuucuccaccuggugugcaaguauuacaagcaacggcagcgagcucgcgacagcagacuauauaucaugcccgaguacagguaugauaaaaagcugcauaaauacaacaauacuggacgguucgacgaugacaaccagcuccugacauacuguaaucacaagccucgccagaaaagauaucaacuuuugaacgaucuggccggcgucuuacaggugucuccaaauuuucucaaggacaaaauuggcucagaugacgaccuguucauaaguaaguggcuuguugaacacaucaggggguuuaagaaagcaugcgaggauagccugaagauucagaaagacaaccguggauugcucaaccauaagaucaauauugcccggaacaccaaagguaagugugagaaggaaaucuucaaucugauaugcaaaaucgagggcuccgaagauaagaaagggaacuacaagcacggacuagcauaugagcugggcgugcuccuguuuggugaacccaaugaggccucuaaaccugaguucgaccgaaagauuaagaaauuuaacucgaucuacagcuucgcucagauucaacagaucgcguuugcagaaagaaaggggaaugccaacacgugugcugucugcuccgccgauaaugcacauaggaugcagcaaauaaaaauuaccgagccaguggaagacaacaaggauaaaaucauucuuucagccaaggcucagcgcuugcccgccaucccgacacggauaguagacggcgcaguuaagaaaauggcgacuauccuggcuaagaauauuguggaugacaacuggcagaauaucaaacaggucuuaagugccaagcaccaacuccacauuccuaucauaaccgagucuaacgcauucgaauuugagcccgcccuggcugaugugaaaggaaagagccuuaaggacagaaggaaaaaggcccuggagcgcauuuccccagaaaauaucuucaaagacaagaacaaccgaaucaaagaguucgcaaagggcauuucagcuuauagcggggccaaucuaacagauggagacuuugauggugcgaaagaagaacucgaccauaucauuccucggucucacaagaaguacggcacucugaacgaugaggccaauuugauaugcgucacccguggggacaacaaaaauaagggaaacagaaucuucugucugagggauuuagcugacaauuauaaacucaagcaguuugaaacaaccgaugaccuggagauugagaaaaagaucgcagauacuauuugggacgccaacaagaaagauuucaaguuuggcaauuaccgcuccuucaucaaccuuacgccccaggagcagaaggcuuuucggcaugcccuguucuuggcagacgaaaauccaauaaaacaagcggugaucagagccauuaacaauaggaaccgaacauuuguuaaugguacccagcgcuacuucgcugaggugcucgccaacaauaucuaucugcgggcuaaaaaggagaaccuaaacacugacaagauuaguuuugauuacuucgggauccccaccauaggcaauggaagaggcauugcugaaaucaggcagcuguaugagaaaguagacagcgauauccaggccuacgcaaagggggacaaaccucaagccucuuauucccaccuuauugaugcuaugcucgcguucugcauagccgcagacgaacaucguaacgauggaucaaucggucuggagauugacaagaauuacaguuuguauccacuggauaaaaacacaggcgaagucuuuaccaaggacaucuucagccagauuaagaucacugauaaugaguuuucggacaaaaaguuagugcgcaaaaaggcuauagagggguucaacacacaccggcagaugacgagagauggaaucuacgccgaaaauuaccucccgauucugauccacaaagagcuuaacgaaguuaggaagggcuauaccuggaaaaauuccgaggaaauuaagaucuuuaaggguaaaaaguacgacauacagcaacugaacaauuugguguauugucucaaauucgucgacaagcccauuucuaucgauauccagauuagcacucuggaggagcuacgaaacauccugacaaccaauaacauagccgcuacagcagaauacuauuacauuaaucuuaaaacucagaagcuccaugaguauuacaucgaaaacuacaacaccgcccugggguauaagaaauacucaaaggagauggaguuuuugcggaguuuagcguaucgcuccgaaagagugaaaauuaagucuaucgacgauguaaaacaagugcuggacaaggauagcaauuucauaauuggcaagaucacgcucccuuuuaaaaaggaguggcagaggcuguaccgggaauggcagaacaccacaaucaaagacgauuaugaguuccuuaaguccuuuuucaauguuaaaucaauuacuaagcugcacaagaaaguccgaaaggacuuuagcuugccaaucaguaccaacgaaggaaaauuccuagugaagagaaaaacaugggauaauaacuucauuuaccagauacugaaugacucugauucccgcgcugacggcacuaagcccuuuaucccugccuucgacauuagcaaaaacgagaucguggaggcaaucauugauucguuuaccucaaagaauauauucuggcucccaaagaacaucgaacugcaaaaagucgacaauaagaacauuuuugccaucgauacgucuaaaugguucgagguugaaacacccagugaccuuagggauauugggaucgcuaccauacaguauaagaucgacaauaacucccguccgaaagugcgggugaaguuagauuacguaauugacgaugacagcaagaucaauuacuuuaugaaccauucucugcucaaaagcagauauccugauaaggucuuggagauucugaaacaguccacuaucauagaguucgaaucaaguggauuuaacaagacaauuaaagagaugcucggcaugaagcuggcagguaucuacaaugaaaccagcaacaauaagaggccagccgcgacuaaaaaggcugggcaggccaaaaagaaaaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3684 - RNA, 3488 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaaagaggaacuacauucugggacucgacauagguaucacaucaguuggcuaugggauuaucgauuacgagacacgggacgugauugaugccggaguacgccuuuucaaagaagcgaauguggagaacaaugaaggccgacguuccaagagaggugcuaggcggcugaagcgcagaaggcggcaucgcauccagcgagucaaaaaguuguuauuugacuauaaccugcuaacugaucacucugagcucucagggauaaauccauacgaagccagagugaaaggacugagucaaaaacuuagcgaggaggaguucuccgcagcccuguugcaucucgcuaaaaggcggggcguucacaacgugaaugaagucgaagaggacacgggcaacgagcugucuaccaaggaacagaucucgcguaauucaaaggcacuggaggaaaaauauguggccgagcuccaguuagaacgccugaagaaagauggggagguaagaggaagcauuaacagguuuaagacaagugacuacguuaaagaggcuaagcagcuuuugaaagugcaaaaggccuaucaucagcuggaucaguccuucaucgacacuuacauugaucuacucgaaacccggcgaacauacuaugaggguccgggcgaagggucucccuuuggauggaaggacaucaaagagugguacgaaaugcugaugggccacugcaccuauuucccugaggagcuucgcagcgucaaguacgcguauaaugcagaucuguacaacgccuugaaugaccucaacaaucuggugauaacuagagacgaaaacgagaaauuagaauauuacgagaaguuucagauuaucgaaaacguguucaaacaaaagaagaaaccaacacugaagcagauugcuaaagagauccucgucaaugaggaagauaucaaggguuacaggguuaccuccacggggaaacccgaguuuacuaaccuuaagguguaucacgacauuaaggauauaaccgcccggaaagaaaucauugagaaugcagagcuguuggaccagaucgcuaagauacuaacaauuuaccagucaagugaagauauccaagaggaacugacuaaccucaauagcgagcugacccaggaagagaucgagcagauuucuaaccuuaaaggauauacaggcacccauaaucuguccuugaaggccaucaaccucauucuggacgaauuauggcacacgaaugauaaccaaauagcgaucuucaaucgccugaaacuuguaccuaagaagguggaccucucacagcagaaagagauuccaacuacacuggucgaugacuuuauccuuagccccgugguuaagagaaguuucauccagucuauuaaagugauaaacgccaucauuaagaaauacggcuugccuaaugauaucauuaucgaacuggcaagggagaagaacuccaaagacgcucaaaagaugauaaaugaaaugcagaagcguaaccggcagaccaacgagcgaaucgaggaaauuaucagaacuacagggaaagagaaugccaaguaucucauugaaaagaucaagcugcaugacaugcaggagggaaaaugucuuuacagccuggaagcuauaccauuggaggaucuccugaacaauccguuuaacuaugaggucgaccacauuauccccaggucggugucuuucgauaauuccuucaacaauaagguauuaguuaagcaagaagagaacucaaagaaggguaaucgcaccccuuuucaguaccugaguagcuccgacucuaaaauuagcuacgaaacguucaagaaacacauccuaaaccucgccaagggcaaggggcggauaucaaaaaccaagaaagaguaucugcuugaggaaagagauaucaauagguuuagugugcagaaggacuucauuaaccgcaauuuggucgauacacgauacgcaacucggggacugaugaaccuccugcguuccuauuuuagagugaauaacuuagacgucaaagugaaaagcaucaacggcgguuucaccucuuuucugaggcgcaaguggaaauucaagaaagagcggaauaagggguacaaacaucacgccgaagaugcucuuauuaucgcgaacgcagacuuuauauucaaggaguggaaaaaguuggauaaggccaaaaagguuauggaaaaucagauguuugaggagaaacaagcugaaucaaugccagagauugaaacagagcaggaauauaaggagaucuucaucacuccccaucagauuaaacacaucaaggacuuuaaggauuacaaauauagucauagaguggacaagaaaccuaacagggagcucauuaaugacacccuguacagcacacgaaaggaugacaaaggcaacacccuaauaguaaauaaccugaauggacucuacgauaaggacaacgauaagcugaaaaagcuaaucaauaaauccccagaaaaguugcugauguaucaccacgacccccagacuuaccaaaaauuaaagcucauuauggagcaguauggcgaugaaaagaacccgcuguacaaauauuacgaggaaacggggaauuaucuuacaaaguacucuaaaaaggacaacggaccugucaucaaaaagauuaaguacuaugguaauaaacugaacgcccauuuggauaucaccgacgauuaccccaacucgcgcaauaaggugguuaaacucagccugaagccauaucgguucgacguguaccuagauaacggcgucuauaaauucgugacuguaaagaaucuggacgugaucaaaaaggagaacuacuaugagguuaauuccaagugcuacgaagaggccaaaaagcucaaaaagauaucaaaccaggcagaauuuauugcuaguuucuacaauaacgaccugaucaaaauuaauggggagcuuuauagagucaucggagugaacaaugauuugcugaacaggauagaggugaauaugauugacaucaccuaccgugaauauuuagagaacaugaaugauaagcgcccuccccggaucauuaagacaauagccucuaaaacccaaagcaucaagaaauacuccacugacauucucggcaaccuguaugaagucaagagcaaaaagcacccacagaucauuaagaaagguaagagacccgcagcgaccaaaaaggcugggcaggccaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3685 - RNA, 4556 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcacuguucaacaagugcauuauaaucagcauuaaucucgacuuuuccaacaaagagaaguguaugaccaagccauacucuaucggacuugauauugguacaaauucaguuggcugggccgugaucacugacaacuauaaaguaccgaguaagaaaaugaaggugcuggggaauacgagcaaaaaguacauaaagaaaaacuuguuaggaguccugcuauucgauuccggcaucaccgcggaagguaggcggcucaagcgcacagcucgacguagauauacuaggcggcgcaauaggauucuguaccuucaggagaucuuuucuaccgaaauggccacacuggacgaugcauucuuucaaagauuggacgauucguuccucgugcccgacgauaaacgggacucaaaguauccuauuuuugggaaccugguugaggaaaaaguguaccaugaugaguucccaaccaucuaucaucugcgcaaguaccucgccgacagcacuaaaaaggcugauuuacgacuggucuaccuugcauuggcccacaugauaaaguauagaggacacuuucugauugagggcgaguucaauaguaaaaacaaugacauccagaagaacuuucaggacuuccuagauacauacaaugcuauuuuugaguccgaccucucucuggaaaacagcaaacagcuugaggagaucgugaaggauaaaaucuccaagcuggaaaagaaagacaggauuuugaaacucuuccccggcgagaaaaauucagggauauucagugaauuucugaaguuaaucguaggaaaccaagccgauuuccggaaaugcuuuaaccuggacgagaaggcgagccuccauuucucuaaggaauccuaugaugaggaccuugagacccuguuggguuacauuggcgaugacuauucagauguuuuucuaaaagcaaagaaacuguacgacgccauccuccugagcggguuccuuacggugacugacaaugaaaccgaggcuccucugaguucugccaugauaaagcguuauaacgaacacaaagaggauuuggcacuccugaaggaauacauucgcaauaucuccuuaaagacauacaacgaggucuuuaaagacgauacuaagaauggauaugcuggcuacaucgacgguaaaaccaaccaggaggauuucuauguguaccugaagaaucuacucgccgaauuugagggggcggacuauuuccuggaaaagauugauagagaggacuuucuuaggaagcagcggacauucgauaacggaagcaucccauaccagauucacuugcaagaaaugcgagccauacuggacaaacaggcaaaguuuuaucccuuccucgcuaagaauaaagagcgcaucgagaagauucugaccuucagaaucccuuacuacgugggcccacuugccaggggcaacucggauuuugcuuggucuauccggaaacgcaaugaaaagauuacgccguggaacuucgaggacgucauagauaaagaauccucagccgaggcauuuaucaauagaaugacaaguuucgaccuguauuugcccgaggaaaagguucucccuaagcauagccuguuauacgagacuuuuaacguguauaaugaacugaccaaaguaagguucauugccgaguccaugcgugacuaccaguuucuagauucuaagcagaaaaaggacaucgugcggcucuauuucaaagauaagcgaaaggucacugacaaagauauuaucgaauaccugcacgcuauauauggguacgacggaaucgagcuuaaggguauugagaaacaauuuaacagcucauugaguacauaccaugaucugcucaacaucauuaaugacaaggaguuccuggaugacuccagcaacgaagcgaucauagaagagauuauccacaccuuaacgauuuuugaagauagagagaugaucaaacagaggcugucuaaguucgagaauauauuugacaagucagugcuuaaaaaguugagucgccggcacuauaccggcugggggaaacucagcgcaaagcugaucaacggaauuagagaugaaaaauccggcaauacaauccuagacuaccugauugacgaugguaucucuaacaggaauuucaugcagcucauacaugacgaugcccugucguucaagaaaaagauucaaaaggcucagaucaucggggacgaggauaaaggcaacauuaaggaaguugugaaaagccuuccaggaucccccgccaucaagaaaggcauuuugcagucaauaaagaucgucgacgagcuggugaagguaaugggagggcgcaaaccugaaaguauuguuguggagauggcacgagagaaucaguauacuaaccaagguaagucuaauagccagcagcgguuaaaacgucucgaaaagucccugaaagagcuuggcucaaagauccugaaggaaaacauuccagccaaauugagcaagaucgauaauaacgcucuccagaaugacagacuguaccuauauuaccugcaaaacgggaaagauauguauaccggagacgaucucgacauagacaggcugucuaacuacgauaucgaccacauuaucccccaggccuuucuuaaggauaauuccauugacaacaaagucuuggugaguagcgcaucuaaucgcggcaaguccgaugacuucccgucacuggaggucgugaagaaacggaagacauuuugguaccaguuacucaaaaguaagcugaucagccagagaaaauucgauaaccuuacuaaggcggagaggggugggcugcuaccugaagacaaggcuggcuuuauacaacgacagcucguugagacccgccagauuacaaaacauguggcccggcuguuggaugaaaaguucaauaacaaaaaggacgagaauaacagagcaguaaggaccgucaaaaucaucacucugaagucgacguuagugucccaguuucguaaagauuucgaacucuauaagguucgcgagauuaaugacuuucaccaugcccacgaugcuuaccugaacgccgugauagcaucugcccuucugaagaaauaucccaaguuggagccagaguucgucuacggagacuauccuaaauacaauagcuuucgggaaagaaagucagcuacagaaaaaguguauuucuacaguaacaucaugaauauuuucaagaaguccaucucucucgcggacggcaggguaauugagcgaccccugaucgaagugaacgaggagaccggggaaagcguuuggaauaaagaguccgaucuagccacuguccggcgcgugcugucauacccacaagugaacgucguuaagaaaguggaagaacagaaccacggacuugacagagguaagcccaaaggccucuuuaaugcuaaccugagcaguaagccuaagccaaauucuaacgaaaauuuggugggggcaaaagaguaucuggauccgaagaaauacggaggcuaugccgguauauccaacagcuucgcuguauuagucaaggggaccaucgagaaaggcgccaagaagaaaauuacaaaugugcucgaauuucagggaaucucgauucuggacaggaucaacuaccggaaggauaaacuuaauuuccuguuggagaagggcuauaaagacauagaacucauuaucgagcugcccaaguacucacuauuugagcugucugaugggagucgaagaaugcuugcauccauccucagcaccaacaauaaacgcggagaaauucauaagggcaaccaaaucuuccugucucagaaguuuguuaaauuguuauaucacgcgaagaggauaagcaauacuauuaacgagaaucaucguaaauacguggaaaaccacaagaaagaguucgaggaacuguuuuacuauauccucgaguucaaugaaaacuacgucggugccaagaagaacgggaaacugcuuaauuccgcuuuucagucauggcagaaccacaguauugacgagcuguguagcucuuucaucggaccuacaggcuccgaacggaaggguuuguuugagcuaacgucaagaggcagugccgcagauuucgaguuccugggggugaaaauaccaagguaucgcgacuacacccccagcucccuccugaaggaugcuacucuuauucaucaaucuguuacaggauuauaugaaacccgaaucgaccuggccaaacucggcgaggggaagagaccugcagccacaaagaaagcuggacaggcgaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3686 - RNA, 3632 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaugguacgccagccugauguccgcgcaucaccucaggguuggaauugacguggguacccauucuguaggccuugcuacacugcggguggaugaccacgggacuccaauagaguuguuaucagcccugagucauauccacgauagcggagucggcaaggaagguaaaaaggaccacgauacgcgcaagaaacuauccgggauugcacgacgugccagaaggcuccugcaucaccggcgcacccagcuucaacagcuggacgagguguugagagaucucggauucccgauccccacaccuggcgaauuucuggaccugaacgagcagacugauccauauaggguuuggcgggugcgcgcucgacucgucgaagagaaguuacccgaggaacugagaggcccugcaauuucuauggccgugaggcauaucgcucggcaccguggguggcgcaauccauacucgaaaguagagucacuuuugagccccgccgaagagaguccuuucaugaaggcgcugagagagaggauacuagcaaccacaggagaaguucucgacgaugguaucaccccaggccaggccauggcucaaguggcccugacucacaacauuuccaugcgggggccggagggaauccuuggcaaacugcaucagucugacaaugcaaacgaaauucgaaagaucugcgcucgccagggugucagccccgauguguguaagcaguugcucagagccguguuuaaagcggacuccccuagggggucagccgucagucggguugcaccagacccccugccuggacaaggcagcuuccgcagagcuccaaagugcgaucccgaguuucagagguuccguauaauuucuaucguggccaauuuacggauuuccgaaacaaaaggcgagaaccgaccgcugaccgcugacgagagaaggcacguagugacguuucucacugaagauucacaggccgaccuuaccugggucgauguggcagagaagcuggggguucaucgccgggacuugagaggaacagccgugcacacugaugacggugaaaggagcgcugcgcgcccucccaucgaugcaaccgaccgaaucaugcggcagacaaaaauuaguucucuaaagaccuggugggaggaagccgauuccgagcaacguggcgcuaugauaagauaucuguacgaggacccaacggacagcgaaugugccgagaucauugcagaacucccugaggaagaucaggccaaacuggacucgcuucaucugcccgcugggagggccgcauauucucgcgaguccuugacugcgcucucagaucacaugcuggcuacaaccgacgauuuacacgaggcccggaagagacuguucggagucgacgauaguugggcaccacccgccgaagcuaucaaugccccugugggcaacccaagcguagacaggacucuaaagauaguuggucgauaccucuccgcaguggagucuaugugggggacaccggaagucauucauguggagcacguccgcgauggcuuuaccagcgagcggauggcugacgaaagagauaaagccaauaggcgucgcuauaacgacaaucaggaggcgaugaagaaaauccaacgggauuacggaaaggaaggcuacaucucaagaggggacauugugaggcuggacgcccuugaguugcagggaugcgcuugucuguauugcgguacgaccaucggcuaccauacaugucagcucgaucacauuguuccccaggcagggccuggaaguaacaaucgacggggcaaccugguggccguaugcgaacgcuguaauagauccaaaagcaacacuccauucgcugucugggcccaaaagugcgguauaccccacguggggguuaaggaggcaaucggcagggugcggggauggcgaaaacagaccccuaacacaucuucagaggaccuuacuagacugaagaaagaagucauugcgcgcuugaggcguacccaggaggauccagaaaucgacgagcggaguauggaaagcguggccuggauggcuaaugagcuccaucacagaaucgccgcagcuuaucccgagacaaccguaaugguguacaggggcuccauuacugccgcagcccgcaaggcugcggggauagauucucgaaucaaccugauuggagaaaaagguagaaaggaccggaucgauaggcgccaucacgccguugacgcaucggucguggcuuuaauggaggccagcguggccaagacgcuggcugaacguuccucacuaagaggcgagcagcggcucacagggaaagaacaaaccuggaagcaguauacuggaaguaccgucggcgcaagggagcauuuugagauguggcgcggucacaugcugcaccuuacagaauuguucaaugagcgacuggccgaagauaaaguuuacgugacccagaacauuagacuccggcugucugacgggaaugcgcauacugugaacccgagcaaguuaguaucccacaggcugggcgauggacuuacaguccagcaaaucgaccgcgcuuguacgccugccuuguggugcgcacucaccagagagaaagauuuugacgagaagaauggccugccagccagggaagaccgggcuauacgugugcaugggcacgagaucaagucaagcgauuauauucagguuuucucuaaacgcaagaaaacugacuccgaucgagacgaaacacccuucggagcaaucgccgugagaggcgguuuugucgagauugggccuaguauccaucacgcgaggauauaccggguggaaggaaagaaacccguuuacgcuaugcuacgcguguucacccacgaucugcucagccagagacauggcgaccuguuuucugccguaauuccaccucaguccaucucaaugaggugcgcagagcccaaacuucggaaagccauuacaacugguaacgcuaccuauuugggcugggucguggugggggaugagcuggaaaucaaugucgacaguuucacgaaguacgccauaggacgauuuuuagaggauuucccaaacaccacaagauggcgcaucuguggcuaugacacuaauagcaagcucacccugaaaccgauuguucuugcagcugaagggcuggagaacccuucguccgccgugaaugaaaucguagaguugaagggauggaggguggcgauuaacguccucacaaaagugcaccccacuguugugcggcgugaugcccugggcagaccaagguacucuagccgcucaaaucuacccaccaguuggacgaucgagaagcggccugcagcuacaaagaaggccggucaagcuaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3687 - RNA, 4493 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaaccaagccauacagcauuggacuggacauagguacaaacuccguuggcugggccgugacuacggauaauuauaaaguaccgucuaagaagaugaaagugcucgggaacaccucaaagaaauacaucaagaaaaaucuucugggagucuuguuauucgacaguggcauuacagcggaggguaggcggcugaagcgcacugcucgacguagauauaccaggcggcgcaacagaauccuauaccuccaggaaauuuuuagcacagagauggccacccuggaugacgcauucuuucaaaggcuugaugacuccuuccuggugcccgaugacaagcgggauucuaaauauccuaucuuugggaauuugguugaagagaaggccuaccaugacgaguucccaacuauauaucaccuccgcaaauaccuggcugauucgacaaagaaagcagaccugcgacucguguacuuagcccuggcucauaugaucaaguauagaggacacuuucuuauugagggcgaguucaacucaaagaauaacgauauccagaagaauuuucaggacuucuuggacaccuacaacgccauuuuugaaagcgaucugagucuagaaaauuccaagcagcucgaagagaucgucaaagacaagauaucuaaacuggagaagaaagauaggauucuuaagcuguuccccggcgaaaagaacagcgggaucuuuuccgaguucuugaaacucauugugggaaaucaagcggacuuccggaagugcuuuaaccuggaugaaaaagcaucauuacauuucaguaaggagagcuaugacgaagaucuggagacgcuccuugguuacaucggcgacgauuauucugacguauuucugaaagccaagaaguuguacgaugcuauccuacuguccggguuccucacuguuaccgacaaugagacagaagccccucugucaagcgcaaugauuaaacguuauaacgagcacaaggaagaccuugcucuguugaaagaguacauacgcaacaucagucucaagacuuacaaugaaguguuuaaagaugacaccaagaacggauaugccggcuacauugaugguaagacaaaucaggaggacuucuaugucuaccugaaaaaguuacuggcggaguuugaaggggccgauuauuuccuagagaaaaucgacagagaagauuuucucaggaagcagcggaccuucgacaacggaucuauaccauaccagauucaccuucaagagaugcgagcaauccuugauaaacaggcuaaguuuuaucccuucuuggccaaaaauaaggaacgcaucgagaagauucugacguuuagaaucccuuacuacgugggcccacucgcuaggggcaacuccgacuucgccuggagcauucggaaacgcaaugagaagauaacuccguggaacuucgaagaugugaucgacaaagagucgucugcagaagccuuuauuaauagaaugacauccuucgaucuguaucuucccgaggagaagguccugccuaaacauucauugcucuacgaaaccuuuaacguuuauaaugagcugacuaaggugagguucaucgcugaaaguaugcgugacuaccaguuuuuagacagcaagcagaaaaaggauaucguacggcuguauuucaaagacaagcgaaaagugacagauaaggacauuauagaguaccuacacgcgaucuauggguacgauggaauugaacucaaggguaucgagaaacaauuuaacuccucucugagcaccuaccaugaccuuuugaauauuaucaacgauaaggaguuccuggacgauucaaguaaugaagcaauaaucgaggaaauuauccacacgcucaccauuuuugaggacagagaaaugaucaaacagaggcuguccaaguucgagaacauauuugauaaaagcgucuuaaagaagcugucucgccggcacuauacaggcugggggaaacuuucagccaaguugauuaacggaaucagagacgagaaaaguggcaauacuauucucgauuaccugaucgacgacgguauaagcaacaggaauuucaugcagcuaauccaugaugacgcucuguccuuuaagaaaaagauucaaaaagcccagaucauuggggaugaagacaagggcaacaucaaggaggugguuaaaucucucccaggaucgcccgcaauaaagaaaggcauucugcagagcaucaagaucguggaugaacuugucaaagugaugggagggcgcaagccugaguccauuguaguugaaauggcccgagagaaucaguauaccaaccaagguaagucaaauagucagcagcgguugaaacgucuggagaagucuuuaaaagaacucggcagcaagauccugaaagagaacauuccagcuaagcuguccaagauagacaauaacgcccugcagaaugauagauuguaccucuauuaccugcaaaacgggaaagacauguauacaggagaugaccuagauaucgacaggcugucaaauuacgacauugaucacaucauuccccaggcauuccucaaggacaacagcaucgauaauaaagugcuggucucuuccgcgaguaaccgcggcaagagcgacgaugugccgucucuugaagucgugaaaaagcggaagacuuucugguaccaguugcugaaauccaaguuaauaucacagagaaaauuugacaaccucaccaaggcugagaggggugggcugaguccugaggauaaagccggcuucauccaacgacagcuuguugaaacacgccagauuaccaagcauguggcacggcugcuagacgagaaguuuaauaacaaaaaggaugaaaauaacagagccguaaggacugucaaaaucauuacgcucaagagcacacuggugucgcaguuccguaaagacuuugaguuguauaagguucgcgaaaucaaugauuuccaccaugcucacgacgccuaccugaacgcaguggucgcuuccgccuuacucaaaaaguaucccaagcuggagccagaguuuguguacggagauuauccuaaauacaauucuuuccgggaaagaaagagcgcgaccgagaaaguauauuuuuacucaaacauaaugaauauuuucaagaaaaguaucucccuugccgacggcagggugaucgaacgaccccugauugagguuaacgaagagacuggggagucugucuggaauaaggaaagcgacuuggcuaccgugcggcgcgugcucuccuacccacaagucaacguugugaagaaaguggaggaacagaaucacggacuggauagagguaagcccaaaggccuauuuaacgcaaaucugucaagcaagccuaaaccaaacaguaacgagaaucuuguaggggccaaggaauaucucgacccgaagaaauacggaggcuaugcugguauaucuaacuccuucacaguccuggugaaggggaccaucgagaaaggcgccaagaaaaagauuacuaauguuuuggaguuccagggaaucagcauucuggauaggaucaacuaccggaaggacaaauuaaauuuucuccuggaaaagggcuauaaagauauagagcuuaucauugaacugcccaaguacucguuguucgagcucucagacgggucucgaagaaugcuggcaaguauccuauccacaaacaauaaacgcggagagauucauaagggcaaccaaaucuuucugagccagaaauucgugaaacuucucuaucacgcgaagaggauaucuaauacgauuaacgaaaaucaucguaaauacgucgagaaccacaagaaagaauuugaggaacuguucuacuauaucuuggaguuuaaugagaacuacgugggugccaagaaaaaugggaaguuacugaacagcgcuuuccaguccuggcagaaucacucaaucgaugaacucuguaguagcuuuauuggaccuaccggcucugagcggaagggucuguucgaacuuacuuccagaggcucagccgcagacuuugaguuccuggggguuaaaaucccaagguaucgcgauuacacacccaguagcuugcuaaaggacgcuacccugauacaucaauccgugacaggacucuaugaaacucgaauugaucuggccaaacuuggcgaggggaagagaccugcagccaccaaaaaggcuggacaggcgaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3688 - RNA, 3575 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcagccgcguucaagccaaacagcauuaauuacauacugggacucgacaucgguauugcuuccguuggcugggccaugguggagaucgaugaagaggaaaacccgauuaggcuuaucgaccuggggguacggguguuugagcgcgcagaaguccccaaaaccggagauucuuuggccauggcucgacguuuagcaagaucagugaggcggcugacacgcagaagggcccaucggcuacuccgcacucgaagacugcuuaagagggagggcguucugcaggcugccaauuucgacgagaacgguuugauaaagagucucccuaauacgccauggcaacugcgggcggcagcccuggaucguaaacucacccccuuagaauggagcgcugugcugcuucacuugaucaagcaucgcggguaucugucccagaggaaaaacgagggagaaacagccgacaaggagcuaggcgcacuccugaaaggcgucgcugggaaugcccacgcgcuucagacuggagauuuuaggaccccugccgagcuggcauugaacaaguucgaaaaggagucuggucauauucggaaucagcgaucggacuacucacacacauuuagccgcaaagaucuccaagcugaacugaucuuacuguucgagaagcagaaagaauuuggcaacccacacgugagugggggacucaaggagggcauugagacccuucugaugacucagagacccgccuuguccggugacgcuguacagaaaaugcuagggcauugcacauucgaaccugccgagccaaaggcagccaaaaauaccuauacggcugaaagguuuaucuggcugacuaagcucaacaaucugcggauacuugagcaaggaucugaacgcccgcugaccgauacagagagagcgacuuugauggacgagcccuacagaaagagcaaacucaccuaugcacaggcccguaagcuguuaggccuggaagauacagcuuucuuuaaaggccuacgguacgggaaggacaacgccgaggcauccacccucauggaaaugaaagccuaucacgcuauuucacgagcccuggagaaggaaggacuuaaggacaaaaagaguccuuugaaucugagcccagagcuccaggaugagaucgguacggcauucucucuguuuaaaacugacgaagauauuacaggcagacuuaaggacaggauccagcccgagauccuggaagcguugcucaaacauauuuccuucgauaaguucguucaaauaucacugaaggcuuuacgccggaucgugccucugauggagcaggggaaaagauacgacgaggccugugcagaaauuuacggagaucacuauggcaagaaaaacaccgaggaaaagaucuaccuaccacccauaccggccgacgagauuaggaacccugucgugcuccgcgcucugagccaggcccgaaaagugaucaauggugucguucggcguuaugggagucccgcaagaauccacauugaaacugcuagggaggugggcaagucuuuuaaggaucgcaaagagaucgaaaagcggcaagaggaaaacagaaaagacagggagaaggccgcggccaaauuccgagaauacuuuccaaauuucguaggagagccuaaguccaaagauauucuuaaguugcgccuguaugagcagcagcauggcaagugccucuacagcgggaaagaaauaaaccugggacgguuaaaugagaaggguuauguggaaaucgaccacgcucugcccuuuucgagaacaugggacgauucuuucaacaauaaaguccuuguguugggcuccgagaaccagaauaaggggaaccaaaccccauacgaauacuuuaauggaaaagacaacucaagggaguggcaggaguucaaggcacguguugaaacgagucgcuuuccccggagcaagaaacagaggauucuccugcagaaguucgaugaggacggcuuuaaagaaagaaaucuaaacgauacccgauaugugaaucgguuccugugucaauuugucgccgaccgcaugagacucacagguaaggggaaaaagaggguguucgcuuccaacggccagaucacuaaccugcuucggggauucuggggcuugcgaaagguaagagccgagaaugaucgccaucacgcacuggacgcgguuguggucgccugcucuaccguggcuaugcagcagaaaaucacaagguuuguccguuacaaggagaugaacgccuucgaugggaaaacuauugacaaggaaaccggagagguguuacaucagaaaacacacuuuccucagccaugggaguucuuugcacaggaaguuaugauacggguguucgguaagccggauggcaagcccgaauuugaggaggcugacacccucgaaaaacugagaacucuucuggccgagaaguugagcucaaggccugaagcaguacacgaguaugucacgccacucuucgugagucgcgcccccaaucgaaaaauguccgggcagggacauauggaaacaguuaagagcgcuaaaagacuggaugagggcgugucuguccuacgggugccucugacccaacucaagcugaaagaccuugagaagaugguaaacagggaacgcgagccaaaguuguacgaagcgcugaaagcccguuuagaggcacacaaggacgaucccgcuaaagccuuugccgaaccguucuauaaguacgacaaagcugguaauagaacucaacaggugaaggcaguucgggucgagcaagugcagaagaccggggugugggucaggaaccauaauggcaucgccgauaacgcgacaaugguucgcguggacguguuugagaaaggagauaaguauuaccucguaccuauuuacucauggcaggucgcuaaaggcauccugccagaccgagccgugguucaggggaaggaugaagaggacuggcaacuuauugaugacaguuucaauuuuaaauucagccugcaccccaacgaucuaguggaagucaucaccaagaaggcaagaauguucggauauuuugccuccugucaccggggcacugguaauauaaacaucaggauucaugaccucgaucacaaaaucgggaagaauggcauucuggagggaaucggugugaaaacagcuuugucuuuccagaaguaccagauagacgagcugggcaaagaaauucgcccuugcagauuaaagaagaggcccccaguucggaaacguccugcagccacgaagaaagcggggcaggcuaagaaaaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3689 - RNA, 4331 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaaagaaaccauacaccauuggacuggacauagguacaaacagcguuggcugggccgugcucacugaucaguaugaccuuguaaagaggaagaugaaaaucgcgggggauuccgagaagaaacaaauuaagaaaaauuucuggggagugcggcuguuugacgaaggccagacggcugccgaucgccgaauggcacguaccgccagaaggcggaucgagcgcagaaggaaccggauuucuuacuugcaggguaucuucgcugaagagaugucaaagacagacgcaaacuuuuucugccgcuuaagugauagcuuuuaugucgacaaugaaaagcgaaauuccagacauccguucuuugccacuauagaggaggaaguggaguaccacaaaaacuaucccaccaucuaccaucugagggaggagcuaguuaauucuucggaaaaggcugaucuccggcugguguaucuugcccuggcgcacauuaucaaauaccgugggaacuucuugauugaaggagcacucgacacacagaauaccucagucgauggcaucuacaagcaauuuauacagacuuauaaccagguguucgccagcggcauugaggacgggagucugaaaaagcuggaagauaauaaagacguagcuaagauccucguugagaaggugacacgcaaagaaaaguuagagaggauucugaaacuuuacccuggagagaaguccgccgguauguuugcacaguucaucucuuugaucgucggcagcaaagggaacuuucaaaagccauucgaccugauugaaaaguccgauauagagugugcuaaagacucauaugaagaggaucuagaaagucuccuggcccuuaucggagacgaguacgcggagcuguucguggccgcaaagaaugcuuauagcgccguggucuugucuuccauuaucaccguugcugaaacggagacuaacgccaaacucucagcaagcaugauagaaagguuugauacccaugaggaagaccugggcgaguuaaaggccuucauuaaacugcaccuccccaagcacuacgaggaaaucuuuaguaauacagagaagcaugguuaugcuggguacaucgauggaaaaacuaagcaggcggacuucuacaaauauaugaagaugacccuugaaaacauugagggcgcagauuacuuuaucgccaaaauugagaaggaaaacuuccugcggaagcagcgaacauuugacaauggcgcuauaccucaccaguugcaucuagaggaacuggaggccauccuccaccaacaggcaaaauauuacccauuccugaaggaaaacuaugauaaaauuaagucucuugugaccuuucgcauccccuacuucguagggccucuggccaauggacaguccgaguuugcuugguugacgagaaaagccgacggugagaucaggccauggaacauugaagagaagguggacuucggcaaaagcgcagucgauuuuauagaaaagaugacuaauaaggacacauaucucccgaaagagaacgugcugcccaagcacucguuaugcuaccaaaaauaccugguuuauaaugaacuaaccaaggugcgguacaucaacgaucaggggaaaacuucuuauuucuccggacaggagaaggagcagauuuucaaugaccucuuuaagcaaaaacgcaaggucaaaaagaaagaucuggaacuuuucuugagaaacaugucacauguggagaguccuacaaucgaaggccuggaggacagcuuuaauuccucuuacagcaccuaucacgaucuccugaagguagguauuaagcaggaaauccuugacaacccaguuaauacggagaugcuggagaacauagugaaaaucuugaccgucuucgaagauaagaggaugauuaaagagcagcuccagcaauuuucagacgugcuggauggggucguguuaaagaaacuggaacgucggcauuacacaggcuggggacgacuaagugcgaagcuccugaugggcaucagagacaagcagucccaccuuacuauuuuggauuaucugaugaaugacgacgggcucaacaggaaccugaugcaguuaaucaaugauagcaaccugucuuucaaaucaauaauugagaaggagcagguuaccacagcugacaaagauauccaaaguauuguggccgaccuugcaggaagccccgccaucaagaaagguauauugcagucccucaagaucguagaugaacuggucucugugaugggcuacccuccacagacuauuguuguggagauggcucgcgaaaaucagaccacagggaaaggaaagaacaauucgcggcccagauacaagagccuagagaaagccaucaaggaauuuggcucccaaauucugaaagagcauccgaccgacaaccaggagcucaggaauaaccgccuguaucuuuacuauuugcagaaugguaaggauauguacacugggcaagaccuggauauccacaacuuaucaaauuaugacauagaucacauugucccucagaguuucaucacggacaacucuaucgauaaucucgugcugacaagcuccgcaggcaaccgagaaaaaggagacgacguacccccacuugagauugugcggaagcguaaggucuuuugggaaaaacuguaccagggcaauuugaugucaaagagaaaauucgauuaucucaccaaggcugagagagggggacugacugaagccgacaaagcgcgcuuuauccaucggcagcuaguugagaccagacaaauuacaaagaacguggccaacauacugcaccagagguucaauuacgagaaggaugaccaugguaacaccaugaaacaggugcgaaucgucacucucaagagcgcucugguuucucaguuucgcaaacaauuccagcuuuacaaggugcgggaugugaaugacuaucaccacgcacaugaugccuacuugaacggcguagucgcuaauacacuguuaaaaguguauccucagcucgaacccgaguucguuuacggggacuaucaccaguuugauugguucaaggccaacaaggcaacggcgaaaaagcaauuuuacaccaauauuaugcuguucuuugcccagaaagacagaaucauugaugaaaacggagagauccuuugggacaagaaauaucuggacacugugaagaaggucauguccuacaggcagaugaauauagugaaaaagacagaaauccaaaaaggcgaguucaguaaggcuaccauuaaaccaaaggguaacagcucuaaacuaaucccccguaagacaaauugggauccuaugaaguacgggggccucgacuccccaaacauggccuaugcaguugugauugaguacgcuaaaggaaagaauaaacugguauuugaaaagaaaaucauacgcgucacuauuauggagcggaaggccuucgaaaaggaugagaaagcauuuuuggaggaacagggcuauagacagccgaaggugcuggccaaauuacccaaguacacccucuaugagugugaagaggggaggcgacggaugcuggcuucagcgaacgaagcccagaaaggaaaucaacaggugcuuccuaaccaucuggucacguugcuccaccaugcagcuaacugcgagguuagugacggcaagagccuggauuacaucgagucgaaucgcgaaauguucgccgagcuacuggcccacguguccgaauuugcuaagagauauacccuugcagaggccaaccucaauaaaaucaaccagcuguucgaacagaauaaggagggugacauuaaagcgauagcucaaucuuucguagauuugauggccuuuaacgcaaugggggccccagcuagcuucaaguuuuucgagacaacuaucgaaaggaaacgguacaauaaccugaaggaguuacucaauucaaccauuaucuaccagaguauuacaggacuguaugaaucccgaaagagacuugacgauaaacgccccgcagccacuaagaaagcgggccaggcuaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3690 - RNA, 4364 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaaagaaaccauacagcauuggacuggacauagguaccaacuccguuggcugggccgugguaacagaugacuauaaggugccggcgaagaaaaugaagguccucgggaauacugauaaaucucauaucgagaagaaccuucugggagcuuuguuauucgacucaggcaauacggccgaagauaggcggcugaaacgcaccgcacgacguagauacacaaggcggcgcaaccggauucuauaucuccaggagaucuuuagugaagagauggguaagguggacgauagcuucuuucacaggcuggaagacuccuuccuuguuacugaggauaagagaggggagcgccaucccauuuuuggaaaucuggaagaggaagugaaauaccacgagaacuucccuaccaucuaucauuugcgacaauaccucgccgacaauccagagaaggucgaucugagacugguguaucucgcuuuagcacacauaaucaaauuuaggggccacuuccugauugaaggcaaguuugacacacggaacaaugauguacagcgucuuuuccaggaguuuuuggccguuuacgacaacaccuucgaaaauucuucgcugcaggagcaaaacgugcaggucgaagagauccuaacugacaaaauuucaaagagcgcuaaaaaggaucgcgugcucaagcuguuucccaaugagaaaaguaacgggagauucgccgaguuccuuaagcugaucgugggaaaucaggcggacuuuaaaaagcauuucgaguuggaagagaaagcaccucuccaguuuuccaaggauacauacgaagaggagcuggaagucuuacuggcccaaauaggugacaacuaugcugaacucuuccuuucugccaagaaacuguacgauagcauuuugcuauccggcauccugaccguuacggacguggggacuaaggcaccacucucagcuaguaugauucagagguauaacgaacaccagauggaucuggcccagcuuaaacaauuuauccggcagaagcugagcgacaaauacaaugagguauucucugauguguccaaggacggauaugcgggcuacaucgaugguaagaccaaccaggaagccuuuuauaaauacuugaaggggcuccugaauaaaauugagggaucaggcuacuucuuagacaagauagagcgagaagacuuucugcgcaaacaaagaacauucgauaacggcagcaucccccaucagauucaccuacaggagaugagggcaaucauacggcgccaggcugaauuuuauccuuuccucgccgacaaucaagauagaauugagaagcugcuuacuuuuaggaucccauacuaugucgggccguuggcucguggaaagagugacuucgccuggcugucucggaaauccgcagauaagaucacccccuggaacuucgacgagauuguggauaaagaaagcucggccgaggcuuuuaucaaucgaaugacaaacuacgaccucuaucugccuaaucagaagguucuuccaaaacacucucuguuguacgaaaaguucaccguguauaacgagcucacgaaagucaaguacaagacugaacaggguaaaacagcguuuuucgaugcaaauaugaagcaggagauuuuugacggcguguucaaaguauacagaaagguuaccaaagauaagcugauggacuuuuuagagaaggaguucgaugaauuuaggauaguggaccugacugggcuagacaaagaaaacaaggucuucaaugccuccuauggaacauaccaugaucucugcaaaauccuggacaaggauuuucuugacaacaguaaaaaugagaagauuuuggaagauaucgugcugacccucacgcuguucgaggaccgcgagaugauccggaagagauuagaaaacuauucagaucugcuuaccaaagagcaagucaagaaauuggaaaggcgccacuacacaggcuggggucgacucagcgcugagcugauucaugggauacggaacaaggaaucccguaaaacuauccuagacuaucugauugaugacggcaauucuaacagaaauuuuaugcagcucaucaacgaugacgcccugagcuucaaggaggagauugcaaaggcccaggugaucggagaaaccgauaaucuuaaccagguugugucagacauagcuggcagucccgccaucaaaaaggggauuuugcaaucccugaaaaucguagacgaguuagucaagauuaugggacaccagccugaaaauaucgugguugagauggcaagggagaaccaguucacaaaucagggucgccggaacagccaacagagacucaaaggccugacugauucuauaaaggaauuugggucacagauucuuaaagagcauccaguggaaaauagucaacugcagaacgacagguuguuccucuacuaucugcagaauggacgagauauguacaccggcgaggaacuagacaucgauuaccugagccaguaugacauugaucacaucauaccccaagcguuuaucaaggacaacuccauugauaaucgcguccucacaucuucgaaggagaaccgggguaaaagcgacgaugugccguccaaggacguagugagaaaaaugaagucauacuggaguaaacugcuuucugcuaaguugaucacccagaggaaguucgacaaccugacuaaagccgagcgugggggcuuaacggaugacgauaaggcaggauuuauuaaacgccagcucguugaaacacggcagaucaccaagcacgucgccagaauacuggacgagagguucaauacugaaaccgaugagaacaauaaaaagauucgacaagugaagaucgugacacuuaaaagcaaccuggucuccaauuuucggaaggaguucgaacuauauaaaguucgcgagaucaacgacuaccaucacgcucaugaugccuaucucaaugcagugauuggcaaggcucuguuggggguguacccucagcuggaacccgaguuuguauauggagacuacccacacuuccacggucauaaagaaaacaaggccaccgcgaagaaauuuuucuacucaaauaucaugaacuucuuuaagaaagaugacgucagaacugauaagaauggcgagauuauauggaaaaaggacgaacacaucagcaacauuaagaaaguguuaucuuauccucagguuaauaucgugaagaaagucgaggagcagacagggggauucuccaaggaaaguauucuccccaaaggcaacagcgauaagcugaucccaaggaaaacgaagaaguuuuacugggacaccaaaaaguaugguggguucgacucucccauaguggccuacuccauccuuguuauugcugauaucgagaaaggcaagaguaaaaagcugaagacugugaaagcauugguaggagucacaauuauggaaaagaugaccuuugagcgggacccuguggccuuccucgagcgaaaaggcuauagaaaugugcaagaagagaacaucauaaagcugccaaaauacucacuauuuaagcuggaaaacgggcgcaagaggcuucucgcuagcgcccgugagcugcagaaaggaaaugaaauugucuugccgaaccaucugggcacauuacucuaucacgcaaagaauauccauaaaguugaugagcccaagcaccuggacuacguggauaaacacaaggacgaguucaaggaacuucuggauguagugucgaacuuuuccaaaaaguacacuuuggcggaggguaaucucgagaaaaucaaggaacuguaugcccagaacaauggggaagaccuaaaagagcuggcuucuagcuucauuaaccuucucaccuuuacggccauaggagcuccugcaaccuucaaguuuuucgauaaaaauaucgaccggaagagauacacaucaacuaccgagauucugaacgccacauugauccaucaaaguauuacuggcuuauaugaaaccaggaucgaucugaauaagcucgguggcgacaaacgcccagcagccacgaagaaagcugggcaggcgaagaaaaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3691 - RNA, 3497 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcacagacaacaaaccugagcuacauucucggacuugaccuggguauagccuccguuggcugggcggugguagagaucaaugaaaacgaggauccaauuggguugaucgacgugggagucaggauuuucgaacgggcugaggugccgaagacuggcgaaucuuuagcccugucacgccgacuagcacguaguacgagaaggcucauccggcgcagagcccauaggcugcuucuggcuaaacgguuuuugaagcgcgaggguauacucagcaccaucgaucuggagaaggggcugcccaaucaagcaugggaacuccgaguugccggauuagagagaaggcuguccgcuauugaauggggcgccgugcuuuugcaccugaucaaacaucggggcuaucuaucuaagcguaaaaacgagucgcagacaaauaacaaggagcucggggcgcugcuuucaggagucgcacagaaucaccagcuguugcaaagcgacgauuaccgcacuccugccgaacucgcucugaaaaaguucgccaaggaggaaggucauauuagaaaccagaggggcgcauauacccacacauuuaaucgguuagaccugcucgcugagcuuaaccuguuguucgcccagcagcaccaauuugggaauccacauugcaaagaacacauccagcaguacaugaccgagcuacugauguggcagaagcccgcgcucaguggagaggccauacugaaaaugcuuggcaaguguacucaugagaaaaacgaguucaaggcagcuaaacacacauauuccgccgaacgauuuguguggcugaccaaguugaauaaccuccgcauucuggaggauggugcugaaagagccuuaaaugaggaggaaaggcaacugcuaaucaaccacccuuacgagaagucuaaacucacguaugcacagguacggaagcugcuuggguugagcgaacaggccauuuucaaacaucugcgcuacuccaaggagaacgcugaaucagcgacuuuuauggagcucaaagcauggcacgccaucagaaaggcucuggagaaucaaggacuuaaggacaccuggcaggaucuggccaaaaagccagacuugcucgaugaaaucggcacagcauucagucuguacaaaacugacgaggauauucagcaguauuuaaccaacaagguucccaauagcgugauaaacgcccugcuagucucucucaauuuugacaaauucaucgaacugucccuuaagucauugaggaagauucugccucucauggagcaaggcaaacguuacgaccaggcuugccgggagaucuaugggcaucacuacggagaagccaaccagaagacaagccagcuguuaccagcaauaccggcgcaagagauucgaaaucccguggugcugagaacccuuagucaggcuaggaaagucaucaacgccaucauucgccaguaugguucuccugcacggguucauaucgaaacgggcagagaguuggggaaguccuuuaaagaaaggcgcgagauucagaagcaacaggaggauaaucgaacuaagcgggaaagcgccgugcagaaauucaaggaacucuucucggacuuuucuuccgaaccaaaaucaaaggauauacugaaauuccgucuauacgagcagcaacacggaaagugucuguauaguggcaaagaaaucaacauucacagacucaaugagaaggguuacguagagaucgaccaugcucugcccuuuagcaggacaugggaugacuccuucaacaauaaggugcuugucuuggccucugaaaaccagaauaaagggaaccagaccccuuacgaguggcugcaaggcaagaucaacagcgaacgcuggaaaaauuuuguggcauuaguucucggaucacagugcagugcugccaagaaacagcggcugcuuacucaggugauugaugacaacaaguucauagauagaaaucugaacgacacaagguauaucgcgcgauuuuuguccaauuacauucaagagaaccuccugcuagucggcaagaauaaaaagaacguguucaccccaaaugggcagaucacggcccugcuccgcagccgguggggacugauuaaagcuagagaaaacaauaacaggcaccaugcacuugaugccaucguaguugcuugugccacccccucuaugcagcagaagauaacacguuuuauccgcuucaaagaggugcacccguauaagauugagaaucgguacgaaauggucgaccaagagucaggugaaaucauuaguccucacuuucccgagccaugggcauauuucagacaggaggugaacaucagggucuuugacaaucauccugauacuguguugaaggaaaugcugcccgaccgaccacaggcgaaccaccaguucguucaacccuuauucgugagccgggccccuacccgcaaaauguccggccaggggcauauggagacaauaaagucugcuaaaagacucgccgaaggaauuucgguacugaggaucccacuuacucagcugaagccgaaccuacucgagaauauggucaacaaagaacgggagcccgcacuguacgcuggcuugaaggcccgacuggcagaguuuaaucaagauccugccaaggcuuucgcgaccccauuuuauaaacagggugggcaacaggugaaggccauuagaguugaacaggugcagaaaagcggcgucuuagugcgcgagaacaauggaguagcagacaacgcuuccaucgugaggacagauguuuucauaaagaauaacaaauuuuuccucguccccaucuacaccuggcaaguggccaagggcauucugccuaauaaagccaucguggcucacaagaacgaagacgagugggaagagauggaugagggggcaaaguuuaaauucucacuuuuuccaaaugaccuggucgaauugaagacuaaaaaggaguacuucuuuggauauuacauuggucucgaucgugccacgggcaacaucagucugaaagaacaugacggggagauaucuaagggaaaggauggcguuuaucgggugggugugaaacuagcgcugagcuucgaaaaguaccagguagacgagcuugggaaaaauagacagauuugcaggccccagcagcgccagccgguccgaaagagaccugcugccaccaaaaaggcaggccaagccaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3692 - RNA, 3575 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcagccgcguucaagccaaacccgauuaauuacauacugggacucgacaucgguauugcuagcguuggcugggccaugguggagaucgaugaagacgagaaccccauuugccuuaucgaucuggggguaaggguguuugaacgggcagaggucccuaaaaccggagacuccuuggccauggcucgccgauuagcacguucugugagaaggcugacacggcgcagagcccauaggcuacuccgggcucgccgacugcuuaagagagaaggcguucugcaggccgcggauuucgacgagaaugguuugauaaagucacucccaaacacucccuggcaacugagggcagccgcucuggaucggaaacucacgccuuuagaguggagugccgugcugcuucacuugaucaagcaucguggguaucugagccagcgcaaaaaugaaggagagaccgcagacaaggaacuaggcgcucuccugaaaggcgucgccgauaacgcgcacgcccuucagacaggggacuuuagaacuccagcagagcuggcuuugaauaaguucgagaaggaauccggacauauuaggaaccagcggggugauuacucucacaccuuuucgcgaaaagaccuccaagccgagcugaucuuacuguucgaaaagcagaaagaguuuggcaauccccacgugucagggggacucaaggaaggcauugagacacuucugaugacccagcgcccugcuuugagcggugaugccguacagaaaaugcuagggcauuguacuuucgagccagcagaaccgaaggccgcuaaaaacacauauaccgcggagagauuuaucuggcugacgaagcucaauaaccugaggauacuugaacaaggaagugagcggccccugacugacaccgaacgcgcaacauugauggacgagccuuacagaaaguccaaacucacuuaugcccaggcuaggaagcuguuaggccuggaggauaccgccuucuuuaaaggccuacguuacgggaaggacaaugcagaagccucuacacucauggagaugaaggcuuaucacgccauuagccgggcacuggaaaaggagggacuuaaggauaaaaaguccccauugaaccugucacccgaacuccaggacgagaucgguaccgcguucagucuguuuaaaacggaugaggacauuacuggccgacuuaaggauagaauccagccugaaauccuggaggcuuugcucaaacauauuagcuucgacaaguucguucaaauaucucugaaggccuuaaggcgcaucgugccacugauggaacaggggaaacgguacgaugaggcaugcgccgagauuuacggagaccacuauggcaagaaaaauacagaagagaagaucuaccuacccccgauaccugcugaugaaauuagaaaccccgucgugcucagggcccugucccaggcacgcaaagugaucaacggugucguucgacgguaugggucaccagcucguauccacauugagaccgccagagaagugggcaagagcuuuaaggacaggaaagagaucgagaagcgccaagaagagaaucggaaagacagagaaaaggcggccgcuaaauucagggaguacuuuccuaacuucguaggagaacccaagaguaaagauauucuuaaguugcgacuguaugagcagcagcauggcaagugucucuacucugggaaagagauaaaucugggacgcuuaaacgaaaaggguuauguggagaucgaccacgcacugccauuuucccggacuugggaugacagcuucaauaacaaaguccuuguguugggcucggaaaaucagaacaaggggaaucaaacacccuacgaguacuuuaacggaaaagauaauucuagagaauggcaggaguucaaggccaggguugagaccucccguuuuccucgcucaaagaaacagcggauucuccugcagaaguucgacgaagauggcuuuaaagagagaaaccuaaaugacacgagguaugugaaccgauuccugugccaauuugucgcugaucggaugcgccucaccgguaaggggaaaaagagaguguucgccaguaauggccagaucacaaaccugcuuaggggauucuggggcuugcggaagguacgagcagaaaacgacagacaucacgcgcuggaugccguuguggucgcuuguagcacuguggccaugcagcagaaaaucacccgcuuugucagguacaaggagaugaaugcauucgacgggaaaacaauugauaaggagacuggagaaguguuacaucagaaaacccacuuuccacagccgugggaguucuuugcucaggaaguuaugauacguguguucgguaagcccgacggcaagccugaguuugaagaggccgacacaccagagaaacuccggacccugcuugcagaaaagcuguccucuagacccgaggccguacacgaauaugucacuccuuuguucgugagcagggcuccaaaccgcaaaaugucagggcagggacauauggagacgguuaagagugcgaaacgacucgaugaaggcguguccguccugagagugccccuaacacaacugaagcucaaagaccuggagaagaugguaaaucgggagagggaaccgaaacuuuacgaggccuugaaagcacgccuggaagcucacaaggaugacccugccaaagccuuugcugagccauucuauaaguacgauaaagcagguaaccguacccaacaggugaaggccguuagagucgaacaagugcagaagacugggguguggguccggaaucauaacggcaucgcggacaaugcuaccaugguuaggguggauguguuugagaaaggagacaaguauuacuuaguacccauuuacagcuggcaggucgccaaaggcauccucccugaucgcgcagugguucaggggaaggacgaggaagauuggcaacugauugacgauucuuucaacuuuaaauucucacuucaccccaaugaccugguggaggucaucacaaagaaggcccgaauguucggauauuuugcuaguugccacagaggcaccgguaacauaaauauccggauucaugaccuagaucacaaaaucgggaagaacggcauucucgaaggaaucggugugaaaacugcacugagcuuccagaaguaccagauagacgaguugggcaaagagauuaggccaugucgccugaagaagagaccucccguuaggaaacggccagccgcgacaaagaaagcugggcaggccaagaaaaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3693 - RNA, 3581 nt, Artificial Sequence
  Cas9 variant mRNA product
gggagagucccgcagucggcguccagcggcucugcuuguucgugugugugucguugcaggccuuauucaagcuuaccauggcacccaagaaaaagagaaaagugggcauccacggggucccugcugcaaaguaccacguuggaauugacguggguaccuucagcguaggccuggccgcgauagagguggaugacgcugggaugccaaucaaaacacucucccuugucucucacauucaugauucaggacuggacccggaugaaaucaagagugccgugacuagguuggcaagcuccggcauugcccggcgcacgcgacguuuauauagaaggaagcggcgcagacugcagcaacuagacaaauuuauccagaggcaggguuggcccguuauagagcucgaagauuacucugacccucuguauccauggaaggugcgggcugagcuugcagccucguacaucgcugaugaaaaagagcgcggggagaagcugucagucgccuugcgacacauugcgagacauaggggauggcggaaccccuaugcaaaagugagcagucucuaccugccugacggcccauccgaugccuucaaggcuauccgugaagagauuaagcgcgccucuggccagcccguaccugaaaccgcaacaguugggcaaauggugacucugugcgagcucggaaccuuaaaacugagaggugagggcgggguccuuagcgcuagguugcagcaguccgacuaugcccgggaaauccaggagauaugucgaaugcaagaaauuggacaggagcuguaccgcaagaucauugaugugguguuugcggccgaaucaccaaaaggcagugcaagcucuagagucgguaaggacccgcuacagcccgggaaaaauagggcucucaaggccuccgacgcuuuccagcgguaccgcaucgccgcacugaucggaaaccuuagaguuaggguggauggcgagaaacguauucugucaguagaggaaaagaauuugguguuugaccaccucgucaaccugacaccuaagaaagagccagaaugggugaccauagccgagaucuuaggcauugaucgggggcaacugaucggaacugcuacaaugaccgacgauggugaacgagcgggcgcaagacccccuacgcacgacacuaauaggagcauaguuaacagucgcauugccccacucguggauugguggaagaccgcuucugcccuugagcagcaugcaauggucaaagcccuguccaaugcugagguggacgauuucgacagccccgaaggggccaagguacaggcauuuuucgcggauuuggacgacgauguucacgcuaaacuagacucgcugcaucucccggugggacgggccgcauauucugaggauacacuggucagacuuacuaggcgcaugcuguccgacggcguggauuuguacaccgcccgacuccaagaauuugguaucgagccuucauggacacccccaaccccucggaucggggaacccgucggcaacccagcuguggaccguguucugaagacggugaguagaugguuagagagcgccacuaagacauggggagcacccgagaggguaauuaucgaacacguccgcgagggcuucgugaccgaaaaacgggcuagagagauggauggggacaugaggcgacgcgccgcgcggaaugccaagcuguuucaggagaugcaggaaaaacuaaacguucagggaaagccuuccagagcugaucucuggagguaucaaucugugcagcgucagaauugccagugugcauacugcgguagcccaauuacuuucucaaacagugagauggaccacauagucccgcgcgccggccaaggguccacaaauacccgggaaaaccugguggcuguaugucauagaugcaaucagagcaaaggaaacacgcccuuugccaucugggcaaagaacaccucuauugagggcgugucaguuaaggaagcggucgagaggacacgacacugggugacugauaccgguaugcggaguacagacuucaaaaaguucacuaaagccguggucgagcgcuuucagagagcuaccauggaugaagagaucgacgccaggagcauggaauccguugcauggauggcuaaugagcuucggucucgaguggcccagcauuucgcaucgcacgggacaaccgugagaguauaucgcggcagcuugacugccgaagcuaggcgugcguccggaaucucaggcaagcugaaauuuuucgacggggucggaaagagucggcucgauagaaggcaucacgccauugacgcagcugugauagccuuuacgucugauuacguugccgagacacuggcugugcgcagcaaccuuaagcaaucccaggcacaccgacaggaggccccucaguggagagaguucaccgguaaagacgcggaacaucgggcugccuggagggucuggugucaaaagauggaaaaacugucagcauugcucacugaggaucugcgcgacgaucgugugguugugaugagcaauguaagauuacggcugggcaacgggucugcccacaaggaaaccaucggaaaacuauccaaggucaaacucaguagccagcugucuguguccgacauugauaaggcuucaagugaggcacuuuggugcgccuugacaagggagccaggcuuugaccccaaggaaggucugccugcgaauccagagcgccauauccgagugaacgggacccacgucuaugcuggcgauaauauuggacucuuccccguuagcgccggcucgaucgcacugagagggggauacgccgaauuaggcuccucuuuucaccaugcucggguguacaaaauaacuagcgguaagaaaccggccuucgcaaugcugaggguauauacaaucgaccuuuugccuuaccgcaaccaggaucucuuuucaguggagcugaagccacaaacgaugaguaugagacaggcugagaaaaagcuaagggacgcccuggcgaccgggaaugccgaauaucucggauggcuggucguggacgaugagcuuguuguggacacuuccaagauugcaacagaucaggucaaagcuguggaagccgaguugggcaccauccggcguuggcgcguugacgguuucuuuucucccagcaagcugcgauuaagaccucuccagauguccaaagaaggcauuaagaaagagucagcucccgagcugagcaagaucauagauaggccaggguggcuuccugcagugaacaagcuguucagugacggaaaugucacaguagugcggcgcgauucuuugggcagaguuaggcucgaauccacugcccaucugcccgugaccuggaaaguccaaaagcggccagccgcuacgaaaaaggcggggcaggccaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3694 - RNA, 3281 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcagccaggauucuggcguucgacauaggaaucagcuccauugguugggcuuuuucugagaacgaugaacucaaggacugcggcguucggaucuucaccaaaguggagaauccaaagacaggggaaucacuugcccugccgcgccgauuggcacguagugccagaaagagguuagcucggcgcaaagcaagacugaaccaucuaaagcaccucauugccaaugaguuuaaacugaacuacgaagauuaucagagcuucgacgagucccuugcuaaggccuacaaaggaucucugaucucgcccuaugaguugagguuucgggcgcucaaugaacugcugucaaagcaagauuucgcacgcguaauacuccauaucgccaagcgaagaggcuacgacgauauuaaaaacagcgacgauaaggagaaaggugcuaucuuaaaggccauuaaacagaaugaagagaagcuggcaaacuaucagagugugggggaguaccuuuauaaagaauacuuucagaaguucaaggaaaauuccaaagaauuuacuaacgucaggaauaagaaagagucuuacgaacgguguaucgcucagagcuucuugaaggacgagcugaaacuaauauuuaagaagcaacgugaguucggauuuuccuucucuaaaaaguucgaagaggaagugcucaguguugccuuuuauaaacgcgcgcugaaggauuucagccaccuugugggcaacugcucauuuuucacggacgagaaaagagccccuaaaaauuccccacuggcauuuauguucgucgcuuugaccaggauuaucaaccuccugaauaacuuaaagaacacagaaggcauucuguacacuaaagaugaccucaaugcccuucugaacgagguguugaagaaugggacccuaacauauaaacagaccaagaaacugcucggacugucagacgauuacgaguuuaagggugaaaagggcacuuauuucaucgaguuuaaaaaguacaaagaguucaucaaggcucuuggggagcauaaccugagccaggacgauuugaaugaaauugccaaagacauaacacucaucaaggaugagauuaaacugaagaaggcauuagccaaauaugaccugaaccaaaaucagaucgauagucuaucuaagcucgaguuuaaagaccaccugaacauauccuucaaggcucuuaaauugguaacuccccugaugcucgaaggaaagaaguacgaugaggcguguaaugaacugaaccuuaaaguugcaauuaaugaggacaagaaagauuuucugccugccuucaacgagacguacuauaaggacgaagugacuaauccagucguguugcgggcuaucaaagaguaccgaaaggugcucaacgcccuguuaaagaaauauggcaagguccacaaaaucaauauugaacuggcacgcgagguugguaagaaccauagccagagagccaaaaucgaaaaggagcagaacgagaauuacaaggcuaaaaaggacgccgaacuagagugcgaaaaacucgggcugaagauuaacucgaaaaauauacuuaaguugaggcuguucaaagagcaaaaggaauuuugugcauauucuggagagaagaucaaaauuuccgaucuccaggacgagaagaugcuggaaaucgaucacaucuaccccuauucacggaguuucgacgauagcuacaugaacaaaguguuaguauuuaccaagcagaaucaagagaaacugaaccagacaccuuucgaagcguuuggcaaugacuccgcuaaguggcagaagauugaggugcuugccaaaaacuugccaacuaagaaacagaagcgcauacucgauaaaaauuacaaggacaaggaacaaaagaacuucaaggauagaaaucugaacgacaccagguauaucgcacgucuaguccugaauuacacaaaagauuaucucgacuuucugccgcuuucugaugacgagaacaccaaguugaaugacacgcagaaaggcagcaaggugcauguugaggccaagucagggaugcugaccagugcuuuacggcacacauggggauucuccgccaaagaucgaaacaaccaccuccaucacgcaauugacgcugugaucauugccuacgcgaauaacagcaucgucaaggccuuuucugauuucaaaaaggaacaggagucaaauagugcugaacuguaugccaaaaagauaagcgagcuugacuacaagaacaaaagaaaguuuuucgagcccuuuuccgguuucaggcagaaagugcuggauaagaucgacgaaauuuucguaucuaaaccugagcgcaagaaaccaucgggcgcauugcaugaagagaccuuucggaaggaagaggaguucuaucaaagcuacgggggaaaggaaggcguucucaaagcucuggagcuagguaagaucagaaaagugaaugggaagauugucaaaaacggcgauauguuuaggguggacaucuucaagcacaagaaaacuaauaaguuuuacgccguccccauauauacaauggauuucgcacugaaagugcucccuaacaaggcgguugcccgcuccaaaaagggagaaauuaaggacuggauccugauggaugagaauuacgaauuuugcuucucacuuuauaaagacaguuugauucugauccagaccaaggauaugcaggagccagaguuuguguacuauaacgcuuucacgucuagcaccguauccuuaauagucucaaaacaugacaauaaguuugaaacacucagcaaaaaccagaagauccuguucaagaaugccaacgagaaagaagugauugcaaagucuaucggcauucaaaaucuuaaaguuuucgagaaguacaucguguccgcucugggggaagucacuaaagccgaguuucgacagcgggaggacuucaagaaaaagcgucccgcagccaccaagaaagcuggacaggcgaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3695 - RNA, 3692 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcaagcgaccugguucucggacuugauauugguauaggcuccguggggguaggaauccugaacaaggugaccggcgagauuauccauaaaaauucuaggauuuucccagccgcgcaggcugaaaacaauuugguccggcgcacaaaccgacaaggucguagauuagccaggcggaagaagcaccgcagagugaggcugaaucggcuauuugaggaaucagggcucaucacugacuucacgaaaauaaguaucaaccugaauccguaccagcuucgcguuaagggacugaccgaugaguugagcaacgaagaacucuuuauugcacugaaaaauauggugaagcaucgaggcaucuccuaucuggacgaugccucugacgauggcaacucgucagucggggacuacgcucagauugugaaagagaauagcaagcagcucgaaacaaagacucccggacaaauccaguuagagagauaucagaccuacggucagcugaggggcgauuucacaguagaaaaagacgggaagaaacaccggcuuauaaacguuuuuccuaccagugcauaucguuccgaggccuugcgcauucugcaaacucagcaggaguucaauccacagaucacagaugaauuuauuaacagauaccuagagauccucaccggaaagaggaaauauuaccauggccccgguaaugaaaagucucggacggacuacgggcgauaucgcacuagcggagagacccuggauaacaucuucggcauucuuauaggcaaaugcacauuuuacccugacgaguucagagcugccaaggcguccuauacugcacaagaguuuaaccuguugaaugaccucaacaaucugaccgugccaacagagaccaagaaauuaucaaaggaacagaaaaaccagaucauuaauuacgucaagaacgagaaagccauggggcccgcuaagcuguucaaguauaucgccaaacuccuuaguugugauguggcagacauaaagggauacaggauugauaaaagcgguaaggcugaaauccacacguuugaggccuaucggaaaaugaagacucuggaaacauuggacaucgagcaaauggaucgcgagacccuagacaagcuggcguacgugcucacucugaauacagaaagagagggcauucaggaagcccuugagcacgaguucgcagaugggucuuucucccagaaacaggucgacgagcugguucaauuuaggaaggcuaacucaagcaucuucggaaaaggcuggcauaauuuuagugugaaguugaugauggagcucauuccugaacuguacgagaccucugaagaacagaugacgauauuaacccgucuggguaaacagaagacaacuuccagcucgaacaagaccaaauauaucgaugagaagcuacucacagaagagauuuacaauccaguaguggccaaaucuguccggcaggcuaucaagaucgugaacgccgcaauuaaagaauauggggacuucgauaauauaguuaucgagauggcccgagaaacuaacgaggacgacgagaagaaagcuauucaaaagauccagaaggcgaauaaagaugaaaaggacgcagccaugcugaaagcugccaaccaguacaacggcaaggcagagcuuccgcacuccguguuucauggacacaaacaguuggccaccaagauuagacuguggcaccaacagggcgaaaggugccucuauacagggaagaccaucucaauacaugaucugaucaauaacaguaaucaguucgaggucgaccacauucuuccccugagcaucacuuuugaugacuccuuggcuaacaaagugcucguauacgccacggcaaaucaggaaaagggacaacgcacaccuuaucaggcgcuggauucuauggacgaugcuuggagcuuccgggaguuaaaagccuuuguuagagagucaaagacccugaguaacaaaaagaaggaauaccuacucacugaggaagacauuuccaaauucgaugugaggaagaaauuuaucgagcgcaaucuggucgacacccgauacgcaagccgggugguccuuaacgccuugcaggaacauuuccgugcucacaagauagauacaaaagugucuguugugagaggucaauuuaccucacagcugaggcgccauuggggcauugagaagacucgggacacauaucaccaccaugccguagacgcacucaucauugcugccaguagccagcugaauuuauggaagaaacagaagaacacgcuggucuccuacucugaggaucaacuuuuggacaucgaaaccggggagcucauaucggaugacgaauauaaagagagcguguucaaggcgccauaccagcacuucguugauacucugaaauccaaggaguuugaagacucaauccuauucaguuaucagguggauucuaaauuuaauagaaagauuagcgacgccacaaucuacgcuaccaggcaggcaaaggucggaaaagauaaggccgacgagacauaugugcugggcaaaauuaaggauaucuacacucaagacgguuacgaugcuuucaugaaaauauauaagaaggacaaauccaaguuucucauguaccgacaugacccccagaccuucgaaaaaguaauugagccuauccuggaaaacuauccaaauaagcagaucaacgagaaagggaaggaggugcccuguaauccguuucuuaaguacaaagaggaacacggcuauauucgcaaguacagcaaaaagggaaacggcccugaaaucaaaucauugaaguauuacgauucuaagcuggggaaccacauugacauaacgcccaaagauuccaauaacaagguugucuuacagagugugagcccauggcgggccgacguguacuucaauaaaaccacaggaaaguaugagauccucggucugaaauacgcagaucuucaauuugaaaagggcacugggaccuauaagauuucucaggagaaauacaacgacaucaagaaaaaggagggagucgauuccgacucagaguucaaauuuacacuguauaagaaugauuugcuccugguuaaagacacugaaaccaaggaacagcaacuauucagauuucugaguaggacgaugccuaagcagaaacauuacguggagcucaagcccuaugauaaacagaaguucgaaggcggugaggcgcugauuaaagugcuugggaacguagccaauagcggccagugcaagaagggauugggcaaaucgaacaucuccauauacaagguccguacagacgugcuggggaaucaacacaucauuaaaaacgagggagacaagccaaaauuagauuucaagcgccccgcugccaccaagaaagcaggccaggcuaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3696 - RNA, 4250 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugcaacccaguucgagggauuuacaaaccuguaccaaguuagcaagacucucagguucgaacuuauuccacaggguaaaacgcugaagcauauacaggagcagggcuuuaucgaagaggacaaggcccggaaugaucacuauaaagaauugaagccgauuaucgaccgcauuuacaaaaccuaugcggaucaaugcuuacagcuggugcagcuagacugggagaaccucuccgcugccaucgauucuuaccgaaaggagaaaacagaagagacucguaaugcacugauagaggaacaggccaccuauagaaacgcuauccaugacuacuucauugggaggacagauaaucuuaccgacgcaaucaacaagcggcacgccgagauuuauaagggacuguuuaaagcugaauuguucaauggcaagguacucaaacaacuggguacugugacaaccacggagcaugaaaacgcccugcuccgcucauuugauaaguucacuaccuacuuuaguggguucuacgagaauaggaaaaacgucuuuagcgcggaagacaucuccacagcaauaccccacagaauugugcaggauaauuucccuaaguuuaaagagaacugucacaucuucacucgguuaauuaccgccguuccaucucugcgcgagcauuucgaaaaugugaagaaggcuaucggaaucuuugucucgacaucaauugaggaaguguucagcuuucccuucuauaaccagcuuuugacccagacgcaaauagaccuguacaaucagcuacucggcggcaucagucgagaggccgggacugagaaaauuaagggacugaacgaaguacuuaaccuggcaauccagaaaaaugaugagacagcucacauaauugccuccuugccucauagauuuaucccacucuucaagcaaauccugucugacaggaacacccuuagcuuuauucuggaagaguucaaauccgacgaagagguuauccagucauuuugcaaguauaagacucuccuucggaaugaaaacgugcuggagacagcggaggccuuguucaaugaacuaaacaguauugaucugacccacauauuuaucagccacaaaaagcucgagacgauuucuuccgcacugugugaccauugggauacccuucguaaugcucuguacgaacgcagaaucucagaguugacagguaaaaucacuaagagcgccaaagagaagguccagaggagucucaagcacgaagacauuaaccugcaggagauaaucucugcugccggcaaagaauuauccgaggcauucaagcagaaaaccagcgaaauucugucgcaugcccacgcugcgcuagaucaaccccucccuacaacucugaagaaacaggaggagaaggaaauccuuaagucucaguuggacucccugcucgggcuguaucaucuucuggauugguuugcaguggacgagucaaaugaaguggauccagaguucagugcccgguugaccggaauuaaacucgaaauggagccgagccuguccuucuacaacaaggcucgaaauuaugccacuaaaaagcccuacucugucgagaaauuuaaguuaaacuuccaaaugccuacccuggcaagcggcugggacguuaauaaagaaaagaacaauggugccauccuauuugugaagaacgggcucuacuaucugggaauaaugccaaaacagaagggccgcuacaaagcucuuucauucgagcccacugaaaagacgagugagggcuuugauaaaauguauuacgacuauuucccugacgccgcaaagaugaucccaaagugcuccacacaguugaaagcgguaaccgcucacuuucagacucacaccacacccauucugcucagcaacaauuucaucgaaccgcuggagauuaccaaggagaucuacgauuuaaacaauccugaaaaagagcccaagaaauuucaaacugccuaugcaaagaagacaggggaccagaaaggauacagagaagcccuguguaaguggauagauuucacgagggacuuucuuucuaaauacaccaagacuacaucaauugauuugaguagccuccggccauccucucaguauaaagaccugggugaguacuaugcugagcuaaacccucugcucuaccauaucucguuccagcgcauugccgaaaaggagaucauggaugcaguggaaaccggcaagcuguaucuuuuucaaauauacaauaaagacuucgcuaaggggcaccauggaaaacccaacuugcacacacuguauuggacuggcuuauucagcccagagaaucucgccaagaccuccaucaaacugaacggucaggcggaauuauuuuacagacccaagucaaggaugaaacguauggcccaccggcugggggagaagauguugaauaagaaacucaaggaucagaaaacgccuauuccagacacccuguaccaagagcuauaugauuacgucaaccaucgacugagucacgaccucucugaugaagcuagagcacugcuuccgaaugugaucacaaaggagguuagccaugaaauuaucaaagacaggcgcuucacuuccgacaaguuuuucuuucacgugcccauaaccuugaacuaucaggccgcuaauucaccuagcaaguucaaccagcgggucaaugccuaccugaaagagcauccagaaacacccauuaucggcaucgauagaggagagaggaacuuaauuuauaucacugugauugacucuaccggcaagauacucgagcagcgcucccugaacacgauccaacaguuugauuaccagaaaaagcuggacaaucgagaaaaagagcggguagcagcgcgucaggccuggaguguuguggggacaauuaaggaucuuaagcaaggauaucuaagccaggucauccacgaaauuguggaccucaugauccacuaccaggcugucgugguucuggagaacuugaauuucgguuuuaaaucuaagagaaccggcauagccgaaaaagcaguguaccagcaauucgagaagaugcugaucgauaaauuaaacugccucguacugaaggacuauccugcugagaaggucgggggagugcuuaauccauaccagcugacugaucaguuuacauccuucgccaaaaugggcacccaaucagguuucuuguuuuauguucccgcaccguacacaaguaagauugacccucucaccggguucguggauccauuugucuggaaaacaaucaagaaccaugaaagcaggaaacacuuccuggagggcuuugacuuccuacauuaugaugugaagacgggagacuuuauucugcacuucaagaugaaucgcaaccuuucguuucagcggggccuccccggguucaugccugccugggacaucguauuugagaaaaaugaaacccaguucgaugcuaagggaacucccuuuauagcggguaaaagaauugugccaguuaucgagaaccauagguucacaggccgauaccgcgaccuguauccugccaaugaauugaucgcacuguuagaggaaaaggggauugucuuccgggauggauccaacauacuccccaaacugcuugagaaugacgauucucacgcuaucgacaccaugguggcccugauuagaagcguguugcagaugaggaacucaaaugccgcuacaggcgaagauuacaucaacaguccaguccgugaccucaacgguguuuguuuugauucccgcuuccaaaauccggaguggccuauggacgcagaugccaacggggcguaccacauugcucugaagggccagcuacugcuuaaucaucucaaagagucuaaggaccugaaguugcagaacggaaucagcaaucaggacugguuagccuauauacaagaacugcggaacaaaagacccgcagccacuaagaaagcuggccaggcaaagaaaaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3697 - RNA, 4229 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugcaagcauuuaccaggaguucguuaacaaguauucccugucuaaaacccucagguuugaacuuauaccacaaggaaagacacuggagaauaucaaggcccgggguuugauuuuagacgaugaaaaacgcgcgaaggacuacaaaaaggcuaaacagaucauugauaaguaucaucaguucuuuaucgaggaaauacugucaagugugugcaucagcgaggaccuacuccagaacuacuccgauguauauuucaagcugaaaaagucugacgaugacaaucuucaaaaagauuuuaagucggccaaagacacuauuaagaaacagaucucagaguacauuaaggauagcgaaaaguucaaaaaccuguuuaaucagaacuugaucgacgcaaagaaaggccaggagagugaucucauacuguggcugaagcaauccaaagacaaugggauugaacucuucaaggccaacucugacaucacggauauugacgaggcuuuagagaucaucaagagcuuuaaaggauggaccacauauuucaagggcuuucacgaaaaucguaaaaacguguacuccucaaaugauauuccgacaaguauaaucuaccgaauugucgacgauaaccugcccaaguuccuugagaauaaagcaaaguaugagagcuugaaggacaaagccccugaggcuaucaacuacgaacagauaaagaaagaucuggccgaggagcuaaccuuugacauugauuauaagacaucugaagugaaucagagaguuuucucccucgacgagguguucgaaaucgcgaacuuuaacaauuaccugaaccagucagguaucaccaaauucaauacuauuaucgggggaaaguuugucaacggcgagaauacaaagaggaaaggcauuaacgaauauauaaaucuuuacagccaacagaucaacgauaagacccugaaaaaguauaaaaugaguguguuguucaagcagauucucucugacacggaguccaagagcuuuguaaucgacaaacuggaggaugacucggauguugugacuaccaugcaaucuuucuacgaacagaucgcagccuuuaagacagucgaggaaaaauccauuaaggagacuuuaucacuccuguucgacgaucuuaaagcucagaagcuggacuugaguaaaauauacuuuaagaaugauaagagccuaaccgaccugucccagcaaguguucgaugacuauucugugaucgggacagccguccucgaauacauuacccagcagaucgcacccaaaaaccuggauaauccaagcaagaaagagcaggagcuuauugcuaagaaaacggaaaaggccaaguaucugucauuggagacuaucaaacucgcgcuggaagaguuuaacaagcaucgggacauagauaaacaaugucgcuucgaggaaaucuuagccaauuuugcagcuauuccuaugaucuucgacgagauugcccagaacaaggacaaucuggcucagaucaguauaaaauaccagaaccaaggaaagaaggaucuacuccaggccuccgcagaagacgauguuaaagccauuaaggaccugcuugaucagacaaacaauuugcugcacaaacucaagaucuuccauauuagccagucugaggacaaagcuaacauccuggauaaggacgaacacuuuuaucuuguguucgaggagugcuacuuugaacuggcgaauauaguaccauuguauaacaaaaucagaaauuacauuacccaaaagcccuacucagaugagaaguucaaacucaacuuugaaaauaguacucuggcaaacgguugggacaagaauaaagagccugauaacacagccaucuuauucauuaaggacgauaaauauuaccugggcgugaugaauaagaagaacaauaaaaucuuugacgacaaggcuauaaaagaaaacaagggggagggauauaaaaagauugucuacaagcuacucccaggcgccaauaaaaugcugccgaagguguucuuuagcgcaaaauccaucaaguucuauaaccccucugaggauauccuuaggauucggaaccacucgacccauacgaaaaaugguagcccucagaagggguacgaaaaguuugaguucaacaucgaagacugucgcaaauuuauugauuucuauaagcaguccauaucaaaacacccagaguggaaggacuucggauuucgauucagugauacccaaagauacaauucuaucgacgaauuuuacagggagguugagaaccagggcuauaaauugacauucgaaaauauuagcgaguccuacaucgauucaguggucaaccagggcaagcuguaucucuuucagauuuacaauaaggacuucagcgccuauucuaaagggcggcccaaccugcauacuuuauacuggaaggcucuguuugaugaacguaaucuucaagacgugguauauaaauugaacggagaggccgaacucuucuaccgcaagcaguccaucccuaaaaagauaacccacccagcaaaagaagcgaucgcuaauaagaacaaggauaaucccaaaaaggagaguguuuuugaauacgaccugauuaaagacaagagauucacagaggauaaauuuuucuuccacugcccgaucacuauuaacuuuaagagcucuggugccaauaaguucaacgacgaaaucaaccuacugcucaaagagaaggcaaaugaugugcauauacuguccauugacaggggcgagcggcaccuugccuauuacaccuuggucgaugggaaaggaaacaucaucaagcaggacacauuuaauauuauaggcaacgaucgaaugaaaaccaauuaucaugacaagcuggcugccaucgaaaaggaucgcgacucagcaagaaaagauuggaagaaaauuaacaauaucaaggagaugaaagaagguuacuuaagucaggugguccacgagauugcuaagcucgugaucgaauauaacgccauaguuguguucgaggaccugaauuuuggguucaagaggggccgguuuaaaguagagaagcaagucuaccagaaacuugaaaagaugcugaucgagaaauugaacuaucucguguucaaggauaaugaauuugacaaaacuggaggcguucugcgcgcguaccagcuaacggccccuuucgagacauuuaagaagauggggaaacagaccggaauuaucuacuaugugcccgcugguuucacuagcaagauuuguccagucaccggcuuugugaaccaacuguacccuaaauaugaaucgguauccaagucucaggaguucuucagcaaauuugacaagaucugcuacaaucucgauaagggguauuucgaguuuucauucgacuacaaaaacuuuggagauaaggcagccaaaggcaaguggacaauagcuaguuucgguuccagacugauuaauuuuaggaacucugacaaaaaucauaacugggauacccgugaaguguaucccacuaaggagcuugaaaaguugcugaaagacuacagcaucgaguacgggcacggcgaguguaucaaggccgcaauuugcggagaauccgauaaaaaguucuuugcgaaauuaacaucaguucucaacacgauccugcagaugcggaauagcaagaccggcacugagcuugacuaucugauaaguccagucgccgaugugaacgggaauuucuuugacucucgacaagcucccaagaacaugccucaggaugccgacgcaaauggagcuuaccacauuggucuaaaaggccucaugcuguuggggagaaucaagaacaaucaggaaggcaaaaagcugaacuuagugauuaaaaaugaggaauauuucgaguuuguccagaacaggaauaacaagcgcccagccgcaacuaaaaaggccggacaagcuaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 3698 - RNA, 51 nt, Artificial Sequence
  NLS2 variant
auggcccccaagaaaaagagaaaagugggcauccacggggucccugcugcc

SEQ ID NO: 3699 - RNA, 48 nt, Artificial Sequence
  NLS4 variant
aagagacccgccgcuaccaaaaaggccggccaggcgaaaaagaaaaag

SEQ ID NO: 3700 - RNA, 4107 nt, Artificial Sequence
  Cas9 variant
auggacaagaaauacagcaucggccuggauauugggaccaacuccgugggaugggccgucaucacagacgaguauaagguucccucuaaaaaguucaaagugcugggcaauacggauagacacagcauuaagaagaaccugaucggggcccuucuguuugacuccggagaaaccgccgaggcgacacggcucaaacgcaccgcuagacggcgcuacacaagacggaagaaucgcauuugcuaucugcaggaaaucuucucuaacgagauggccaaaguggaugacagcuuuuuccauagacuugaagaguccuuucuggucgaggaagauaagaaacacgagcggcauccuaucuucggcaauauuguggacgaaguugccuaccacgagaaguauccgaccaucuaccaucuccgcaagaaacugguggauucuacagacaaggcugaucugagacucauuuaucuggcccuugcucacaugaucaaauuucgggggcacuuccugauugagggagaccucaaccccgauaauagcgacgucgacaagcuguuuauccaacuugugcagaccuacaaccagcuguucgaagagaauccuauuaacgccuccggcguugaugcgaaagccauccucagcgcucgccugucuaaguccagacggcuggaaaaucucaucgcccagcugcccggcgagaaaaagaacgggcuuuuuggaaaucugauugcucucagccugggccuuacgccuaacuucaagucuaauuuugaccuggccgaagaugcgaaacuccaacuguccaaggacaccuacgaugacgaucuggacaaccuccuggcccagaucggggaucaguaugcugaccuuuuccuggccgcuaaaaaccucagcgaugccauucugcuuucugacauccugcgcgugaauacagagauuaccaaggcuccccucuccgcuagcaugaucaaaagauacgacgagcaucaccaggaucugacacugcucaaggcgcugguccggcaacagcuuccugaaaaguauaaagagaucuucuuugaccaguccaagaacggauacgccggcuauauugaugggggagcuucucaggaagaguucuacaaauuuaucaagccgauucuggaaaagauggacggcaccgaggagcuccuggugaagcugaauagagaagaucuucuccgcaagcaacggacguucgacaacggcagcaucccccaucagauucaccugggggagcugcacgccauccucagacgccaggaagauuuuuauccuuuccugaaagacaaucgggagaagaucgaaaagauucuuacauuuagaauccccuacuacgugggaccucuggcccgcggcaacucccgguucgcuuggaugaccagaaagagcgaggagacaauuacccccuggaauuuugaagaggucguugauaaaggggccucugcgcaauccuucaucgaacgcaugaccaacuuugacaagaaucucccgaacgagaaggugcugccuaaacauagccugcuuuaugaguacuucacaguguauaaugaacucacgaaggucaaauacgugaccgagggaaugcggaagcccgcuuuucugucuggcgaacagaaaaaggccauuguugaucugcuguucaaaacaaacagaaaggugaccgucaagcagcugaaagaggacuauuucaagaaaaucgaauguuuugauagcguggagauuuccgggguugaggaccgcuucaaugccucucuuggaacauaccacgaccugcucaagaucaucaaagauaaggacuuucuggauaacgaagagaaugaagacauucuggaggauaucgugcuuacccucacgcuguucgaagaccgggagaugauugaggaaagacugaagacauaugcucaucucuuugaugacaaagucaugaagcagcugaaacggcgcagauacaccggcuggggccggcuuagcagaaagcugaucaacgggauucgcgauaaacaauccggaaagaccauccucgacuuccucaagagcgauggcuuugccaaccggaauuucaugcagcugauccacgacgauucucuuacauuuaaagaggacauucagaaggcucagguguccgggcaaggagacagccuccaugaacacaucgccaaccuggcgggcucuccugccauuaaaaaggggauccugcagaccgucaaagugguugaugagcucgugaaggucaugggcagacacaagcccgaaaauauugugaucgagauggcucgcgagaaccagacaacgcagaaaggacaaaagaacuccagagaacggaugaaacgcaucgaggaaggcauuaaggagcuggggagccagauccuuaaagagcaucccguugaaaauacccagcugcagaaugagaagcucuaccuguauuaccugcaaaacggaagagacauguauguggaucaggaacuugacauuaaucggcuguccgauuacgacgucgaucacaucgugccucagucuuuccucaaagacgauagcauugacaacaaggugcugacacgcuccgauaagaauagaggcaaaucugacaacguuccgagcgaggaagucgugaagaaaaugaagaauuauuggcggcaacuccugaacgccaaacuuaucacccagcgcaaguuugacaaucugacaaaggcugagagagggggacucuccgagcuggauaaagccggcuucaucaagcggcagcugguggaaacccgccagauuacgaaacaugucgcgcaaauccuugacagcagaaugaacaccaaguacgaugagaacgacaaacugauucgggaagugaagguuaucacacucaagucuaaacugguguccgauuuuagaaaggacuuccaguucuauaaaguccgcgagauuaauaacuaccaccacgcccaugaugcuuaccucaaugccgugguugggaccgcucugaucaagaaauaucccaaacuugaaagcgaguuuguguacggcgacuauaaggucuacgaugugcggaaaaugauugccaagucugagcaggaaaucggaaaagccacagcuaaguauuucuuuuacuccaacaucaugaauuucuuuaaaaccgagauuacgcuggcgaacggcgaaaucagaaagcgcccucucauugagacaaauggggaaaccggagagaucguuugggacaagggccgggauuucgccacagugagaaaaguccugagcaugccccaggugaacauugugaagaaaaccgagguccaaaccgggggauuuucuaaggaaagcauccugccuaaacgcaauuccgacaaacuuaucgcucggaaaaaggauugggaccccaagaaauauggcggguucgacagcccgacaguugccuacucugugcugguggucgccaagguggagaaaggcaaguccaaaaagcucaagagcguuaaagaacugcucggaauuacgaucauggagagauccucuuuugagaagaacccuauugauuuccuggaagcuaaaggcuacaaggaggugaaaaaggaccuuaucauuaagcugcccaaauauagccuguuugaacucgagaaugggcgcaagcggaugcuggccuccgcgggagaacuucagaaaggcaacgagcuggcucucccuucuaaguacgucaauuuccuguaucucgccagccacuacgagaaacugaaggggucccccgaagauaacgagcagaagcagcuuuucguggaacaacauaaacacuaucuggacgagaucaucgaacagauuucugaguuuagcaagagaguuauccuggccgaugcuaaucucgacaaagugcuguccgccuacaacaagcaucgggauaaaccuauucgcgagcaggcggaaaacaucauucaccuuuucacccugacaaaucucggagcucccgccgccuuuaaguauuucgacaccacaaucgauagaaaacgguacaccagcacgaaggagguccuggacgcuacacucauucaccaaucuaucaccggccuguacgaaacccgcaucgaucuuucccagcucgggggcgacuga

SEQ ID NO: 3701 - RNA, 4890 nt, Artificial Sequence
  Cas9 variant
augaacuucaagauccugcccauugccaucgaccucggcgugaaaaauaccggggucuuuagcgcuuucuaccagaagggaacaucccuggagagacuugauaacaaaaauggcaagguuuaugaacugucuaaagacagcuacacgcuccugaugaacaaucggaccgcccgcagacaccaacggcgcgggauugauagaaagcagcuugugaagcggcuguuuaaacucaucuggacagagcagcugaaccuggaaugggacaaggauacccagcaagcgauuuccuuccucuuuaaucgcagaggauucucuuuuaucacagacggcuauagcccugaguaccugaacaucgugccggaacaggucaaagcuauucuuauggauaucuucgacgauuauaauggggaggacgaucuggacuccuaccucaagcuggccaccgagcaggaaucuaaaauuagcgagaucuauaacaaacuuaugcagaagauucuggaauuuaaacucaugaagcugugcacagauaucaaagacgacaagguguccaccaaaacgcugaaggagauuaccagcuacgaguucgaacuccuggccgauuaccuugcuaauuauucugagucccugaaaacacaaaaguuuagcuacaccgacaagcagggaaaccucaaagaacugucuuauuaccaucacgauaaguauaauauccaggaguuccuuaaacggcaugccacaaucaacgaccgcauucuggauacccuccugacggacgaucuggacaucuggaauuuuaacuucgaaaaguucgauuuugacaaaaacgaggagaagcuccagaaucaagaagauaaggaccacauucaggcucaucugcaccacuucguuuuugccgugaacaaaaucaaguccgagauggcgagcggcggcagacaucggucucaguacuuccaagaaauuacaaauguccuugacgagaacaaucaccaggaaggguaucugaaaaacuuuugugagaaucuccauaacaagaaauacuccaaucugagcgugaagaaccuuguuaaucugaucggaaaccucuccaaucuggagcugaagccccuccgcaaauacuucaacgauaagauccacgccaaagcugaccacugggaugaacagaaguuuaccgagacauauugccauuggauucugggcgaauggagagugggggucaaagaccaggauaagaaggacggagccaaauacucuuauaaggaucuuuguaaugagcugaaacaaaaggugaccaaagcuggccucguggacuuccugcuggaacuugauccuugccggaccauucccccuuaccucgacaacaacaaucgcaagcccccuaaaugucagagccugauccugaacccgaaguuucucgauaaucaguaucccaacuggcagcaauaccugcaggagcuuaagaaacugcaguccauccagaauuaucucgacagcuucgagacagaucugaagguccugaaaucuuccaaggaccaaccuuacuuuguugaauacaaaagcucuaaccagcagauugccagcgggcagagagacuauaaggaucuugacgcgcggauccuccaauucaucuuugauagagugaaggccuccgacgagcugcugcucaaugaaauuuacuuccaggcuaaaaagcugaaacagaaggccucuagcgagcuugagaaacuggaauccagcaagaagcucgaugaggugaucgcuaacucucaacugucccagauucugaaaagccagcacacgaauggaaucuucgaacagggcaccuuucuucaucucgucugcaaguauuacaaacaacgccagcgggccagagacucucgccuguauauuaugcccgaguaccgguaugauaagaaacugcacaaguacaacaauacaggcagauucgacgaugacaaccagcuccugaccuacuguaaucauaagccucgccagaaacgguaucaacuucugaacgaucucgccggggugcugcagguuucccccaauuuucugaaggacaaaaucggaagcgaugacgaccuuuucauuuccaaguggcucguggaacacaucagaggcuuuaaaaaggcuugcgaggauucucugaaaauccagaaggacaaccgcgggcugcucaaccacaagauuaauaucgcgcggaacacaaaaggaaagugugagaaagaaauuuucaaucugaucugcaagauugagggcagcgaagauaaaaaggggaacuacaagcauggacuugccuaugagcugggcguccuccuguuuggcgaaccgaaugaggcuuccaaaccugaguucgacagaaagaucaaaaaguuuaacucuaucuacagcuucgcccagauucaacagaucgccuuugcugaacgcaaagggaaugccaacaccugugcggugugcuccgcugauaaugcccaccggaugcagcaaauuaagaucacggagcccguugaagacaacaaggauaaaauuauccugagcgccaaggcucagagacuuccugccauccccacacggauuguggacggagcugucaaaaagauggccaccauccuggcgaaaaauauuguggaugacaacuggcagaauaucaagcagguccucucugccaagcaucaacugcacauucccaucaucaccgaguccaacgcuuucgaauuugagccugcccucgcugaugugaaaggcaagagccugaaagaccgcagaaagaaagcccuugagcggauuucuccggaaaauaucuucaaggacaagaacaacagaauuaaagaguucgcgaaggggaucuccgccuauagcggagcuaaucugacagauggcgacuuugauggggccaaagaggaacucgaccacauuaucccccgcucucauaagaaauacggcacccugaacgaugaggcuaaucugauuugcguuacacggggagacaacaagaauaaaggcaacagaaucuucugucuucgcgaucuggccgacaauuauaagcucaagcaguuugaaacgaccgaugaccuggagaucgaaaagaagauugccgauacaaucugggacgcuaacaaaaaggauuucaaauuugggaauuacagaucuuucauuaaccucaccccucaggagcagaaggcguuucggcacgcccuguuccuugcugacgaaaaucccaucaagcaagccgugauucgcgccaucaacaauagaaaccggacauuugucaauggaacccagcgcuacuucgcugaggugcuggccaacaauaucuaucucagagcgaaaaaggagaaccugaacacggacaaaauuuccuuugauuacuucggcaucccuaccauugggaauggacggggcaucgcugaaauucgccagcuguaugagaagguugacagcgauauccaggccuacgccaaaggggacaagccccaagcuagcuauucccaucuuaucgaugccaugcuggcguucugcauugcugccgacgaacacagaaacgauggcagcaucggacucgagauugacaagaauuacucccuguauccgcucgauaaaaacacaggcgaaguguuuaccaaggacaucuucucucagauuaaaaucacagauaaugaguuuagcgacaagaaacugguccggaagaaggccauugagggguucaacacccaucgccagaugacgagagauggaaucuacgcugaaaauuaccuuccuauccugauucacaaagagcugaacgaagugcggaagggcuauacauggaaaaauuccgaggaaaucaagauuuuuaaagggaagaaauacgacauccagcaacucaacaaucugguguauugucuuaaguucguugacaagcccauuucuaucgauauccagauuagcacccuggaggagcucagaaacauccugacaaccaauaacauugccgcuaccgccgaauacuauuacaucaaucucaaaacacagaagcugcacgaguauuacauugaaaacuacaacacggcgcuuggauauaaaaaguacuccaaagagauggaguuucugcgcucucuggccuaucggagcgaaagagucaagaucaaguccaucgacgaugugaaacaagugcucgacaaggauagcaauuucauuaucggcaaaauuacccugccuuuuaagaaagaguggcagcgccuuuaccgggaauggcagaacacaaccaucaaggacgauuaugaguuccugaaguccuuuuucaaugucaaaucuauuacaaagcuccauaaaaaggugagaaaagacuuuagccugcccaucucuaccaacgaagggaaguuccucguuaagcgcaaaacgugggauaauaacuucauuuaccagauccugaaugacuccgauagccgggcugacggcacaaagccuuuuauccccgccuucgacauuucuaaaaacgagaucguggaggcuauuaucgauuccuuuaccagcaagaauauuuucuggcuuccgaaaaacaucgaacugcaaaaggucgacaauaaaaacaucuuugccauugauaccuccaagugguucgagguggaaacaccuagcgaccugagagauaucggaauugccaccauccaguauaagauugacaauaacucucgccccaaaguucgggugaagcucgauuacgucaucgacgaugacagcaaaaucaauuacuuuaugaaccacucccugcuuaagucuagauaucccgauaaagugcuggagauucucaagcagagcacaaucauugaguucgaauccucuggcuuuaacaagacgaucaaagagaugcuggggaugaagcucgcuggaauuuacaaugaaaccagcaacaauuga

SEQ ID NO: 3702 - RNA, 3162 nt, Artificial Sequence
  Cas9 variant
augaagagaaacuacauccugggccucgacauugggaucaccagcgugggauauggcauuaucgauuacgagacacgggacgucauugaugccgggguucgccuguucaaagaagcuaauguggagaacaaugaaggaagacgguccaagcgcggcgccagacggcuuaaacgcagacggcgccacagaauccagcgggugaagaaacugcucuuugacuauaaccugcuuacggaucauucugagcugagcgggaucaaucccuacgaagcgcgcgucaagggacucucccaaaagcugucugaggaggaguucagcgcugcccugcuccaccuggccaaaagacggggcgugcauaacguuaaugaaguggaagaggacaccggcaacgagcuuuccacaaaggaacagauuucucgcaauagcaaagcucuggaggaaaaguaugucgccgagcuccagcuggaaagacuuaaaaaggauggggaggugcggggauccaucaacagauuuaagaccagcgacuacguuaaagaggcuaagcagcugcucaaagugcaaaaggccuaucaccagcuggaucagucuuucauugacacauacaucgaucugcucgaaacccgccggacauacuaugagggcccuggggaaggauccccguuuggcuggaaagacauuaaggagugguacgaaaugcugauggggcauugcaccuauuuccccgaggagcuuagaagcgucaaauacgcguauaaugccgaucuguacaacgcucucaaugaccugaacaaucuugugaucacgcgcgacgaaaacgagaagcuggaauauuacgagaaguuucagauuaucgaaaacguguucaaacaaaagaaaaagccuacccucaaacagaucgccaaggagauucuggucaaugaggaagauaucaagggauaccggguuacaucuaccggcaaacccgaguuuacaaaccugaagguguaucacgacauuaaagauaucaccgcuagaaaggaaauuaucgagaaugccgagcuccuggaccagaucgcgaaaauucuuacgaucuaccaguccagcgaagauauucaagaggaacugacaaaccucaauucugagcugacccaggaagagaucgagcagauuuccaaccuuaagggcuauacagggacccacaaucugagccucaaggccaucaaccugauccuggacgaacucuggcauaccaaugauaaccaaauugcuaucuucaaucgccugaaacuugugccuaagaaagucgaccugucccagcagaaggagauucccacaacgcucguggaugacuuuauccugucuccuguugugaaacggagcuucauucaguccaucaaggucauuaacgccaucaucaagaaauacggacugccgaaugauauuaucauugaacuugcuagagagaagaacagcaaagacgcccaaaagaugaucaaugaaaugcagaaacgcaaccggcagaccaacgagagaauugaggaaaucauccgcacaaccggcaaggagaaugccaaauaucucauugaaaagaucaagcugcacgacaugcaggaggggaaaugucuguacucucucgaagcuauuccccuggaggaucuucugaacaauccuuuuaacuaugagguggaccauaucauuccccgguccguuagcuucgauaauucuuucaacaauaaggugcucgucaaacaagaagagaacagcaagaaaggaaauagaacaccuuuucaguaccuguccucuagcgacuccaagaucagcuacgaaaccuucaagaaacacauccugaaccuugcgaagggcaaagggcggauuucuaagacgaaaaaggaguaucuccuggaggaacgcgauaucaauagauuuuccgugcagaaggacuucauuaaccggaaucuggucgauacaagauacgccacccgcggacucaugaaccugcuucggagcuauuuuagagugaauaaccuggacguuaaagugaagucuaucaacggcggcuucaccuccuuucuccgcagaaaauggaaguucaaaaaggagcggaauaagggguacaaacaccaugcugaagaugcccugauuaucgccaacgcugacuuuaucuucaaggaguggaaaaagcuggauaaagccaagaaagucauggaaaaucagauguuugaggagaagcaagcggaaagcaugcccgagauugaaacagagcaggaauauaaggagaucuucauuaccccgcaccagaucaaacauauuaaggacuuuaaagauuacaaguauucccaccgcguggacaaaaagccuaacagagagcuuaucaaugacacacucuacucuacgcggaaggaugacaaaggaaacacccugauuguuaauaaccugaauggccucuacgauaaggacaacgauaaacugaagaaacuuaucaauaagagccccgaaaagcugcucauguaucaucacgacccucagacauaccaaaaacugaagcugaucauggagcaguauggggaugagaaaaacccccuuuacaaguauuacgaagaaaccggaaauuaucucacaaaauacuccaagaaggacaacggccccgugauuaaaaagaucaaauacuaugggaauaagcugaacgcucaccuggauauuaccgacgauuacccuaacucucgcaauaaagucgugaagcucagccugaagccguauagauucgacguguaccuugauaacggcguuuauaaauucgucacggugaagaaucuggacgugaucaaaaaggagaacuacuaugaggucaauuccaaaugcuacgaagaggccaagaaacucaagaagauuagcaaccaggccgaauuuaucgcuucuuucuacaauaacgaccugaucaaaauuaauggagagcuguaucgggugaucggcguuaacaaugaucuucugaaccgcauugaggugaauaugaucgacauuaccuacagagaauaucucgagaacaugaaugauaagcggcccccucgcaucaucaaaacaauugccuccaagacccaaagcaucaaaaaguacucuacagacauucuggggaaccucuaugaagucaaguccaaaaagcauccccagaucauuaaaaagggauga

SEQ ID NO: 3703 - RNA, 4230 nt, Artificial Sequence
  Cas9 variant
augcuguucaacaagugcaucauuaucagcauuaaucucgacuuuuccaacaaagagaaguguaugaccaaacccuacucuaucggccuggauauugggacaaauagcgugggaugggccgucaucacggacaacuauaagguuccuuccaaaaagaugaaggugcuuggcaauaccucuaaaaaguacaucaaaaagaaccugcucggggugcugcuuuucgauagcggaauuacagcugaaggcagacggcugaaacgcaccgccagacggcgcuauacaagacggcgcaauagaauccucuaccugcaggagauuuuuagcaccgaaauggcgacacuggacgaugcuuucuuucaacggcucgacgauucuuuccuggucccggacgauaagcgcgacagcaaguaucccaucuuugggaaccuuguggaggaaaaaguuuaccacgaugaguucccuaccauuuaucaucugagaaaguaccucgccgacuccacgaaaaaggccgaucugcggcuuguguaccuggcucucgcccacaugaucaaauaucgcggacauuuucugauugagggcgaguucaauagcaagaacaaugacauccagaaaaacuuucaggacuuccuggauaccuacaaugcuaucuuugaaucugaccucucccuggaaaacagcaagcagcuugaggagauugucaaggauaaaaucucuaagcuggaaaagaaggaccggauucucaaacuguuccccggcgagaaaaauuccgggaucuucagcgaauuucuuaagcugauugugggaaaccaagccgauuucagaaaaugcuuuaaccucgacgagaaggcgucucugcacuucuccaaagaaagcuaugaugaggaccuggagacacuccugggcuacaucggggaugacuauuccgauguuuuucuuaaggccaaaaagcuguacgacgcuauccuccugucuggauuccuuaccgugacagacaaugaaaccgaggccccucugagcuccgcuaugauuaagcgcuauaacgaacauaaagaggaucucgcccugcugaaggaauacaucagaaauauuagccucaaaacguacaacgaggucuuuaaggacgauacaaagaauggcuaugcgggguacaucgacggaaagaccaaccaggaggauuucuauguguaccugaagaaucuucuggccgaauuugagggcgcugacuauuuccucgaaaagauugaucgggaggacuuucugagaaagcagcgcacauucgauaacggcucuauccccuaccagauccaucugcaagaaaugcgggccauucuugacaaacaggcuaaguuuuauccuuuccucgccaaaaauaaggagagaaucgagaaaauucugaccuuccgcaucccguacuacguggggccccuggcccggggaaacuccgauuuugcuuggagcauuagaaagcgcaaugaaaagaucaccccuuggaacuucgaggacgucauugauaaagaaucuagcgcggaggccuuuaucaaucggaugacauccuucgaccucuaucugcccgaggaaaagguucuuccuaaacacucucugcucuacgagacguuuaacguguauaaugaacugaccaaggugagauucaucgcugagagcaugcgcgacuaccaguuucuggauuccaaacagaagaaggacauuguccggcuuuauuucaaagauaagagaaaagugacagacaaggauaucauugaauaccuccacgccaucuauggcuacgacgggauugagcugaaaggaaucgagaagcaauuuaacagcucucuguccaccuaccacgaucuccugaacaucauuaaugacaaggaguuccuugaugacagcucuaacgaagccaucauugaagagaucauucauacacugaccaucuuugaagaucgcgagaugaucaaacagcggcucuccaaguucgagaauauuuuugacaaaagcguucugaagaaacuguccagacggcacuauacgggcugggggaaacuuucugcuaagcucaucaacggcauucgcgaugaaaaauccggaaauacaauccuggacuaccugauugacgauggcaucuccaacagaaauuucaugcagcucauccacgacgaugcccugucuuucaagaaaaagauucaaaaagcgcagaucauuggggacgaggauaagggaaacaucaaagaaguggucaagagccuucccggcuccccggcuauuaagaaagggauccugcagagcauuaagaucguggacgagcucguuaaagugaugggaggccggaagccugaaucuaucgucguggagauggccagagagaaucaguauaccaaccaagggaaauccaauagccagcagcgccugaagcggcuggaaaagucucuuaaagagcucggcuccaagauucugaaagaaaacauccccgccaagcugagcaaaauugauaauaacgcucuccagaaugacagacuguaccuuuauuaccugcaaaacggaaaggauauguauaccggcgacgaucucgacaucgaccgccugucuaacuacgauauugaccauaucaucccucaggccuuucugaaggauaauagcauugacaacaaaguccuuguguccagcgcuucuaauagagggaaguccgaugacuuccccagccuggagguugugaaaaagcggaaaacauuuugguaccagcuccugaaguccaagcucaucucucagcgcaaauucgauaaccugaccaaggccgagagaggaggccuucugcccgaagacaaagcgggguuuauucaacggcagcucgucgagacacgccagaucacgaagcacguggccagacugcuggaugaaaaauucaauaacaagaaggacgagaauaaccgggcuguucgcaccgugaaaauuaucacacuuaagagcacccuggucucccaguuuagaaaagauuucgaacucuauaaggugcgggagaucaaugacuuucaucacgcccaugaugcuuaccugaacgccgugauugcgucugcccuccugaaaaaguauccuaaacuugagccggaguucguuuacggagacuaucccaaguacaauagcuuucgcgaaagaaaguccgcuacagaaaaagucuauuucuacucuaacaucaugaauauuuucaagaaaagcaucucccuggccgacggccgggugauugagagaccucucaucgaagugaacgaggagaccggggaaagcgucuggaauaaggagucugaucuggcuacggugcgccggguucuguccuacccccaagugaacgucgugaaaaagguugaggaacagaaccacggccuugacagaggaaagccuaaaggccuguuuaaugccaaccucagcucuaagcccaaaccuaauuccaacgaaaaucuggugggggccaaggaguaucucgauccgaaaaaguacggaggcuaugcugggauuagcaacucuuucgcgguccuggugaagggaaccaucgagaaaggcgccaagaaaaagaucacaaauguucuugaauuucaggggauuuccauccuggaccgcauuaacuaccggaaagauaagcugaauuuccuccuggagaagggcuauaaagacaucgaacuuauuaucgagcugcccaaguacagccucuuugagcuguccgauggaagcagacgcaugcucgcuucuauccugagcaccaacaauaaacggggcgaaauucacaaggggaaccaaaucuuccuuucccagaaauuugugaagcugcuguaucaugccaaaagaauuucuaauacaaucaacgagaaucaccgcaaguacgucgaaaaccauaagaaagaguucgaggaacucuuuuacuauauucuggaguucaaugaaaacuacgugggagccaagaaaaacggcaaacuucugaauagcgcuuuucaguccuggcagaaccacucuaucgacgagcucuguagcuccuucaucgggccuaccggaucugaacggaaaggccuguuugagcucacgagcagaggguccgccgcggauuucgaguuccugggcgugaagauuccccgguaucgcgacuacacaccuagcucucuucugaaggaugcuacccugauccaccaauccgucacaggacucuaugaaaccagaauugaccuggccaaacuuggcgagggguga

SEQ ID NO: 3704 - RNA, 3306 nt, Artificial Sequence
  Cas9 variant
augugguacgccagccugauguccgcucaccaucucagagugggcaucgacgucgggacccacucuguuggacuggccacacuucggguggaugaccauggcacgcccauugagcugcucagcgcgcugucccacauccaugauucuggggugggaaaggaaggcaaaaaggaccacgauacccgcaaaaagcugagcgggauugcuagacgggcccgcagacugcuccaccaucggcgcacacagcugcaacagcuggacgagguccucagagaucugggauucccuaucccgacccccggcgaauuucuugaccugaacgagcagacagauccuuaucggguguggcgcguuagagcccggcucguggaagagaaacugcccgaggaacuucgcggcccugcuauuuccauggccgucagacacaucgcucggcaucgcggguggagaaaucccuacucuaagguggagagccugcucuccccugccgaagagagcccguucaugaaggcgcugcgggagagaauccuggccaccacaggagaaguucucgacgauggcauuacccccgggcaggcuauggcccaaguggcucugacgcacaacaucucuaugcgcggaccugagggcauucuugggaaacugcaccaguccgacaaugccaacgaaauccggaagauuugcgcgagacagggagucagccccgauguguguaaacagcuccugcgcgccguguuuaaggcugacucuccucggggcuccgccgucagcagaguugcucccgacccgcuuccuggccaagggucuuuccgccgggcccccaaaugcgauccugaguuucagagauuccgcaucauuuccaucguggccaaucugcggaucagcgaaaccaagggagagaacagaccccucacagcugacgagcgccggcauguggucaccuuucugacagaagauucccaggcggaccugaccuggguggauguugccgagaagcucggcgugcacagacgggaccugcgcgggacggcuguccauacagaugacggagaaagaucugccgcccggcccccuauugaugcuaccgacagaaucaugcgccagacaaaaauuagcucccuuaagaccuggugggaggaagccgauagcgagcaacggggcgcgaugaucagauaucuguacgaggacccgaccgacucugaaugugcugagauuaucgccgaacuccccgaggaagaucaggccaaacuggacucccuucaccuuccugcugggcgcgccgcuuauagcagagagucucucacagcccugagcgaucauaugcuggcgacgaccgacgaucuccacgaggcccggaagcgccuguucggaguggacgauuccugggcucccccugccgaagcuaucaaugcccccguuggcaacccgucuguggacagaacacuuaaaauugucggccgguaccugagcgcgguggaguccaugugggggaccccugaagucauccacguggagcauguucgcgauggauuuacaagcgagagaauggccgacgaacgggauaaggcuaaucgcagacgguauaacgacaaucaggaggccaugaaaaagauucaacgcgauuacggcaaggaaggguacaucucuagaggagacauugugcggcucgacgcucuggagcugcagggcugcgccugucuuuauugcgggaccacgaucggcuaccacacaugucagcucgaucauaucgucccccaggccggaccuggcuccaacaauagacgcgggaaccugguggcuguuugcgaacgguguaauagaagcaaaucuaacacccccuucgcggugugggcccaaaagugcggaaucccucacgucggcgugaaagaggcuaucgggcgcgugcggggauggagaaagcagacccccaacacauccagcgaggaccugacccgccucaaaaaggaaguuauugcccggcugagacgcacacaggaggauccggaaaucgacgagcgguccauggaaucugucgccuggauggcuaaugagcuucaccauagaauugccgcggcuuauccugagacgaccgugaugguguaccggggcagcaucacagccgccgcucgcaaggccgcggggauugauuccagaaucaaccugaucggcgaaaaaggacggaaggaccgcauugauagacggcaccaugcugucgacgccucugugguugcccucauggaggcuagcguggccaaaacccuggcugaaagauccagccugcgcggcgagcagcggcuuacagggaaggaacaaaccuggaaacaguauacgggaucuaccgucggcgccagagagcacuuugagauguggcgcgggcauaugcuccaccugacagaacuguucaaugagcggcucgcggaagauaagguguacguuacccagaacaucagacugcgccuuuccgacggaaaugcccacacagugaaccccagcaagcuggucucucaucggcucggcgaugggcugaccgugcagcaaauugacagagcuuguacgcccgcccuguggugcgcucuuacacgcgagaaagauuuugacgagaagaauggccucccugccagagaagaccgggccauccgcguucacggacaugagauuaaauccagcgauuauauccagguguucucuaagagaaagaagaccgacagcgaucgggacgaaacaccguucggcgcuaucgcgguccgcgggggauuuguggagauuggccccuccauccaccaugccagaauuuaccggguggaagggaagaaaccugucuacgcuaugcugagaguuuucacccacgaucugcucagccagcgccacggagaccuguuuucugccgugauucccccucaguccauuagcaugcggugcgccgagcccaaacuuagaaaagcuaucaccacaggcaacgccacguaucugggguggguggucgugggcgaugagcucgaaaucaauguugacuccuucaccaaguacgcgauuggacgcuuucuggaggauuucccuaacacaacccgguggagaaucuguggcuaugacacaaauucuaaacugacccuuaagcccauugugcucgcugccgaagggcuggagaacccgagcuccgccgucaaugaaaucguggagcugaaaggauggcggguugcuauuaacgugcucacgaagguccauccuacagugguucgcagagaugcccugggccggccccgcuacucuagcagauccaaucuuccuaccucuuggaccaucgaguga

SEQ ID NO: 3705 - RNA, 4167 nt, Artificial Sequence
  Cas9 variant
augaccaagcccuacagcaucggccuggacauugggacaaacuccgugggaugggccgucacgaccgauaauuauaaaguuccuucuaagaaaaugaaggugcucggcaacacaagcaaaaaguacaucaagaaaaaucugcuuggggugcuccuguucgacuccggaauuaccgcugagggcagacggcugaagcgcacagccagacggcgcuauaccagacggcgcaacagaauccuuuaccugcaggaaauuuucucuacagagauggcgacccucgaugacgcuuucuuucaacggcuggaugacagcuuccuggucccggaugacaaacgcgauuccaaguaucccaucuuugggaaucucguggaagagaaagccuaccacgacgaauuuccuacgaucuaucaucugagaaaguaccuugccgauucuaccaagaaagcugaccugcggcucguuuaccuggcccuugcucacaugauuaaguaucgcggacauuuucugaucgagggcgaguucaacagcaaaaauaacgauauucagaagaauuuucaggacuuccucgacacauacaacgccaucuuugaauccgaucugagccuggaaaauucuaaacagcucgaagagauugugaaggacaaaaucuccaagcuggagaagaaagaucggauucuuaagcuguuccccggcgagaaaaacagcgggaucuuuucugaguuccucaagcugaucgucggaaaucaagcggacuucagaaaaugcuuuaaccuugaugaaaaggccucccugcacuucagcaaggagucuuaugacgaagaucucgagacccugcugggcuacauuggggacgauuauuccgacguguuucucaaagcuaagaaacuguacgaugccauccuucugagcggauuccucacaguuaccgacaaugagacggaagcuccucuguccucugccaugauuaagcgcuauaacgagcauaaagaagaccuugcgcugcucaaggaguacaucagaaacauuagccugaagacauacaaugaaguguuuaaagaugacaccaagaacggcuaugccggguacaucgauggaaaaacaaaucaggaggacuucuaugucuaccugaagaaacuccuggcugaguuugaaggcgccgauuauuuccuugagaagaucgaccgggaagauuuucugagaaagcagcgcaccuucgacaacggcuccauucccuaccagauccaccuccaagagaugcgggcuauucuggauaaacaggccaaguuuuauccuuuccuggccaaaaauaaggaaagaaucgagaaaauucuuaccuuucgcaucccguacuacguggggccccucgcucggggaaacagcgacuucgcguggucuaucagaaagcgcaaugagaaaauuacaccuuggaacuucgaagaugugaucgacaaggaguccagcgccgaggcuuuuauuaaucggaugacgucuuucgaucuguaucugcccgaagagaagguccucccuaaacacagccugcuuuacgaaaccuuuaacguuuauaaugagcugacaaaggugagauucaucgccgaauccaugcgcgacuaccaguuucucgacucuaaacagaagaaagauauugugcggcuguauuucaaggacaagagaaaagucaccgauaaggacaucauugaguaccugcaugccaucuauggcuacgaugggaucgaacuuaaaggaauugagaagcaauuuaacagcucccucagcacauaccacgaccugcugaauaucauuaacgauaaagaguuccucgacgauucuuccaaugaagcuaucauugaggaaaucauccauacccugacgauuuuugaggaccgcgaaaugaucaagcagcggcuuagcaaguucgagaacauuuuugauaaaucugugcugaagaaacucuccagacggcacuauacaggcugggggaagcugagcgccaaacugaucaacgggauucgcgacgagaaguccggcaauaccauccuugauuaccucaucgacgacggcauuucuaacagaaauuucaugcagcugauccacgaugacgcgcugagcuuuaagaaaaagauucaaaaagcucagaucauuggggaugaagacaagggaaacaucaaagagguugugaagucccuccccggcucuccggccaucaaaaaggggauucugcagagcaucaagauugucgaugaacuugugaaaguuaugggaggccggaagccugaguccaucguggucgaaauggccagagagaaucaguauaccaaccaagggaaaagcaauucucagcagcgccugaagcggcucgagaaaucccugaaggaacugggcagcaagauucuuaaagagaacauccccgcuaagcucucuaaaauugacaauaacgcccugcagaaugauagacuguaccucuauuaccugcaaaacggaaaggacauguauacaggcgaugaccuugauaucgaccgccuguccaauuacgacaucgaucauauuaucccucaggcuuuccucaaagacaacagcauugauaauaaggugcuggucucuagcgccuccaacagaggaaagagcgacgaugugcccucucuggaaguugugaaaaagcggaaaaccuucugguaccagcuucugaaguccaaacucaucagccagcgcaaguuugacaaccugacaaaggcggagagaggaggccucucccccgaggauaaagccggguucauucaacggcagcuggucgaaacgcgccagaucaccaagcacguggcuagacuucuggacgagaaauuuaauaacaagaaagaugaaaauaaccgggccguucgcacagugaagaucauuacccucaagucuacacuggucagccaguucagaaaagacuuugagcuguauaaggugcgggaaaucaaugauuuccaucacgcucaugacgccuaccuuaacgcggugguugccuccgcucugcucaaaaaguauccuaaacuggagccggaguuugucuacggagauuaucccaaguacaauucuuuccgcgaaagaaaaagcgccaccgagaagguguauuuuuacuccaacauuaugaauaucuucaagaaaucuauuagccucgcugacggccgggugaucgaaagaccucugaucgaggucaacgaagagacgggggaguccguguggaauaaggaaagcgaccuugccaccguucgccgggugcugucuuacccccaagucaacgugguuaaaaagguggaggaacagaaucacggccucgauagaggaaaaccuaagggccuguuuaacgccaaucuguccagcaagcccaaaccgaacucuaacgagaaucuugucggggcuaaggaauaucuggacccuaaaaaguacggaggcuaugcggggauuuccaacagcuucacagugcucguuaaaggaaccaucgagaagggcgccaagaaaaagauuacaaaugugcuggaguuccaggggaucucuauucucgaucgcaucaacuaccggaaagacaagcugaauuuucuucuggaaaaaggcuauaaggauauugagcugaucaucgaacuccccaaguacucccuguucgagcuuagcgacggauccagacgcaugcuggcuagcauucucucuaccaacaauaaacggggcgagauccacaaggggaaccaaauuuuucugagccagaaauucgucaagcuccuguaucaugccaaaagaaucuccaauacgauuaacgaaaaucaccgcaaguacguggagaaccauaaaaaggaauuugaggaacuuuucuacuauauccuggaguuuaaugagaacuacgugggagccaagaaaaauggcaagcugcucaacucugcuuuccagagcuggcagaaucacuccaucgaugaacuguguucuagcuuuauugggccuacaggauccgagcggaaaggccuuuucgaacugaccucuagagggagcgccgcggacuuugaguuccucggcgucaagaucccccgguaucgcgauuacacaccuuccagccugcucaaagacgcuacccugauucaccaaucuguuaccggacuuuaugaaacaagaaucgaucuggccaagcugggcgagggguga

SEQ ID NO: 3706 - RNA, 3249 nt, Artificial Sequence
  Cas9 variant
auggccgcuuucaagcccaacagcaucaauuacauucugggccucgacaucgggauugccuccgugggaugggcgauggucgagaucgaugaagaggaaaacccuauuagacugaucgaccuuggcguucggguguuugagcgcgcugaagugccgaaaaccggggauucucuggccauggccagacggcucgcucgcagcgucagacggcugacacgcagacgggcccaccgccuucugagaacgcggcgccuccugaagagagagggagugcugcaggcugccaauuucgacgagaacggccucaucaaaucccugcccaauaccccuuggcaacuucgggcggccgcucuggaucgcaagcucacaccccuggaauggucugccguucuucugcaucucauuaaacacagaggguaucugagccagcggaagaacgagggagaaaccgcugacaaggagcugggcgcccuccugaaaggcguggcggggaaugcccaugcccuucagacaggagauuuuagaaccccugcugagcuggcucucaacaaguucgaaaaagaguccggccacauccgcaaucagcggucugacuacagccauacauuuuccagaaaggaucugcaagccgaacuuauucuucucuucgagaaacagaaggaauuugggaacccccacgucagcggaggccugaaggaggggaucgagacccugcucaugacgcagcgcccugcccugucuggagacgcugugcagaaaaugcuuggccacugcaccuucgaaccggcggagcccaaggccgcuaaaaauacauauaccgccgaacgguuuauuuggcugacaaagcucaacaaucugagaauccuugagcaaggcuccgaacgcccucugaccgauacggagcgggccacacucauggacgagcccuacagaaaaagcaagcugaccuaugcucaggcccgcaaacugcucgggcuggaagauacagcguucuuuaagggacuucgguacggcaaggacaacgcugaggccucuacccugauggaaaugaaagccuaucaugcuauuuccagagcccucgagaaggaagggcugaaagacaagaaaagcccucugaaucuuucucccgagcuccaggaugagaucggaaccgcuuucucccuguuuaagacagacgaagauaucacgggccgccugaaggaccggauucagccggagauccucgaagcccugcuuaaacacauuagcuucgauaaguucguucaaaucucccugaaagcgcucagacggauugugccucugauggagcaggggaagcgcuacgacgaggccugugcugaaaucuacggagaucauuauggcaaaaagaacaccgaggaaaagaucuaccugcccccuauucccgccgacgagaucagaaaccccgucgugcuucgggcucucucucaggccagaaaagugauuaauggcgucguucgccgguaugggagcccugcgagaauccacauugaaacagcccgcgaggugggaaaguccuuuaaagauagaaaggagaucgaaaaacggcaagaggaaaaccgcaaggacagagagaaggcugccgcuaaauuccgggaauacuuuccgaauuucgugggcgagcccaagagcaaagauauccugaagcugcgccucuaugagcagcagcacgggaaaugccuguacucuggaaaggaaauuaaccuuggcagacugaaugagaaaggguaugucgaaaucgaccaugcccucccuuuuucccggaccugggacgauagcuucaacaauaaggugcugguucugggcucugagaaccagaauaagggaaaccaaacacccuacgaauacuuuaauggcaaagacaacagccgcgaguggcaggaguucaaggccagaguggaaaccucccgguuuccucgcucuaaaaagcagcggauucuucuccagaaauucgaugaggacggguuuaaggaaagaaaucugaacgauacgagauaugucaaucgcuuccugugucaauuuguggcugaccggaugagacucacaggaaagggcaaaaagcgcguuuucgcgagcaacgggcagaucaccaaccugcuucggggauucuggggccugagaaaagugcgcgccgagaaugaucggcaccaugcucucgacgccgucguggucgccugcuccaccguggcuaugcagcagaagauuacaagauuuguucgcuacaaagagaugaacgccuucgaugggaagaccaucgacaaggaaacaggcgaggugcugcaccagaaaacgcauuuuccccagccgugggaguucuuugcgcaggaagucaugauucggguguucggaaagccugauggcaaacccgaauuugaggaggcugacacccuggaaaagcugagaacacuccuggccgagaaacugagcucucggccugaagccguucacgaguaugugacaccccucuucgucucccgcgcuccuaauagaaagaugagcgggcagggacacauggaaaccgugaagucugccaaacggcuggaugagggcguguccguucuucgcgucccccugacccaacucaagcugaaagaccuggagaagauggugaacagagaacgggagccgaaacuuuacgaagcgcugaaggcuagacucgaggcccauaaagacgauccugccaaggcuuuugccgaacccuucuauaaguacgacaaagcugggaaucgcacgcaacaggugaaggccguccggguggagcaaguucagaaaaccggagugugggucagaaaccacaauggcaucgcggauaacgccacaauggugcgcguugacguguuugagaagggggauaaauauuaccugguccccaucuacagcuggcaaguggcuaagggcauucucccugaccgggccguugugcagggaaaggaugaagaggacuggcagcugaucgaugacuccuucaauuuuaaauucucucuucauccgaacgaucuggucgaagugauuaccaagaaagcuagaauguucggcuauuuugccagcugucaccgcgggacaggaaauaucaacauucggauccacgaccucgaucauaagaucggcaaaaaugggauucuggagggaaucggcgugaagaccgcccuguccuuccagaaguaccagauugacgagcuugggaaagaaaucagacccugccgccugaagaaaagaccucccguccgguga

SEQ ID NO: 3707 - RNA, 4005 nt, Artificial Sequence
  Cas9 variant
augaagaaacccuacaccaucggccuggacauugggacaaacagcgugggaugggccguccucacggaucaguaugaccugguuaagagaaaaaugaagaucgcuggcgauuccgagaaaaagcaaauuaagaaaaauuucuggggagugcggcuuuuugacgaagggcagaccgccgcggaucgcagaauggcucggacagcccgcagacggaucgagcgcagacggaaccgcauuucuuaccugcagggcaucuucgccgaagagaugagcaagaccgacgcuaauuucuucugcagacucuccgauucuuuuuauguggacaacgaaaaacggaauagccgccacccuuucuuugccacaaucgaggaggaagucgaguaccauaagaacuauccgaccauuuaccaccugagagaggaacuuguuaauuccucugagaaagcugaucugcggcucguguaucuggcccuggcgcauaucauuaaguaccgcgggaacuuccucaucgaaggagcccuggacacacagaauaccagcguggauggcauuuacaagcaauuuauccagacguauaaccaggucuucgcuuccggcauugaggacgggagccuuaaaaagcuggaagauaauaaagacguggccaagauccucguugagaaagugaccagaaaggaaaaacuggagcggauccuuaagcuguaccccggagagaagucugcuggcauguuugcccaguucauuucccucaucgucgggagcaaaggaaacuuucaaaagccuuucgaccugauugaaaaaucugauaucgagugugcgaaggacuccuaugaagaggaucuggaaagccuccuggcccuuauuggcgacgaguacgcugagcuguucguggccgcuaaaaaugccuauucugccgugguccucuccagcaucaucacaguugcugaaaccgagacaaacgcgaagcuguccgccucuaugauugaaagauuugauacccacgaggaagaccuuggggagcugaaggcuuucaucaaacuccaucugcccaagcacuacgaggaaauuuuuagcaauacggagaaacacggauaugccggcuacaucgauggcaagacaaaacaggccgacuucuacaaguauaugaagaugacccuggaaaacauugagggggcugauuacuuuaucgccaaaaucgagaaggaaaacuuccuccgcaaacagcggacauuugacaauggagcgauuccucaucagcugcaccuugaggaacuggaggcuauccuccaucaacaggccaaguauuaccccuuccugaaagaaaacuaugauaagauuaagucccuugugaccuuuagaaucccuuacuucgugggcccgcuggccaaugggcagagcgaguuugcuuggcucacccgcaaagccgacggagagauucggcccuggaacaucgaagagaaggucgacuucggcaaaucugcuguggauuuuauugaaaagaugacaaauaaagacacguaucugccuaaggagaacguucugcccaaacacucccucugcuaccaaaaguaccugguguauaaugaacuuaccaaggucagauacaucaacgaucaggggaaaacaagcuauuucucuggacaggagaaggagcagaucuucaaugaccuguuuaaacaaaagcgcaaagugaagaagaaagaucucgaacuguuccugcggaacaugagccacguugaguccccuaccauugaaggccuugaggacucuuuuaauagcuccuacagcacauaucaugaucuccugaaggugggcaucaaacaggaaauucuggacaaccccgucaauaccgagaugcucgagaacaucgugaagauucugacggucuucgaagauaaaagaaugaucaaggagcagcuucagcaauuuucugacgugcuggaugggguugugcucaagaaacuggaacgccggcacuacacaggauggggcagacuguccgccaagcuccucauggggauccgcgacaaacagagccaucugaccauucuggauuaucucaugaaugacgacggacugaaccggaaccuuaugcagcugaucaaugauucuaaccucuccuucaagagcauuaucgagaaagagcaggucaccacagcggacaaggauauucaauccaucguggccgaccuggcuggcucuccggccaucaagaaagggauucugcagagccuuaagaucguugaugaacucguguccgucaugggcuacccuccccagaccauugugguggagauggcuagagaaaaucagacaacgggaaaaggcaagaacaauucucggccucgcuacaaaagccuggagaaggccaucaaagaauuugggucccaaauucugaaggagcaccccaccgacaaccaggagcucagaaauaaccggcuguaucuuuacuaucugcagaauggaaaggauauguacacaggccaagaccucgauauccauaaccugagcaauuaugacaucgaucacauuguuccccagucuuucaucaccgacaacuccauugauaaucugguccuuacaagcucugcggggaacagagaaaaaggagacgacgugccuccgcucgagaucgugcgcaagcggaaagucuuuugggaaaagcuguaccagggcaaucugauguccaaaagaaaguucgauuaucucaccaaggccgagcgcgggggccugacggaagcugacaaagccagauuuauucaccggcagcuuguggagacccgccaaaucacaaagaacguugcuaacauucugcaucagagauucaauuacgagaaagaugaccacggaaacaccaugaaacaggugcggaucgucacacucaagagcgcccuggugucucaguuucgcaagcaauuccagcuguacaagguuagagaugugaaugacuaucaucacgcccacgaugcuuaccuuaacggcgucguggcgaauacccugcucaaaguuuauccccagcuggaaccugaguucguguacggggacuaucaucaguuugauugguucaaggccaacaaagcuacggccaagaaacaauuuuacacaaauaucaugcuuuucuuugcccagaaggaccggauuaucgaugaaaacggagagauucugugggacaagaaauaucuugacaccgucaagaaagugaugagcuaccgccagaugaauaucgugaagaaaacagaaauucaaaagggcgaguucuccaaggcuaccaucaaacccaaggggaacagcucuaaacugaucccuagaaagaccaauugggaucccaugaaauacggaggccucgacuccccgaacauggccuaugcggucguuauugaguacgcuaaggggaaaaauaagcugguguuugaaaagaaaaucauucgggugacaaucauggagcgcaaggccuucgaaaaagaugagaaggccuuucuggaggaacagggcuauagacagccuaaaguccuugcuaagcugcccaaguacacgcucuaugagugugaagagggacggagacgcaugcuggccagcgcgaacgaagcucagaaaggcaaucaacaggugcucccuaaccaccugguuacccuucugcaucacgccgccaacugcgagguguccgacgggaagucucucgauuacauugagagcaaucgggaaauguucgcugagcugcuggcccaugucuccgaauuugcuaaaagauauacacuugccgaggcgaaccugaauaagaucaaccagcucuuugaacagaauaaagagggagacaucaaggccauugcucaaucuuucguggaucugauggccuuuaacgcuaugggcgcccccgccagcuucaaguuuuucgagaccacaaucgaacgcaaacgguacaauaaccucaaggagcugcuuaauuccaccauuaucuaccagucuauuacggggcuguaugaaagcagaaaacgccuggacgauuga

SEQ ID NO: 3708 - RNA, 4038 nt, Artificial Sequence
  Cas9 variant
augaagaaacccuacagcaucggccuggacauugggaccaacuccgugggaugggccgucguuacagaugacuauaaggugccugcuaaaaagaugaaagugcucggcaauacggauaagucucacaucgagaagaaccugcuuggggcccuucucuucgacagcggaaauaccgcggaagauagacggcugaaacgcacagcuagacggcgcuacaccagacggcgcaaccggauucuuuaucugcaggagaucuuuuccgaagagaugggcaaggucgacgauucuuucuuucaucggcucgaagacagcuuccuggugacagaggauaaacgcggggagagacacccgauuuuuggaaaucuggaagaggaaguuaaguaccaugagaacuuccccaccaucuaucaccuccggcaauaccuggccgacaauccugagaaaguggaucuucgccuggucuaucucgcccuggcucauaucauuaaguuuagaggccacuuccuuaucgaaggcaaguuugacacacggaacaaugaugugcagcgccuguuccaggaguuucucgccguuuacgacaacaccuucgaaaauuccucucugcaggagcaaaacgugcaggucgaagagauucugacggacaaaaucagcaaguccgcuaaaaaggauagagugcucaaacuguuucccaaugaaaagagcaacgggcgguucgccgaguuccuuaaacugauugugggaaaucaggcggacuuuaagaagcacuucgagcucgaagagaaagccccucugcaguuuucuaaggauaccuacgaagaggagcuugaaguccugcucgcucaaaucggcgacaacuaugccgagcuguuccuguccgcuaaaaagcucuacgauagcauucugcuuucugggauccugacaguuaccgacgugggaacaaaagcgccccucuccgccagcaugauccagagauauaacgaacaucagauggaucuggcccagcuuaagcaauuuauucgccagaagcugucugacaaauacaaugagguguucuccgaugucagcaaggacggcuaugcuggguacaucgauggaaaaaccaaccaggaagccuuuuauaaguaccucaaaggccugcugaauaagauugagggcuccggguacuuccucgacaagaucgagcgggaagacuuucugagaaaacaacgcacguucgauaacggaucuauuccucaccagauccaucuucaggagaugcgggcuaucauuagacgccaggccgaauuuuauccguuccuggccgacaaucaagaucggaucgagaagcuccugacauuucgcauucccuacuaugugggcccucuggcuagagggaaaagcgacuucgcguggcuuuccagaaagagcgccgauaaaaucacccccuggaacuucgacgagauuguugauaaggaaucuuccgcugaggccuuuaucaauagaaugacaaacuacgaccucuaucugccuaaucagaaggugcugcccaaacacagccuccuguacgaaaaguucaccgucuauaacgagcuuaccaaagugaaguacaaaacagaacagggaaagacggccuuuuucgaugcuaauaugaaacaggagaucuuugacggcguuuucaagguguaccgcaaggucaccaaagauaagcugauggacuuucucgagaaagaguucgaugaauuucggauuguggaccugacagggcuggacaaggaaaacaaagucuucaaugccucuuauggaaccuaccacgaucuuugcaagauccucgacaaggauuuucuggacaacagcaaaaaugagaagauucuggaagauaucgugcucacacugacccuuuucgaggacagagagaugauucggaaacgccuggaaaacuauuccgaucuccugacgaaggagcaaguuaaaaagcuggaaagacggcauuacacaggcuggggcagacuuucugcggagcucauccacgggauucgcaacaaggaaagccggaaaaccauccuggacuaucugaucgaugacggaaauuccaacagaaauuuuaugcagcucauuaacgaugacgcucugagcuucaaggaggagaucgccaaagcccaggugauuggcgaaaccgauaaucuuaaccaggucgugucugacaucgcuggguccccggccauuaagaaaggaauccugcaaagccucaagaucguugacgagcuggugaagauuaugggccaucagccugaaaauaucgucguggagauggcucgcgagaaccaguucacaaaucaggggagacggaacucucaacagcgccugaaaggccuuaccgauuccauuaaggaauuuggaagccagauccucaaagagcaccccguggaaaauucccaacugcagaacgacagacuguuccucuacuaucugcagaauggccgggauauguacacaggggaggaacuugacauugauuaccugucucaguaugacaucgaucauaucauuccucaagccuuuaucaaggacaacagcauugauaaucgcguucucacguccucuaaagagaacagaggaaagagcgacgauguccccuccaaagacguggugcggaagaugaaaagcuacuggucuaaacugcuguccgcgaagcugaucacccagcgcaaauucgacaaccugacaaaggccgagagaggcgggcucaccgaugacgauaaagcuggauuuauuaagcggcagcuggucgaaacacgccagaucaccaagcacguggccagaauccucgacgagcgguucaauacggaaaccgaugagaacaauaaaaagauuagacaaguuaaaaucgugacacuuaagagcaaccuggucucuaauuuucgcaaagaguucgaacuguauaaggugcgggagauuaacgacuaccaccaugcucacgaugccuaucucaaugcgguuaucggcaaggcccugcuggggguguacccccagcuugaaccugaguuugucuauggcgacuacccgcauuuccacggacacaaagaaaacaaggcuaccgccaaaaaguuuuucuacuccaauauuaugaacuucuuuaaaaaggaugacgugagaacagauaagaauggcgagaucauuuggaaaaaggacgaacauaucagcaacaucaaaaagguucugucuuauccccaggugaauauugucaaaaagguggaggagcagaccgggggauucagcaaggaauccauccucccuaaaggcaacagcgauaagcugauuccccgcaaaacgaagaaauuuuacugggacacaaagaaauaugggggauucgacucuccuaucguggcuuacuccauucucgucaucgccgauaucgagaagggcaagagcaaaaagcugaaaaccguuaaggcccuugugggggugacaauuauggaaaagaugaccuuugagcgggaccccgucgcuuuccuggagagaaagggcuaucgcaaugugcaagaagagaacaucauuaagcucccgaaauacucccuguuuaagcuggaaaacggacggaaaagacuucuggcgucugcccgcgagcuccagaagggcaaugaaaucguucugccuaaccaccucgggacccugcuuuaucaugcuaaaaauauucacaagguggaugagcccaagcaucuggacuacgucgauaaacacaaggacgaguucaaagaacugcucgaugugguuagcaacuuuuccaagaaauacacacuggccgagggaaaucuugaaaagaucaaggagcuguaugcccagaacaauggcgaagaccucaaagagcuggcuucuagcuucaucaaccuccugacguuuaccgccauuggggcgccugcuacauucaaguuuuucgauaaaaauaucgaccggaagagauacaccuccacaaccgagauucuuaacgccacgcugauccaccaaucuauuacaggacuguaugaaacccggaucgaucucaauaaacugggcggggacuga

SEQ ID NO: 3709 - RNA, 3171 nt, Artificial Sequence
  Cas9 variant
augcagaccacaaaccugagcuacauccucggccuggaccuugggauugccuccgugggaugggcugucguugagaucaaugaaaacgaggaucccauuggccugaucgacgugggggugagaauuuucgaacgggccgaggucccuaagacgggagaaucucucgcgcugagccgcagacuugcucgguccacccgcagacugauccggcgcagagcccaccggcuccugcuggccaaacgcuuucucaagagagagggcauccugucuacaauugaucuugagaaagggcugccgaaucaggcuugggaacuccggguggccggacuggagcgcagacuuagcgcuaucgaauggggcgccguucugcuccaucugauuaagcaccggggcuaucuguccaaacgcaagaacgagucucagaccaauaacaaggagcucggggcgcugcuuagcggaguggcccagaaucaucagcugcuccaauccgacgauuacagaacacccgcugaacuggcccuuaaaaaguucgcuaaagaggaaggccacauccggaaccagagaggggccuauacccauacauuuaaucgccuggaccuccuggcggagcugaaccuccuguucgcccagcagcaccaauuuggaaauccucacugcaaggaacauauucagcaguacaugaccgagcuucugauguggcagaaacccgcucucagcggcgaggccauccugaagaugcuugggaaguguacgcacgaaaagaacgaguucaaagcugccaaacauaccuauucugccgaacgguuugucuggcugacaaagcucaauaaccugcgcauucuggaggauggagcugaaagagcgcucaaugaggaggaacggcaacugcuuaucaaccacccuuacgagaaauccaagcugaccuaugcccaggugagaaaacuccugggccugagcgaacaggcuaucuucaagcaccuucgcuacucuaaggagaacgccgaauccgccacauuuauggagcucaaggcuuggcaugccauucggaaagcgcuggagaaucaaggccugaaagacaccuggcaggaucucgcuaagaaacccgaccugcuugaugaaaucgggacggccuucagccuguacaagacagacgaggauauucagcaguaucucaccaacaagguuccuaauucugugaucaacgcccugcuggucucccuuaauuuugacaaauucauugaacucagccugaagucccugagaaaaauccucccgcugauggagcaaggaaagcgcuacgaccaggcuugccgggagaucuauggccaccauuacggggaagccaaccagaaaacaucucagcuucugcccgcuauuccugcccaagagaucagaaaucccguggugcuccgcacccugagccaggcgcggaaggucauuaacgccaucauuagacaguauggauccccugcucggguucacaucgaaaccggccgcgagcuggggaaguccuuuaaagaaagacgggagauccagaagcaacaggaggauaauagaacaaaacgcgaaucugccgugcagaaguucaaagagcuuuucuccgacuuuagcucugaacccaagagcaaggauauucucaaauuccggcuguacgagcagcaacauggaaagugucuguauuccggcaaagaaaucaacauucacagacucaaugagaagggcuacguggagaucgaccacgcucugccguuuucucgcacgugggaugacagcuucaacaauaaaguccuugugcuggccuccgaaaaccagaauaaggggaaccagaccccuuacgaguggcuccaaggaaaaauuaacagcgaaagauggaagaauuuuguugcgcuggugcugggcucucagugcuccgccgcuaagaaacagcggcuucucacacaggucaucgaugacaacaaguucauugaucgcaaucugaacgacaccagauauaucgcccgguuucugagcaauuacauccaagagaaccuccugcuuguggggaaaaauaagaaaaacguuuucacacccaauggacagauuaccgcucugcuccgcucuagauggggccugaucaaggcccgggaaaacaauaaccgccaucacgcccuggaugcuauuguggucgcgugugccacgccuuccaugcagcagaagaucacaagauuuauucgguucaaagaggugcaucccuauaagaucgagaaucgcuacgaaauggucgaccaagagagcggggaaaucauuagcccccacuuuccugagccgugggcuuauuucagacaggaggugaacauccggguuuuugacaaucaccccgauaccgugcuuaaagaaaugcugccugacagaccccaggccaaccaucaguucguccaaccucucuucgugucucgcgcccccacccggaagaugagcggccagggacacauggagacaauuaaauccgcuaagagacuggccgaaggcaucucuguucuccgcauuccgcugacccagcuuaagccuaaccugcucgagaauauggugaacaaagaacgggagcccgcgcuguacgcugggcugaaggccagacuugccgaguuuaaucaagauccugcuaaagccuucgcgacacccuuuuauaagcagggaggccagcaggucaaagcuauccgcguggaacaagugcaaaagagcgggguucugguccgggagaacaauggaguggccgacaacgccuccaucgugagaacggaugucuucauuaagaauaacaaauuuuuccucgugccuaucuacaccuggcagguugcuaagggcauucugcccaauaaagccaucguggcucauaagaacgaagacgagugggaagagauggaugagggggccaaauuuaaguucagccucuuuccgaaugaccuggucgaacuuaaaacaaagaaggaguacuucuuuggcuauuacauuggacuggaucgcgcgaccggcaacaucucucucaaagaacacgacggggagaucuccaagggaaaagauggcguguaucggguuggggugaagcuggcccugagcuucgaaaaauaccaggucgacgagcuuggaaagaauagacaaauuugccggccucagcagcgccagcccgugagauga

SEQ ID NO: 3710 - RNA, 3249 nt, Artificial Sequence
  Cas9 variant
auggccgcuuucaagcccaacccuaucaauuacauucugggccucgacaucgggauugccagcgugggaugggcgauggucgagaucgaugaagacgagaacccgauuugccugaucgaucuuggcguuagaguguuugaacgggcugaggugcccaaaaccggggacucccuggccauggcccgcagacucgcucggucuguccgcagacugacacggcgcagagcccaccggcuucugcgcgcuagacggcuccugaagcgcgaaggagugcugcaggccgcggauuucgacgagaauggccucaucaaaagccugccuaacacgcccuggcaacuuagagccgcugcccuggaucggaagcucaccccucuggagugguccgcuguucuucugcaucucauuaaacaccgcggguaucugucucagagaaagaaugaaggagagacagccgacaaggaacugggcgcgcuccugaaaggcguggccgauaacgcucaugcccuucagaccggggacuuucggacacccgcugagcuggcccucaauaaguucgagaaagaaagcggacacaucagaaaccagcgcggcgauuacucccauaccuuuucucggaaggaccugcaagccgagcuuauucuccuguucgaaaaacagaaggaguuugggaauccucacgucagcggaggccugaaggaagggaucgagacacugcucaugacccagagaccggcucuguccggagaugcggugcagaaaaugcuuggccacuguacguucgagcccgccgaaccuaaggcugccaaaaacaccuauacagccgagcgcuuuauuuggcugaccaagcucaauaaccugcggauccuugaacaaggcagcgagagaccccugacagacaccgaacgcgcuacgcucauggacgagccuuaccggaaaucuaagcugacauaugcccaggcgagaaaacugcucgggcuggaggauaccgcuuucuuuaagggacuucgcuacggcaaggacaaugccgaagccuccacacugauggagaugaaggcuuaucaugccauuagccgggcucucgaaaaagaggggcugaaagauaagaaaucuccccugaaccuuuccccggaacuccaggacgagaucggaaccgccuucagccuguuuaagaccgaugaggacaucacaggcagacugaaggaucgcauucagccugaaauccucgaggcgcugcuuaaacacauuucuuucgacaaguucguucaaaucucccugaaagcccuccggagaauugugccccugauggaacaggggaagcgguacgaugaggcuugcgccgagaucuacggagaccauuauggcaaaaagaauacggaagagaagaucuaccugccucccauucccgcugaugaaauccgcaacccugucgugcuuagagcccucagccaggcgcggaaagugauuaacggcgucguuagacgcuauggguccccggcccggauccacauugagaccgcuagagaagugggaaagucuuuuaaagaccgcaaggagaucgagaaaagacaagaagagaaucggaaggaccgcgaaaaggccgcugccaaauucagagaguacuuucccaacuucgugggcgaaccuaagagcaaagauauccugaagcugcggcucuaugagcagcagcacgggaaaugucuguacuccggaaaggagauuaaucuuggccgccugaacgaaaaaggguaugucgagaucgaccaugcccuccccuuuagcagaacaugggaugacucuuucaauaacaaggugcugguucugggcuccgaaaaucagaacaagggaaaucaaaccccuuacgaguacuuuaacggcaaagauaauagccgggaauggcaggaguucaaggcucgcguggagacaucuagauuuccccggagcaaaaagcagcgcauucuucuccagaaauucgacgaagauggguuuaaggagagaaaccugaaugacacccgguaugucaacagauuccugugccaauuuguggcggaucgcaugcggcucacgggaaagggcaaaaagagaguuuucgccuccaaugggcagaucacaaaccugcuucgcggauucuggggccugcggaaagugagagcugaaaacgaccgccaccaugcccucgaugccgucguggucgcuuguucuaccguggccaugcagcagaagauuacccgguuuguuagauacaaagagaugaaugcguucgacgggaagacaaucgauaaggagaccggcgaagugcugcaccagaaaacacauuuuccgcagccuugggaguucuuugcucaggaagucaugauucgcguguucggaaagcccgacggcaaaccugaguuugaagaggccgacacgcccgagaagcugcggacccuucucgccgaaaaacugagcuccagaccugaggcuguucacgaauaugugacaccccuguucgucagccgggccccgaaccgcaagaugucugggcagggacacauggagaccgugaaguccgcgaaaagacucgaugaaggcgugagcguucugcgggucccucuuacacaacugaagcucaaagaccuggagaagauggugaaucgcgagagagaacccaaacuguacgaggcucuuaaggcccggcuggaagcccauaaagaugaccccgcuaaggccuuugcugagccuuucuauaaguacgauaaagccgggaacagaacccaacaggugaaggcgguccgcguggaacaaguucagaaaacgggaguguggguccggaaucacaacggcaucgccgacaaugcuaccauggugagaguugauguguuugagaagggggacaaauauuaccucgucccgaucuacucuuggcaaguggccaagggcauucugcccgaucgcgcuguugugcagggaaaggacgaggaagauuggcagcucaucgacgauuccuucaacuuuaaauucagccugcauccuaaugaccuugucgaggugauuacaaagaaagcccggauguucggcuauuuugccuccugccacagagggaccggaaacaucaauauucgcauccacgaccuggaucauaagaucggcaaaaacgggauucucgaaggaaucggcgugaagacagcucugucuuuccagaaguaccagauugacgagcuggggaaagagauccggcccuguagacuuaagaaacgcccucccgucagauga

SEQ ID NO: 3711 - RNA, 3255 nt, Artificial Sequence
  Cas9 variant
augaaguaccacgugggcaucgacgucgggaccuucagcguuggacuggccgcuauugagguggaugacgccggcaugcccaucaaaacacucucccuggugucucauauucacgauagcgggcuugacccugaugaaaucaaguccgcggucacgagacuggcuucuagcggaauugcccggcgcaccagacggcucuaucgcagaaaacggcgcagacugcagcaacuugacaaguuuauccagcggcagggcuggccggugaucgagcuggaagauuacuccgacccccucuauccuuggaaaguucgcgccgagcuggcugccucuuacauugcugaugaaaaggagagaggggagaagcugagcguggcccuccggcauaucgcgcgccacagaggauggcggaaccccuaugccaaagucuccagccuguaccuuccugacggccccucugaugcuuucaaggccauucgcgaagagaucaaaagagcuuccggccagccugugccggaaacagccaccguugggcaaauggugacacugugcgagcucggaacccugaaacuucggggcgaagggggaguccugagcgcgagacuccagcagucugacuaugcccgcgaaauucaggagaucugucggaugcaagaaauuggccaggagcuguacagaaaaaucaucgaugugguguuugcugccgaaucccccaaggggagcgcuucuucccgcgucggaaaggacccucugcagcccggcaaaaaucgggcccucaaggccagcgacgcuuuccagagauaccgcauugcggcccugaucggcaaccuucggguuagaguggauggggagaaacgcauucuguccguggaggaaaagaaucucgucuuugaccaucuggugaaccuuacaccuaaaaaggagcccgaauggguuaccaucgcugagauucugggaaucgaucggggccaacucaucgggacggccaccaugacagacgauggagaaagagccggcgcucgcccgccuacccacgacacaaaucggucuauugugaacagcagaaucgcuccccuggucgauugguggaaaaccgcguccgcucuggagcagcacgccauggugaaggcccucagcaaugcugagguugacgauuucgacucuccugaaggggccaaggugcaggccuuuuucgccgaucuggacgacgauguccaugcgaaacuugacucccugcaccuccccgugggacgggccgcuuauagcgaggauacgcugguccgccuuacaagacggaugcugucugacggcguggaucucuacaccgccagacugcaagaauuuggcauugagcccagcuggacaccuccgacaccccgcaucggggaaccuguuggaaaccccgcuguggaccggguccugaagaccguguccagauggcucgagucugccaccaaaacguggggcgcgccugagcgcguuauuaucgaacaugugagagagggguucgucaccgaaaagcgggcccgcgagauggauggagacaugagacggcgcgcugccagaaaugcuaaacuguuucaggagaugcaggaaaaacuuaacgugcagggcaagcccagccgggccgaucuguggcgcuaucaauccgugcagagacagaauugccagugugccuacugcgggagcccgaucacauucucuaacuccgagauggaccacauuguuccucgggcuggccaaggaagcaccaauacacgcgaaaaccucgucgcggugugucacagaugcaaucagucuaaaggcaacacccccuuugccaucugggcuaagaacacguccauugagggggugagcgucaaagaagccguggagcggacaagacauuggguuaccgauaccggaaugcgcuccacagacuucaagaaauucaccaaggccguggucgagcgguuucagagagcuacaauggaugaagagaucgacgcccgcucuauggaaagcguggcguggauggcuaaugagcugcgguccagaguugcccagcacuucgccucucauggcacgaccgugcgcgucuaucgggggagccugacagcugaagccagacgcgcguccggaauuagcggcaaacuuaaguuuuucgacggggugggcaagucucggcucgauagacggcaccaugcuaucgacgccgccguuauugcuuuuaccuccgauuacguggccgagacacuggcuguccgcagcaaccugaaacaaucucaggcccacagacaggaggcgccucaguggcgggaguucaccggaaaggacgccgagcaccgcgcugccuggagaguguggugucaaaagauggaaaagcucuccgcucugcuuacggaggaucugcgggacgauagaguggucguuaugagcaaugugcgccuccggcugggcaacgggucugcccauaaggaaaccaucggaaaacugagcaaggugaaacuuuccagccagcucucugucuccgacaucgauaaggccagcuccgaggcucuguggugcgcgcugacaagagagcccggcuuugacccuaaagaagggcuccccgccaauccggagcgccacauucgggugaacggaacccauguuuaugcuggcgauaauaucgggcuguucccugugucugccggcagcauugcccuuagaggaggcuacgcugaacugggguccucuuuucaccacgcccgcgucuacaagaucacaagcggaaagaagcccgcguucgcuaugcuccggguguauaccauugaccugcugcccuacagaaaccaggaucucuuuuccguugagcuuaagccucaaacgaugucuaugcgccaggccgagaaaaagcugagagacgcccuggcuacaggcaaugccgaauaucucggguggcugguggucgacgaugagcuugugguugacaccagcaaaaucgcgacagaucaggugaaggcugucgaagccgagcugggaaccauccggcgcuggagaguggacggcuucuuuuccccgagcaaacuccggcugcgcccccugcagaugucuaaggaagggauuaagaaagaguccgccccugagcuuagcaagaucauugauagacccggcuggcucccugcugugaacaaacuguucucugacggaaaugucaccguugugcggagagauucccugggccgcgugcggcucgaaagcacagcccaucugcccgucacguggaaggugcaauga

SEQ ID NO: 3712 - RNA, 2955 nt, Artificial Sequence
  Cas9 variant
auggccagaauccuggcuuucgacauuggcaucagcuccauugggugggccuuuucugagaacgaugaacucaaggacugcggagugcggaucuucaccaaagucgagaaucccaagacaggcgaaagccuggcgcuuccucgcagacuggcucgguccgcccgcaaaagacucgcccggcgcaaggcuagacugaaccaccuuaaacaucugauugccaaugaguuuaagcucaacuacgaagauuaucagucuuucgacgagagccuggcuaaggccuacaaagggucccugaucucuccguaugagcuccgguuucgcgcgcugaaugaacuucugagcaagcaagauuucgccagaguuauccuccacauugcuaaacggcgcggauacgacgauaucaagaacuccgacgauaaagagaagggcgccauucugaaggcuaucaaacagaaugaagagaaacuugccaacuaucagagcgugggggaguaccuguauaaagaauacuuucagaaguucaaagaaaauucuaaggaauuuacgaacgugagaaauaaaaaggaguccuacgaacgguguauugcgcagagcuuccucaaggacgagcugaaacugaucuuuaagaaacaacgcgaguucggauuuucuuucuccaagaaauucgaagaggaaguccucagcguggccuuuuauaagagagcucugaaggauuucucucaucuuguuggcaacugcuccuuuuucaccgacgagaaacgggcccccaagaauagcccucuggcuuuuauguucguggcccucacaagaauuaucaaccugcuuaauaaccugaaaaacaccgaaggcauccucuacacaaaggaugaccugaaugcccugcucaacgagguccugaaaaaugggacccuuacauauaagcagaccaagaaacugcucggacuguccgacgauuacgaguuuaagggcgaaaaagggacguauuucauugaguuuaagaaauacaaggaguucaucaaggcucuuggagagcacaaccugucucaggacgaucucaaugaaauugcgaaagacaucacccugauuaaggaugagaucaaacugaagaaagcccucgcuaaguaugaccugaaccaaaaucagaucgauagccuuuccaaacuggaguuuaaggaccaucucaacauuagcuucaaggcccugaaacuggugacaccccuuaugcucgaaggcaagaaauacgaugaggccuguaaugaacugaaccugaagguugcuaucaaugaggacaaaaaggauuuucucccugccuucaacgagaccuacuauaaggacgaagugacaaaucccgucgugcugcgcgcgauuaaagaguaccggaaggugcuuaacgcucugcucaaaaaguaugggaaaguccacaagaucaauauugaacuggccagagagguuggaaagaaccacucucagcgcgccaaaaucgaaaaggagcagaacgagaauuacaaagcuaagaaagacgccgaacuggagugcgaaaaacuuggccucaagaucaacuccaaaaauauucugaagcugagacucuucaaagagcaaaaggaauuuugugcuuauagcggcgagaaaaucaagauuucugaucugcaggacgagaaaaugcuugaaaucgaucauauuuacccuuauagccgguccuucgacgauucuuacaugaacaaggugcugguguuuaccaagcagaaucaagagaaacucaaccagacgccguucgaagccuuugggaaugacagcgcgaaguggcagaaaaucgagguccuggccaagaaccugcccacaaagaagcagaagcgcauucuugauaaaaauuacaaggacaaagaacaaaagaacuucaaagaucggaaucucaacgacaccagauauaucgcucgccuggugcugaauuacacaaaggauuaucucgacuuucugccucuuuccgaugacgagaacaccaagcugaaugacacccagaaaggaagcaagguucacguggaggccaaaucuggcaugcucacauccgcucugcggcauacguggggguucagcgccaaggauagaaacaaccaucugcaccacgcgaucgacgccgucauuaucgcuuacgccaauaacucuauugugaaggcuuuuuccgauuucaagaaggaacaggagagcaauuccgccgaacuuuaugccaaaaagaucucugagcucgacuacaaaaacaagcgcaaauuuuucgagcccuuuagcggauuccggcagaagguucuggauaagauugacgaaaucuucguguccaaaccugagagaaagaaacccucuggcgcucugcacgaagagaccuuucggaaggaagaggaguucuaucaaagcuacgggggaaaagaaggcguccucaaggcgcuggagcuuggcaaaauccgcaaggugaaugggaagauugucaaaaacggagauauguuuagaguggacaucuucaagcauaaaaagacaaauaaauuuuacgccguuccgauuuauaccauggauuucgcucugaaggugcucccuaacaaggccgucgcccgguccaaaaagggcgaaaucaaagacuggauucugauggaugagaauuacgaauuuugcuucagccuguauaaggacucucuuauccugauccagacaaaagauaugcaggagcccgaguuuguguacuauaacgcuuucaccuccagcacgguuucucucauuguguccaagcacgacaauaaguuugaaacacugagcaaaaaccagaagauccucuucaaaaaugccaacgagaaggaagucauugcgaaaucuaucgggauucaaaaucugaagguguucgagaaguacaucgugagcgcucuuggagaaguuaccaaagccgaguuuagacagcgcgaggacuucaagaaauga

SEQ ID NO: 3713 - RNA, 3366 nt, Artificial Sequence
  Cas9 variant
augagcgaccuggugcucggccuggauaucgggauuggauccgucggcguugggauccuuaacaaggugaccggagagauuauccacaaaaauucuagaauuuuccccgccgcucaggccgaaaacaaucuggugcggcgcacaaacagacaaggccggcgccucgcgagacggaagaaacaucgcagaguccggcugaaucgccuuuuugaggaaagcgggcugaucacggacuucaccaagaucuccauuaaccucaauccuuaccagcugagagugaaaggacugacagaugagcucucuaacgaggagcuguuuaucgcucuuaagaauaugguuaagcaccggggcauuagcuaucuggacgaugccuccgacgauggcaacucuagcgugggggacuacgcccagaucgucaaagaaaauuccaagcagcucgaaaccaaaacaccgggacaaauucagcuggagcgcuaucagaccuacggccagcuuagaggggauuucacaguggaaaaggacggaaagaagcaucggcugaucaacguuuuucccaccagcgcuuaucgcucugaggcccuccggauucugcaaacgcagcaggaguucaauccucagaucaccgaugaauuuaucaacagauaccuggagauucucacaggcaagagaaaauauuaccacgggcccggaaaugaaaagucccgcaccgacuacggccgguauagaacaagcggcgagacccuggauaacaucuucgggauucuuaucggaaaaugcacguuuuacccugacgaguuccgcgcugccaaggcgucuuauacagcccaagaauuuaaccugcucaaugaccugaacaaucuuaccgugcccacagagaccaaaaagcuguccaaagaacagaagaaccagauuaucaauuacgucaagaacgagaaagcuaugggcccugccaaacucuucaaauauaucgcuaagcugcugagcugugauguggccgacauuaaaggguaccggaucgauaagucuggaaaggcggaaauucauaccuuugaggccuauagaaaaaugaagacacucgaaacgcuggacaucgagcaaauggaucgcgagacccuugacaaacuggcuuacgugcucacacugaauaccgaacgggagggcauucaggaagcccuugagcacgaguucgcugauggguccuucagccagaagcaggucgacgaacugguucaauuuagaaaagccaacuccucuaucuucggaaagggcuggcacaauuuuagcgugaagcucaugauggagcugaucccggaacuguacgagacauccgaggaacagaugaccauucucacgcgccugggcaaacagaagacaaccucuagcuccaacaaaaccaaguauaucgaugagaaacuucugacagaagagauuuacaaucccguggucgccaagagcgugcggcaggcuaucaagauuguuaacgcggccaucaaagaauauggggacuucgauaauauugugaucgagauggcuagagaaaccaacgaggacgacgagaagaaagccauccaaaagauucagaaagccaauaaggaugaaaaagacgcugccaugcucaaggcggcuaaccaguacaacggaaaggccgagcugccucauucugucuuucacggccauaaacagcuggccacaaagauccgccuuuggcaccaacagggggaacggugccucuauacgggaaaaaccauuagcauccacgaucugauuaauaacuccaaucaguucgagguggaccauauccugccccucucuaucacauuugaugacagccuggcuaacaagguucuuguguacgccaccgcuaaucaggaaaaaggccaaagaacaccuuaucaggcccuggauuccauggacgaugcguggagcuuccgggagcucaaggccuuuguccgcgagucuaagacccuguccaacaaaaagaaagaauaccugcuuacggaggaagacauuagcaaguucgaugugcggaaaaaguuuaucgagagaaaucucgucgacaccagauacgcuucucgcgugguucugaacgcccugcaggaacacuuccgggcucauaagauugauacaaaaguguccgucgugagagggcaauuuaccagccagcuccgcagacacuggggcaucgagaagacacgggacaccuaucaucaccacgccguugacgcgcugauuaucgccgcuuccucucagcuuaaucuguggaaaaagcagaaaaacacgcucgugagcuacuccgaggaucaacugcuggacaucgaaacaggagagcuuauuucugaugacgaauauaaggagagcgucuucaaggcccccuaccagcauuucguggauacccucaaauccaaggaguuugaagacagcauccuguucucuuaucagguggauuccaaauuuaaucgcaagauuagcgacgcuacaaucuacgccaccagacaggccaaaguuggcaaggauaaagcugacgagaccuauguccuggggaagauuaaggauaucuacacacaagacggauacgaugcguucaugaaaaucuauaagaaagacaagucuaaauuucucauguaccggcacgacccgcagacguucgaaaaggugauugagccuauccuggaaaacuaucccaauaagcagauuaacgagaaaggcaaggaggugccuuguaaucccuuucuuaaauacaaggaggaacauggguauauccgcaaauacuccaagaagggaaacggccccgaaauuaaaagccugaaguauuacgauucuaaacucgggaaccacaucgacauuaccccuaaggauagcaauaacaaagucgugcugcaguccguuagcccguggagagccgacguguacuucaauaagacaaccggcaaguaugagauccugggacuuaaauacgcugaucuccaauuugaaaagggcacagggaccuauaaaaucucucaggagaaguacaacgacauuaaaaagaaggagggagucgauuccgacagcgaguucaaauuuacgcuguauaagaaugaucugcuccuggugaaagacacagaaaccaaggaacagcaacuuuuccgguuucugucccgcaccaugcccaaacagaagcacuacguugagcucaaaccuuaugauaagcagaaguucgaaggcggggaggcccugaucaaagugcugggaaacgucgccaauucuggccagugcaagaaagggcuuggcaagagcaacauuuccaucuacaaagugagaacagacguucugggaaaucaacauauuaucaagaacgagggcgacaagcccaaacucgauuucuga

SEQ ID NO: 3714 - RNA, 2556 nt, Artificial Sequence
  Cas9 variant
augaccaacggcaagauccuggggcucgacauuggaguggccagcgucggcguugggaucauugaggcuaaaacaggaaaggugauccacgccaauuccagacuguucucugcggcuaacgccgaaaauaacgccgagcggcgcggcuuuagaggggcucggcgccuuacgagacggaaaaagcaucgcgugaaaagaguccgggaucuguucgaaaaguacgacauucucaccgauuuucgcaaucugaaccuuaaucccuaugagcugagagugaagggacucacagaacagcugaccaacgaggagcuguucgccgcucuccggacaaucgccaaacgcagaggcaucagcuaccuggacgaugcggaagacgauuccaccggcucuagcgacuaugccaaguccauugaugagaaucggcgccuucugaaaucuaugacaccugggcaaauccagcucgaaagacuggagaaguacggacagcuucggggcaacuuuaccguuuaugacgagaauggggaagcucacagacugauuaacguguucagcacguccgauuacaaaaaugaggcccgcaagauccucgaaacccagagcaacuauaauaagcaaauuacagacgaguuuaucgaagauuacauugagauccugacccagaaacggaaguacuaucauggaccgggcaacgagaaaucuagaacagacuacgggcgcuuccggaccgacggaacgacacuggaaaacaucuuuggcauucucaucggcaagugcuccuucuaucccgaggaauacagagcuagcaaagccucuuauaccgcgcaggaguuuaauuuccugaacgaucuuaauaaccugaaggucccuacagaaaccgggaaacucuccaccgagcagaaggaguaccuggugaauuuugccaagaacagcaaaacacuuggagcuucuaagcugcucaaagaaauugccaagcugguugacggcgaugugaaagacaucuccggguaucgcgaggauagcaagggaaagcccgaccugcacacguucgaaccuuaccggaaacucaaguucaaucugaccacagucgauauugacaaccuuuccagagauauccuggacaaacucgcugauauccugacccuuaauacagagcgcgaaggcauugaggacgccaucaaccaaaaucugcccgagcaguuuaccaaggaacagauuucugagaucgugcagauucggaaaagccaauccagcgccuucaacaagggguggcauucuuuuuccgcuaagcucaugaaugaacugaucccugagcuguacgcgacgagcgaggaacagaugacaauccucaccagacuggagaaauucaaggccaccaaaaagucuagcaaaaacacaaagaccauugacgaaaaggagaucacagaugaaauuuauaauccgguggucgcuaaauccguucgccagacgaucaagauuaucaacgccgccgugaaaaaguacggagacuuugauaaaauugugaucgagaugccccgggacaagaacgcugaugacgagaaaaaguucaucgauaagaaaaauaaggaaaacaaaaaggagaaagacgauucucuuaagagagccgcguaucuguacaauggcaccgacaagcucccugaugacgucuuucacggcaacaaacaacuggcuacaaagauucggcugugguaucagcagggggaacgcugucuuuacagcggaaaacccauccucauucaggaucuggugcacaauuccaacaauuucgagaucgaccauauucugccucucagccugucuuuugacgauucccuugccaacaagguucugguguaugccugggcuaaucaagaaaaagagcagaagacccccuaccaggucaucgacagcauggaugccgcuuggucuuucagagagaugaaggacuacgugcucaaacagaagggcaucgggaaaaagaaacgggaauaucugcugacaaccgagaacauugauaagaucgaaguuaagaaaaaguuuauugagagaaaucuuguggacacgcgcuacgccucccgggucgugcucaacagccugcaaaccgcgcugaaagaacucggaaaggauacaaaagucuccgugguuagaggccaguucaccucucagcugcgcagaaaguggaaaaucgacaagagccgggagacauaucaccaucacgccguggaugcucuuauuaucgccgcuuccucucagcugaagcucuggcaaaaacacgagaaucugauguuugaaaacuacggggagaaucaggucgugaacaaggaaaccggcgagauccugagcauuuccgacgaugaguauaaagaaagcguuuuccagccgccuuaccagggauucgugaacacgaucucuuccaaggccuuugaggacgaaauucuuuucagcuaucaagucgauucuaaauuuaaucgcaagguguccgacgcgacaaucuacagcaccagaaaggccaaacucggcaaggacaaaaaggaggaaacauacgugcuggggaaauga

SEQ ID NO: 3715 - RNA, 2598 nt, Artificial Sequence
  Cas9 variant
augagacacaagaucggccuggacauugggaucaccagcgugggaugggccgucauuaaccucgauaucccccggauugaggaccugggcguucgcaucuucgauagagcugaaaauccucagacaggggagucccuugcccugccgcggcgccucgcgagaucugcucggcgcagacugcggcgcagaaaacaucggcuugaacgcaucagacggcugcucauucgcgagggaauccugacgaaggaggaacuggacaaacucuuugaggaaaagcacgagauugauguguggcaacugagaguggaagcccuugaccggaaacugaacaaugaugagcucgccagaguccugcuucaucuggcuaagcgccggggcuucaagagcaacagaaaauccgagcgcaauaacaaggaaaauucuaccaugcucaaacacaucgaggaaaaccgggcccugcugagcggguacagaacaguggcugagaugauuguuaaggaccccaaauuugccuuccauaagcgcaauaagggagaaaacuauaccaauacaaucgcgcgggaugaccucgagagagagauuaaacugaucuuuaccaagcagcgcgaauacggcaacaucgugugcacagagaccuucgaaaaugaguauauuaugaucugggccucccagcggccuuuugcuucuaaaaacgauauugaaaagaaagucggcuucuguacguuugagcccaaggagaaaagagccccuaaggcuaccuacacauuccagagcuuuguggccugggaacacaucaauaagcugcgccugguuuaucccaccgggacacggggacucaccgacgaggaaagacggcugcuuuacaaacaagcguuccacaagaacaaaauuacguaucaugauauccgcacacugcuccaccuuccugacgacaccuacuuuaagggcaucguguacgauagaggggccccgcugaaacaguccgagacaauucgguuccucgaacuggacgcuuaucaucagaucagaaaggccgucgauaagguguacggaaaaggcaagucuagcuccuuccuucccauugacuuugauaccuucggguaugcucugacccucuuuaaagacgaugccgacauccgcagcuaccugcggaacgaguaugagcagaauggaaagagaaugccuaaccuugccaauaaaguguacgauaacgaacccauugaggaacugcucaaucugucuuucacaaaguuuggccaccugucccucaaggcucugcgcaacauccuuccuuauauggagcaaggcgaggucuacagcguugcgugcgaaagagccggguacacguucaccggacccaaaaagaaacagaagacacugcuccugccgaauaucccucccauugcuaacccuguggugaugcgggcccugacccaggcccgcaaagucgugaaugcuaucauuaagaaguauggcucucccguuuccauccacauugagcuugccagagaccucagccagacauuugaugaacggcgcaaaaccaagagagagcaagacgaaaaccggaaaaagaaugagacggcgauccgccagcugauggaguacgggcugacaauuaaccccaccggacaugacaucgugaaauucaagcucugguccgaacagaauggcagaugugcuuauucucugcaaccuaucgagauugaacggcuucuggagccgggguacgucgaaguggaucacguuauccccuauagccgcucccucgacgauagcuacaccaacaaagugcugguccugacaaaggagaauagagagaagggaaaccggauuccugccgaauaucuuggcgugggcaccgagagauggcagcaguuuaaaacauucguccucacgaacaagcaguuuucuaaaaagaaacgcgaccggcugcugagacuccauuacgaugaaaaugaggaagccgaguggaagaaccgcaaucugaacgacacccgguacaucuccagauucuuugcuaauuucauucgcgagcaccuuaaguucgccgaaagcgaugacaaacaaaagguguauacaguuaacgggcgggugaccgcucaucugagaucucgcugggauuuuaauaaaaaccgggaggaaagcgaccuccaccacgccgucgaugcggccaucguggcuugcacaucccccucugacaucgccagaguuaccgcuuucuaccagcggcgcgagcaguguaaggagagcgccaaaaaggcggaaccucauuuuccccagccguggccucacuucgccgaugagcugagagcucggcuguccaagaaucccaaagaaagcauuaaggcccuuaaccucggaaauuaugacgaccaaaaacuggagucucugcagccuguguuugucucccgcaugcccaagagaagcgugacgggcgcugcccaucaggaaacccuccggagauacaucgggauugaugagcgcucuggaaaaauccagacagugguuaagaccaagcuguccgagauuaaacuugacgaaacaggccacuucccuauguaugggaaggagagcgaucccccggccuccgcuuga

SEQ ID NO: 3716 - RNA, 2886 nt, Artificial Sequence
  Cas9 variant
auggccagaauccuggcuuucgacauuggcaucagcuccauugggugggccuuuucugagaacgaugaacucaaggacugcggagugcggaucuucaccaaagcggagaaucccaagacaggcgaaagccuggcccuuccucgcagacuggcucgguccgcccgcaaaagacucgcucggcgcaaggccagacugaaccaccuuaaacaucugauugcuaaugaguuuaagcucaacuacgaagauuaucagucuuucgacgagagccuggccaaggcguacaaagggucccugaucucuccguaugagcuccgguuucgcgcccugaaugaacuucugagcaagcaagauuucgcuagagucauccuccacauugccaaacggcgcggauacgacgauaucaagaacaauggcgacgaggaaaaagggaagauucugaaggcuaucaaacagaacgaggagaaacuuguuaauuaucaguccgugggagaauaccuguauaaagaguacuuucagaaguucaaagaaaacagcaaggaguuuauuaaugugagaaacaaaaaggaaucuuacgagcgguguaucacgcaauccuuccucaaguaugagcugaaacugauuuuucagaagcagcgcgaauuuggcuuuagcuucucuaaaaaguucgaggaagagguccucuccguggccuuuuacaaaagagcgcugaaggauuucagccaucuuguuggcaauugcucuuucuucuccgacgaaaagcgggcccccaaaaacagcccucuggcuuuuauguucguggcccucaccagaaucaucaaucugcuuaacaaccugaagaauacagaggggauucucuauaccaaagaugaccugaacgcucugcucaaugagguccugaagaacggaacacuuaccuacaaacagacaaagaagcugcucggccuguccgaugacuaugaauuuaaaggggagaagggaaccuacuucaucgaauuuaaaaaguauaaagaguucauuaaggcccuuggcgaacacaaucugucucaagacgaucucaacgagaucgccaaggacauuacgcugaucaaagaugagaucaagcugaaaaaggcucucgcgaaauacgaccugaaucagaaccagauugauagccuuuccaagcuggaauuuaaagaccaucucaauaucggguucaaggcccugaagcugauuacaccccuuaugcucgagggaaagaaguacgaugaggcuuguaacgaacugaaucugaaaguggccaucaacgaggacaagaaagauuuucucccugccuucaaugaaaccuauuacaaggacgagguuaccaaccccgugguccugcgcgcuauuaaggaauaucggaaagugcuuaaugcccugcucaagaaauacggcaaggugcacaaaaucaacaucgagcuggcgagagaagucggcaagaaccacagccagcgcgcuaagauugagaaagagcaaaaugaaaacuauaaggccaaaaaggaugccgagcuggaaugcgagaaacuugggcucaagaucaauucuaagaacauucugaaacugagacucuucaaggaacagaaagaguuuugugcuuacuccggagagaagaucaaacugagcgaccuucaggacgaaaagaugcuggagauugaucauaucuauccuuacucucggagcuucgacgauuccuacaugaauaaaguucucguguuuacaaagcaaaaccaggaaaagcugaauaaaaccccguucgaggccuuuggcaacgacaaugugaaguggcagaaaauugaaguccuggcuaagaaccuucccgagaaaaagcagaagcgcauccucgauaaaaauuauaaggacaaagagcaaaaggauuucaaagaccggaaccugaaugauacgagauacaucgcccgccuggugcucaacuauacaaaggacuaccuggauuuucuuccucugucugacgaugaaaauaccaagcucaaagggagcaagguucacguggaggcgaaauccggaaugcugacaagcgcccugcggcauaccuggggcuucucuaccaaggacagaaacaaccaccuucaccaugcuauugacgccgcuaucauugccuaugcgaauaacuccaucgucaaagauuuuagcgacuucaagaaggaacaggagucuaauuccgccgagcucuacgcuaaaaagauuagcgaacuggauuauaaaaacaagcgcaaauuuuucgagcccuuuuccggguuccggcagaaggugcuggacaagaucgaugaaaucuucguuucuaaaccugagagaaagaaacccagcggagcccuccacgaagagacauuucggaaggaggaagaguucuaccaguccuacggcggcaaagaaggggugcugaaggcucuugagcugggaaaaauucgcaaggucaauggcaagaucgugaaaaacggggacauguuuagagucgauauuuucaagcauaaaaagacgaauaaauuuuaugccgugccgaucuacaccauggacuucgcccucaagguucugccuaacaaggcuguggcgcggucuaaaaagggagaaauuaaagauuggauccugauggacgagaauuaugaguuuugcuucagccuuuacaaggauucccugauccucauucaaacaaaagacaugcaggaacccgagcuggucuauuuuaacgccuucaccagcucuacagugucccucaucguuagcaagcacgauaauaaguuugaaacccugucuaaaaaccuuaagguguucgagaaauacauugucuccgcucugggcgaagugacgaaggccgaguucagacagcgcgaggacuuuaaaaaugaacuccgguga

SEQ ID NO: 3717 - RNA, 2955 nt, Artificial Sequence
  Cas9 variant
auggccaagauccuggcuuucgacauuggcaucagcuccauugggugggccuuuucugagaacgaugaacucaaagacugcggagugagaaucuucaccaaggcggagaaucccaaaacaggcgaaagccuggcccuuccucggcgcauugcuagauccgcccggaagcgccuggcuagacggaaagcccgccucaaccaccugaagcaucuuaucgcuaaugaguuuaagcugaacuacgaagauuaucagucuuucgacgagauccucgccaaagcguacaaggggagccugauuuccccguaugagcugagauuucgggcccucaaugaacugcuuucuaaacaagauuucgcucgcgucauccugcacauugccaagagacggggauacgacgauaucaaaaacaauggcgacgaggaaaaggggaagauucucaaagcuaucaagcagaacgaggagaaacuggccaauuaucagagcguuggagaauaccuuuauaaggaguacuuucagaaauucaaggaaaacuccaaagaguuuauuaaugugcgcaacaagaaggaaagcuacgagagauguaucgcgcaaucuuuccugaaagaugagcucaagcugaucuuuaaaaagcagcgggaguucggcuuuuccuucagcaaaaaguucgaagaagaggugcugucugucgccuuuuauaagcgcgcucucaaagacuucucccaucuggugggcaauugcagcuuuuucacggaugaaaagagagcccccaaaaacucuccucuugcuuuuauguucguugcccugacccggauuaucaaucuccugaacaaccuuaagaauacacuguacaccaaagacgaucucaacgcccugcugaaugaggugcucaagaacgggacacugaccuauaagcagacaaagaaacuucugggacucuccgacgacuacgaguuuaaaggcgaaaaggggaauuauuucauugaguuuaaaaaguacaaggaguucaucaaagcucugggagaacacagccuuucccaggaugaccugaacgaaauugcgaaggauaucacccucaucaaagacgagauuaagcugaaaaaggcccuggcuaaauaugaucucaaugagaaccaaaucgacaaucugucuaaacuugaauuuaaggaucaucugaacauuagcuucaaagcccucaagcugaucacgccccugaugcuugagggcaaaaaguacgacgaagccuguaaugagcucacccugaaagucgcuauuaacgaggauaagaaggacuuucugccugccuucaaugaaacauacuauaaagaugaggugaccaaccccguugugcucagagcgaucaaggaauaccgcaaaguccugaaugcccuucugaagaaauaugggaaggugcacaagaucaacauugagcucgcucgggaagugggaaagaaccacucccagagagccaagaucgagaaagagcagaaugaaaacuacaaggcuaaaaaggacgccgagcuggaaugcgagaagcugggccuuaaaauuaauagcaagaacauccucaaacugcgccuguucaaggaacagaaagaguuuugugucuauucuggcgagaagauuaaacucuccgaccugcaagaugaaaagaugcuugagaucgaccauauuuacccuuauagccggucuuucgaugacagcuacaugaauaagguucugguguuuacaaaacagaaccaggaaaagcucaaucaaaccccguucgaggcuuuugggaacgauuccgccaaauggcagaagaucgaagugcuggcgaaaaaucugcccacgaagaagcagaaaagaauccuugacaagaacuacaaagauaaggagcagaaagacuucaaggaucgcaaucucaacgacacacgguauauugccagacugguccugaauuacaccaaggauuaucucgacuuucugccucuuucugaugacgagaacacaaaacugaaugacacccaaaagggaagcaaagugcacguugaagcuaaguccggcaugcucaccagcgcccugcgccauacauggggguucucuacgaaagaucggaacaaccaucugcaccacgcuaucgacgccgugauuaucgcguacgccaauaacuccauugucaaggcuuuuagcgauuucaagaaagagcaggaaucuaauaccgccgagcuuuaugcuaagaaaaucuccgagcucgacuacaagaacaaaagaaaguuuuucgaacccuuuagcggauuccgccagaaggugcuggauaaaaucgacgagauuuucguuuccaagccugaacggaaaaagcccucuggcgcccugcacgaggaaacauuuagaaaagaggaggaguucuaucagagcuacgggggaaaggaaggcgugcucaaagcccuggaacuuggcaagauccggaaggucaaugggaaaauugugaagaacggagauauguuucgcgucgacaucuucaaacauaagaaaaccaauaaguuuuacgcugugccgauuuauacaauggauuucgcgcugaagguucucccuaacaaagccguggcuagauccaagaaaggcgagaucaaggacuggauccugauggaugaaaauuacgaguuuugcuucucucuguauaaagacagccuuauucugauccaaaccaaggauaugcaggagcccgaauuugucuacuauaacgccuucacguccagcacagugucucucauuguuuccaagcacgacaauaaauuugagacccugagcaagaaccagaaaauccucuucaagaaugccaacgaaaaagaggugauugcuaagucuaucgggauccagaaucugaaggucuucgaaaaauacauuguguccgcccuuggagaggugaccaaggcggaguuucggcaaagagaagaguucaaaaacgaacugcgcuga

SEQ ID NO: 3718 - RNA, 2955 nt, Artificial Sequence
  Cas9 variant
auggccagaauccuggcuuucgacauuggcaucagcuccauugggugggccuuuucugagaacgaugaacucaaggacugcggagugcggaucuucaccaaagcggagaaucccaagacaggcgaaagccuggcccuuccucgcagacuggcucgguccgcccgcaaaagacucgcucggcgcaaggccagacugaaccggcuuaaacaccugauugcuaaugaguuuaagcucaacuacgaagauuaucagucuuucgacgagagccuggccaaggcguacaaagggucccugaucucuccguaugagcuccgcuuuagagcccugaaugaacuucugagcaagcaagauuucgcucgggucauccuccauauugccaaacgcagaggauacgacgauaucaagaacuccgacgauaaagagaagggcgcuauucugaaggccaucaaacagaaugaagagaaacuugcgaacuaucagagcguuggggaguaccuguauaaagaauacuuucagaaguucaaagaaaauucuaaggaauuuacgaacgugcggaauaaaaaggaguccuacgaacgcuguauugcccagagcuuccucaaggacgagcugaaacugaucuuuaagaaacaaagagaguucggauuuucuuucuccaagaaauucgaagaggaagugcucagcgucgcuuuuuauaagcgggcccugaaggauuucucucaccuugugggcaacugcuccuuuuucaccgacgagaaaagagcucccaagaauagcccucuggccuuuauguucguugcccucacacgcauuaucaaccugcuuaauaaccugaaaaacaccgaaggcauccucuacacaaaggaugaccugaaugcucugcucaacgaguuucugaaaaaugggacccuuacauauaagcagaccaagaaacugcucggacuguccgacgauuacgaguucaagggcgaaaaagggacguauuuuauugaguucaagaaauacaaggaauuuaucaaggcgcuuggagagcauaaccugucucaggacgaucucaaugaaauugccaaagacaucacccugauuaaggaugagaucaaacugaagaaagcucucgccaaguaugaccugaaccaaaaucagaucgauagccuuuccaaacuggaguucaaggaccaccucaacauuagcuuuaaggcccugaaacugaucacaccccuuaugcucgaaggcaagaaauacgaugaggcuuguaaugaacugaaccugaagguggccauuaaugaggacaaaaaggauuuccucccugcguucaacgagaccuacuauaaggacgaagucacaaaucccgugguucugcgggcuaucaaagaguacagaaaggugcuuaacgcccugcucaaaaaguaugggaaaguccauaagauuaauaucgaacuggcccgcgaggugggaaagaacuacucucagcgggcuaaaaucgaaaaggagcagaacgagaauuauaaagccaagaaagacgcugaacuggagugcgaaaaacuuggccucaagauuaacuccaaaaauauccugaagcugagacucuuuaaagagcaaaaggaguucugugccuacagcggcgagaaaauuaagaucucugaucugcaggacgagaaaaugcuugaaauugaucacaucuauccuuacagccgcuccuuugacgauucuuacaugaacaaggugcuggucuucaccaagcagaaucaagagaaacucaaccagacgccguuugaagcguucgggaaugacagcgccaaguggcagaaaauugagguucuggcuaagaaccugcccacaaagaagcagaagcggauccuugauaaaaauuauaaggacaaagaacaaaaggauuuuaaagacagaaaccucaaugauacccgcuacaucgcccggcuggugcugaacuauacaaaggacuaccucgauuuccugccucuuuccgacgacgagaauaccaagcugaacgauacccacaaaggaagcaaggugcaugucgaggcuaaaucuggcaugcucacauccgcccugagacacacguggggguuuagcaccaaggaccgcaauaaccaucugcggcacgcgauugaugccgugaucauugcuuaugccaacaauucuaucguuaaggcuuucuccgacuuuaagaaggaacaggagagcaacuccgccgaacuuuacgccaaaaagauuucugagcucgauuauaaaaauaagagaaaauucuuugagcccuucagcggauuccggcagaaggugcuggacaagaucgaugaaaucuuugucuccaaaccugagcgcaagaaacccucuggcgcucugcacgaagagacauucagaaaggaagaggaguuuuaccagagcuacgggggaaaagaaggcgugcucaaggcgcuggagcuuggcaaaauucggaagguuaacgggaagaucgugaaaaauggagacauguucagagucgauauuuuuaagcauaaaaagaccaacaaauucuaugccgugccgaucuacacaauggacuuugcucugaagguccucccuaauaaggccguggcccgcuccaaaaagggcgaaauuaaagauuggauccugauggacgagaacuaugaguucugcuuuagccuguacaaggauucucuuauccugauucaaaccaaagacaugcaggaacccgaguucguuuauuacaaugcuuuuacguccagcacagugucucucaucgucuccaagcacgacaacaaguucgaaacccugagcaaaaaucagaagauucucuucaaaaacgccaaugagaaggaagugaucgcgaaaucuauugggauccagaaccugaagguuuuugagaaguauaucgugagcgcucuuggagaagucaccaaagccgaguuccggcaaagagaggauuuuaagaaauga

SEQ ID NO: 3719 - RNA, 2955 nt, Artificial Sequence
  Cas9 variant
auggccagaauccuggcuuucgacauuggcaucagcuccauugggugggccuuuucugagaacgaugaacucaaggacugcggagugcggaucuucaccaaagucgagaaucccaagacaggcgaaagccuggcgcuuccucgcagacuggcucgguccgcccgcaaaagacucgcccggcgcaaggcuagacugaaccaccuuaaacaucugauugccaaugaguuuaagcucaacuacgaagauuaucagucuuucgacgagagccuggcuaaggccuacaaagggucccugaucucuccguaugagcuccgguuucgcgcgcugaaugaacuucugagcaagcaagauuucgccagaguuauccuccacauugcuaaacggcgcggauacgacgauaucaagaacuccgacgauaaagagaagggcgccauucugaaggcuaucaaacagaaugaagagaaacuugccaacuaucagagcgugggggaguaccuguauaaggaauacuuucagaaguucaaagaaaauucuaaggaauuuacgaacgugagaaauaaaaaggaguccuacgaacgguguauugcgcagagcuuccucaaggacgagcugaaacugaucuuuaagaaacaacgcgaguucggauuuucuuucuccaagaaauucgaagaggaaguccucagcguggccuuuuauaagagagcucugaaggauuucucucaucuuguuggcaacugcuccuuuuucaccgacgagaaacgggcccccaagaauagcccucuggcuuuuauguucgugacacucaccagaauuaucaaccugcuuaauaaccugaaaaacacagaaggcauccucuacaccaaggaugaccugaaugcccugcucaacgagguccugaaaaaugggacacuuaccuauaagcagacgaagaaacugcucggacuguccgacgauuacgaguuuaagggcgaaaaagggaccuauuucauugaguuuaagaaauacaaggaguucaucaaggcccuuggagagcacaaccugucucaggacgaucucaaugaaauugcuaaagacaucacacugauuaaggaugagaucaaacugaagaaagcgcucgccaaguaugaccugaaccaaaaucagaucgauagccuuuccaaacuggaguuuaaggaccaucucaacauuagcuucaaggcucugaaacugaucacaccccuuaugcucgaaggcaagaaauacgaugaggccuguaaugaacugaaccugaagguggccauuaaugaggacaaaaaggauuuucucccugcuuucaacgagaccuacuauaaggacgaaguuaccaaucccgugguccugcgcgccaucaaagaguaccggaaggugcuuaacgcgcugcucaaaaaguaugggaaagugcacaagauuaauaucgaacuggcuagagaggucggaaagaaccacucucagcgcgccaaaaucgaaaaggagcagaacgagaauuacaaagccaagaaagacgcugaacuggagugcgaaaaacuuggccucaagauuaacuccaagaauauccugaagcugagacucuucaaagagcaaaaggaauuuugugccuauagcggcgagaaaauuaagaucucugaucugcaggacgagaaaaugcuugaaauugaucauaucuacccuuauagcagauccuucgacgauucuuacaugaacaagguucugguguuuacgaagcagaaucaagagaaacucaacaagacaccguucgaggcuuuugggaaugacagcgccaaauggcagaagauugaagugcuggcgaaaaaccugcccaccaagaagcagaaacgcauccuugauaagaauuacaaagacaaggaacagaaagauuucaaggaccggaaccucaaugauacaagauauaucgcccgccugguccugaacuacaccaaggacuaucucgauuuucugccucuuuccgacgacgagaauaccaaacugaacgauacacaaaagggaagcaaagugcacguugaggcuaagucuggcaugcucacguccgcccugcggcauaccuggggguucagcacaaaagacagaaauaaccaucugcaccacgcuauugaugccgugaucauugcguacgccaacaauucuaucgucaaggcuuuuuccgacuucaagaaagaacaggagagcaacuccgccgaacuuuaugcuaagaaaauuucugagcucgauuacaagaauaaacgcaaguuuuucgagcccuuuagcggauuccggcagaaggugcuggacaaaaucgaugaaaucuucguuuccaagccugagcggaaaaagcccucuggcgcccugcacgaagagaccuuucggaaagaagaggaguucuaucagagcuacgggggaaaggaaggcgugcucaaagcccuggagcuuggcaagauucgcaaggucaacgggaaaaucgugaagaauggagacauguuuagagucgauauuuucaaacauaagaaaacaaacaaguuuuacgcugugccgaucuauaccauggacuucgcgcugaagguucucccuaauaaagccguggcucgguccaagaaaggcgaaauuaaggauuggauccugauggacgagaacuacgaauuuugcuucagccuguauaaagauucucuuauccugauucaaacgaaggacaugcaggagcccgaguuugucuacuauaaugccuucacauccagcaccgugucucucaucguuuccaagcacgacaacaaauuugaaacccugagcaagaaucagaaaauucucuucaagaacgccaaugagaaagaagugaucgcuaagucuauugggauccagaaccugaaggucuucgagaaauacaucgugagcgcccuuggagaagugacaaaggcggaguuuagacaacgcgaggauuucaaaaaguga

SEQ ID NO: 3720 - RNA, 2955 nt, Artificial Sequence
  Cas9 variant
auggccagaauccuggcuuucgacauuggcaucagcuccauugggugggccuuuucugagaacgaugaacucaaggacugcggagugcggaucuucaccaaagcggagaaucccaagacaggcgaaagccuggcgcuuccucgcagacuggcccgguccgcccgcaaaagacucgcucggcgcaaggccagacugaaccaccuuaaacaucugauugcuaaugaguuuaagcucaacuacgaagauuaucagucuuucgacgagagccuggccaaggcguacaaagggucccugaucucuccguaugagcuccgguuucgcgcccugaaugaacuucugagcaagcaagauuucgcuagagucauccuccacauugccaaacggcgcggauacgacgauaucaagaacuccgacgauaaagagaagggcgcuauucugaaggccaucaaacagaaugaagagaaacuugcgaacuaucagagcguuggggaguaccuguauaaagaauacuuucagaaguucaaagaaaauucuaaggaauuuacgaacgugagaaauaaaaaggaguccuacgaacgguguauugcccagagcuuccucaaggacgagcugaaacugaucuuuaagaaacaacgcgaguucggauuuucuuucuccaagaaauucgaagaggaagugcucagcgucgcuuuuuauaagagagcccugaaggauuucucucaucuugugggcaacugcuccuuuuucaccgacgagaaacgggcucccaagaauagcccucuggccuuuauguucguugcccucacaagaauuaucaaccugcuuaauaaccugaaaaacaccgaaggcauccucuacacaaaggaugaccugaaugcucugcucaacgaggugcugaaaaaugggacccuuacauauaagcagaccaagaaacugcucggacuguccgacgauuacgaguuuaagggcgaaaaagggacguauuucauugaguuuaagaaauacaaggaguucaucaaggcgcuuggagaccacucucugagccaggaugaccucaacgagauugccaaagauaucacccugauuaaggacgaaaucaaacugaagaaagcucucgccaaguaugaucugaaucaaaaccagaucgacucccuuagcaaacuggaguuuaaggaucaucucaauauuucuuucaaggcccugaaacugaucacaccccuuaugcucgagggcaagaaauacgacgaggcuuguaacgaacugaaucugaaggucgccauuaacgaagauaaaaaggacuuucucccugcguucaaugagaccuacuauaaggacgaggugacaaaccccguugugcugcgcgcuaucaaagaauaccggaagauucuuaaugcccugcucaaaaaguaugggaaaguccacaagaucaacaucgagcuggccagagaagugggaaagaaucacucccagcgcgcuaaaauugagaaggaacagaacgagaacuacaaagccaagaaagaugcugagaucgaaugcgagaagcugggccuuaagauuaauagcaaaaacauccucaagcugcggcuguucaaagaacaaaaggaguuuugugccuauucuggcgaaaagauuaagcucagcgaccugcaggaugagaaaaugcuugagaucgaccauauuuacccuuauuccagaucuuucgaugacagcuacaugaauaaggugcuggucuuuaccaagcagaaccaagaaaaacucaauaagacgccguucgaggcguuugggaacgauuccacaaaauggcagaagaucgaaguucuggccaaaaaucugcccgagaagaagcagaaacgcauccuugacaagaacuacaaagauaaggaacagaaagacuucaaggaucggaaucucaacgacaccagauauauugcucgccuggugcugaauuacacaaaggauuaucucgacuuucugccucuuagcgacgaugagaacaccaaacugaaugacacccaaaagggaucuaaagugcacgucgaggccaaguccggcaugcucacaagcgcucugcggcauacguggggguucucugccaaagauagaaacaaucaucugcaccacgcgaucgacgccgcuauuaucgccuacgcuaacaacuccauugugaaggccuuuagcgauuucaagaaagaacaggaguccaauucuguugaacuuuaugccaagaaaaucagcgagcucgacuacaagaacaaacgcaaguuuuucgagcccuuuuccggauuccggcagaaggugcuggauaaaaucgacgaaauuuucgucucuaagccugagcggaaaaagcccagcggcgcucugcacgaagagaccuuuagaaaagaagaggaguucuaucaguccuacgggggaaaggaaggcgugcucaaagcgcuggagcuuggcaagauccgcaagguuaaugggaaaauugugaagaacggagauauguuuagagucgacaucuucaaacauaagaaaacaaauaaguuuuacgccgugccgauuuauaccauggauuucgcucugaagguccucccuaacaaagccguggcccggagcaagaaaggcgaaaucaaggacuggauccugauggaugagaauuacgaauuuugcuucucucuguauaaagacucccuuauucugauccaaacaaaggacaugcaggagcccgagcucguuuacuuuaacgcuuucaccagcucuacggugucccugauugucagcaagcacgauaauaaauuugaaacacucucuaagaaccagaaaauccuguucaagaaugccaacgagaaagaagugauugcuaagagcaucgggauccagaaucuuaagguuuucgagaaauauauuguguccgcucugggagaagucaccaaggccgaguuuagacaacgcgaggacuucaaaaaguga

SEQ ID NO: 3721 - RNA, 2955 nt, Artificial Sequence
  Cas9 variant
auggccagaauccuggcuuucgacauuggcaucagcuccauugggugggccuuuucugagaacgaugaacucaaggacugcggagugcggaucuucaccaaagucgagaaucccaagacaggcgaaagccuggcgcuuccucgcagacuggcucgguccgcccgcaaaagacucgcccggcgcaaggcuagacugaaccaccuuaaacaucugauugccaaugaguuuaagcucaacuacgaagauuaucagucuuucgacgagagccuggcuaaggccuacaaagggucccugaucucuccguaugagcuccgguuucgcgcgcugaaugaacuucugagcaagcaagauuucgccagaguuauccuccacauugcuaaacggcgcggauacgacgauaucaagaacuccgacgauaaagagaagggcgccauucugaaggcuaucaaacagaaugaagagaagcucgccaacuaucagagcgugggggaguaccuguauaaagaauacuuucagaaguucaaagaaaauucuaaggaauuuacgaacgugagaaauaaaaaggaguccuacgaacgguguauugcgcagagcuuccucaaggacgagcugaaacugaucuuuaagaaacaacgcgaguucggauuuucuuucuccaagaaauucgaagaggaaguccucagcguggccuuuuauaagagagcucugaaggauuucucucaucuuguuggcaacugcuccuuuuucaccgacgagaaacgggcccccaagaauagcccucuggcuuuuauguucguggcccucacaagaauuaucaaccugcuuaauaaccugaaaaacaccgaaggcauccucuacacaaaggaugaccugaaugcccugcucaacgagguccugaaaaaugggacccuuacauauaagcagaccaagaaacugcucggacuguccgacgauuacgaguuuaagggcgaaaaagggacguauuucauugaguuuaagaaauacaaggaguucaucaaggcucuuggagagcacaaccugucucaggacgaucucaaugaaauugcgaaagacaucacccugauuaaggaugagaucaaacugaagaaagcccucgcuaaguaugaccugaaccaaaaucagaucgauagccuuuccaaacuggaguuuaaggaccaucucaacauuagcuucaaggcccugaaacugaucacaccccuuaugcucgaaggcaagaaauacgaugaggccuguaaugaacugaaccugaagguggcuauuaaugaggacaaaaaggauuuucucccugccuucaacgagaccuacuauaaggacgaaguuacaaaucccgugguccugcgcgcgaucaaagaguaccggaaggugcuuaacgcucugcucaaaaaguaugggaaagugcacaagauuaauaucgaacuggccagagaggucggaaagaaccacucucagcgcgccaaaaucgaaaaggagcagaacgagaauuacaaagcuaagaaagacgccgaacuggagugcgaaaaacuuggccucaagauuaacuccaaaaauauccugaagcugcggcuuuucaaagagcaaaaggaauuuugugcuuauagcggcgagaaaauuaagaucucugaucugcaggacgagaaaaugcuugaaauugaucauaucuacccuuauagcagauccuucgacgauucuuacaugaacaagguucugguguuuaccaagcagaaucaagagaaacucaacaagacgccguucgaagccuuugggaaugacagcgcgaaauggcagaagauugaggugcuggccaaaaaccugcccacaaagaagcagaaacgcauccuugauaagaauuacaaagacaaggaacagaaagauuucaaggaccggaaccucaaugauaccagauauaucgcucgccugguccugaacuacacaaaggacuaucucgauuuucugccucuuuccgacgacgagaauaccaaacugaacgauacccaaaagggaagcaaagugcacguugaggccaagucuggcaugcucacauccgcucugcggcauacguggggguucagcaccaaagacagaaauaaccaucugcaccacgccauugaugcggugaucauugccuacgcuaacaauucuaucgucaaggccuuuuccgacuucaagaaagaacaggagagcaacuccgcugaacuuuaugccaagaaaauuucugagcucgauuacaagaauaaacgcaaguuuuucgagcccuuuagcggauuccggcagaaggugcuggacaaaaucgaugaaaucuucguuuccaagccugagagaaagaagcccucuggcgcccugcacgaagagacauuucggaaagaagaggaguucuaucagagcuacgggggaaaggaaggcgugcucaaagcucuggagcuuggcaagauucgcaaggucaacgggaaaaucgugaagaauggagacauguuuagagucgauauuuucaaacauaagaaaaccaacaaguuuuacgcggugccgaucuauacaauggacuucgcccugaagguucucccuaauaaagcuguggcccgguccaagaaaggcgaaauuaaggauuggauccugauggacgagaacuacgaauuuugcuucagccuguauaaagauucucuuauccugauucaaaccaaggacaugcaggagcccgaguuugucuacuauaaugccuucacguccagcacagugucucucaucguuuccaagcacgacaacaaauuugaaacccugagcaagaaucagaaaauucucuucaagaacgcuaaugagaaagaagugaucgccaagucuauugggauccagaaccugaaggucuucgagaaauacaucgugagcgcgcuuggagaagugaccaaggcugaguuuagacaacgcgaggauuucaaaaaguga

SEQ ID NO: 3722 - RNA, 2955 nt, Artificial Sequence
  Cas9 variant
auggccagaauccuggcuuucgacauuggcaucagcuccauugggugggccuuuucugagaacgaugaacucaaggacugcggagugcggaucuucaccaaagcggagaaucccaagacaggcgaaagccuggcccuuccucgcagacuggcucgguccgcccgcaaaagacucgcucggcgcaaggccagacugaaccaccuuaaacaucugauugcuaaugaguuuaagcucaacuacgaagauuaucagucuuucgacgagagccuggccaaggcguacaaagggucccugaucucuccguaugagcuccgguuucgcgcccugaaugaacuucugagcaagcaagauuucgcuagagucauccuccacauugccaaacggcgcggauacgacgauaucaagaacuccgacgauaaagagaagggcgcuauucugaaggccaucaaacagaaugaagagaaacuugcgaacuaucagagcguuggggaguaccuguauaaagaauacuuucagaaguucaaagaaaauucuaaggaauuuacgaacgugagaaauaaaaaggaguccuacgaacgguguauugcccagagcuuccucaaggacgagcugaaacugaucuuuaagaaacaacgcgaguucggauuuucuuucuccaagaaauucgaagaggaagugcucagcgucgcuuuuuauaagagagcccugaaggauuucucucaucuugugggcaacugcuccuuuuucaccgacgagaaacgggcucccaagaauagcccucuggccuuuauguucguugcccucacaagaauuaucaaccugcuuaauaaccugaaaaacaccgaaggcauccucuacacaaaggaugaccugaaugcucugcucaacgaggugcugaaaaaugggacccuuacauauaagcagaccaagaaacugcucggacuguccgacgauuacgaguuuaagggcgaaaaagggacguauuucauugaguuuaagaaauacaaggaguucaucaaggcgcuuggagaccacucucugagccaggaugaccucaacgagauugccaaagauaucacccugauuaaggacgaaaucaaacugaagaaagcucucgccaaguaugaucugaaucaaaaccagaucgacucccuuagcaaacuggaguuuaaggaucaucucaauauuucuuucaaggcccugaaacugaucacaccccuuaugcucgagggcaagaaauacgacgaggcuuguaacgaacugaaucugaaggucgccauuaacgaagauaaaaaggacuuucucccugcguucaaugagaccuacuauaaggacgaggugacaaaccccguugugcugcgcgcuaucaaagaauaccggaagguccuuaaugcccugcucaaaaaguaugggaaagugcacaagauuaacaucgagcuggccagagaagugggaaagaauuacucccagcgcgcuaaaaucgagaaggaacagaacgagaacuauaaagccaagaaagaugcugagcuggaaugcgagaaacuuggccucaagauuaauagcaaaaacauccugaagcugagacucuucaaagaacaaaaggaguuuugugccuacucuggcgaaaagauuaagaucagcgaccugcaggaugagaaaaugcuugagauugaccacaucuauccuuacucccggucuuucgaugacuuuuacaugaauaagguccugguuuucaccaagcagaaccaagaaaaacucaaucagacgccguuugaggcguucgggaacgauagcgccaaguggcagaaaauugaagugcuggcuaagaaucugcccacaaagaagcagaagcgcauccuugacaaaaacuauaaggauaaagagcaaaaggacuuuaaagaucggaaucucaacgacaccagauacaucgcccgccuggugcugaauuauacaaaggauuaccucgacuuccugccucuuuccgacgaugaaaacaccaagcugaaugacacccagaaaggaagcaagguccauguggaggcuaaaucuggcaugcucacauccgcccugcggcacacguggggguuuagcgcgaaggauagaaacaaucaucugcaccacgccauugacgcuguuaucauugccuaugcuaacaacucuaucgugaaagccuucuccgauuuuaagaaggagcaggaaagcaauuccgccgagcuuuacgcuaaaaagauuucugaacucgacuauaaaaacaagcgcaaauucuuugagcccuucagcggauuccggcagaagguccuggauaagaucgacgagaucuuuguguccaaaccugaaagaaagaaacccucuggcgcgcugcaugaggaaaccuuccggaaggaggaagaguuuuaccaaagcuacgggggaaaagagggcguucucaaggcccuggaacuuggcaaaauucgcaaggugaaugggaagaucgucaaaaacggagauauguucagaguggacauuuuuaagcacaaaaagacaaauaaauucuaugcugucccgaucuacaccauggauuuugcccugaaggugcucccuaacaaggccguugcucgguccaaaaagggcgagauuaaagacuggauccugauggaugaaaauuaugaguucugcuuuagccuguacaaggacucucuuauccugauucagacaaaagacaugcaggaacccgaguucguguauuacaacgccuuuaccuccagcacggucucucucaucguguccaagcaugauaauaaguucgagacacugagcaaaaaccagaagauucucuucaaaaaugcgaacgaaaaggagguuaucgcuaaaucuauugggauccaaaaucugaagguguuugaaaaguauaucgucagcgcccuuggagaggugaccaaagccgaguucagacagcgcgaagacuuuaagaaauga

SEQ ID NO: 3723 - RNA, 2955 nt, Artificial Sequence
  Cas9 variant
auggccagaauccuggcuuucgacauuggcaucagcuccauugggugggccuuuucugagaacgaugaacucaaggacugcggagugcggaucuucaccaaagcggagaaucccaagacaggcgaaagccuggcccuuccucgcagacuggcucgguccgcccgcaaaagacucgcucggcgcaaggccagacugaaccaccuuaaacaucugauugcuaaugaguuuaagcucaacuacgaagauuaucagucuuucgacgagagccuggccaaggcguacaaagggucccugaucucuccguaugagcuccgguuucgcgcccugaaugaacuucugagcaagcaagauuucgcuagagucauccuccacauugccaaacggcgcggauacgacgauaucaagaacuccgacgauaaagagaagggcgcuauucugaaggccaucaaacagaaugaagagaaacuugcgaacuaucagagcguuggggaguaccuguauaaagaauacuuucagaaguucaaagaaaauucuaaggaauuuacgaacgugagaaauaaaaaggaguccuacgaacgguguauugcccagagcuuccucaaggacgagcugaaacugaucuuuaagaaacaacgcgaguucggauuuucuuucuccaagaaauucgaagaggaagugcucagcgucgcuuuuuauaagagagcccugaaggauuucucucaucuugugggcaacugcuccuuuuucaccgacgagaaacgggcucccaagaauagcccucuggccuuuauguucguugcccucacaagaauuaucaaccugcuuaauaaccugaaaaacaccgaaggcauccucuacacaaaggaugaccugaaugcucugcucaacgaguuucugaaaaaugggacccuuacauauaagcagaccaagaaacugcucggacuguccgacgauuacgaguucaagggcgaaaaagggacguauuuuauugaguucaagaaauacaaggaauuuaucaaggcgcuuggagagcacaaccugucucaggacgaucucaaugaaauugccaaagacaucacccugauuaaggaugagaucaaacugaagaaagcucucgccaaguaugaccugaaccaaaaucagaucgauagccuuuccaaacuggaguucaaggaccaucucaacauuagcuuuaaggcccugaaacugaucacaccccuuaugcucgaaggcaagaaauacgaugaggcuuguaaugaacugaaccugaagauugccaucaaugaggacaaaaaggauuuccucccugcguucaacgagaccuacuauaaggacgaagugacaaaucccgucgugcugcgcgcuauuaaagaguaccggaagguucuuaacgcccugcucaaaaaguaugggaaagugcacaagaucaauaucgaacuggccagagaggucggaaagaaccacucucagcgcgcuaaaauugaaaaggagcagaacgagaauuacaaagccaagaaagacgcugaacuggagugcgaaaaacuuggccucaagaucaacuccaagaauauucugaagcugcggcucuuuaaagagcaaaaggaguucugugccuauagcggcgagaaaaucaagauuucugaucugcaggacgagaaaaugcuugaaaucgaucauauuuacccuuauagcagauccuuugacgauucuuacaugaacaaggugcugguguucaccaagcagaaucaagagaaacucaaccagacgccguuugaagcguucgggaaugacagcgccaaguggcagaaaaucgagguccuggcuaagaaccugcccacaaagaagcagaagcgcauccuugauaaaaauuacaaggacaaagaacaaaagaacuuuaaagaucggaaucucaacgacaccagauauauugcccgccugguucugaauuacacaaaggauuaucucgacuuccugccucuuuccgaugacgagaacaccaagcugaaugacacccagaaaggaagcaaggugcacguggaggcuaaaucuggcaugcucacauccgcccugcggcauacguggggguuuagcgcgaaggauagaaacaaccaucugcaccacgccaucgacgcugucauuaucgccuacgcuaauaacucuauugugaaagccuucuccgauuuuaagaaggaacaggagagcaauuccgccgaacuuuaugcuaaaaagaucucugagcucgacuacaaaaacaagcgcaaauucuuugagcccuucagcggauuccggcagaagguucuggauaagaucgacgaaauuuuuguguccaaaccugagagaaagaaacccucuggcgcgcugcacgaagagaccuuccggaaggaagaggaguuuuaucaaagcuacgggggaaaagaaggcguccucaaggcccuggagcuuggcaaaauccgcaaggugaaugggaagauuguuaaaaacggagauauguucagaguggacaucuuuaagcauaaaaagacaaauaaauucuacgcugucccgauuuauaccauggauuuugcccugaaggugcucccuaacaaggccgucgcucgguccaaaaagggcgaaaucaaagacuggauccugauggaugagaauuacgaguucugcuuuagccuguauaaggacucucuuauucugauccagacaaaagauaugcaggaacccgaguucguguacuauaacgccuuuaccuccagcacgguuucucucauuguguccaagcacgacaauaaguucgaaacacugagcaaaaaccagaagauccucuucaaaaaugcgaacgagaaggaagucauugcuaaaucuaucgggauccaaaaucugaagguguuugagaaguacauuguuagcgcccuuggagaagugaccaaagccgaguucagacagcgcgaggacuuuaagaaauga

SEQ ID NO: 3724 - RNA, 2955 nt, Artificial Sequence
  Cas9 variant
auggugagaauccuggccuucgacauuggcaucagcuccauugggugggcuuuuucugagaacgaugaacucaaggacugcggaguccggaucuucaccaaaguugagaaucccaagacaggcgaaagccuggcccuuccucgcagacuggcgcgguccgcucgcaaaagacucgcccggcgcaaggccagacugaaccaccuuaaacaucugauugcuaaugaguuuaagcucaacuacgaagauuaucagucuuucgacgagagccuggccaaggcuuacaaagggucccugaucucuccguaugagcuccgguuucgcgcccugaaugaacuucugagcaagcaagauuucgcgagagugauccuccacauugccaaacggcgcggauacgacgauaucaagaacuccgacgauaaagagaagggcgcuauucugaaggccaucaaacagaaugaagagaagcucgcuaacuaucagagcgugggggaguaccuguauaaagaauacuuucagaaguucaaagaaaauucuaaggaauuuacgaacgucagaaauaaaaaggaguccuacgaacgguguauugcccagagcuuccucaaggacgagcugaaacugaucuuuaagaaacaacgcgaguucggauuuucuuucuccaagaaauucgaagaggaagugcucagcguugcguuuuauaagagagcccugaaggauuucucucaucuugugggcaacugcuccuuuuucaccgacgagaaacgggcucccaagaauagcccucuggccuuuauguucgucgcucucacaagaauuaucaaccugcuuaauaaccugaaaaacaccgaaggcauccucuacacaaaggaugaccugaaugcccugcucaacgaggugcugaaaaaugggacccuuacauauaagcagaccaagaaacugcucggacuguccgacgauuacgaguuuaagggcgaaaaagggacguauuucauugaguuuaagaaauacaaggaguucaucaaggcccuuggagagcacaaccugucucaggacgaucucaaugaaauugcuaaagacaucacccugauuaaggaugagaucaaacugaagaaagcgcucgccaaguaugaccugaaccaaaaucagaucgauagccuuuccaaacuggaguuuaaggaccaucucaacauuagcuucaaggcucugaaacugaucacaccccuuaugcucgaaggcaagaaauacgaugaggccuguaaugaacugaaccugaagguugccauuaaugaggacaaaaaggauuuucucccugcuuucaacgagaccuacuauaaggacgaagugacaaaucccgucgugcugcgcgccaucaaagaguaccggaaggugcuuaacgcgcugcucaaaaaguaugggaaaguccacaagauuaauaucgaacuggcuagagagguuggaaagaaccacucucagcgcgccaaaaucgaaaaggagcagaacgagaauuacaaagccaagaaagacgcugaacuggagugcgaaaaacuuggccucaagauuaacuccaaaaauauccugaagcugcggcuuuucaaagagcaaaaggaauuuugugccuauagcggcgagaaaauuaagaucucugaucugcaggacgagaaaaugcuugaaauugaucauaucuacccuuauagcagauccuucgacgauucuuacaugaacaaggugcugguguuuaccaagcagaaucaagagaaacucaacaagacgccguucgaggcuuuugggaaugacagcgccaaauggcagaagauugaaguccuggcgaaaaaccugcccacaaagaagcagaaacgcauccuugauaagaauuacaaagacaaggaacagaaagauuucaaggaccggaaccucaaugauaccagauauaucgcccgccuggugcugaacuacacaaaggacuaucucgauuuucugccucuuuccgacgacgagaauaccaaacugaacgauacccaaaagggaagcaaaguucacguggaggcuaagucuggcaugcucacauccgcccugcggcauacguggggguucagcaccaaagacagaaauaaccaucugcaccacgcuauugaugccgucaucauugcguacgccaacaauucuaucgugaaggcuuuuuccgacuucaagaaagaacaggagagcaacuccgccgaacuuuaugcuaagaaaauuucugagcucgauuacaagaauaaacgcaaguuuuucgagcccuuuagcggauuccggcagaagguucuggacaaaaucgaugaaaucuucguguccaagccugagagaaagaagcccucuggcgcccugcacgaagagacauuucggaaagaagaggaguucuaucagagcuacgggggaaaggaaggcguccucaaagcccuggagcuuggcaagauucgcaaggugaacgggaaaaucgucaagaauggagacauguuuagaguggauauuuucaaacauaagaaaaccaacaaguuuuacgcuguuccgaucuauacaauggacuucgcgcugaaggugcucccuaauaaagccgucgcucgguccaagaaaggcgaaauuaaggauuggauccugauggacgagaacuacgaauuuugcuucagccuguauaaagauucucuuauccugauucaaaccaaggacaugcaggagcccgaguuuguguacuauaaugccuucacguccagcacaguuucucucaucguguccaagcacgacaacaaauuugaaacccugagcaagaaucagaaaauucucuucaagaacgccaaugagaaagaagucaucgcuaagucuauugggauccagaaccugaagguguucgagaaauacaucgugagcgcccuuggagaaguuaccaaggcggaguuuagacaacgcgaggauuucaaaaaguga

SEQ ID NO: 3725 - RNA, 2955 nt, Artificial Sequence
  Cas9 variant
auggccagaauccuggcuuucgacauuggcaucagcuccauugggugggccuuuucugagaacgaugaacucaaggacugcggagugcggaucuucaccaaagcggagaaucccaagacaggcgaaagccuggcccuuccucgcagacuggcucgguccgcccgcaaaagacucgcucggcgcaaggccagacugaaccaccuuaaacaucugauugcuaaugaguuuaagcucaacuacgaagauuaucagucuuucgacgagagccuggccaaggcguacaaagggucccugaucucuccguaugagcuccgguuucgcgcccugaaugaacuucugagcaagcaagauuucgcuagagucauccuccacauugccaaacggcgcggauacgacgauaucaagaacuccgacgauaaagagaagggcgcuauucugaaggccaucaaacagaaugaagagaaacuugcgaacuaucagagcguuggggaguaccuguauaaagaauacuuucagaaguucaaagaaaauucuaaggaauuuacgaacgugagaaauaaaaaggaguccuacgaacgguguauugcccagagcuuccucaaggacgagcugaaacugaucuuuaagaaacaacgcgaguucggauuuucuuucuccaagaaauucgaagaggaagugcucagcgucgcuuuuuauaagagagcccugaaggauuucucucaucuugugggcaacugcuccuuuuucaccgacgagaaacgggcucccaagaauagcccucuggccuuuauguucguugcccucacaagaauuaucaaccugcuuaauaaccugaaaaacaccgaaggcauccucuacacaaaggaugaccugaaugcucugcucaacgaggugcugaaaaaugggacccuuacauauaagcagaccaagaaacugcucggacuguccgacgauuacgaguuuaagggcgaaaaagggacguauuucauugaguuuaagaaauacaaggaguucaucaaggcgcuuggagaccacucucugagccaggaugaccucaacgagauugccaaagauaucacccugauuaaggacgaaaucaaacugaagaaagcucucgccaaguaugaucugaaucaaaaccagaucgacucccuuagcaaacuggaguuuaaggaucaucucaauauuucuuucaaggcccugaaacugaucacaccccuuaugcucgagggcaagaaauacgacgaggcuuguaacgaacugaaucugaaggucgccauuaacgaagauaaaaaggacuuucucccugcguucaaugagaccuacuauaaggacgaggugacaaaccccguugugcugcgcgcuaucaaagaauaccggaagguccuuaaugcccugcucaaaaaguaugggaaagugcacaagauuaacaucgagcuggccagagaagugggaaagaauuacucccagcgcgcuaaaaucgagaaggaacagaacgagaacuauaaagccaagaaagaugcugagcuggaaugcgagaaacuuggccucaagauuaauagcaaaaacauccugaagcugagacucuucaaagaacaaaaggaguuuugugccuacucuggcgaaaagauuaagaucagcgaccugcaggaugagaaaaugcuugagauugaccacaucuauccuuacucccggucuuucgaugacagcuacaugaauaagguccugguuuuuaccaagcagaaccaagaaaaacucaaucagacgccguucgaggcguuugggaacgauuccgccaaguggcagaaaauugaagugcuggcuaagaaucugcccacaaagaagcagaagcgcauccuugacaaaaacuauaaggauaaagagcaaaaggacuucaaagaucggaaucucaacgacaccagauacaucgcccgccuggugcugaauuauacaaaggauuaccucgacuuucugccucuuagcgacgaugaaaacaccaagcugaaugacacccagaaaggaucuaagguccauguggaggcuaaauccggcaugcucacaagcgcccugcggcacacguggggguucucugcgaaggauagaaacaaucaucugcaccacgccauugacgcuguuaucauugccuaugcuaacaacuccaucgugaaagccuuuagcgauuucaagaaggagcaggaauccaauucugccgagcuuuacgcuaaaaagauuagcgaacucgacuauaaaaacaagcgcaaauuuuucgagcccuuuuccggauuccggcagaagguccuggauaagaucgacgagaucuucgugucuaaaccugaaagaaagaaacccagcggcgcgcugcaugaggaaaccuuucggaaggaggaagaguucuaccaauccuacgggggaaaagagggcguucucaaggcccuggaacuuggcaaaauucgcaaggugaaugggaagaucgucaaaaacggagauauguuuagaguggacauuuucaagcacaaaaagacaaauaaauuuuaugcugucccgaucuacaccauggauuucgcccugaaggugcucccuaacaaggccguugcucggagcaaaaagggcgagauuaaagacuggauccugauggaugaaaauuaugaguuuugcuucucucuguacaaggacucccuuauccugauucagacaaaagacaugcaggaacccgaguuuguguauuacaacgccuucaccagcucuacggucucccucaucgugagcaagcaugauaauaaguuugagacacugucuaaaaaccagaagauucucuucaaaaaugcgaacgaaaaggagguuaucgcuaaaagcauugggauccaaaaucugaagguguucgaaaaguauaucgucuccgcccuuggagaggugaccaaagccgaauuuagacagcgcgaggacuucaagaaauga

SEQ ID NO: 3726 - RNA, 2958 nt, Artificial Sequence
  Cas9 variant
auggccaagauccuggcuuucgacauuggcaucagcuccauugggugggccuuuguggagaacgaugaacucaaagacugcggagucagaaucuucaccaaggcggagaaucccaaaacaggcgaaucucuggcgcuuccucggcgccuggccagaagcgcccggaagcgccucgcuagacggaaagcccgccugaaccaccuuaagcaucugauugcuaaugaguuuaagcucaacuacgaagauuaucaguccuucgacgagucucuggccaaagcguacaaggggacgcugaucagcccguaugagcucagauuuaaagcccugaaugaacuucuguccaagcaagaucucgcucggguuauccugcacauugccaaacgcagaggauacgacaacaucaaaaauucugaugacaaggagaagggcgcuauucuuaaggccgugaaagaaaacgaggagaagcuggcgaauuauaaaagcgugggggaauaccucuauaaggaguacuuccagaaauuuaaggaaaacuccaaggaguucaucaauguccggaacaaaaaggaaagcuacgagcgcuguauugcccagucuuuucugaaagaugagcugaagcucaucuuccagaaacaaagagaauuuggauucaauuuuuccaagaaguucgaggaagaggugcugagcguugcuuucuauaaacgggcccuuaaggacuuuucucaucuggugggcaacugcuccuucuuugucgaugaaaaacgcgcucccaagaauagcccucucgccuucgaguuuguggcccugaccagaauuguuaaccuucugaacaaucucaacaaaaauaacucuuacaucaaggacgaucugaaugcucugcucuccgaggugcugaagaacggcacacuuaccuauaaacagacaaagaaaauccuggggcucagcgacgacuacgaauuuaagggacagaaaggcaauuauuucauugaguucaagaaguacaaagaauuuaucaaggcgcugugugagcacaaccuuaaucaggaugaccugaacgaaauugccaaagauaucacccucgucaaggacgagacaaaacugaagaaagcucuggccaaguaugaucucaaucaaaaccagauugagaaucuguccaagaucgaguucaaagaccaucuuaacaucucuuuuaaggcccugaaacucauugugccccugaugcgggaagggaagaaauacgaugaagugugcaaugagcugaaccuuaagaccgcuaucaacgaggacaagaaagaguuccucccugccuuuaaugaaacguacuauaaggaugaagucaacaaucccguugugcugagagcgauuaaagaguaccgcaaggugcugaacagccuccugaaaaaguauggaaagguccacaaaaucaauauugaacuugcucgggaggugggcaagaaccacagagagcgcuccaaaaucgaaaaggagcagaaugaaaacuucaaagccaagaaggacgccgagcuggaaugugagaaacucgggcugaagaucaauagcaaaaacauucugaagcuccggcuuuucaaagagcagaaggaauuuugcguuuacucuggagagaaaaucaagauuuccgaucugcaagacgaaaagaugcuggagaucgaccauauuuauccuuacagcagaucuuucgaugacagcuauaugaauaaagugcucgucuuuaccaagcagaaccaggaaaaacugaauaagacaccguucgaggcuuuuggcaaagaugacgugaaguggcaaaagaucgagacccuugccaaaaaccugcccgcuaagaaacagaagcgcauucucgauaaaaauuacaaggacaaggaacagaaagauuucaaggaccggaaccugaacgauacaagauacaucgcccgccugguucuuaauuauaccaaagacuaccucgaguuucugccucuguccgaugacgaaaacaucaagcucaaugauacgcagaaaggcucuaaggugcacgucgaggcuaagagcgggaugcugacauccgugcuucggcauaccuggggauucagcacaaaagacagaaacaaucaucugcaccacgccauugacgcugucaucauugccuaugcuaacgccucugugguuaaggcguuuuccgauuucaaaaaggagcaagaaaauuacaccgccgagcucuaugcuaaaaagaucaacgaacuggacuuuaagaauaaacgcaaguucuuugagcccuucagcaacuuccggcagaaagugcuggaaaagauugaugagaucuuugucucuaaaccugagagaaagaaacccuccggcgcccuucacgaagagaccuucuacaaggaagaggaauuuuauaaggaguacgggggaaaagagggcgugcucaaggcucuggaacuggggaaaauccggaagguuaauggaaaaauugugagcaacgccaauauguuccgcgucgacaucuuuaaguacaagaaaacaaacaaguucuaugccgugccgauuuacacgauggauuuugcucucggcauccugccuaauaaagcggugguuggcgggaaggacaaacagggaauuaucaaggauuggcuucugauggacgagaacuaugaguucuguuuuucccucuacaaggauucucugauccugcuucagaccaaagacaugcaagaacccgaacuggucuauuucaagagcuuuaaauccucuacagccggccucguggugagcaagcaugauaacaaauucgagaaucugaacgagaaucagaagaaacucuucaaguccgcuaacgaaaagaaagucguggccgaggggauuggaauccagaaucugaagguuuuugaaaaauacauugugagcgcccuuggcgagaucaccaaggcugagauuaaagaaagagagaacuucaagaagaaauga

SEQ ID NO: 3727 - RNA, 2961 nt, Artificial Sequence
  Cas9 variant
augcccagcgacccugccgaggcuaagccgcuggaacuccuggaucccuacgcccuuagagcgcagggccuggaccaagcucucccucugacccacuucgggcgggcccuuuuucaucugaaccagcgcagaggauucaaauccaaucggaagacagaucgcggcgacaacgagaaugggaaaaucaaggaugccucucagagacucgacugggcuaugcacgaagccaaagcucggacguauggagaguuucugcaucugcgcagacagaaggcccccgauccucggcaagugcccaccguccgcacaagacucagcguuggcaagcgcgggggaccugacgcgaaagaagaggccggcuacgauuucuauccggaccggagacaccuggaggaagaguuucaugaacuuugguccgcucaggcccaguuccaccccgagcugacccaggaucuccgggaccugguguuugagaagauuuucuaccaacgcccucuuaaagaacccaaggugggccugugccucuuuacaucugaggaaagacuggcuaaagcccacccucugacccagcggagaguccucuaugagacagugaaccagcugcgcaucaccgcggaugggcggagcguuagaccccuuucccgcgaacagcgggaccaaauuauccuggcccucgacacgaagaagccgaccaaaucucugaauagcaugguggucacacuucaggcucugggaaaggugcucaaacugagagagggcgagcgcuucacccuggaauccgggguucgggaggccauugcuugugauccugugagagccgccaugcucgcuacauuuggaccccgcuggagcgcgcuggacuggccugaacaguggcaagucaucucucgggugagaaaacuucaggaugacaaggauuucgccgagcugguggaauggcucaucgagcuguacggcgucgacaaggaggcugccguuaaaauugccaacacccaucuucccgaaggguauggacgccugggccucacggcuacaacccggauccuggauagacugaaguccaauguguuuacauacgcccaggcgguggcugccugcggcuggcaccauagcgaccagcggaccggggagugucucgaucgccugcccuacuauggagccguccuugacagacacgugauuccuggcaccuacgaugaaaacgacgacgauaucacacgguucgggagaauuacgaauccgaccguucacaucggacugaaccaacuccgccggcuggugaauaagauuaucgaggucuauggcaaacccaaccagaucgugguugaacuggcuagagagcuuaagcagucugagcagcagaaaaaugacgccauuaagcucauccgcgauacaaccacagcugccaaacagagauccgaaaagcuggaggaacuggggauuaccgacaacggacggaaucgcaugcuccugagacuuugggaggaucugaacccugacgaugcgaugcggcgcuucugccccuacacgggccagagaaucagcgccgcuaugauuuuugacggcucuugugauguggaccauauccucccuuauucccggacacuggaugacggguucgccaaccgcacccugugccuuagagaggcuaaucgggaaaagcgcaaccagacccccugggaggccuggggaggcacaccgaauugggaagcgaucgagaccaaccucaaaaaucugccugaaaacaagagauggcgguuugcccccgaugcuauggccagauucgagggggagaaugacuuucuggaccgcgcucucgucgauacacaauaccuggcccggauuagcagaacguaucuugacacccuguucacagaaggaggccacgugugggucgugccugggcgccucaccgagaugcugcggagacauuggggccugaacucccuucucacagauaaagaccgcggagccguuaagucuaaaaaucggaccgaucacagacaucacagcaucgacgcugcgguggucgccgcuacggaucgcucccugcugaaccggauuagcagagccgccggccagggggaaguggcuggacagucugccgagcucaucgcgcgggaaacacccccucccugggagggcuuucgcaaugaccugaagucccagcuugggagaauuaucguuagccaccgggcugaucauggacgcaucgacagacaagcccggaagcagggcagagauucuacagccgggcagcugcaccaagagaccgcuuacagcauuguggacgauacacgcgucgccucccggaucgacuuccucucugugaaaccggcgcagcugcuggaccagccuggcagaagcggacaggugcgcgaucuucaacuccggaaggcucugagaguugccaccggcgaccugacggggaaagauuacgaaaaggcccuccgcgacuuugcugccaaacccggacccuauaagggcauucggagaguccgcaucauuaagccucugcaggagcaggcuagagugccggugcccguccuugauccuaucaaagccuaccaagggggauccaaccauguguucgaaauuuggcaucugcccgacggcaagguugagccucaagugaucaccagcuuugaagcgcacgcccucgaggucgagaaacggccccacccugcugccaagcgccugcugagagugcacaaaggggauaugguugcucuuaagcgggaaggccgcaccguggucggacaugugcagcagaugcacaucaaaaauggccuguucauuguuccccauaacgaggccaaugccgacgcuagaaacucugaucggacagacccguuuaaguggauccagauugcggcccaaccugcuaucgccgccgggauuagacgcguggcugucgaugaaaucggacggcucagagacggcggggccaagaccaucuga

SEQ ID NO: 3728 - RNA, 2964 nt, Artificial Sequence
  Cas9 variant
auggccagaauccuggcuuucgacauuggcaucagcuccauugggugggccuuuucugagaacgaugaacucaaggacugcggagugcggaucuucaccaaagcggagaaucccaagacaggcgaaagccuggcccuuccucgcagacugucccggucugcucgcaaaagacucgcccggcgcaaggcuagacugaaccaccuuaaacaucugauugccaaugaguuuaagcucaacuacgaagauuaucagagcuucgacgagucccuggcuaaggccuacaaagggucucugaucagcccguaugagcuccgguuucgcgcgcugaaugaguuccuuuccaagcaagauuuugccagagucauccugcacauugcuaaacggcgcggauacgacgauaucaagaacaauggcgacgaggaaaaaggggagauucucaaggccaucaagcagaacgaggaaaaacugguuagcuaucagucugugggagaguaccuuuauaaggaauacuuccagaaauuuaaggaaaauuccaaagaguucauuaacgugagaaauaagaaagaaagcuacgagcgguguaucgcucaaucuuuucugaaggaugaacucaagcugauuuuccagaaacagcgcgaguuuggcuucuccuucagcaagaaauuugaagaggaaguccugucuguggccuucuauaagagagcgcucaaagacuuuucccaucugguuggcaacugcagcuucuuuacggaugagaagcgggcccccaaaaauuccccucuugcuuucauguuuguggcccugaccagaaucaucaaccuccugaauaaccuuaagaacacagaggggauucuguacaccaaggacgaucucaauacacugcugaacgaaguccucaaaaauggaacccugacauauaagcagaccaaaaagcugcuuggccucucuaacgacuacgaguucaagggggaaaaaggaacguauuuuaucgaguuccaaaaguacaaagaauuugugaaggcucugggcgagcacaaucuuagccaggacgaucugaacgagauugccaaagacaucacccucauuaaggaugaaaucaagcugaaaaaggcccuggcuaaauaugaccucaaucagaaccagaucgauucccugagcaaacuugaguucaaggaccaucugaauauuucuuuuaaggcgcucaaacugaucacaccccugaugcuugaagggaagaaguacgaugaggccuguaacgagcucaaucugaaaguugcuauuaacgaagacaagaaagauuuccugccugccuucaaugagaccuacuauaaggacgaagugacaaaccccgucgugcuccgcgccaucaaagaguaccggaaggugcugaaugcccuucugaagaaauauggaaagguccacaaaauuaacaucgaacucgcuagagagguuggcaagaaccacucccaacgcgcgaaaaucgagaaggaacagaaugagaacuacaaggcuaaaaaggaugccgaacuggagugcgaaaaacugggccuuaagauuaauagcaaaaacauccucaagcugcggcuguuuaaggagcagaaagaguucuguguguauucuggggaaaagauuaaaaucagcgaccuccaagacgagaagaugcuggaaauugaucauaucuacccuuauuccagaucuuuugacgauagcuacaugaauaaagugcuugucuucaccaagcagaaccaggagaaacugaauaagacgccguuugaaacauucggaaacgaccgcgugaaguggcagaaaauugagguucucgccaagaaucugcccaccaaaaagcaaaaacggauccuggauaagaacuacaaggacaaagagcagaaggauuuuaaagacagaaaucuuaacgauacacgcuauaucgcucggcucgugcugaauuacaccaaggacuaucuggauuuccucccucuguccgacgaugaaaacaccaaacuuaaugacacacagaagggcagcaagguccacguggaggccaaaucugggaugcugacguccacccucagacauacauggggauuuagcaccaaggaccgcgauaaccaucugcaccacgcuauugacgccgcgaucauugccuacgcuaacaauucuaucguuaaagccuucuccgauuuuaagaaagaacaggagagcaacacagcugagcuguaugccaagaagauuuccgaacuugacuacaaaaauaagcggaaauucuuugagcccuucucuggcuucagacaaaagcuccuggauaaaaucgacgaaaucuuugugagcaagccugagcggaagaaacccuccggggcgcugcacgaagagaccuuccgcaaggaggaagaguuuuaucagucuuacggaggcaaagaaggcguccucaaggcccuggagcuugggaaaauuagaaaggugaacggaaaaauggucaagaauggcgauauguuccggguggacaucuuuaagcauaaaaagacgaacaaauucuacgcuguuccgauuuauacaauggauuuugcccugaaggugcucccuaauaaagcugucgugcaggggaaggacaagaaaagcggacugaucaaggauuggauucugauggacgaaaacuacgaguucugcuuuucccuuuauaaagauagccugauccucauccagaccaaggacaugcaagagcccgaacugguuuacuaugagagacucgacucuuccaaugccagccugaccgugucuaaacacgauaacaaguucgaaacacuuuccaagaaucagaaaauucuguuuaagaacgccaaugagaaagaagucaucgcuaagagcauuggcauccagaaccucaaaguguucgagaaguacauugugucugcgcugggggagguuaccaaggccgaguuccgccagcgggaagacuuuaaaaaguga

SEQ ID NO: 3729 - RNA, 2964 nt, Artificial Sequence
  Cas9 variant
auggccagaauccuggcuuucgacauuggcaucagcuccauugggugggccuuuucugagaacgaugaacucaaggacugcggagugcggaucuucaccaaagcggagaaucccaagacaggcgaaagccuggcccuuccucgcagacuggcucgguccgcccgcaaaagacucgcucggcgcaaggccagacugaaccaccuuaaacaucugauugcuaaugaguuuaagcucaacuacgaagauuaucagucuuucgacgagagccuggccaaggcguacaaagggucccugaucucuccguaugagcuccgguuucgcgcccugaaugaacuucugagcaagcaagauuucgcuagagucauccuccacauugccaaacggcgcggauacgacgauaucaagaacuccgacgauaaagagaagggcgcuauucugaaggccaucaaacagaaugaagagaaacuugcgaacuaucagagcguuggggaguaccuguauaaagaauacuuucagaaguucaaagaaaauucuaaggaauuuacgaacgugagaaauaaaaaggaguccuacgaacgguguauugcccagagcuuccucaaggacgagcugaaacugaucuuuaagaaacaacgcgaguucggauuuucuuucuccaagaaauucgaagaggaagugcucagcgucgcuuuuuauaagagagcccugaaggauuucucucaucuugugggcaacugcuccuuuuucaccgacgagaaacgggcucccaagaauagcccucuggccuuuauguucguugcccucacaagaauuaucaaccugcuuaauaaccugaaaaacaccgaaggcauccucuacacaaaggaugaccugaaugcucugcucaacgaggugcugaaaaaugggacccuuacauauaagcagaccaagaaacugcucggacuguccgacgauuacgaguuuaagggcgaaaaagggacguauuucauugaguuuaagaaauacaaggaguucaucaaggcgcuuggagaccacucucugagccaggaugaccucaacgagauugccaaagauaucacccugauuaaggacgaaaucaaacugaagaaagcucucgccaaguaugaucugaaucaaaaccagaucgacucccuuagcaaacuggaguuuaaggaucaucucaauauuucuuucaaggcccugaaacugaucacaccccuuaugcucgagggcaagaaauacgacgaggcuuguaacgaacugaaucugaaggucgccauuaacgaagauaaaaaggacuuucucccugcguucaaugagaccuacuauaaggacgaggugacaaaccccguugugcugcgcgcuaucaaagaauaccggaagguccuuaaugcccugcucaaaaaguaugggaaagugcacaagauuaacaucgagcuggccagagaagugggaaagaauuacucccagcgcgcuaaaaucgagaaggaacagaacgagaacuauaaagccaagaaagaugcugagcuggaaugcgagaaacuuggccucaagauuaauagcaaaaacauccugaagcugagacucuucaaagaacaaaaggaguuuugugccuacucuggcgaaaagauuaagaucagcgaccugcaggaugagaaaaugcuugagauugaccacaucuauccuuacucccggucuuucgaugacagcuacaugaauaagguccugguuuuuaccaagcagaaccaagaaaaacucaaucagacgccguucgaggcguuugggaacgauuccgccaaguggcagaaaauugaagugcuggcuaagaaucugcccacaaagaagcagaagcgcauccuugacaaaaacuauaaggauaaagagcaaaaggacuucaaagaucggaaucucaacgacaccagauacaucgcccgccuggugcugaauuauacaaaggauuaccucgacuuucugccucuuagcgacgaugaaaacaccaagcugaaugacacccagaaaggaucuaagguccauguggaggcuaaauccggcaugcucacaagcgcccugcggcacacguggggguucucugcgaaggauagaaacaaucaucugcaccacgccauugacgcuguuaucauugccuaugcuaacaacuccaucgugaaagccuuuagcgauuucaagaaggagcaggaauccaauucugccgagcuuuacgcuaaaaagauuagcgaacucgacuauaaaaacaagcgcaaauuuuucgagcccuuuuccggauuccggcagaagguccuggauaagaucgacgagaucuucgugucuaaaccugaaagaaagaaacccagcggcgcgcugcaugaggaaaccuuucggaaggaggaagaguucuaccaauccuacgggggaaaagagggcguucucaaggcccuggaacuuggcaaaauucgcaaggugaaugggaagaucgucaaaaacggagauauguuuagaguggacauuuucaagcacaaaaagacaaauaaauuuuaugcugucccgaucuacaccauggauuucgcccugaaggugcucccuaacaaggccguugcucggagcaaaaagggcgagauuaaagacuggauccugauggaugaaaauuaugaguuuugcuucucucuguacaaggacucccuuauccugauucagacaaaagacaugcaggaacccgagcucguguauuuuaacgccuucaccagcucuacggucucccugaucgugagcaagcaugauaauaaguuugagacacucucuaaaaaccagaagauucuguucaaaaaugcgaacgaaaaggagguuaucgcuaaaagcauugggauccaaaaucuuaagguguucgaaaaguacaucgucuccgcccugggagaggugaccaaagccgaauuuagacagcgcgaggacuucaagaacgagcuccgguga

SEQ ID NO: 3730 - RNA, 2964 nt, Artificial Sequence
  Cas9 variant
auggccagaauccuggcuuucgacauuggcaucagcuccauugggugggccuuuucugagaacgaugaacucaaggacugcggagugcggaucuucaccaaagcggagaaucccaagacaggcgaaagccuggcucucccucgcagacuggcccgguccgcccgcaaaagacucgcucggcgcaaggccagacugaaccaccuuaaacaucugauugcuaaugaguuuaagcucaacuacgaagauuaucagucuuucgacgagagccuggccaaggcguacaaagggucccugaucucuccguaugagcuccgguuucgcgcccugaaugaacuucugagcaagcaagauuucgcuagagucauccuccacauugccaaacggcgcggauacgacgauaucaagaacaauggcgacgaggaaaaauccgagauucugaaggcuaucaagcagaacgaggaaaaacuuguuaauuaucagagcgugggggaguaccuguauaaggaauacuuucagaaauucaaggagaacucuaaagaauuuauuaaugugagaaacaagaaagaguccuacgagcgguguaucgcccagagcuuccucaaggaugaacugaagcugauuuuucaaaaacagcgcgaguucggauuuucuuucuccaagaaauucgaagaggaaguccucagcguggcguuuuauaagagagcccugaaagacuucucucaucuuguuggcaauugcuccuuuuucacggaugagaagcgggcucccaagaacagcccucugguguuuauguucgucgcccucaccagaaucaucaaucugcuuaacaaccugaaaaauacagagggcauucucuacaccaaggacgaucugaacgcucugcucaaugaagugcugaaaaacgggacacuuaccuauaagcagaccaaaaagcugcucggacuguccgacgacuacgaguuuaagggcgaaaaagggaccuauuucaucgaguuuaagaaauacaaggaguucauuaaagcccuugaugaacacucucugagccaagacgaucucaaugagaucgccaaggacauuacgcugaucaaggaugaaaucaaacugaagaaagcucucgcgaaguaugaccugaaagagaaccagauugauucccuuagcaagcuggaauuuaaagaccaucucaauaucucuuucaaggcccugaagcugauuacaccccuuaugcucgagggcaaaaaguacgaugaggcuuguaacgaacugaaucugaaaguugccaucaacgaggacaagaaagauuuucucccugccuucaaugaaacauacuauaaggacgaggugaccaaccccgucgugcugcgcgcuauuaaggaauaccggaaaauccuuaaugcccugcucaagaaauauggaaaggugcacaaaaucaacauugagcuggcgagagaggucgggaagaaucacucccagcgcgcuaagaucgaaaaagagcagaacgaaaacuacaaggccaaaaaggacgccgagcuggaaugcgagaaacuuggacucaagauuaauagcaagaacauccugaaacugcggcuuuucaaggagcaaaaagaauuuuguguuuauucuggcgagaagauuaaacugagcgaucuucaggacgaaaagaugcuggagaucgaucauauuuacccuuauuccagaucuuucgacgauagcuacaugaauaaagugcucguguuugcuaagcagaaccaagaaaagcugaauaaaacaccguucgaggccuuuggcaacgacuccaccaaguggcagaaaaucgagguccugacgaagaaucuucccaccaaaaagcagaagcgcauccucgauaaaaacuacaaggacaaagaacagaaggauuucaaagaccggaaucugaacgauacaagauauauugcucgccuggugcucaauuacacaaaggacuaucuggauuuucuuccucugagcgacgacgagaacaccaagcucaaugauacccaaaaagggucuaagguucacguggaagccaaauccggaaugcugacaagcgcgcugcggcauacguggggcuucucuaccaaggacagaaacaaucaccuucaccaugccaucgaugcugucauuaucgccuacgcuaacaacuccauugugaaagccuuuagcgacuucaagaaggagcaggaguccaauucugcggaacucuaugccaaaaagaucagcgagcuggauuacaaaaacaagcgcaaauuuuucgaacccuuuuccggguuccggcagaagguucuggacaagaucgaugagauuuucgugucuaaaccugaaagaaagaaacccagcggagcucuccacgaggagacauuucggaaggaagaggaguucuaucaguccuacggcgggaaagaaggaguccugaaggcccuugaacugggcaaaauccgcaaggugaauggcaagauugucaaaaacggggacauguuuagaguggauaucuucaagcauaaaaagaccaauaaauuuuacgcuguuccgauuuauacaauggacuucgcccucaaggugcugccuaacaaggccgucgcucggagcaaaaagggagagaucaaagauuggauccugauggacgagaauuacgaauuuugcuucucucuuuauaaggauucccugauucucauccaaaccaaagacaugcaggagcccgaacugguguacuuuaacgcguucacgagcucuacaguuucccucauugugagcaagcacgacaauaaguuugagacccugucuaaaaaccagaagauccuuuucaaaaaugccaacgaaaaggaggucauugcuaaaagcaucggcauccagaaucugaagguguucgagaaguauauuguguccgcccucggggaaguuaccaaagccgaguuuagacaacgcgaagauuucaagaacgagcugcgguga

SEQ ID NO: 3731 - RNA, 2964 nt, Artificial Sequence
  Cas9 variant
auggccagaauccuggcuuucgacauuggcaucagcuccauugggugggccuuuucugagaacgaugaacucaaggacugcggagugcggaucuucaccaaagcggagaaucccaagacaggcgaaagccuggcccuuccucgcagacuggcucgguccgcccgcaaaagacucgcucggcgcaaggccagacugaaccaccuuaaacaucugauugcuaaugaguuuaagcucaacuacgaagauuaucagucuuucgacgagagccuggccaaggcguacaaagggucccugaucucuccguaugagcuccgguuucgcgcccugaaugaacuucugagcaagcaagauuucgcuagagucauccuccacauugccaaacggcgcggauacgacgauaucaagaacuccgacgauaaagagaagggcgcuauucugaaggccaucaaacagaaugaagagaaacuugcgaacuaucagagcguuggggaguaccuguauaaagaauacuuucagaaguucaaagaaaauucuaaggaauuuacgaacgugagaaauaaaaaggaguccuacgaacgguguauugcccagagcuuccucaaggacgagcugaaacugaucuuuaagaaacaacgcgaguucggauuuucuuucuccaagaaauucgaagaggaagugcucagcgucgcuuuuuauaagagagcccugaaggauuucucucaucuugugggcaacugcuccuuuuucaccgacgagaaacgggcucccaagaauagcccucuggccuuuauguucguugcccucacaagaauuaucaaccugcuuaauaaccugaaaaacaccgaaggcauccucuacacaaaggaugaccugaauacccugcucaacgaggugcugaaaaaugggacacuuaccuauaagcagacgaagaaacugcucggacuguccgacgauuacgaguuuaagggcgaaaaagggaccuauuucauugaguuuaagaaauacaaggaguucaucaaggcucuuggagagcacaaccugucucaggacgaucucaaugaaauugcgaaagacaucacacugauuaaggaugagaucaaacugaagaaagcccucgcuaaguaugaccugaaccaaaaucagaucgauagccuuuccaaacuggaguuuaaggaccaucucaacauuagcuucaaggcccugaaacuggucacaccccuuaugcucgaaggcaagaaauacgaugaggccuguaaugaacugaaccugaagguggcuaucaaugaggacaaaaaggauuuucucccugccuucaacgagaccuacuauaaggacgaaguuaccaaucccgugguccugcgcgcgauuaaagaguaccggaaggugcuuaacgcucugcucaaaaaguaugggaaagugcacaagaucaauauugaacuggccagagaggucggaaagaaccacucucagcgcgccaaaaucgaaaaggagcagaacgagaauuacaaagcuaagaaagacgccgaacuggagugcgaaaaacuuggccucaagaucaacuccaagaauauucugaagcugagacucuucaaagagcaaaaggaauuuugugcuuauagcggcgagaaaaucaagauuucugaucugcaggacgagaaaaugcuugaaaucgaucauauuuacccuuauagccgguccuucgacgauucuuacaugaacaagguucugguguuuacgaagcagaaucaagagaaacucaaccagacaccguucgaagccuuugggaaugacagcgcgaaguggcagaaaaucgaggugcuggccaagaaccugcccaccaaaaagcagaagcgcauucuugauaaaaauuacaaggacaaagaacaaaagaacuucaaagaucggaaucucaacgacacaagauauaucgcucgccugguccugaauuacaccaaggauuaucucgacuuucugccucuuuccgaugacgagaacaccaagcugaaugacacacagaaaggaagcaaggugcacguugaggccaaaucuggcaugcucacguccgcucugcggcauaccuggggguucagcgccaaggauagaaacaaccaucugcaccacgcgaucgacgccgugauuaucgcuuacgccaauaacucuauugucaaggcuuuuuccgauuucaagaaggaacaggagagcaauuccgccgaacuuuaugccaaaaagaucucugagcucgacuacaaaaacaagcgcaaauuuuucgagcccuuuagcggauuccggcagaaggugcuggauaagauugacgaaaucuucguuuccaaaccugagagaaagaaacccucuggcgcucugcacgaagagacauuucggaaggaagaggaguucuaucaaagcuacgggggaaaagaaggcgugcucaaggcgcuggagcuuggcaaaauccgcaaggucaaugggaagauugugaaaaacggagauauguuuagagucgacaucuucaagcauaaaaagaccaauaaauuuuacgccgugccgauuuauacaauggauuucgcucugaagguucucccuaacaaggccguggcccgguccaaaaagggcgaaaucaaagacuggauucugauggaugagaauuacgaauuuugcuucagccuguauaaggacucucuuauccugauccagaccaaagauaugcaggagcccgagcucgucuacuuuaacgcuuucacguccagcacagugucucugauuguuuccaagcacgacaauaaguuugaaacccucagcaaaaaccagaagauccuguucaaaaaugccaacgagaaggaagugauugcgaaaucuaucgggauucaaaaucuuaaggucuucgagaaguauaucgugagcgcucugggagaagugaccaaagccgaguuuagacagcgcgaggacuucaagaacgaacuccgguga

SEQ ID NO: 3732 - RNA, 2964 nt, Artificial Sequence
  Cas9 variant
auggccagaauccuggcuuucgacauuggcaucagcuccauugggugggccuuuucugagaacgaugaacucaaggacugcggagugcggaucuucaccaaagcggagaaucccaagacaggcgaaagccuggcccuuccucgcagacuggcucgguccgcccgcaaaagacucgcucggcgcaaggccagacugaaccaccuuaaacaucugauugcuaaugaguuuaagcucaacuacgaagauuaucagucuuucgacgagagccuggccaaggcguacaaagggucccugaucucuccguaugagcuccgguuucgcgcccugaaugaacuucugagcaagcaagauuucgcuagagucauccuccacauugccaaacggcgcggauacgacgauaucaagaacuccgacgauaaagagaagggcgcuauucugaaggccaucaaacagaaugaagagaaacuugcgaacuaucagagcguuggggaguaccuguauaaagaauacuuucagaaguucaaagaaaauucuaaggaauuuacgaacgugagaaauaaaaaggaguccuacgaacgguguauugcccagagcuuccucaaggacgagcugaaacugaucuuuaagaaacaacgcgaguucggauuuucuuucuccaagaaauucgaagaggaagugcucagcgucgcuuuuuauaagagagcccugaaggauuucucucaucuugugggcaacugcuccuuuuucaccgacgagaaacgggcucccaagaauagcccucuggccuuuauguucguugcccucacaagaauuaucaaccugcuuaauaaccugaaaaacaccgaaggcauccucuacacaaaggaugaccugaaugcucugcucaacgaggugcugaaaaauuccacccuuacauauaagcagaccaagaaacugcucgggcugucugacgauuacgaguuuaagggagaaaaaggcacguauuucauugaguuuaagaaauacaaggaguucaucaaggcgcuuggggaccacagccugucccaggaugaccucaacgagauugccaaagauaucacccugauuaaggacgaaaucaaacugaagaaagcucucgccaaguaugaucugaaucaaaaccagaucgacagccuuucuaaacuggaguuuaaggaucaucucaauauuuccuucaaggcccugaaacugaucacaccccuuaugcucgagggaaagaaauacgacgaggcuuguaacgaacugaaucugaaggucgccauuaacgaagauaaaaaggacuuucucccugcguucaaugagaccuacuauaaggacgaggugacaaaccccguugugcugcgcgcuaucaaagaauaccggaagguccuuaaugcccugcucaaaaaguauggcaaagugcacaagauuaacaucgagcuggccagagaaguggggaagaauuacagccagcgcgcuaaaaucgagaaggaacagaacgagaacuauaaagccaagaaagaugcugagcuggaaugcgagaaacuuggacucaagauuaauucuaaaaacauccugaagcugagacucuucaaagaacaaaaggaguuuugugccuacagcggcgaaaagauuaagaucuccgaccugcaggaugagaaaaugcuugagauugaccacaucuauccuuacucucggagcuucgaugacuccuacaugaauaagguccugguuuuuaccaagcagaaccaagaaaaacucaauaagacgccguucgaggcguuuggcaacgauagcgccaaauggcagaagauugaagugcuggcuaaaaaucugcccacaaagaagcagaaacgcauccuugacaagaacuauaaagauaaggagcagaaagacuucaaggaucggaaucucaacgacaccagauacaucgcccgccuggugcugaauuauacaaaggauuaccucgacuuucugccucuuucugacgaugaaaacaccaaacugaaugacacccaaaagggguccaaaguccauguggaggcuaagagcggaaugcucacaucugcccugcggcacacguggggcuucuccgcgaaagauagaaacaaucaucugcaccacgccauugacgcuguuaucauugccuaugcuaacaacagcaucgugaaggccuuuuccgauuucaagaaagagcaggaaucuaauagcgccgagcuuuacgcuaagaaaauuuccgaacucgacuauaagaacaaacgcaaguuuuucgagcccuuuucuggguuccggcagaagguccuggauaaaaucgacgagaucuucgugagcaagccugaaagaaagaagcccuccggagcgcugcaugaggaaaccuuucggaaagaggaagaguucuaccagagcuacggcgggaaggagggaguucucaaagcccuggaacuuggcaagauucgcaaggugaauggcaaaaucgucaagaacggggauauguuuagaguggacauuuucaaacacaagaaaacaaauaaguuuuaugcugucccgaucuacaccauggauuucgcccugaaggugcucccuaacaaagccguugcucggucuaagaaaggagagauuaaggacuggauccugauggaugaaaauuaugaguuuugcuucucccuguacaaagacagccuuauccugauucaaacaaaggacaugcaggaacccgagcucguguauuuuaacgccuucaccucuuccacggucagccugaucgugucuaagcaugauaauaaauuugagacacucagcaagaaccagaaaauucuguucaagaaugcgaacgaaaaagagguuaucgcuaaguccauuggcauccagaaucuuaagguguucgaaaaauacaucgucagcgcccugggggaggugaccaaggccgaauuuagacaacgcgaggacuucaaaaacgagcuccgguga

SEQ ID NO: 3733 - RNA, 2964 nt, Artificial Sequence
  Cas9 variant
auggccagaauccuggcuuucgacauuggcaucagcuccauugggugggccuuuucugagaacgaugaacucaaggacugcggagugcggaucuucaccaaagcggagaaucccaagacaggcgaaagccuggcccuuccucgcagacuggcucgguccgcccgcaaaagacucgcucggcgcaaggccagacugaaccaccuuaaacaucugauugcuaaugaguuuaagcucaacuacgaagauuaucagucuuucgacgagagccuggccaaggcguacaaagggucccugaucucuccguaugagcuccgguuucgcgcccugaaugaacuucugagcaagcaagauuucgcuagagucauccuccacauugccaaacggcgcggauacgacgauaucaagaacuccgacgauaaagagaagggcgcuauucugaaggccaucaaacagaaugaagagaaacuugcgaacuaucagagcguuggggaguaccuguauaaagaauacuuucagaaguucaaagaaaauucuaaggaauuuacgaacgugagaaauaaaaaggaguccuacgaacgguguauugcccagagcuuccucaaggacgagcugaaacugaucuuuaagaaacaacgcgaguucggauuuucuuucuccaagaaauucgaagaggaagugcucagcgucgcuuuuuauaagagagcccugaaggauuucucucaucuugugggcaacugcuccuuuuucaccgacgagaaacgggcucccaagaauagcccucuggccuuuauguucguugcccucacaagaauuaucaaccugcuuaauaaccugaaaaacaccgaaggcauccucuacacaaaggaugaccugaaugcucugcucaacgaggugcugaaaaaugggacccuuacauauaagcagaccaagaaacugcucggacuguccgacgauuacgaguuuaagggcgaaaaagggacguauuucauugaguuuaagaaauacaaggaguucaucaaggcgcuuggagaccacucucugagccaggaugaccucaacgagauugccaaagauaucacccugauuaaggacgaaaucaaacugaagaaagcucucgccaaguaugaucugaaucaaaaccagaucgacucccuuagcaaacuggaguuuaaggaucaucucaauauuucuuucaaggcccugaaacugaucacaccccuuaugcucgagggcaagaaauacgacgaggcuuguaacgaacugaaucugaaggucgccauuaacgaagauaaaaaggacuuucucccugcguucaaugagaccuacuauaaggacgaggugacaaaccccguugugcugcgcgcuaucaaagaauaccggaagguccuuaaugcccugcucaaaaaguaugggaaagugcacaagauuaacaucgagcuggccagagaagugggaaagaauuacucccagcgcgcuaaaaucgagaaggaacagaacgagaacuauaaagccaagaaagaugcugagcuggaaugcgagaaacuuggccucaagauuaauagcaaaaacauccugaagcugagacucuucaaagaacaaaaggaguuuugugccuacucuggcgaaaagauuaagaucagcgaccugcaggaugagaaaaugcuugagauugaccacaucuauccuuacucccggucuuucgaugacagcuacaugaauaagguccugguuuuuaccaagcagaaccaagaaaaacucaaucagacgccguucgaggcguuugggaacgauuccgccaaguggcagaaaauugaagugcuggcuaagaaucugcccacaaagaagcagaagcgcauccuugacaaaaacuauaaggauaaagagcaaaaggacuucaaagaucggaaucucaacgacaccagauacaucgcccgccuggugcugaauuauacaaaggauuaccucgacuuucugccucuuagcgacgaugaaaacaccaagcugaaugacacccagaaaggaucuaagguccauguggaggcuaaauccggcaugcucacaagcgcccugcggcacacguggggguucucugcgaaggauagaaacaaucaucugcaccacgccauugacgcuguuaucauugccuaugcuaacaacuccaucgugaaagccuuuagcgauuucaagaaggagcaggaauccaauucugccgagcuuuacgcuaaaaagauuagcgaacucgacuauaaaaacaagcgcaaauuuuucgagcccuuuuccggauuccggcagaagguccuggauaagaucgacgagaucuucgugucuaaaccugaaagaaagaaacccagcggcgcgcugcaugaggaaaccuuucggaaggaggaagaguucuaccaauccuacgggggaaaagagggcguucucaaggcccuggaacuuggcaaaauucgcaaggugaaugggaagaucgucaaaaacggagauauguuuagaguggacauuuucaagcacaaaaagacaaauaaauuuuaugcugucccgaucuacaccauggauuucgcccugaaggugcucccuaacaaggccguugcucggagcaaaaagggcgagauuaaagacuggauccugauggaugaaaauuaugaguuuugcuucucucuguacaaggacucccuuauccugauucagacaaaagacaugcaggaacccgaguuuguguauuacaacgccuucaccagcucuacggucucccucaucgugagcaagcaugauaauaaguuugagacacugucuaaaaaccagaagauucucuucaaaaaugcgaacgaaaaggagguuaucgcuaaaagcauugggauccaaaaucugaagguguucgaaaaguauaucgucuccgcccuuggagaggugaccaaagccgaauuuagacagcgcgaggacuucaagaacgagcugcgguga

SEQ ID NO: 3734 - RNA, 2979 nt, Artificial Sequence
  Cas9 variant
augagaaucuucagcgacggccggaaccccaaggauggguccucucuggccgugacccgcagagcugcccgggcgaugcgcagacggcgcgacagacuccugaaacggaagacacgcaugcaggcuaaacuugucgagcacggauuuuucccugccgaugccggcaagagaaaagcucuggaacaacucaauccguacgcccugcgggcuaaggggcuucaggaggcccugcuccccggagaauuugcgcgcgcccuguuccauauuaaccagagacggggcuuuaagagcaaucgcaaaacggacaagaaagauaacgacuccgggguucugaagaaagcuaucggacagcucagacaacagauggccgagcagggcucucggaccgugggcgaauaucuguggacaagacuucagcaagggcagggagugcgcgcucgguacagagagaagccuuauaccacagaggaaggcaagaaacgcauugauaagagcuacgaccuguauaucgaucgggccaugauugagcaggaguucgacgcgcucugggccgcucaggccgcuuuuaaucccacccuguuccacgaggccgccagagcugaucuuaaagacacacugcuccaucaacgcccucugcggcccgucaagccugggagaugcacccugcucccggaggaagaacgcgcgccccuggcccuuccuuccacgcagcgguuuagaauccaccaggaagugaaccaucugcgccuccuggaugagaaucuucgggaaguugcucugacccucgcccaaagagacgccguggucacagcucuggagaccaaagccaagcugucuuucgagcagauccggaaacuccugaaacuuagcggauccgugcaguuuaaccuggaagacgcgaagcgcacagagcucaaaggcaaugcuaccagcgccgcccuggcuagaaaggaacuuuucggggccgcuuggucuggauuugaugaggcccugcaggacgaaauuguuuggcaacucgugacggaggagggcgaaggcgcgcugaucgccuggcugcagacacacaccggggucgaugaggcucgggcccaggcuauuguggacgugucccuccccgaaggauacggcaaccugagcagaaaagcccuugcgcgcaucgucccugcccugcgggcugccguuauuacauaugauaaggcugugcaggccgccggguucgaccaccauucucaacucggauucgaguacgaugcuuccgaaguggaggaccugguccaccccgagaccggcgaaaucagaagcguguuuaaacagcugccguacuaugggaaggcgcuucagcgccauguugccuucggaucuggcaagccugaggaucccgacgaaaagagauacggcaagauugcuaauccuaccgugcacaucgggcucaaccagguccggauggugguuaaugcccugauccgcagauauggacggcccacagagguggucauugagcuggcccgcgaucucaaacaauccagagaacagaagguggaggcucagcggcgccaggccgacaaccaaagacggaaugcgcgcaucagacggagcauugcugaaguccugggcaucggggaggaaagagugcgcggauccgacauucagaaauggaucuguugggaggagcuuucuuuugaugccgccgaccggagaugccccuacagcggcguucagaucuccgcugccaugcugcucagcgaugaaguggaggucgaacacauucugccuuucucuaagacgcuggacgauucccuuaacaaccgcaccguggcgaugcggcaagcuaauagaaucaagcgcaaccggacaccgugggacgccagagccgaguuugaagcucagggguggagcuaugaggauauucuccagcgcgccgagcggaugccccugagaaaacgguaccgcuucgcuccugacggcuaugaaagauggcugggagaugacaaggauuuucucgcccgggcgcugaaugacacccgcuaccuuucuagaguugccgcugaguaccugcggcucgugugucccggcacaagagucaucccugggcagcugaccgcccugcuucgcggaaaauucggccucaacgaugugcuggggcuggacggagaaaagaaucggaacgaccauagacaccaugcuguggaugccugcguuauuggcgucacggaccaagggcucaugcagcgcuuugccacagcuagcgcgcaggcccggggcgauggacugaccagacuuguggacggcaugcccaugccguggccuaccuaucgcgaucacguggagcgggcugucagacauaucugggugucccaccgccccgaccacggguucgaaggagccaugauggaggagacaucuuacggcaucagaaaagaugggagcauuaagcagcggcgcaaggccgacggauccgcuggcagagaaaucagcaaucugauucggauccaugaggccacccaaccucuccgccacgggguuucugcggauggccagccccuggcuuauaaaggauacgugggcggguccaacuauuguauugaaaucacagucaaugacaagggaaaaugggagggcgaggugauuagcacguuuagagccuacgggguugugcgggccggaggcauggggagacugcgcaacccucaugaaggccagaauggacggaaacuuaucaugagacucgucaucggcgauucugugcgccuggagguugacggggcugaacggaccaugagaauugugaagaucuccggaagcaacggccagauuuucauggcccccauccacgaggcgaaugucgaugcucggaacacagacaagcaagacgccuuuaccuauacauccaaauacgccgggucucugcagaaggcuaagacccgcagagugacgauuagcccgaucggagaagugcgggauccuggcuucaaaggcuga

SEQ ID NO: 3735 - RNA, 2985 nt, Artificial Sequence
  Cas9 variant
augacccugggccucgaccuggggacaaacagcaucggaugggcccuuauugauuucgacgauaaucagcaacccagaaaccugaucgcuugcggcucccggauuuuucaggaggccguggaagcgaagacggggaccccuaaaaaucacgcucgcagaacagcccgggccgcucgcaagcucgucgccagacggaaacagcgcagaaccaagcugcuuaaccugcucauccggcauggacugcugccgcaggacguugcugagcgcaaugcccuccugcuugauaaccaagcgaauaaccccuaccagcugagaaaacggggccucgacgaaaagcuggagccuuucgccuuugggcgcgcucuuuaucaccuggcccauagacggggauuccagucuaaucgcaaggcugccagcgaugaagacggcaaagugaagacagcgauuuccacccucagagccgagaugcagggccggacacugggggcuuuucuggccgaucaacccacccagagacgccgguacacggacagagcuauguauguggaggaguucgagcagcucuggucuaaacaggccagcuuuacccaagaacagcugacacaggcccuuaaggucgcuauccacaacuccaucuucuuucaacgcccucugaaaucucagaagcaucucgugggaaaguguaccuucgagcccacacggaaaagagcggccaaggcuauucugcuuacccagcgcuuucggauccugcaggauguuaaucaccucgccgugaaaaacccuauuacgagagaguuccgcccgcugacacaagacgaacggaauaagcuggccgaggcucucgauaaacaaaagagcaugaccuggggcgccgucagaaaagugaucggguggaacaagaaggacucccugcacgaaggagagacauuuaaucuugaagagggcaaaaaggacaaacugauugggaaccgcaccgcgugcgaucuccggggagcucugggcgacagaugggaugcccuuaccgcccagcagcaagacgaucugguuacagaccuccugacgaucgauaacaccgacggcuuccugaagcggaugaaaacacauugggaguucgaugacgcuaccgccgaagugauugcuaagaucgagcucgaacccggguacgcccgccugagcgcgaaggccaugagagcuauccuuccuuaucuggagcagggaaugauuuacucugaugccuguaaagcugccggcuaugaccacuccaaucccaaccagcggacaaucaccgacaagcucgggcugccuagcaaugucagaaaccccguggugcagaaagcgcuguuugaaacgcgcaaggucguuaaugccauugugcggaaauacggaaagccggcugugaucagagucgagauggcccgcgauaugaagcucucuaaaagacaaaaggaggaacuccagaaagagcagaacaagcagaaaaaggcuaaugaacuggccgagggcauucugcggaaggaguucgggauccaacagccugcccgcgcugacauccagaaauacaaccucuggcuggaaugcaaggaggugugucccuauacaggaaccaccauuuccagagaaaugcuuuuuagcccugagguugauguggaacauauccugcccuacucucggucccucgacgauagcuauaugaauaaaacacugugcauggcgaccuucaaccgccaagucaagcugaauaacacacccuacgagauuggccagggcgacccucuugccuaugcugagaucuuucagagaauuaaaacgcucccguuccccaagcggcgcagauuugaacagaaagagaucgaaaccgauaaguucaucgagcggcaacugaaugacacacgcuacauuuguguggaaguuagagauuuucugcagcagcucggggccccuguggaggucuccaagggagaggccaccgcuaaacugcggggcagauggaaacuuaacacacugcucucucccgacgggagcaaugaaaaguaucgcggagaucaccggcaccaugccaucgacgcgguggucauugcucugaccaacagaucccuguuccacaaacuuagccgccucucugcccaguccaucagccuggauaagucucgguuugacgugccucccccgugggacggcuucuacgaugacguuuacgagaagauugauaaggugaucgucagccaugccccugcuagaaaaauugggggcgcccugcacgaagacacggcguauggacauuuuaaggaggaaguggcugaucccaaaaccggcaagguuuccaucgaggaccgcuucguguaccggaaaccucucgccacacugaccgccaacgaggucgggaagaucagagaugcuaaggugcgcgaguucguggaagcccggcuugcucaauuuggaaauaacucuaaaacagccuucggcgaccccaauaacccucugcuccacgcggaugggaagacccccauuagaacgguucggcuggucacaaauuuuaacaaagccaccacacacgcuauccagaagggacagggccgcgacuauaaauucuuuaaguacgggaauaaccaucacguggaaauuaucgagcauguggaaaccggcaagagaaaaggaauuuucgucaccgccauggaggcugcccggcgcgugagaggcguugccaauacagaaaagagcgauaucgugcagcggaaccacggggaagaguggagauuugucaugucccugagcaucaaugaccuugugucuauucaagaagcugaucagguucgcaucaugcgggugcagcuuuucgacgcguccaacggaaauauuaucuuuagagaccagaaaagcgccaugcuggaugacaagcugucucgcuaucagacgaaagcucaccuccuggucugccagaagauuaccacagauccgcuuggcaaccuggccccuuguaaugacuga

SEQ ID NO: 3736 - RNA, 2988 nt, Artificial Sequence
  Cas9 variant
augagcaaggugcugggccucgacaucggggccaacuccauuggaugggcucugaucgaugacgaggaaaaugauauuaucggcgccggggucagaguuuucaaagagggagugaaccuuaagggcgugaaagaagagucuaagaaugucgaacggcgcgcggcuagacuggcccggcgccagcacaaaagacggagccaacgcagaaaccggcucguggcccugcuuaagacccuggagauguuucccgagaauaacgaagacauuuccgauuacuaugcucaggacccuuacgagcuccgcaagaaagggcuguaugaaaagcugacaauguacgaguucggaagaguucuccugcauaucugccggcgcagaggcuuuaaaucuagccggaagacggauaucuccgaggaaggcaaaauuuucgaggggaaggacggaaucgugggcauuaaucagacccgcgauucuaucagagaagggggauuuaagacaauuggcgaguaucuugccagccuggacccgcacgucauccggagacgcaaccgguucacccucagagauauguacgaagaggaguuuaaucugaugugggaaaaacagcaauccuucuauccccuucagcugagcaacgaguuuaaggaagcuauugccgaggugauccucucucagcgcaaacugaagucccagaaagcgcugguugggaauuguggacucgaaccuaacaagaaaacagcccccaagagcucuccugcuuuccaauacuuucggauccuggagcagcuuucccgcauucugaucagcauuccccauaccggcagauacaaugacccucucaacgaggaggagcggagaaugcugaucgauaaacuuucugugacagaaaagcugaaguucuccgacaugcgcaaaaugcucaaucugccgggcgagagcgacauuaacaucgaagaggaagggggacggcugcucggcaacaccacguaugccagacugaucaaggucuuugggaaaaagcgcugggcuggauucuccgaagaggaaaaggagcagauuuggcacaccuuccauuuugccgauaaucacgaguggcuuaaagaauacgcgcugaagaaauggucuaucacacccgacgagauuaaggaacucggcaaaguggcccuggagaaggaauaugcucgguucagcaagaaaucccuuaagaaaaucauuccucagcuggaggaggggcucacccuggauaaggccaaaaucgaagcuggauacacacccgaguaugaaaucgaaaagagccugucugccuaccucccucugcccgagaacauuagaaauccgaucgugcaacaggcccuuuaugagcugcggcacgucguuaacgcugugauucgcaccuacggcaagccugacaucgcgagaguggagcucgcccgggaaaugaaaaagcccaaacagaagagagagaaaaugcgcuccgaacugcggaagagacaaaugaaauuugaggaaauuaagagcauccugaaggagcgccuuggcuucauugauccuaaaagagacgagauccauaaguacaugcucugggaagagugccgggaaacgugucccuauacagggcgcaaaaucucucugagcgcucuguacggaggcgauuuugaggucgagcacauuauccccuauaagagaucccucgacgauucucuguucaauaaaaccgugugccuucgggaagagaaccagauuaagggggaccgcacaccuuacgaagccuauagcggagauagacagaaguacgaggaaaucauucugcggguucagaaaaccuccaugccgcgcggcaagaaaaaucucuuugccaucaaggagcugaaagacgacuucgcucauagacaacugagcgauaccgccuauaucucucgggagacacgcaaguaccuuggguccacgauuaagaaagugcaggcggucaagggcggaagcaccgcuaaacucagauacuauuggggccugaacucuauccugggggugcgggacauuaagaugagagaugaccaccgccaccaugccguugaugcccucgugaucgcuaauacaaccuacgccuuugucaacacacugucccgguaucacagcauggacguggaaccccaugaguccagauucccucuucccugggaacaguuucgcaaugaugcugagucugucgugcggaacauuuucguuagccacagacuggggaaaaaggccaccggccagcuccaugaagagacguacuaugggaagauccgcaauacagacggagagccuuacuuugugguccggaaaaagcugggcacccugaccgcgaaacaaaucgccaacauuguggaucccguugugaagacacaggucuucgaaagacuugaggaaaaagggaucgacauugaguccucuaauaagaucccggcugaugccuucguggaaacccucuauaugccugaccgcaaaacacccauuaagagcgugcggguuaaggucccuuccacgaccaugauccagcuguacaaagauaaggagcuguacguggaccccggcagcaaccaccacaucgugauuuuugagaacgaagagggaaaaagagacggcaucgucgugucucucuucgaagcugcccagcggcugcgcagaaaugagccuguuauucaaaagacauggaaacccgaguggcauuuugugaugucccuuagcaucgaugaacugauucuccuggacgucgaugagaagaacaucgacuggggagauaccggacuggcgcuucgguauucuaaggcccucuaccgcgugcagaaaauggacguuaauaagauuaucacacugagacaccaucugguggcucggcucaaagaugacgaaggcaaggaguucgggagagaacaccgcaucccguccacccugcggggacuuaaagucaagauugaucacaucggcagacugcgccgggccuaugacuga

SEQ ID NO: 3737 - RNA, 2988 nt, Artificial Sequence
  Cas9 variant
augaaggugaucggcuucgacauugggaucaacagcauuggaugggccuuugucgagaaugaugaacugaaagacugcggcguuagaaucuucaccaaggcugagaaccccaaaaauaaggaaucccucgcccugccucggcgcaacgcgagaucuagccggaaacgccuuaagagacggaagcugcgccucauugcuaugaaacacauccuggccaaggagcuuaaucugaacuacaaagauuauaucgccaaugacggggaacucccgaaggcuuacgagggaaaacugauuucccccuaugagcugagauacaaggcccucaaccagaagcuggaagcuaaagaucuugugcgggugauccugcauauugccaagcaccgcggcuauaugaauaaaaacgacaagaaaucuaaugaugcggagaaggggaaaauccucagcgcccugaagaacaaugcucuuaagcuggaaaaauaccaauccgucggagaguauuuuuacaaggaguucuuucagaaauacaaggaaaacacaaaagacuucauuaagaucagaaauauuaaggauaacuauaacaauugugugcucgccucugaccuggagaaagaacugaagcucauccuggagaaacagaaggaauuuggcuacagcuauuccaacgauuucaucgaggagguuauucagguggccuuuuuccaacggccucuuaaagacuuuagccaucuggucggcacgugcaccuucuuugaagaggaaaagcgcgcuuguaaaaauucuuacuccgcgugggaguucguggcccucacaaaaaucguuaacgaacuuaagagccuggagaaaauuucuggggagcugaucuccacccagacaauuaaugaaauccucaacuauauccuggauaagggaagcauuaccuacaaaaaguucagaucuuauaucaaucuguacgaguccauuaaguuuaaaagccucaaguacgacaaagacaacgcugaauccgccaagcugaucgauuuccggaaacuuguggaguuuaagaaagcucugggcgaacacuauuucaaucgccaggagcucgaccagauuucuacauacaucacccugaucaaggauaacgucaaacuuaaaacggcccuggagaaguauaaucucagcaacgaacaaauuaauaaccugcuggagaucgaauuuaaugaccauauuaaccucuccuucaaagcccugagcaugauccuuccccugaugaaggaggggaaaaaguacgaugaggcuugcgaaauugcgaaccucaagccuaaaaccacaaaucagaagcaggacuuucugcccgccuucuguaacucuaucuuugugcacgagcuguccaauccuauugugaacagagcuaucagcgaauaucggaaaguccuuaaugcccuccugaagaaauacggaaagguucacaagauccaucuggagcucgccagagauauuggccugucuaaaaaggcucgcgaaaagaucgagaaggagcagaaagaaaaccaagccauuaauaccugggcgcuuaacgagugcgaaaauauggggaucaaggcuaacgccaagaauauucugaaacucaagcuguggaaagagcagaaggaaaucuguaucuauagcggaaagaagauuuccaucgagcaccugaaagacgagaaggcccuugaaguggaucauauuuacccguacucucggagcuucgacgauuccuauaugaacaaggugcucgucuuuacaaaagagaaucaggaaaagcugaacaaaacccccuucgaggcuuuuggcaagaauaucgaaaaauggaacaagauucaaacgcuggcccagauccucccuuacaagaaaaagaacaaaauccuggacgagaauuucaaggacaaccagcagcaagauuucauuagcagaaaucuuaacgacacacgcuauaucgcuacccugauugccaaauacacaaaggaguaucucaauuuucugccccugaacgaaaaugagaacaucaaucuuaagucuggcgaaaaaggguccaagauucacauccagaccgugaacggaaugcucaccagcguucugcggcacacauggggcuucgauaaaaaggacagaaauaaccaucugcaccaugcgcucgaugccaucauuguggcuuacucuaccaauucccugaucaaagccuuuagcgacuucaagaagaaccaggagcuucugaaagcuaagcucuaugccaaagagcugaccaaugauaacuacauucaccaggcgaaguuuuucgaaccuuuugagggguuccgcgagaaaauccugaacaagauugacgaaaucuuugucuccaagcccccgcggaaaagagcccgcggagcccuucauaaggaaacauucuacucugagaaaaagaugauuaaaaaguauaauagcaaagagggccucaacaucgcucuggauugcgggaagauccggaagauuggaaccaaauacguggaaaaugacacaaugguuagaguggauaucuuuaagaaacaaaacaaguucuaugcuauuccuaucuacaccauggacuuugcccugggcauucuccccaauaaaaucgucgugaucggcaaggauaagaacaauaacccuaaacaguggcaggagauugacgaauccuaugaguucuguuucucucuguacaagaaugaccuuauccugcuccagaaaaaggauaugcaagaagccgaguuugcuuauuacaacggguucgacauugauagcucccgcaucaauauuaaaaagcacgacaacaaguuugagaaucugacgagcaaccagaaacugcuuuucacaaauaaggagaaaaaccggaccggaauccagaaucugaagaucuuugaaaaauacauugucacgccccucggcaacaagaucaaggcggauuuccagcccagacaaaacauuucucugaaauccagcaagaaaaaugggcucuga

SEQ ID NO: 3738 - RNA, 2988 nt, Artificial Sequence
  Cas9 variant
augaagauccugggcuucgacauugggaucaacagcauuggaugggccuuuguggagaaugaugaacucaaagacugcggcgucagaaucuucaccaaggcugagaaccccaaaaauaaggaaucccuggcccuuccucggcgcaacgcgagaucuaaucggcgcagacugaaacggcgcaagagcagacucauugcuaucaagcacauccuggccaaagagcuuaaccugaauuacaaggauuauauugccaacgacggggaacucccgaaggcuuacgagggaaagcugacaaauguuuaugagcugcgguacaaagcccucaaccagaagcuggaagcuaaggaucuugcccgcgugauccugcauauugcgaaacacagaggcuauaugaauaagaacgagaaaaaguccaaugacucugaaaaagggaagauccucagcgcccugaaaaacaaugcucuuaagcuggagaaguaccaauccgugggagaguauuuuuacaaagaguucuuucagaaguacaaagaaaacacgaagaacuucauuaaaauccggaauaccaaggauaacuauaauaacuguguccucgccucugaccuggaaaaggagcugaaacucauucuggaaaagcagaaagaguuuggcuacagcuauaaugaugacuucaucaaggagaucauuaacaucgcuuucuuccagcgcccccuuaaagauuuuucccaucuggugggcagcugcacauucuuugaagaggaaaagagagccuguaaaaauucuuacuccgcgugggaguucguugcccucagcaaaauuaucaacgaacugaagcggcuugagaaaauuucuggggagcugaucuccgcucaaaccaucaaugaaauucucaaccacauccuggacaagggaaauauuacauauaaaaaguuccgcagcugcaucaaccugcaugagucuauugaauuuaagucccucaauuacgauaaagacaacgccgagagcgcuaagcugguggacuucaaaaagcugaucgaauuuaaaaaggcccugggcgagcacuccuucaauagacaggagcucgaugaaaucgccacccacauuacacugaucaaagacaacgauaaacuuaagaccgcucuggagaaguauaaccucaauaacgaacagauuaaugcgcugcuggagaucgaguuuaacgaccauauuaaucucucuuucaaggcccugaaccuuauccugccucucaugcgggaagggaaaagauacgaugaggcuugugaaauugucaaucuuaagagcaaaacguccaaccagaagcaagaccugcuucccgccuuuugcgauagcaucuucucucaggagcucuccaauccugugguuaaccgcgccaucagcgaauaccggaaggugcugaaugcucugcucaaaaaguauggaaaaguccacaagauucaucuggagcuugccagagacgugggccugucuaaaaaggcgcgcgagaagaucgaaaaagagcagaaggaaaacaaagagauuaaugauugggcucucgacgaaugugagaaguuugggcugaaagccaacaauaagaacauccugaaacuuaagcucuggaaggagcagaaagaaauuugcgccuacagcggaaagaaaaucuccaucgagcaccugaaggaugaaaaagcucuggagguggaccacauuuaucccuacucucggagcuucgacgauuccuauaugaacaagguccucguuuuuaccaaggaaaaucaagagaaacugaacaagacaccuuucgaggccuuuggcaaaaauaucgaaagauggaacaagauucaggcucuugcccagaaucugccguacaaaaagaagaacaaaauccucgacgagaauuucaaggauaaacaacagcaggacuucauuagccgcaaccugaaugauacccgguauaucgcgacacugaucgccaaguacaccaaagaauaccuuaacuuucucccccugaaugagaacgagaauacgaaccugaagucuggcgaaaagggguccaaaauucaugugcagacaaucaauggaaugcucaccagcgugcugagacacacauggggcuucgacaagaaagaucgcaacaaccaucuucaccaugcucuggacgccauuaucgucgcuuauucuaccaauuccauuaucaaggccuuuagcgauuucaaaaagaaccaagagcuccugaaggcgaaacuguacgccaaggaacuuaccuccgacaauuauaaacaccaggcuaaguuuuucgagccuuuugaaggguuccgggagaaaauccucaacaagauugaugagaucuuugugucuaagcccccuagaaaacgcgcccggggaacacugcacaaggaaacguucuaccccgaggaaaccaugauuaaaaaguauaauagcaaagagggccugaacaucgcucucaauugugggaagauuagaaaaaucggaacaaaguacguugaaaacgacaccauggugcggcuggauauuuuuaagaaacagaauaaguucuaugccaucccgaucuacacaauggacuuugcccuuggcauucugccuaacaaaaucgucauugcuggcaaggacaaaaauaacaaucccaagcaguggcaagagaucgaugaguccuacgaauuuugcuucucucucuauaagaacgaccugauucugcuucagaaaaaggauaugcaggaggcggaauuugccuacuauaauagcuucgacaucgauuccagccgcaucaacauuaaaaagcaugacaauaaauuugagaaccugaccgauaaccagaagcuccuguucacgaaucaagaaaagaacagaacagggauccagaaucucaaaauuuuugagaaguacaucgugaccccucugggagacaaaauuaaggcugauuuccagccccggcagaacaucucucuuaaaaccuccaagaaguauggccuguga

SEQ ID NO: 3739 - RNA, 2991 nt, Artificial Sequence
  Cas9 variant
augaugggcaacuucacccuggggcucgaccugggaacaaauagcaucggcugggcccuuauugauuuugacgauaaccagcaaccccagaaucugaucgcuugcggguccagaauuuuccaggaggccguggaagcgaagacgggaaccccuaaaaaccacgcucggcgcgccgccagagcugcccggaagcucgucgcucgcagaaaacagcggcgcacaaagcugcuuaaucugcucguuugucaugaccugcugccgcaagaugaggccgaaagaaacgcgcuccugcuugacaaucaggccaacaaucccuaccagcugcggaaacgcggccucgaugagaagcuggaaccuuuugcuuucgggagagcccuuuaucaccuggcucaucggcgcggauuucagucuaacagaaaggccgcgagcgacgaggauggcaaagugaagaccgccaucuccgcucuccgggccgagaugcaaggccacacacugggggcuuuccuggccgaccagcccacccagcgcagacgguacacagauagagccauguaugcugaagaguuugaacagcucuggucuaaacaaaccauuuucgcgccugagcagcugacgcaggcccuuaagguggagaucaaaaauagcaucuuuuuccaacgcccccugaagucccagaagcaucucgucggaaaaugcaccuuugaaccuacacggaagagagcugccaaagccauucugcuugcucagcacuuccgcauccugcaggacgugaaccaccucgccguuaagaauccgauuacccgggaguuuagaccccugacacaagaugaacgcaacaaacuggcggaggcucucgacaagcagaaaggcaugaauuggucugccgugcggaaggucaucggguggaacaagaaagacagccugcaugaaggagagaccuucaaccuugaggaaggcaagaaagauaagcugauugggaauagaacggccugugaccuccgcggagcucugggcgaucggugggacgccuucacagcuccucagcaggaugaccuugugaccgaucugcucacaaucgacaaccccgauggcuuucugaaaagaaugaagacccacuggggguucgacgaugccaccgcggaggcccuggcuacaacggaacucgagccuggauacgcccgccuguccagcaaggcuaugcgggccauucuuccccaucuggaacaaggcaugaucuauucugacgcgugcaaagccgcuggguacgaccacuccaauccgaaccagagaaccaucacagauaagcucggacugccuagcaauguucggaaccccgugguccagaaagcccuguuugagacccgcaagguggugaaugcuauugucagaaaauauggcaagccugccguuauccggguggagauggccagagacaugaaacuuucuaagcgccagaaggaggagcuccaaaaagaacagaacaagcagaaaaaggcuaaugagcuggcggaagggauucugcggaaggaguucggaauccagcaacccgccagaacagauauucagaaauacaaccucuggcuggaguguaaggaagugugccccuacaccggcacggucaucucccgcgagaugcuuuauagcccugaaguggacguugagcacauccugccguacucuagaucccucgaugacagcuauaugaauaaaacacuguguauggcuaccuacaaccggcagaccaagcugaauaacacacccuaugagauuggccaaggggauccuguggccuacgccgaaaucuuucagcgcauuaaaacccuucccuucccuaagagacggcgcuuugagcagaaagaaaucgagacagacaaguucauugaaagacagcucaaugauacgcgguauaucugcgucgaggugcgcgacuuucugcaacagcugggagcucccguugagguguccaagggcgaagccaccgcgaaacucagagggcgguggaagcugaacacacuucugucuccgggaggcgggaacgagaaaaaucgcgcugaucauagacaccaugccaucgacgccgucgugauugcucucaccaaccggagccuguuccacaagcuguccagacuuagcgcccagucuaucuccuuugauaaaagccgcuucgacgucccucccccuugggacgauuuuuacgacgauguguacgaaaagauugacaagguuaucgugucucaugcgcccacacggaaaauuagcggcgcucuccacgaggccaccgccuauggacacuucaaggaagagaucgcugauccuaaaacgggcaaguucuccauugaggacagauuugucuaccgcaaaccccugaccacacugaccgccaaugaaguggggaagauccgggaugcuaagguuagagagcucguggaagcccgccuggcgcaguucggaaacaauucuaaagccgcuuuuggcgacccgaacgagccucuucugcaugccgaugggaagacacccauccggaccauuagacucacgacaaauuucaacaaaaccacaacccacgcuauccaaaagggacaggaccgcgauuauaaauuuuucaaguacggcaauaaccaucacgucgaaauuaucgagcacguggagaccgggaagcggaaaggcauuuuugugacagccauggaagccgcuagacgggcgcgcggaguugccaauacggaaaagagcaacaucguccagagaaaucauggcgacggguggaaauucgugaugucccuggcugugaacgauaugguccggaccgaagacacacaggccaucuaucgcgugcaaaagcuggacggaagcaauaacagauuuacccuucggucucacaacgccgcuacacucgaugacaaacagaccggcguugauaagacgcccaaucuguucaaagggacaaagauuaucguggacccucugggaaaccucacccaguguaaugauuga

SEQ ID NO: 3740 - RNA, 2994 nt, Artificial Sequence
  Cas9 variant
augaaggugcuggucgacgccggccucaugcccagcgauccugcugccgcgaaagcucuggagacccuugacccguacgaacugagagccacaggccucgauguuaugcugccccuuacgcaccugggacgggccguguuccaucucaaccagcgcagaggcuuuaaguccaaucggaaaaccgaccgcggggauaacgagucuggaaagaucaaagacgcuacaaagagacugaccugggccaugcaagaagcuggcgcccggacauauggggaguuccugcacaugcgcagagcgcgggccagcgauccucgccaggugcccuccgucagaacccggcucucuguggcuagccgcggaggcccugacuccaaggaagaggccggcuacgauuuuuaucccgagagagcucaucuggaagacgaguuccacgcccuuuggucugcgcaggccgcuuuucauccugaucugacaugcgaacuccgggacguuguguucgagaaaaucuuuuaccagcgcccgcugaaggagcccaaagucgggcuuugucuguucaccgccgaagagagacucccuaaggcucacccccugacgggacggagagugcuguaugaaaccguuaaucaacuccgcgugacagccgauggccggaccacaagaccucugacccuugaggaacgcgacaugauugucuacgcccuggacaacaaaaagcccgucaagagccucuccagcaugcaccugaaacuuguggcucuggggaagcucgugaaacugaaggauggagagcgguuuacgcuggagucuggcguuagagacgcgauugccugcgauccgauccgcgcuacaauggggcauccugacggauucggccccgccuggucccggcucgauuggcaggcccagugggcucugauugaaaaacuuagacaggugcaaagcgacgaugacuuugccucucugguggcguggcucggcgcuacccacaaucuguccgaggaucaugccaagcgcgucgccaaccuucaucugccugaaggguauggacggcucggccugacagcuaccgaggccauccuguguaaucucaaagcugaagugugcaccuacagccaggccguugagagaugggggaagcaccacucuaaccagcgcacaggagagugucuggaagcgcuucccuacuauggcgaggugcuggaccggcacgucauccccgggacguacaaugaagaugacgacgaugugaccagauauggacggauuacaaacccuaccguucauaucggccucaaucagcugcgcagacuggugaaccggauuaucgccacauacggcaagccggaccaaauugucguggagcuugcuagagaacucaaacaguccgaggcccaaaagagcgaggcucugaaaaagauccgcgauaccacggccgacgcgauucggagagggcgccagcuggaagagaucggacagaaaaauacaggcgccaacagacuccugcuucggcugugggaagaucucgggcccgcugucggaccucgcugcugucccuauaccggcaagccuaucuccgugaccaugcuguucgacggggccugcgauguugaccacauucugcccuacucuagaacacuugaugacagcuuugcuaaucggaccaucugucuccgcgaggccaacagacagaagggcgaucggacaccgugggaggccuggggaggcuccgaccagugggaugcuauugaagcgaaccugaaagaccugccugagaauaagcgcaaaagauucgcccccgacgcuauggaacgguucgagggggaacgcgauuuucucgacagagcccugguggauacgcaauaucuugcccggaucagcagagcuuaccuggacacccucuucacagagggaggccaugucugggugguuccugggcgcaugaccgagaugcugcggagacacuggggacugaacgcccuucucucugauaaggaccgcggcgcggggaaagugaagaaucggacagaucacagacaucacgcuauugacgccgccgucaucgcugccaccgaucauucccuggugaaccgcaucagcaaggcggcuggccagggagaaucugccggccagagcgccgagcugauugcucgggacacgcccgaaccuugggagggguuuagaaaugauaucuccgcccagauugcucgcaucgugguuucucaccgggccgaccacggaagaauugaugucgaaggccggaaacaugggaaggacagcaccgcgggacgccuccacaacgacacagccuacggcaucguggaugaccauaccguggucuccagaacaccccugcuuagccugaaaccgggggauaucgaggugaccacgaagggcaaaaauauucgggacacacaacuccagaaggcucugucuguugccaccacaggaaaggauggcaaaggguucgaggaagcucugcgcaacuuugccgagaaggaaggaccuuaucagggcaucagacgggugagacuuauugagacccuccaguccagcgcccgcgucgaaguggggucugacgaggauggacaaccccugaaggcuuacaagggcgacuccaaucacugcuaugaucuguggaaacuccccgacgggaagguugugccucaugucgugagcaccuacgaggcgcacgccggcacagauaaacggccgcaccccgcugccaagagaauccugcgcguuuucaagaaagacaugguggccauugaacaggacgaucagacggcuaucuuuuauguccagaaacuugaccgggccaacggacuguuccucgcgccucaucuggaggcuaaugccgaugccagacaccgcaaccccaaugacgcuuuuaaauuccugcaaaugggcgccggguccguggugcggaacaaacuuagacgcgucuacguugaugaaauuggaagaaucaaggacccugggcccccuaagcauuga

SEQ ID NO: 3741 - RNA, 2994 nt, Artificial Sequence
  Cas9 variant
augaagauccugggcuucgacauugggaucaacagcauuggaugggccuuuguggagaaugaugaacucaaagacugcggcgucagaaucuucaccgaggcugaaaaccccuccaauaaggagucucuggcccuuccucggcgcaacgcgagaagcucccggcgcagacugaaacggcgcaaggcuagacucguugccauuaaacggauccuggccaaggaacuuaagcugaauuuuaaagauuacguggcugccgacggggagcucccgaaggcuuaugagggaaaacugacaucuaucuacgaacugcgcuauaaggcccucauucagcaacuggagacgaaagaucuugcgagagugauccugcacauugccaagcaucggggcuacaugaacaagaaugagaaaaagagcaacgacaccaaaaaggggaaaauccucuccgcucugaagaauaacgcccuuaaacuggaaaauuaucagucugucggagaguacuucuauaaggaauuuuuccagaaguacaaagagaacacaaagaauuuuauuaaaauccgcaacaccaaggauaauuacaacaacugugugcucagcuccgaccuggaaaaagagcugaagcucauucuggaaaagcagaaagaguucggcuauaauuacagcgaggauuuuaucaacgaaauccuuaagguugcuuucuuucaaagaccccugaaagacuucucucaccucgugggcgccugcacauuuuucgaggaagagaagcgggcguguaaaaauuccuauagcgccugggaguucgucgcucugaccaagauuaucaacgaaauuaagucucuugagaaaaucuccggggaaauugugccuacacagaccaucaaugagauccugaaccucauucuggauaagggaagcaucacguacaaaaaguuucgcucuugcauuaaucugcaugaauccaucagcuucaaaucccucaaguaugacaaggagaacgccgaaaaugcuaaacugauugauuuuagaaaacuuguugaguucaaaaaggcccugggcgugcacucucucagccggcaggagcuggaccagaucuccacccauaucacacuuauuaaagacaacgucaagcugaaaaccgugcucgaaaaguacaaucugagcaacgagcaaaucaauaaccugcucgaaauugaguuuaaugauuauaucaaccugucuuucaaggcccuugggaugauucugccccucaugagagagggaaaacgcuacuacgaggcuugugaaaucacaaaccugaagccuaaaaccguggacgaaaaggaggauuuucugcccgcguucugcgacuccauuuuugcccacgaacuuagcaauccugucguuaaccgggcuaucucugaguauagaaaagugcucaaugcccugcugaagaaguacggcaaagugcacaagauccaucucgagcuggcccgcgaugucgggcuuagcaaaaaggcucgggagaaaauugaagaccagcagaagaacaauaaggccaucaacgauugggcgcugaaagaaugugagaauauuggaaucaaggcuuccgccaaaaacauucucaagcugaaacuguggaaggaacagaaggagaucugcaucuauucuggcaauaaaauuagcaucgagcaccuuaaggacgaaaaagcccucgagguggaucauauuuacccguauucccgcagcuucgacgauucuuuuaucaacaagguucugguguucacgaaagaaaaucaagagaagcugaacaaaacacccuuugaggcuuucggcaagaauauugaaaagugguccaaaauccagacccucgcccagaaccugccuuacaagaaaaagaauaaaauccuugacgagaacuucaaggacaagcaacagcaggauuuuauuagcagaaaccugaaugacacacgguauaucaccacccucauugcuaaauacacaaaggaauaccugaacuuccugccccuuucugagaaugaaaacacgaaucucaaauccggggagaagggaagcaaaauccacauucagaccaucuccggcaugcugacaucuguccugagacacaccuggggguuugauaagaaggaccgcaacaaucaucuccaccaugcccuggaugcgaucauuguggccuauagcacauccucuaucauuaaggcuuucagcgacuuuaagaaaaaccaagagcuucugaaggcccgguucuacgcuaaagaacucaccuccgauaauuauaagcaccagguuaaguuuuucgagccuuuuaaaggauucagagaaaagauccugagcaaaauugacgagaucuuugugucuacgcccccgcgcaagcgggccagaggcgcgcugcaugaagagacauucuacuccgaggauaaaaugauuaagaaguauaacagcaaagaagggcuucagaucgcccucucuuguggacggguccgcaagaucggcaccaaauacguggagaaugacaccauggucagaguggauauuuuuaagaaacagaacaaguucuaugcuaucccuauuuacguuauggacuucgcccugggcauccugcccaauaaaauugugaucacagggaaggauaagaacaauaacccuaaacaauggcagaccaucgacgaauccuacgaguuuugcuucagccucuauaagaacgaccugauucuucugcagaaaaagaauaugcaggaacccgaguuugcuuacuauaacucuuucgauaucgaccggagcagaauuaaaaucaagaagcacgauaauaaauuugagaaccucacauccaaucaaaagcugcuguucacgaacaaagacaagggaaagaaucgcaccggcauucagaaccuuaaaaucuuugaaaaguacaucgucacaccccugggggauaaaauuaaggccgacuuccagccucgggagaauaucagccucaaaaccucuaagaaacacggacuguga

SEQ ID NO: 3742 - RNA, 2994 nt, Artificial Sequence
  Cas9 variant
augggcaacuacacccuggggcucgacaucggaagcaauuccauuggcugggcccugguggaggaugcugucgaagcccccagaaucguugacaugggggugcggguguucccugagggagucgaucgcgacacaaagggccuugaaaaaucuaagaacgcgacgagacgggaggcucgcggggccagacggacccaccagcgcagacggcaacgcaaacagagacuggugcgggcccuccgccagguuggacugcuuccgugcgauaaggcugaagugagaagccuguuucagacagaccccuaugagauucggaaacgcggccucgaucauagacuggagcuguacgaaaucggccgggccuucuaucaccucucccaaagacgcggguuuaagucuaauagaaagagcggagcucugaaagaggacggcaccgucaagaaagaagccggggagcuucagcggaagauugaugaggcgggaugucgcacaaucggcgaauacuucgccgggcuggacccugagcagcagcggaucagaggacgcuauaccuuucgguccauguaccaaaaagaguucgaucuccugugggcuaaacagguggaguuuuaucccaagguucuuacagaagaccugagaucuaaggugcgcgaugagauuaucuucuuucagcggccucucaagagcgccaaagaccugauuggcgacugcgagcuggaacccaccgagaagagauguccucgcgcugauugguacgcccggagauuccggcuccugcaggacaucaacaaucuuauuauccaaaacccggauggcacggaacagaaacugucccccgaccagcgcgcggcccuccugggggagcuuggacaaagagaaaagcugaccuuugauaauauucgggcuaaacucggccugcuggagacacagaaguucaacgccgaguacagaaucgggcgcaaggggaaaaaggucgaagcuaucaaaggcgacguguuuguguggaccaugcggggaaagagcgucuucggaccuaaagccugggaugccauggcugacgagagaaagguuucucucaaugaacuguucguggagcuugaagaugacgaucuggcgcgcaagcucgagacagaguauggccugaccgacaaacaggugcaggccgcuaugaaggccucccuuccccaaggcuacaugagcuuuucuagaaaagccguccugaagcuccugccuuucauggaagcuggggcccugacgcaugaggcgauugaccaggcuggauaucggaaagaagaacccacacagaccgaugccaucgcccgcguguccuuuccgccugaccucagaaaccccauuguucagaaggcucuguucgaggugcggaaggucgugaaugcccuuguucgcgaauacggcaaaccuacaagaaucaagauugagauggcucgggaugugcaagggagcaaacgccagagagaggaacugcacuggcggaacgaagacaaucgcaagaaaaacgaggaggucagagaucggcucagaaccgacauccauaucgaugaccccucucgcgaugacgugauuaaguauaagcuguggcaggaauccggaaaaaugugccccuacaccggccggcagaucugucaagaggcccuguuugggccuaauccggaguuccaggucgaacacauucuucccuaugauagaagccucgacgauuccuacaugaaccugacacugugcgaagugcacgagaacauccauggcaagcgcaaucagacgccuuuugaggcguacggaucuggcgccgaacgguaugagcagauuaaacaaagaaucaagguucuccccuggccuaaacgccagaaguuccugcagcaagaaaucaaccuugacagccacauuucccgggagcugaaugacaccagauacaucugucgcgaaacaguggcuuaucucaaacagcuggggguccaugugcggggaaccagaggcaagauuacagccgagcugcggcaccagugggggcuugauggaaucuuuagcgagcucggcguucgcagagacgaugaccaccggcgccaugcuguggaugcccuggucguggcggugaccgacaacgaacaccugagacggcucgccguuucuaaguacguccuggcugggcccagauucgagacgccgugguccgccuuucgcgaugaagcucggggcaaugugaaaagaaugaacgugagccaucgcgucugccggaaggugucuggagcccuucacgaggagacaaauuauggcccuaccgggguuagagaccaggccggacaagauauuuacgcuuaucgcaaaaagcuggaagaccucaccacacccaugguggagaaaaucgucgauccugugguucgggacauugugagacagcgccugcugaugaagggcaucgaucccgcggccgcugacagaaagaucccuaaagacgucuggaaggaaccccuuuacaugcggcgcaccaaaagcgauaagaugauucagaucagacgggugcgcauucaugacguuaaaaacuccaucauugugcucacagaugagucugggagaccguaccgggccgucgaaccuggaggcaaucaccacguggagguguucgaguauguccaugggacgaagaccggcacaagagaagccgagguugugaccauguuugaagcugugcgccggagcagagcccgcgcgcccgucgugcggagagaccacggacccggcacacgguucguuuguucccuggcuaucaacgauauggugaugaugccugacaagagcgggaaaauggaucuguuccgcauccagaagaugucugccuccaaacaagucuacuuuagacaucacaccgccgcucggauugacagcgagcgcacgcucaucagaaagcaggcccaccuguucaauggauauaaagugucuguugauccgaccggcgcgauuugccgggcuaacgacuga

SEQ ID NO: 3743 - RNA, 3000 nt, Artificial Sequence
  Cas9 variant
augaagauccugggcuucgacauugggaucaacagcauuggaugggccuuuguggaggauaaucagcuccaagacugcggcgucagacuguucaccaaagcugaagaucccaagacaaaagagucccuugcccugccucggcgcaacgcgagaucuaaucggcgcagacucgggcggcgcagaagccggcugaucgcucuuaagcacauuaucuccaaaggacugaagcucaacuaccaggacuauaucgccaaugauggcgaacugccgaaggccuacgaggggcgccugauuucucccuaugaacucagauacaaagcucugaacgagaagaucgagccuaaagaccuugcccggguuauucugcauaucgcuaagcaccgcggauauaugaauaaaaacgaaaagaaaagcuccgauaaugagaaaggcaagauucucucugcccugaaaacgaacgcgcuuaagcuggaaaaauaccagagcgugggcgaguauuuuuacaaggaguucuuucagaaauacagagaaaauaccaaggacuucaucaacauucggaauaaggagggguccuaugaaaacugugugcucgccagcgaucuggagaaagaacugaagcucauccuggagaaacaaaaggaguggggauacucuuauaaugacaacuuuaucaaagaaauucuuaaggucgcuuucuuucagcgcccccugaaggauuucuccuaccucgugggcgccugcacauuuuucgaggacgaaaagagagcuuguaagaacagcuauucugccugggaguuuguugcgcugaccaaaaucauuaaugaacuuaagucccuggagaaagagagcggggaacucgugucuucccagaucauuaacgagauccugaaucauauccuggauaagggaagcauuacauacaagaaauuccgggaauauaucaagcuccacgaguccaugaaauucaagucucugaaauacgacaaggacaacgucgaaagcaccaagcugauugaguuuagaaaacugguggaguucaagaaagcccucggcgaacauucccugagccgcgaggaacuugaucagaucgcuacauacauuacccugaucaaggacaaugagaaacucaagaucacgcuggagaaauauucucugaacaaugaacaaauuaagaaccuccuggagaucgauuuuaaugaccacauuaaccuuuccuucaaggcccugaaucucauccugccucugaugaaagaagggaagcgguacgaugaggcuugcaaacuucucaaccugaagaccaaaagcaauaaccagaaguuugacuuccugcccgccuuuugugauucuauuuucgcccaggaacucacaaauccuaucguuaacagagcuauuagcgaguaucgcaaggugcugaacgcgcuucugaaaaaguacggaaaaaugcacaagauccauaucgagcucgcccgggacauuggccuguccaaaaagcugagagcuaagaucgaaaaagagcagaaggaaaauuaugagaacaauauuugggcccuuaacgaaugcgagaaauuuggccucaaggccaaugcuaaaaacauccugaagcugaagcucuggaaagagcaaaaggaguucuguauuuacucugggaaaaagaucagcaucgaacaccuucgcgaugaaaaagcccuugaggucgaccauauuuauccguacucccggagcuuugaugacucuuuccugaauaaggugcucguguuuaccaaagaaaaccaggagaagcugaauaagacacccuucgaggcguucggagcuaacgaagagagaugguccaaaauccaggcccuggcccaaaaucuuccuuacaagaaaaagaacaaaauucucgacgaggcuuuuaagggcaagcagcagcaggauuucaucagccgcaaucugaacgacacccgguauauuucuacgcugaucgucaaauacacaaaggaauaucucgauuuucugccccuugacgagaaagaagauguuaaucugaaguccggggagaaaggaagcaagauccacgugcaaaccauuaacggcaugcucacauccgugcugagacacaccuggggguucgcccagaaggaccgcaacaaucaucugcaccaugcucuugaugccaccaucgucgcguacucuacaaacgccauuaucaaggcuuuuagcgacuucaagaaagaacaggagcuccugaaggccaaacuguaugcuaaggaacucacguccgauucuuacaagcaccaggccaaauuuuucgagccuuuugagggauuccgggaacaaauucugaaucagaucaacaaacuuuuugugagcaaacccccgagaaagcgggcgcgcggcgcccugcauaaagagaccuucuauuccaaggacgaaaugaucaagaaauacaauagccaggagggcguugaaauugcucucaacugcgggaagaucagaaaaauuggaacaaaguacguggagaaugauaccaugguccggaucgacauuuuuaaaaagcagaacaaauucuaugccaucccuauuuacacaauggauuucgcucugggcgugcugcccaauaagaucguuaucauugggaaggacaaaaagggaaacccuaaacaauggcaggagaucgacgaaucuuaugaguuuuguuucucccuucacaaggaugaccuggugcucauucagaaaaaggauaugcaggaacccgaguuugccuacuauaauggcuucgacaucagcaacucuuccauuugcgucgaaaagcacgauaauaaauuugagaaccugaccgacaaucaaagacuccuguucacgaacgccgaggggaacgugaaggcuaaaaagaucggcauccagggacuucgcauuuuugaaaaauacaucauuacaccccugggcgagaagaucaaggcggauuucaaaccucgggaagacauugcccucaagaccagcaaaaagcaugggcuguga

SEQ ID NO: 3744 - RNA, 3003 nt, Artificial Sequence
  Cas9 variant
augaagauccugggcuucgacauugggaucaacagcauuggaugggccuuuguggagaaugaugaacucaaagacugcggcgucagaaucuucaccaaggcugagaaccccaaaaauaaggaaucccuggcccuuccucggcgcaacgcgagaucuagccggcgcagacugaaacggcgcaaggcuagacucauugccaucaagcggauccuggccaaagagcuuaagcugaauuuuaaagauuacguugcugccgacggggaacucccgaaggcuuaugagggaucccuggccucuguguacgagcugcgcuauaaagcgcucacacagaagcuggaaacgaaggaucuugccagagugauucugcacaucgcuaaacaucggggcuacaugaacaagaaugagaaaaagagcaacgacgccaaaaaggggaaaauucucuccgcucugaagaauaacgcccuuaagcuggaaaauuaucaaucugucggagaguacuucuauaaagaguuuuuccagaaguacaaagaaaacaccaagaauuuuaucaaaauucgcaacacaaaggauaauuacaacaacugugugcucagcuccgaccuggagaaggaacugaaauucauccucgagaagcagaaagaauuuggcuauaaguacagcgagggcuucauuaaugagauccugaaaguugcguuuuuccagagaccccuuaaggauuuuucucaccuggugggggccugcaccuucuucgaagaggaaaaccgggcuuguaaaaauuccuauagcgccugggaguuugucgcucucacaaaaaucauuaacgaaaucaagucucuggagaaaauuuccggagagaucgugagcacccaaacaauuaaugaaguucuuaaccugauccucgacaagggcucuaucaccuacaaaaaguuccgcuccugcauuaaucugcaugagagcaucuccuuuaagucucugaaauaugauaaggaaaacgccgagaaugccaaacucauugacuucagaaagcugguggaauuuaaaaaggcucuugggguccacagccugucccggcaggagcucgaucagaucagcacgcaugugacccugauuaaagacaacgugaaacuuaagacaguccuggagaaguacaaucucucuaacgaacagaucaauaaccugcuggagaucgaguucaaugacuauauuaaccucuccuuuaaggcgcugggaaugauccuuccucugaugagagaaggcaaacgcuacgaugaggccugugaaauuaccaaccucaagcccaaaacaguugacgagaagaaggauuuccugccugcuuuuugcgacagcaucuucgcccacgaacugucuaaucccguggugaaccgggccauuagcgaguacagaaaaguccuuaaugcucuccugaagaaauaugauaaggugcacaaaauccaucuggaacucgcccgcgacguugggcuguccaagaaggcgcgggagaaaauugagaaggaacaaaaagagaaccaggcugugaaugccugggcccuuaaggaaugugagaacaucggacugaaggcuucugccaagaauauccucaagcugaaacuguggaaggaacagaaagagauuugcaucuacagcggcaacaagauuuccaucgagcaccuuaaagaugaaaaggcucucgaggucgaccauauuuauccuuacagcagaucuuuugaugacuccuucaugaauaaagugcugguuuuuaccaaggaaaaccaggagaagcugaauaaaacgccguucgaagccuucggcaagaacaucgagaaauggagcaagauccaaacacucgcgcagaaucugcccuauaaaaagaagaacaaaauucuugaugagaauuuuaaggacaaacagcaagaagacuucaucucucgcaaccugaacgauacccgguacauugccacacucaucaccaaguauaccaaagaguaccugaauuuucugccucuuaacgaaaaugagaacacaaaucucaaguccggggagaagggaagcaaaauucacgugcagacggucaacggcaugcugaccuccgugcugagacacacauggggguucgacaagaaagaucgcaauaaccaucuccaccaugcucuggacgccaucaucgucgcuuacucuaccaauagcauuaucaaggccuuuuccgauuucaaaaagaaccaggaacuucugaaggcgcgguuuuaugccaaagagcucacaucugacaauuacaagcaccaggugaaauucuuugaacccuucaagggauuuagagagaaaauucugagcaagaucgaugaaauuuucguuuccaagccuccccgcaaacgggcuagaggcgcccugcauaaggagaccuuuuauagcgaggacgaaaugaucaaaaaguacaacucuaaagaggggcuucaaaucgcucucuccuguggacgggugcgcaagauuggcacgaaauaugucgaaaaugauacaauggugagaguugacaucuucaagaagcagaacaaauucuacgccauuccgaucuaugccauggauuuugcucugggcauucugccuaauaagaucguggucguggggaaagacaagaacaacaaucccaaacaguggcagaccauugaugagagcuacgaguucugcuuuucucucuacaagaacgaccugaucaugcuucaaaagaaagacaugcaggaagcggaguucgccuauuacaauggauuugauaucuccaccagcucuauuuguguggaaaagcacgacagcaaauucgagaaccugacauccaaucagaagcuccuguuuagcaacgcuaaagaaggcucuguuaaggucgagaaucuggggauccagaaccuuaagauuuucgaaaaauauaucauuaccccucugggagauaagaucaaagccgacuuucaaccccgggagaauaucucccucaagacaagcaaaaagaacggccuguga

SEQ ID NO: 3745 - RNA, 3003 nt, Artificial Sequence
  Cas9 variant
auggccagagcucagcggcgccugaucagcagacgggccaaccgcaugaauaagcucagacggcugcuuaaacaagagaacgugcugcaggcgaaugacuacgaugaaaagggccucauuaucgggcugcccaaccaggcuugggagcuucgcgcccagggacuggacagaaaacucgaaccuaaggagugggccgcuguccugauuaaucugguuaaacaccggggcuaucucucccaacgcaagaacgaaucucagaccgccgauaaggagcugggggcucugcugagcggaaugaaucauaaccaccagcuccugcagucccaaucuaaucaguacagaacaccggccgagcuugcgaucaaacaguucgccacgcaggacggccauauucggaaccaacgcggggcuuauacccacacauuuaauagacuggaucuccagaacgaacugaaucagcuguucgacgcccaaacccggcucggaaacccccaugugagcggcucccugaagacagcuaucaaugaucuucugaugaaccagaaagccgcgcucucuggcgacgccauccuggagaugcuugggcgcugcaccuuugaaccuagcgaguacaaggcugccaaaaacacauauuccgcugagagauucguguggcugggaaagcucaccaaucugcggauucaggauaacggccuggaaagcgcccucucuagagagcagcgcgaacugcuucugaaugagcccuacaacaagacgaaacucaccuaucaacagguccggaagcugcuuagacugccugaaacagccuuuuucaaagggcuccgcuacggaaaggacaaugcugaguccgcgaccuuuauggagaugaaaagcuaccacgccauccggaagucucuggaaaacaaaucccugaaaagcgagugggaaaagcucaaaacacagcccaagcugcuugaucugauuggcaccgcuuucucuaucuauaaaacggacgaugagauugccgggugucucaagaaucagcugccugaaaacgugaucauugcccugcaagagcagcuuaauuuuuccaacuucauggagcucagccugaaagcucuggaaaagcuccugccgcuuauggagcagggacugagauacgacgaagccugcacacagaucuauggcaaucgccacgagaagaucgcggacaaaaccgaaaaguuucuccccaacauuccugcugauaaacugcggaaucccguugugcugagaacacuuacccaagcccgcaaggucaucaacgccauuauccggagauacggcuccccugcucgcgugcauauugagaccgggcgggagguuggaaaaucuuucagcgacagagauaagcucaagaaacagcaggaagagaaucaggaacaacggcgcagagccaucgacgaguggaagcaguuuuuccccaacgcugcccacgagccgaaagcgguggauauccugaagcugcggcucuaucagcugcaacagggcaaaugucuuuacuccgggcugccuauugacgucagacgccuccccgaaaagggauauguggagaucgaucaugcccugccuuucagccggacaugggacgauucuuuuaacaauaagauucuggugcuugcuuccgaaaaccagaauaaaggcaaccagacgcccuacgaguaccucagaggggccgacaauagcgaaucuuggcgccuguucgucgagaacguucaaaauugccaguuuagccccaacaagaaacagaagaucauggcuaaacagcuggaugagaagggauuccucgaaagaaaucugaacgacacccgguaugugucccgcuuucuuugucaauucauuucugagcaccuucaccucacaggcaaaggcaagaagagaguguuugccagcaaugggcagaucaccgcgcugcugcggggacgcuggggccuuuccaaaaacagagaagagaaugaccggcaucacgccgucgaugcugugguuguggccugcagcacagucgcuaugcagcagaagaucacccaauucgugcgcuaccagaaagggaacguuuuuacgggagaaagaauugacaaggagacaggcgaggugaucucuauucauuucccuaccccgugggaacacuuucgggaggaagucaugauccgcguguucgaugacaauccccucagaacccugccugagaaacugcccaaccggccugaagcccuccaugaguaugucaugccccuguuuguguccagaaugccgacacgcaagaugaccgggcagggccacaaggagacaauuaaaagcgccaagcggcuugaugaaaagaucucuguucugagagugccucucacgcaacugaagcugaacgaccuugagaauauggucaaccgcgaacgggagcccgcucuguacgaggcgcucaaagccagacuggaacaguucaagaaugauccugcuaaggccuucgccgagcccuuuuucaaacagggaggccagcaagugaaggcuguucgcguggaaauuguccagaaauccgggaugcuccugcggaagaucaacggaguggccgacaauggcagcauggugagaguugaugucuuugagaaauccgggaaguucuaucuugugccuaucuacgcguggcaaguggcugaaggcauucugcccaacuaugccgucguggcccacaaggacgagucugauuggauccucauggacgagagcuaccauuuuaaauucgcucuguacaagaaugaucugcuugaaguucagaccaaaaagggagggauuaugggcuauuuugccucccuggaccgcgcgacaggagcuaucaccauucgggagcacgacagagauaaaaagaaauguaaggacggcgaacaucggucuaucggggugaagauggccagcuccuucaaaaagcuccaggucgaugagcugggcaaaaacauccacgaaacacgcagcagaaagcggccgaauauuggauga

SEQ ID NO: 3746 - RNA, 3012 nt, Artificial Sequence
  Cas9 variant
augagaauccugggcuucgacauugggaucaacagcauuggaugggccuuuguggagaaugaugaacucaaggacugcggcguccggaucuucaccaaagcugagaaccccaagaauaaagaaucccuggcccuuccucgcagaaacgcgcggucuagccgcagacggcugaagcgcagaaaagcucggcucauugccaucaagcgcauccuggccaaggagcuuaaacugaauuacaaggauuauguugcugccgacggggaacucccgaaggcuuacgagggaucccuggccucuguguaugagcugagauacaaggcgcucacacagaaccuggaaacgaaagaucuugcccgggugauucugcacaucgcuaagcaucgcggcuauaugaauaagaacgagaaaaagagcaaugacgccaaaaaggggaaaauucucuccgcucugaagaacaaugcccuuaaacuggaaaacuaccaaucugucggagaguauuuuuacaaggaguucuuucagaaguacaaaaagaauaccaaaaacuucaucaagauuagaaauacaaaagauaacuauaacaauugugugcucagcuccgaccuggaaaaggagcugaagcucauccuggaaaaacagaaggaguuuggcuacaacuauagcgaagauuucauuaaugagauccuuaaaguugcguuuuuccagcggccccugaaggacuuuucucaccucgugggcgccugcaccuucuuugaggaagagaaacgcgcuuguaagaacuccuacagcgccugggaguucgucgcucugacaaagaucauuaaugaaaucaaaucucuugaaaagauuuccggggagaucgugccuacccaaacaauuaacgagguucugaaucucauccuggauaaaggaagcaucaccuauaagaaauucagaucuugcauuaaccugcaugaauccaucagcuuuaagucccucaaguacgacaaagagaaugccgaaaacgccaagcugauugauuuccggaaacuuguggaguuuaagaaagcucugggcguccacucucucagcagacaggaacuggaccagaucuccacgcauauuacccuuaucaaggacaaugugaaacugaagacagugcucgagaaguauaaccugagcaaugagcagaucaacaaucugcucgaaauugaguucaacgauuacaucaaccugucuuuuaaagcgcuugggaugauucugccccucaugcgcgaaggaaagcgguacgacgaggccugugagaucgcuaaucugaaaccuaagaccgucgaugagaaaaaggacuuccugcccgccuuuugcgauuccauuuucgcccacgaacuuagcaacccuguugugaauagagcuaucucugaauaucgcaaggugcucaacgcccugcugaaaaaguacggcaaaguccacaagauucaucucgagcuggcgcgggacguggggcuuagcaaaaaggcuagagaaaagaucgagaaagagcaaaaggaaaaucaggccguuaacgccugggcucugaaagagugugaaaauaucggacucaaggccuccgcuaaaaacauucugaagcugaaacuuuggaaagagcagaaggaaaucugcauuuauucuggcaauaaaaucagcauugagcaccucaaggaugagaaagcccuggaaguggaccauaucuacccguauucccgcagcuuugaugacucuuucaucaacaagguccugguguuuacaaaagagaaucaggaaaagcucaacaagacccccuucgaggcguuuggcaaaaauauugaaaagugguccaaaauccaaacgcuggcccagaaccuuccuuacaagaaaaagaauaagauucuggaugagaacuucaaagacaagcagcaagaggacuucaucagccggaaccucaaugauacaagauauauugcuacccugaucgccaaauacacaaaggaauaccugaacuuucuucuccugucugagaaugaaaacgcuaaucugaaauccggggagaagggaagcaagauccacguucagaccauuuccggcaugcucaccucugugcugcgccacacauggggguucgacaaaaaggaucggaacaaucaucuucaccaugcccuggacgcgaucauugucgccuauagcacgaacuccaucauuaaggcuuuuucugauuucagaaagaaucaggagcuccugaaagcccgcuuuuacgcuaaggaacugaccagcgacaacuauaagcaccaggugaaauucuuugagcccuucaaguccuuucgggagaaaauccuuagcaagaucgaugaaauuuucgucucuaaaccucccagaaagcgggcccgcagagcccuccauaaggacacauuucacuccgaaaauaaaaucauugauaaguguagcuacaacucuaaagagggacugcaaaucgcucuguccugcggccgggugagaaagauugggaccaaauauguugagaaugacacaaucgugcgcgucgauauuuucaagaaacagaacaaguuuuacgcgaucccgaucuaugccauggacuucgcucucggcauucugccuaauaagaucgugauuaccggaaaagauaagaacaacaaucccaaacaguggcagacgaucgacgaaagcuacgaguucuguuuuucucuuuacaagaacgaccugauucuccugcagaaaaagaauaugcaagaaccugaguucgccuauuacaacgauuuuagcaucuccacaagcucuaucugcguugaaaagcacgacaauaaauucgagaaccugaccuccaaucagaaacuucuguuuagcaacgccaaagagggcuccgugaaggucgaaucucucgggauucagaaucugaaaguguucgagaaguauaucauuacaccccucggagauaagaucaaagcugacuuucaaccccgggaaaacauuagccugaagaccuccaaaaaguacggccuuagauga

SEQ ID NO: 3747 - RNA, 3012 nt, Artificial Sequence
  Cas9 variant
augaucgacgagagccugaccuucggcauugaucucgggaucggauccugcggcugggccgugcugagacggcccucugcuuuugggcgcaagggagucauugaaggcauggggagcugguguuucgacguuccugagacauccaaagaaagaacgccgaccaaccagauccggcgcucuaauagacuucugcggcgcgugauuagacggcgcagaaaccggauggccgcgauccgcagacuccugcacgcugccggacuucugcccagcacagauuccgacgcccucaagcggccuggccaugaucccugggagcugcgcgcuagaggccuggacaaaccucucaagcccguggaauuugccgucgugcuggggcacaucgcuaaacggagaggauucaagucugccgcgaagcgcaaagccaccaauauuagcuccgaugacaagaaaaugcuuacagcucuggaggccacccgggagagacucggccgcuaccggacaguuggggaaauguuugcuagagauccugacuucgccagccgccggagaaaccgcgagggaaaguaugaucggaccacggcgagagacgaucuggaacaugaggugcacgcccuuuuugcugcccaacgccggcugggccagggguucgcuucuccggagcucgaagaggccuuuaccgccuccgcuuuccaucagagacccaugcaggacagcgaacggcuggucggauuuugcccuuucgagcgcacagagaaaagagcggccaagcugacccccucuuuugaacgguucagacuccuggcucgccuucugaaucuccggaucacaaccccugacggcgagagaccccugacgguggaugaaauugcccuuguuacacgcgaccugggcaagaccgccaaacucuccaucaagagagugcggacacugauugggcuggaggauaaccaacgcuucaccaccaucagaccggaagacgaggaucgggacauugucgcucgcacaggaggcgccaugacggggaccgcgacacucagaaaagcucugggagaagcccuuuggaccgauaugcaggagcggccugagcagcuggacgccaucguccaggugcucagcuuuuucgaagcuaaugagacaaucaccgaaaagcugcgcgagauuggccuuacgcuggccgugcucgauguucugcugacagcucucgacgccgggguguuugcgaaauucaagggagccgcucacaucucuaccaaagccgcuagaaaccugcuuccccaccuggaacaaggccggcgcuacgaugaggccuguaccauggcgggcuaugaccaugccgcuuccagacucagccaccaugggcagauuguggccaagacacaguuuaaugcucuggucaccgagaucggagaauccauugccaacccuaucgcccggaaggcucugaucgagggccuuaaacagauuugggcgaugagaaaucacugggggcuccccggaucuauccacguggaacuggcccgcgacguuggcaacagcauugagaagcggagagagaucgaaaaacauauugagaagaauacagcucugcgcgcccgggaaagacgcgaggugcacgaucuccuggaccuugaagaugucaacggggacacgcugcuccgguacagacuguggaaagagcaaggcggaaagugccuguauaccggcaaggccauccauauccgccagauugcugccacagauaauuccgugcagguugaccacauccuucccuggagccgguucggggaugacucuuuuaacaacaaaacccucugucuggcguccgcuaaucaacagaagaaaagaagcacaccuuacgaguggcugucuggacagaccggcgaugccuggaacgccuucgugcagcggauugaaacgaauaaggagcuccgcggguuuaaaaagagaaacuaucugcuuaagaaugcuaaagaagccgaggaaaaguuccggagccgcaaccugaaugacaccagauacgcggcucggcucuuugccgaggccgucaaacugcuguacgcuuucggagagagacaagaaaagggcgggaaccgccggguguuuacaagaccgggcgcccuuaccgcugcccuccgccaggcguggggagucgagucccugaaaaagcaggauggcaagcggaucaaugacgauagacaucacgcccuggacgcucucacaguggccgcuguugacgaagccgagauucagcgccugaccaaaucuuuccacgaaugggagcaacaggggcuuggacggccccugagacgcguggagccucccugggagagcuucagagccgaugucgaagcuacguauccugaaguguuuguugcgcggcccgagcgcagacgggcccgcggcgaggggcaugcugccacaaucagacaggugaaggaacgggagugcaccccgauugucuucgaaagaaaagccguguccagccucaaggaggcugaccuggaacgcaucaaagauggagagcggaacgaggccaucguggaagcgauuagaucuuggaucgcuacaggccgcccugccgacgcucccccucggucccccagaggggauauuaucaccaagauucggcuggccaccacaaucaaagccgcgguuccuguccgcggcggaacggcuggcagaggggagauggugcgggccgacguguuuagcaagcccaaucgcagaggaaaggaugaaugguaccuugucccgguguauccucaccagaucaugaaccggaaagccuggcccaagcccccuaugcgcucuauuguugcuaauaaagacgaggaugaauggaccgaggugggcccggagcaucaauucagauuuucccucuacccccggagcaacaucgaaauuauccgcccuuccggggaggucauugaaggauauuucgugggccugcacagaaauacaggggcccugauccccaccccuguuggccccgacucuuacgugaucgcuuga

SEQ ID NO: 3748 - RNA, 3024 nt, Artificial Sequence
  Cas9 variant
augaaggugcugggcuucgacaucgggauuaacagcaucggaugggccuuugucgagaauaacgaacucaaagauugcggcguuagacuguucaccaaggcugagaaucccaaaacaaaggaaucccuugcccugccucggcgcaacgcgagaucuagccgggugcgccucagacggcgcagaucccggcugcuuucucugaaacacauuaucagcaaggaguuugggcuccauuacgaagacuauauugcucuggauggaaaucugccgaaggccuacacgggcaaaaucgaguccaucuauaagcuccgcuacgaggcccugucucaggcuauuagcaaagaagaccuugccagagugauccugcacauugcuaagcaucggggguauaugaacaaaaaucaaaagaccucccaggauagcgagaagggagccauccucucugcgauuaaagaaaacuccaauaagaucaaacacuaccagacagccggcgaguauuucuacaaggagcuguuugaaaaccuucgcgacggcaccaaagaguucaagaauauuagaaacaaagcuaugaagaaugaaaagacagggaacauggagagcaccuacuauaauacaauccuggccucugaucucgaaaaagagcugaagcugauccucgagaaacagcaggcuuaccauaacuauuccgacaccuuuauuaaggaaguccuggagaucgccuucuaccaacggccccuuaaagauuuuagccaccuggugggaucuuguacguucuaugaaaacgagaagcgcgcgugcaaaaauuccuacagcgccugggaauuuauugcucucggcaaaaucauuaacacccuggaguccaucaagaaagacacaggggagaucuucucuaaugaaauuaucacccagauucuuaaggagguucuggauaaaggaagccucuccuauacaaagcugagaaagaugaucaaccuggacgaaaaagugaaguuuaaaggccucaaguacgauaaagagggggucgaaaagaccaaucugauugaguucaagaaacuuaaggaguucaaaaaggcccugggagaacacaaccucgagcggaaaacgcuggacgaaaucgcuacacauaucacccuuacaaaggacgagaaucagcugaaaaagcaacucgagcaguacgcccugagccagaaccagauugaugcccuggcugaacucgacuuuaaugaucacaucaaccugucuuucaaggcgcuuuaugagauucugccucucauggaaaaaggcaagagauacgacgaggccuguaaugaacugggccugaaagcuaagaccuccaaccaaaagagcgaguuucuucccgccuucugcgauucuaucuuugcccaggagcucaccaauccuauugugaaccgcgcuaucagcgaauaucggaagguucugaauagacugcucaagaaauacgggaagaugcauaaaauucacaucgagcuggcccgcgacgcgggacuuuccaaggaagcucggaacaaaaucgagaaggaacagaaggagaacaaagauauuaaugacaaggccgagaaaacauguaaggaguucggccugaaacccaacgccaagaauauccucaagauuaaacuguggagagaacaaggggaaaucugcgcuuauucuggaaagaaaauuacgaucgaugaccugaaggaggauaaagcccuugaaguggaccacaucuacccuuauagccgcuccuacgacgauagcuacaacaauaagguccucguguuuauuaaagagaaccagcugaagcugaaucagaccccguaugaggcuuucggcucuaaccaggaaaagugguccaaaauccaagugcucgcccagaagcugcccuacaaaaagaaaaaucggauucuugacgagaacuuuaagaauaaggaucagaucgaguucauuagcagaaaccugaaugacacacgcuaugcgaccucucucaucgccaaauacacaaaggaauaucuggaguuucugccucuuuccgaugacgaagauaucagccucaaauccggggagaagggaucuaaaacccauguccagacgaugaacggcaugcugacaagcguucugcggcacgcuuggggcuucucccaaaaggacagaaauaaccaucuccaccaugcccuggaugcuauuaucauugccuacucuaccaacagcaucauuaaggcguuuuccgacuucaaaaagaaucaggaaauccuuaaagccaagcuguaugcuaaaaagcucaccagcgaggaauacaagaaccagucuaaauucacaggguuugagaaguaccgcuccaaaauccuggagaagcuggauagcauuuucgugucuaaacccccuaauaagaacaccaagggagcccuucacgaacagacauuuuauuccuaccaagacauccucgaggaauauaaaacgcaggagggccugaagcgggcucuggaaugugggaaagugagaaagauuggaaccaaauacgucgugaaugaucggaugguucgccucgacaucuucaagaaagacaacaaguuuuauggcauucccaucuacacaauggauuucgcccugggggugcuuccgaauaaggucgugaccauuggcacagacaaagauaagaucaaaaaggaguggaaaaccaucgacgagacguaugaauuuugcuucagccuguacaagggagaucucguucugauucagaagaaagagaugcaggaaucugaguuugccuacuauaacggcuucgacaucagcuccgcuagcauuucucuggaaaagcacgauaauaaauuugagaaccuuaccgagaaucaaaagcuccuguucccuaaagcgaaggaaggggacguggaggucagaggaaucggcauucaggggcugaagguguuuaaaaaguacauggucacaccccucggagaaauccaggagacccggacagaggccagacaaaacauccagccucgcaaaaagcauggccugcgguga

SEQ ID NO: 3749 - RNA, 3033 nt, Artificial Sequence
  Cas9 variant
augagcgacuccucuuacgugcugggccucgaucuggggaccaacagcaucggaugggccugcgucagacuuaauaagggcaaacccgacgggcugcucgcucagggaguucggauuuucgaggccggccuggaaaucgaugcguaugggcgcggaacaccucuuaacacggagagacggaaugcucgccaaagacggcgccugcacgacagacggaagcgccgcauucucaaagugcggcgcauccugcaggaagccggcaugcugccggccaacaagcccgaucauaaagacgcugaguggaagaugcuccuggccagaaauccuuaccggcuucgcgcuaaggcccuggaugaacagauugaccucaaagagaucggccuguguaucuaucaguuugcgcacagacggggguuccuuuccaacucuaagauucugaaaaaggaugacgauagaggaaaacucaaggacgccaccaaggcuuuugccgaggauauggaacaaaaaggcgcucgcacauggggagaguaccugagccaucuggacccccacgaacagcggaucagaaccaauuauacacuccgcgagugguacaccuccgaguucgaccugauuugggaaaagcagcagucuuuuuauccucaugugcuuacagaugaccuguacaaacgggucaaggaggcccucuucuaccaaagaccccugaaaagccaggcgcaccuucuggggcagugcgaacucgagccuggccgcaagcgggccccguuugcucugcugauggcccaggaguucagacuccugcaaucccuuaaccaucugcgcgugguuagcucuaccggggaugaacggcuccugacggacgaggaaagaaaacaggcucuugcccugcuccgcucccggggaaaucagaaguuuaccacacugagaaaggugcugaaccuccggggcaccaaauucaaucuggagcgcggcggggaaaagacaauccaaggaaacaauaccgccgcugcgcuuggcaaccuguuuggggaggccugggaucacuucagcucugaacagaaaaaucagauugucgaggacagacucacgaucggagauacagacgcucugauucggagaaugaagaaaaccuggggccuggauuccgugacagccgagauguuuagcgaaaccgagcuugaagacggguauuguggauucucucgcaaggcccucgagaagcugcugccccuccuggaacggggccacgcucuuauggaggccguucaggcggcuuacccugauuaucaaaagaaccugcccagaaccgacacacucccuccccuggagaaccugcgcaauccgaucgugcagagaacgcuuuccgaacuccggcgcgucgugaacgccaucauuaaggaguacggcaaaagcgacaagaucagaauugaacuggcccgggauaugaaacagaccgcuaagaaucgcgagaaguccugggacagaaugcgggugcgcgagagacagcggaaagaagccgcuaagaaaauccuggaggaaacagggaacccugcccccagaagacaugagauugaaaagguccuccuggcggaggagugcaauugggaauguccuuauaccggaaaacggaucugcaugaacacacuucugggcgaugcuccccaauucgacaucgagcacauuauccccuuuucucgcagcuucgauaauuccuuuagcaacaagacccucugugacguuaauuacaacagaaaugugaaggggaacaaaacgccuuaugaaucugccuccgagacagaacacgaggagauggugugccgggucaagagauucaccggagauuacaaagaaauuaagcuggaccgcuuuaauacccgggagacagauagcagagccgacuucaucgaagaguuuucuaccagccagcugaacgauacacgcuacgcuucccggcuugccggcgaauaucucgggaaacuguacggcucugaguggagaaagcauauucagaucgcgaaaggaggcacgaccaaguaucugcgcgacgccugggaucucaaucggauccugagcgacgggggaacaaaguccagagacgaucaccggcaucacgcuguggacgccguuguggucgcucuuaccacaccgcagaccgugaaagcccugagcgaugccaaccaacgcgcucccgagcauagacgguacgcguucucugacaugccucuccccugggaaacguuucgccaggauguugagcaggccauuaacuccaucaccgugagccacaaggucuguagaaaagcuaauggccagcugcacaaggaaacauucuaugggcugauuaaagaccggaagaccggagauacaagaaccgugcuucgcaagccucuccaugagcugacggacaaagagaucaagcgggccgaaauugucgauucuuccaucagaaaacugauugagcaaaagcucaaagaccuggaucagcccccgaagacagccuuuaaggaccgcaacaaucacccuuucaucaucgauaaaaacggcaauaagcgguuuauucauaaagugagaguuuaccaggacgcuaagcccgugaaaaucgccgaaaaccgccacgucaaacuugggggcaaucaccaucuggagauuuucgaagugaucgacaagaaaggaaacccuaccuggaagugcgagguuauuagccucuucgauacacggcaaagagugaaagagaagcgccccgucaucgugagacaggaccagaauggcaacccucugaaauuuucccugucuaucggggaagcggugcagcuugauuggaauggaggccgggagaccgcuguuguccaaaagaugagcaaaacccccaacacaguggaauauguguuccgcaagcacaaugacgccagaaaggccgcugauauuccguacaaagagacgaucaccgucaaguccgacucugcccuguuugcgagcaaccuccagaaaauugugaucacaccuaccgggcugauucggcgcgcuaaugauuga

SEQ ID NO: 3750 - RNA, 3033 nt, Artificial Sequence
  Cas9 variant
augaagaacagaaaugugaucggcauugacgucgggaccaacagcaucggaugggcccugguugaggaaaaugagaacggccucccccagucccugaaagcugccggggugcggauuuuccaagaagcgguggaggcuaagacacgcacgccuaaaaaucacaagagacggcaggcccgccuugccagacggguccuggcucgcagagcccggcgcaaacagagacuccagaaccugcuucugaagcauggacuccugccgggcggggugaccgaucccguucaacgggaagcugccuuuacaacccugggagacccuuaccagcuccgcgcgaagggccugaaucuuccccugggccuccacgaguucgggagagugcuguuucagcuuggagcccggcgcggcuuccugucuaacagaaaaacacgguaugggcaucucaauaagcuggaugagcuggcugaccucaucgaagccgaggaugcugccccuaaaaccggagacgcggaagagggcauuaucagaaaggagaucggggaacugcgccaggccaugagcgcugccggaucccggacacuuggcgaguaccuggcuggccucgccaaagaagagagaaagcgcugccggcacaccgaaagagccaugcuggaggaggaauuugagcgccuuuggaugguccaagcucgguuccaucccgaacugucugaugagcucaaggugcagguucacacggugaucuuuuuccagagaccucugaaaagcaaccgcgcgucccuggggaaguguucucucgaaccgagccggagaaaagccgcucgcgccuggcccgaggcccagcgguuuagacugcuucaagaccugaauaaccucgagauucuggauccucggaccggagaacuucgcagacugcgggacacagagagagcuauucuccugaaugcccuggaacagcagaaguccaugaccuggaacgcgguccgcaaaaagcucggccugcaccaaggggagaaauucaaucuugaaacaggagcuaaggccgagaccggccugaaggggcuccagacgcuggccagccugcaugcuauccuucagggaugguuugaugagcucggcgacaaacgggaucugcugauugaagaccucaucacaauugaggacucugccggccuguauagacgccuuagagaacacuggggguucgaucgggagaccgcuuuucgccuggccacacucgagcuggaacccggauacgcgucccugagccuuaaggccaucagaaaacuccugccucauaugggcgcugggcaccgguauucugaggcccgccagcaagugggauacggcuaugaaaccgggcagagagaccugcaggagcggcucggcgaacccccggauccucgcaaccccguggucgacaaggcucugcacgagcuuagacggguuaucaacgcccugauucaucgcuucggaagaccugauguggugcgggucgagcucgcgagagaccugaaacuggccaagcgcgauaaggaacggcuugagaaacagaauagagaaaaccaacgccucaaucggaaggcugaggccgcucuggccgaacugggccucgggcagcccuccagagacgaucugaucaaauaccgccuuugggaggagagcaagggacugugccccuacaccggccgggaaauugggcucucuacacuguucuccccugagguggacguugaacacaucauuccguauagcagaugucuggaugacuccuacaugaacaaaacgcuuugcaugaccgaggaaaaucgcaugcagaagggaaaccggacacccugggaggccuauggcggggacccugcuagauacgagcagauccuccaaugugcgcgguauuuucccauggccaagcgcaaaagauuccuggaacagggcucugauuuuguggaccaguucauccagcggcaacugaaugauacccgcuacauugcuaagcucgccaaagaguaucuggccgcugucugcacaaacgugcagguuaccaagggaggcacgacagccaugcuuagacaucacugggggcugaaucggcuccugggagaagacgauggccagaaagagagaggggaccaucgccaccacgcgcuggaugcugccgugaucgccgucaccagccggucccuuuaccaaagacuggcucgcauugcccaucagcggggacacgcgccuagccagagaggcuuuuacaucgaucccccguggcagggguaucaagcugaccucgcccagacccuggccggcauuguggucucucaugcuacaaaccgcaagcucaccggagcccugcacgaggaaacagcuuacggccacaucccucaugugggguucguuuaucggaagacgcuuaauaaagacuuuaagcugggagauaucgaggccauuuacgaccccucccuccaggaacuggugaaagcgcaccuggagcaucacggcaacgauccuaagagagccuucgcugaagggauccaguguuaucauaaagacggacacacccccauuaagcgcgucagaauccgggccaaacaagugagcgagaagggcacauuuucuauuagcgaccgcgcugggagagccuacaagcaccauaaaaccggcuccaaucaccauguugagauccuucggcaccgcgccacaggaaagauugaaccuguguaucugaccacgaaagaggcuaccgaaagagcgcggagaggcggggagcccgucauccagcgcgaucauggaccggaaugggaguucaucauuucucucugcaucaacgacauggugcggcugggcgaagggggacagguggccuacuuuagaguucagaagauugaggcuacaaauaaccgcgucacccuccggagccaccuggccgccacacuugaugacgaggauaugaaagugaccacguccgugccuaagcuggcugucaugcccggcuuccaaaaggugcucguuacagccgugggcgaaguccuggagcugcacgacuga

SEQ ID NO: 3751 - RNA, 3033 nt, Artificial Sequence
  Cas9 variant
augaagagaauggccgcugugggccugaugcccgccgacccuaccgaggcgaaagcucucgaacugcuugauccguacgcccugcgggccgcugggcucgaccaggcccugccccuuacacacuucggacgcgcucuguuucaucucaaccaaagacggggcuucaagagcaaucgcaaaacggauaagggggacaacgaguccggaaaaaucaaggaugccaccaagagacuggacgaagagauggcgauuaaaaaugcccggacauauggcgaauuucugcacaugcgcagaaccucugcuacagauccuaagaacguccccaccguucggacacgccucagcaucgccagacgggacaaugcugagaaagaggaagccggguacgauuucuauccugaccgcagacaucuggcggaggaauuugauaagcuguggaaagcccaggcuggauacucccccgacgugcugaccgaugagcuccgggacgagauuucugugaucauuuuccaccagcgcccucugaagacgccggaagucggccuuugccuguuuagcggcucccauggggugcccaagaaagacaagagaaucccuucugcccacccccucaaccagcggagaauccuguucgagaccauuaauaaccugcgcguugcugcccggggagaaccugccagaggccucacacgcgaugagcgggacgcuaucgugcacgcgcuggauaauaaagcccauaccaagagccuuuccgggaugagcaugaaacugaaggcucucggaaaagucauuaagcugagacccgaacaaucuuuuacacuucagaccgccaaccgcgagacgaucgccugugacccggugcgggcuucccugagccacccugauagauucggcccccgcuggucuaugcucgacgccgaugcgcagugggacguugugcagcggauuagagcuguccaauccgaggccgaacaugaugcccuggugaaguggcugauggcuacacacgggcucgaccgcgaucacgccgagagcaccgcuaaagccccucugcccgaaggauauggccggcuuggccugacagcgaccaagagaauccucgccgcucuggaggccgacgugauucccuacucugacgcugucaaagccugcggguggcaucacuccgauggacggaccggcgaaguucuuacagagcugccuuauuacgggcagauccucgaccgccaugugaucccgggaacguacaaugagagcgaugacgaugugaccagauauggccggauuacaaaccccaccguccacaucgggcugaaucagcugagacgccucgugaacaagauuaucacaguuuacggaaaaccugacgaaauuguggucgagcuggcgcgggaucuuaagcuguccgaagaccagaagagagaugugcaacgcgacaucaaaaagaauaccgaugccgcuaucgccagaggcgcuaaacucucugagaugggcguucccgacacgggggccaaccggauggugcugcgccugugggaaagccuuggagaugacgucaugacaagaaacuguccuuauuccggcaagcggauuagcgccaccaugcucuuugacgggucuugcgauguggaccauauccugcccuacucccgcacccuggaugacggauucgcuaauagaacacucugucugaaagaguuuaaccggcagaagaccgauaagacaccgugggaggcguggggcgacacgccugccugggcuaccauugaagccaaucuuaaaaaccugcccgccaauaaggcuuggcgcuucgccccugaugcgauggagagauucgaaggggagaacgacuuuacaagccgggcucucaaagaugcccaguaucugucucgcaucgccagaaccuaccuggacgcucuuuaugauggcgccgacggaaagagccacgucugggugguucccggccggcucacagagaugcugagacgccacugggggcuuaauucccuccugccugauaaagacggagcggugaaggcuaagaaccggaccgaccauagacaccaugccauugaugccgcugucguggccgcuacggaccgcucucuuauccaacggaucagcaaaauggccagaaaggaugaaguuaauggcgcggaggaaguggcccgcuccgugcccccgccuugggagggguuccggaccgacauugaaacacagcuggauagaaucauuaucagccaccgcgcugaccacggacggauugaucccgccgcuagaaaagacggccaugauucuaccuccgggcagcuccacaacgacacagccuacggccugggagagggcaauagcgucgugucucggaagccccugcuuucccucaaaagcaacgauaucgagguuaccacgaagggggccaauauucgcgacgucgaccugcagagacaucuggaacggaucacacgcggacucgauggcaaagcucuggaggcggcccuugcugaauuugccgccaccgcuaagcugccugacgggacagauaacccguacuauggacucagacgggugagacuggaggaaacccugcaacagggcgcccgcguggaggucaaggaccggaaugggaaacccuucaaggcguacaaaggcgauuccaaccacugcuaugagaucuggagaaugccugacggaaaggugguuccccaggugauuaccacauacgaagcucaucagaucgaugucgagaaaaagccucaccccgccgccaagcgccuucuccggauuuuuaaaagagacaugguggcuaucgaacaagaugacaaggccauuaucggcuauguucagucuaugcacguggcgaacgggcuguucaucgcuccucauacggaggccaaugccgaugcucgcagccgggacaaauccgauucuuuuagacugauucagaugagcgccggaccccucgucaaggcuaacgcccgcagaguguacguugacgaaaugggccggcugcgcgacccgggggcgccuuccuga

SEQ ID NO: 3752 - RNA, 3039 nt, Artificial Sequence
  Cas9 variant
auggccaacaugagauaccggcuggcucucgaccugggcagcaccucccuugggugggccauggugcgccuggaugcgcagaaugagacaugcgcugucaucaaggccggaguuagaauuuucucugacggccggaaccccaaagaugggagcucccucgccgugucucgcagagaagcucgggccaugcgcagacggcgcgacagacugcuuaagcggaaaacgcgcaugauggcuacccugaugaagcacggauuuuucccucaagaugaggccgcgagacaggcccucgugaauaaagaaccguuugcucugcgggccaagggccuggaccaugcucuccugcccgaggaguucgcccgcgcgcuuuuucacaucaaccagagacggggguucaagagcaauagaaaaacagauaagaaagagaccgacuccucugcccugaagaaagcuauuggacagcuccgcgaggccaugcaagcuagcggcugucggacagucggcgaauggcugugcgccagacaucagcaggggcuuuccgugcgcgcccgguauagagagaaccgcaucaccaaggaugacggaaagacaaaaauugaaaagagcuacgaucuguauaucgaccgggcuaugaucgaggcggaguuugaugcccucugggcuaaacagucugaacugaauccugagcuguuccacgaaaccgccagagccgagcucaaggacugucugcuucaucaacgcccccugaaaccuguuaagcccggccggugcacgcuccugccugacgaagagagagcuccgcuugcccugcccucccagcagcgcuuucggauuuaccaggaggugaacaaucucagacugcugcgggaagggcucaacgaggaaccucugacccuuacacaacgcgaucagcugauccaggcgcucgagaccaaucccaaaagauccuucacacaaauucagaagcugcuuggauuuucuggccaguucaaccugcaggacgauaagcggaccgaacucaaagggaauagcacgagcgcuaugcugucuaagaaagaguuuuucggaucccaauggcugagcuucgacgagacacaccaggaugaaaucgucaugcagcucguguccgaggaaaacgaggccagacugauugccuggcuucaggcugaaaccggcguugacgagaucacagccgagcgcauugcuaauaccccucuggccgaaggcuaugggucucucagcgcgaaggcccuggagaaaauccugcccgcccuucgggcugaugugaucaccuacgacaaggcuguccucgccgcgggauuugaucaccauucccacauuagccaugccgcuacaggcgaaauccugccggaccugccuuauuacgggcaauaccuccagagacacgugggauucggcacggggaagcccgaggauccugccgagaaacgcuauggaaagauugcuaaccccaccgugcacaucggccugaaccaggucagaacaguugugaaugcccuuauuaaacgguacggccaucccucugaaguggucguggagcuggcccgcgaccucaagcagucccaagaacagagaaaagaggaacaggcucagcaagcgaagaaccagcggcgcaaugagagaaugcggcaggacaucgccgggcugcugaacaccagcacagagcgcguuagagcucuugaucuccaaaagaugauccugugggaagaacugucuuuuaauguggccgaccggcgcuguccuuauagcggaguccagauuuccgcccagaugcuuuucucugaucagguggaaaucgagcacauucugccguuuagccaaacccuugacgauucccugaacaauaaaacgguugcuaugagacaggccaaccggaucaagggcaauagaacacccgcggaagcugccgccgacuucgcugcccagggguggccuguggaggauaugcuccaucgcgcgagccugaugcccaaaggaaagcgguacagauuugcucaggacggcauggcccaauggcugcgcgaggauaaaggguuccuugcccgggcucucaacgacaccagacaccugucucgcgucgcccgggaauaucugucccucgugugcccucagggcaccagagucauucccggacgcaugacagcuaugcugcgggccaaguuuggccuuaaugauauccuggggcucaacggagagaagaauagaaacgaccaucggcaccacgcgguggaugccuguguuaucgcugugaccgaccagagcaugcugcagaaauucgccaaggcuucugccuccgcccgcgaaaaacaacugaauaagcucgucgagagcaugccgcucccuugggacuccuacagagaucaugugcagcgggcuguugaacgcauuugggugucucacaaacccgaccauggccacgagggggcgaugcacaacgauacagccuauggacugcugggcgggggccauguccaggugagaaagcggauggacggagugagaacgcgcgagaccgcugcccucaaaguuaucgaauuugccgaucggcaagcucacccuagacauggccugcuucccaacggggagccuaugcccuacaagggauacaagggcgacagcaauuauugcauggaaauuguccgcaacgauaaagggaagugggagggagaggugguguccacauucgaagccuaccagcugguccggcagcacggccucgcgagacugcgccauccggcucugucugugagcgggcggccucuuguuaugagacugcuccgcaaugacacccugagagugauccacaacggcgagcagcggacaguccgcauuuguaaaaugaccgccgaaggagugaucgcccucgcugauacgaccgaguccaauguugacgccagaacacggaccaaggaucugagcuauauuuuuaaaacagcgggcucucuucaaaaguccaaggggcgcagaguggcuaucagccccucuggagaaaugaaagaccccggcuucuucgauuga

SEQ ID NO: 3753 - RNA, 3051 nt, Artificial Sequence
  Cas9 variant
auggagguguucgucgacguuagcgccagacagcugggcaucgaucucgggauuggaaccugcggcugggcucugcuugccgaagacucccugaucgcgcucgggacacggacguuugaugugcccgagaccgacaaggaacgcauuccuacaaaccaaaucagacggcaggcucgcggaaugagacgggugauugaucgcagacggcagcgcaugaaugccgucagacggcugcuugccgaccacggccugcucgcugaugggggaaaacugggccuggccaccgugcgccucgacccguggcaggcuagagccgagggccuggaucggcuucugucugcgggggaacucgccguugcucugggacauaucgccaagcaccgcggcuucagaagcaacuccaaacgggacagaggggcuaaugcccccaaggagucuagcgcgaugcuuggagccaucgcucaaacaggcgagcgccugcagcauuggcggaccgugggggaaauguuuuggaaagaugaguucuaccagacaagacgccggaacagagacggagauuauucccgcaccguccagcggcucgaccuggaaacggaggugcacagacugcucgccgcucaacgccggcugggcaauccucuugccaccuuugaccuggagcagucuuucauugauguugccuuuuuccagagaccccucgcugacagcgaugacaaggugggcccuugucccuuugaaccuuccgagaagcgcgcggcccggcauagcccgucuuucgaaagauuucggcugcuuucccgccuggcugcccucagacugagcucuggggccggagagcggccccuguccgaugcugaguucgccgcggcuugcgccgacuuuggcagacuccagggguucagcuucaaacgccugcggcaacaccuuaagcuggauccuucuaucagauuugccggaauugcucccgacgaggagggcaaacgcgaugucguggccagauccggggaagcuacaccuggaagcgccgcgcuccggcacugucugggcgacaccgugugggauaacaugcuuggcacacgccccgcccugcucgacgcuaucgccgcuauucugaccuucagagacgaugccgaccggaucgcggaggggcuggccggacucggcauugaggaaccgauccuggaugcucuuauggacgggguccgcaauggauccuuuggcaaguucaaagggccuggccauaucucugccaaggcuugcagagcccugcucccccaccuggcccggggacgcguuuacagcgaugcuugugcggacgccggcuaugaucauuccagacagacggaaacaaaccuggacgauauucggaauccuguggcucgcaaggcccuuggggaggcccucaaacagaucaagauuaucauucacacccacggaagacccacagcuauccauguggagauggcccgggacaucggcaaaagcgcggaugaaagagacgagauuaagaaagggaucgauaagcgcaacucugaaaaagaccgggcuagacaacaguuucacgagauggucggaacccccgccgccggcgcugaagaccugcugcgcuucgagcucuggaaggagcagaauggguggugccuguacaccggccgggaaauuccuaucgaugcccuuguguccagcgacaaccgcauucagguugaucauauccugccguggucuagaagcggagacgauuccuauaucaauaagacacucuguuuuacggaggcgaaccaacacaaaaagggcaugacccccugggaauggcugcaugacgauccugagcggugggagaaauucgcuagaacaguggaagggugcaagaccaugaaaggacgcaagaagcggaaucugcuucucagagacucuagccggcuggagaaagaauuucgcuccagaaaccugaacgauacacgguacgccugucgccuccugcuuggcauucugaagcacaccuaucccgacaucgucguggccgcuagaccugggccccucacggaucggcugagacgcgccuggggacugcagagccuuaaaaagcacgaggacggcacacggaaagaugacgacagacaucacgcucucgaugccgcgguuguggccgcuaccucucaguccaugcugcagcgccugaccacacucuuccaaaaggccgaacgggaagggggcagacgcgacuuugucggacuggagccgccuuggcccggcuuccgggcugaucuugaagccaagcuggaggggguggucgugagcagagccgaacgcagacgggcucgcggagcgggccauaaagacaccauuagagccaucggggagggagaugcuggcccuguuguguacgaacggaagcccgucgccgcccucacagagaaagaccuggaucgcgugaaggacccugagagaaauaaaguucugauugaaaaccuucggcaguggaucgcugccgggaagcccaaggauccggacaaagcgccuagaucucccaagggcgaucccaugacgaaagugaagcucgucaccacagacgacgugcgcauucuggugcggggaggcaccgcugauagaggggacauggcccgcguugaugucuuucggcaggccgacccuaaaggaagauggcgguucuuccuggugccgguguacccccaccaggucuuugauccuacagacuggccccaaccucccaaucgcgcugugguugccuauaagccugagaaagaauggaccgugaugggccccgaucacgaguuccucuggucccuguacccguuuagcuggaucgcggucgaaaaggcugacgggacgagaaucgagggauauuuccggggcaugcaucgcuccaccggcgccauuucuaucagcccucaccauuccaagucucuugccagcacagggauuggagcuaaaacccuggccuccuuuagaaaguucgcuauggaucggaugggcaaccucagcgagaucgaacgcgaggugagaacauggcacgggguugccugcaccuga

SEQ ID NO: 3754 - RNA, 3054 nt, Artificial Sequence
  Cas9 variant
augagaguggacagccugggccggugccucuccgaugaggaaugggcccgcgucaucuaccaccuguguaagcauagaggguuccacuggauuucucgggcugaggccaaacagaccgaaggagacagcaaguccgagggcgggaaaguuaagcaaggacuugcgggcacagcuaaacugauggaugaaaagggguaucgcucugccgccgagauggugcucgcugaguuucccgaagcccagagaaacaagcagggagaguaccggaaagcucugagccgcgaacuucuggccaaggagcucgcgcugcuguucgccagacagcggguguuuggcaaucgccaugcuacggacacccucgagacagccauccugggcaacuccgauaaaaagucugggcuuuucuggcaacagaaaccugcucuggccggagcggaccuccugaagaugcuugggaccugcacauuugaaaagaaugaguauagagccccgaaagcuagcuucaccgccgaacggcacgucuggcugacacgccucaacaaucugagaauugugaccgaugggaucacgcggcagcugaccgagcaggaacgccaacucguucugccccuuccuuacagacaggcuggagaccugacauauaagcagcucggcauggcccugaccaaagccgggcuucuggaggcuggauguuuuaaguucauuggccucgcguaccccacagaggcccagaaagcugaaggcaagaccaaagauccugaguccgccacgcuggugaagauccccgccuggcaagaacugcggcagacacucaacaaggcuagccugaaugacgagugggaaaaacuuucuggggaugcccugugcggacagccugagaucuuugacaagauugcguggauccucuccgucuauaaagaugacgacgaggugagaaccgaacuggcuaaacuuguucugccgaaccccgagggccucacagaagcccugcugaauauucgcuucgauaaguuucaugcccucagccugaaggcccuucgggcuaucgugccucacauggagaaggggcugagauacgacgaggcuuguguccaagccggauaccaccauucucagcuccacaaaauuggcgagggggagcauaaguaucugcccccucuguacgauggacgcgacggcgauggccggaugaucuucgcggaagacgccgauauucccagaaacccgguggugcuucgcucccucaaucaggcucggaaagucguuaacgccaucaucagacgcuaugggagcccuucugcugugcacauugagauggcccgggaccuguccagacccuuugaugaacgcaauaagaucaaaaaggaccaggaugaguaccaagcgcggaaccagagagaccgggagcaguucauugaacuguucggacacccucccaagggccucgaguuugaaaaauggcgccuguauagagagcagaaugggcaaugcgccuacagccagaagccccuugcuuccucuggagacguggccgaaaucuuccuggauggcagcaccgagauugaccaugcucucccuuauucccggagcuuugaugacucuaaaaacaacaagguccuggugcugaccagagagaaucgcgauaaagggaaccggacaccguacgaauaccuuggcggagccgaaaauuccgaaagauggcagcgcuucuuuagcuucguugagucuaacaaggccuauagacucgcuaagcggacgcgccugcugagaaaagacuuuggcgcgaaggaaagcgaggaguuccgggaacgcaaucucaacgauaccagauacgugugucgguuuuucaaaaauuaugucgagcagcaccugaaacuugccgaaggguccgaggcuaagcgcugcgugguugugucuggacaacugacaaacuuucucagaacccgguggggccugcugaagauccgcagcgacuccgauagacaucacgcccuugacgccgcugucguggccgcguguagccauucuaugguccagcggcucuccaauuacagcagaacacgcgaacuggaacaggugcgggauggguucguuaacaucgagaccggagaaauugugaaucccgcuaugcaccagcaacugagagagcacuuuccugaccccuggccuuauuuccgccaugaacucgaggcccggcugaaaaucgauucucccgcccuucugagagaggaaauggcucgccucuccagcuacacggaggaggagcuggccgcgcugaagccgcuuuucgucucccgggcuccucagagacgcaacggcggggccgcccacaaggacacaauuuauggccagcccgaaaaacucaagaaaaauggaucugugagccaaaagguugcucuggccucccuggcucucaaagacaucgaucugcuugccgacccucaucggaacgcgaagcuguacggcgccauuagagagcggcucgaggcucacgggggaaagggcgauaaagccuuucccgcuaccaauccucugcgcaagcccgacaaagaagggaacccgaccggaccuaucgugagaacagucaccaaggugaucgauaaacugucuggcauucccgugcggggcggcaucgccaagaacgacacaaugcuucgcguugaugucuucacgaaggccggaagauuucaccuggugcccguguacguccaucaccgggugaccggccucccuaaucaggcuauuacaagagggaaagacgagaaccagugggcgaucauugaugacaccuucgaauggcgcuuuagccuguauccgaaugaucucguucagauccggcugaaggacgagacacaucuuggauacuaugccuccaccgauagaagcacgucuuccauuagcaucugggcucacgaccgcaaccaaucugugggcaaagacgggcugauccgguccauuggagucaccacagccaaggauaucgaaaaauuccauguggacacccucggcaauguuuaccccgccccucccgagaagagacgcgggcuggcuuga

SEQ ID NO: 3755 - RNA, 3066 nt, Artificial Sequence
  Cas9 variant
augagacggcgcagagaccgguucaagcagcgccaagccgcucugcucaaacaccuggccggcguggggcuuuuucccgcggaugaggcugccagacgggaacuggccggacucgacccuuacgagcugcgcgcuagagcccuucaugaagcucugccgcucaaccacaucggccgggcccuguuccaucugaaucagcgcagaggguuuaagagcaaccggaaaaccgaucgcggaaaggcggacgaugagggcaaaauuagacucggggucgcccggcugcaggaagcuaugcacgagaagggauccgccacacuuggcgaguuccugcauggccgcagagcugccgcgacggaccccaaucagaucccuucuguucggaccagacuccgcgccgaaagcggggagggagcucggggcgauggguaugacuuuuaccccgauagacgcaugcuggaagacgaguucgaggccauuugggaaucccaacaggugcaccacccugcugugcuuacagaugagaucaagcagcgguuuuucgaagucaucuuuuaucagagaccccugaaacaaccugagauuggaaccugcacacucguggccggcgaacgccggcugccgaaggcccauccccuguuccagaaaagacgccuccuggaggagcuuaacgcucugcggaucguuuggccuggggugcaggcggaacuccugucuagagagcagcgcgaccuugccuaccugaagcucaaagauaagcgggcugucagauuugaaagccugcggaaggcccugaaacucgaccccgacgcccgcuucaauaaggaguccgaaaacagaucugagcugaaaggagaugagguggcugccgaacuuggcgcuaagagccgguuuggcgggagauggggacacaccgcgccugccgaccaaugggagauuguuucccgcauccaggcccuggaaagcgaugacgaugaggcucaguucuguguguggcucucugaacgguauggccuggacuccgagcaagccagagcugucgccgcggcccgccuuccccagggguucggaagauuuggccugacagcuaccacgcggcucauuaaagcccugcaggaugaggugaucguguacagcgaagcuguccagaagaccgggcugggacaucacucugacuuccgcaauggcgagguucucgccgaacugccguauuacggcauugcgcuugagagacacaucaugccugggacaggagaucccggcgacuccgaugagaugcggguggggcgcgugaccaacccuacaguccauauuggacugaaucaacucagacgggugguuaaccgccugaucaaaagauacggcccuccccggcagaucgccguggaacuggcucgcgagcuuaagcucgacgaccagcacaagagagaaauuaaugggcggaacagacagaaucgcgaggccgcugaacggagaagccaaaaacuggucgauaucggcauugccgacaagggagccaaccgcgcucugcucaaacugugggaggagcuuaaucccgauaacgcgcuggaccggagaugcguguauaccggccgccagaucucuauugaaaugcucuuuuccggggccguugagguggaucauauccugccguucgcugccacgcuggacgauagcaacgccaauaagcugcucugucugcgggaagcuaacagaaauaaacgccggagaucccccuuugaggccuucggacagggcgcggacugggaagagaucgcugcccgggccgcucgccugccuagagagaagcgguggcgcuuugaacccgaugccauggcgagauucgacacagaggaaaaguuucucgcucggcagcuggucgauacccaauaccuuucuagacuggcccgcgaguaucucggggugcuguucccugacaaaggagaaggcagcgggcgggucugggugucccccggcagacugacagagaugcuucgccggagcuggggacucaaccaccuucugccggaucauaaucucggcgggggagccgaccagccuaagaacagacgcgaccaccggcaccaugcuauugaugccaucguuguggcugucaccgacagacaucugcuucaggccauugcgcgcgaggccggccagagagggcacgaagcugccaaucggaugaccgcugaucugcccgugccuuggcccgacuuugaucgcgacguuggacaagugaucagacaggucguggugucucaccgggccgaucacggcacaguuuccaaagccggggcugcgaagggccaggacagcacggccggacgccuccauaacgauaccgcuuacggccugacagggcaaaccgacgagaaaggaaauacaauugucgugagacgggugccucugaccgcccuuaagaagcccacgucuaucgaagccgucagagaugacgagcuccgcaaagcucugagcguguggacacggggcuaugaugggaaggccuucgaggcgagacugucccgcuuuccggaacucggaccucugcaguuccggggcaucagacggguucgcguggucgagccccuuaccgugauucccaucagagacucuagcgggcggguuuacaaaggcuauaagggagacuccaacuaccgcuacgaugugugggaacugaaagacggcaagugggucgcugaggugguuagcauguucgaugcccaccagucuuccuggaccagcccugugagacgggaaaauccgacagcccgcaagguccucucucugcagcaaaacgacauuguggcuaucgagcccgaggggaaagaaagagagcugaugcggguggcccagcuucgccagggaggccagauuacccuggcggcuugccaugaagccggggaucucaagagacgggacgccgaguccaaugaagucgauccuuuuaaauauuucagccccacagcuggaggccugaagagaguucgcgcccggcaagugagaguggacgagcucggccgcguccuggauccugggucccgggacagagagcgcggagcugccuga

SEQ ID NO: 3756 - RNA, 3066 nt, Artificial Sequence
  Cas9 variant
augaaguacacccugggccucgacguggggaucgccagcgucggaugggcuguuauugauaaagacaacaauaagaucauugaucugggcgugagaugcuucgacaaagccgaggaauccaagacaggggagucucuugcgacggcucggcgcaucgccagaggaaugcggcgcagaauuagccggcgcucccagagacugcggcucgugaaaaagcuguuuguccaauaugaaaucaucaaggauucuagcgaguucaaccgcauuuuugacaccuccagagauggcuggaaagaccccugggaacuucgguacaaugcccugucucgcauccucaagccuuaugagcuggugcagguucugacacacauuaccaaaagacggggguucaagagcaaccgcaaagaggaucucuccacaaccaaggaaggaguggucaucacaagcauuaagaauaacucugagaugcugagaaccaaaaauuaccggacgaucggcgaaaugauuuuuauggagaccccggagaacuccaauaagagaaacaaaguggacgaauauauccauacaaucgcucgcgaggaucuucugaaugaaauuaaguacaucuucagcauucagcggaaacucggcucucccuuuguuaccgagaagcuggaacacgacuuccuuaacaucugggaguuucagagaccuuucgccuccggggauagcauucugucuaaagugggaaaguguacacuccugaaggaggaacugcgcgcucccaccuccugcuauacgagcgaguacuuuggccuccugcaauccaucaauaaccuuguccugguggaagacaauaacacacucacccugaacaaugaccagcgggccaaaaucauugaguacgcgcauuucaagaacgaaaucaaauauucugagauuagaaagcugcuggauaucgagccugaaauucucuuuaaagcccacaaucugacacauaagaaccccagcgggaauaacgaguccaagaaauucuacgaaaugaaaagcuaucacaagcugaagucuacccucccuaccgacaucuggggaaaacugcacuccaauaaggagagccuugauaaccuguucuacugucucacaguguauaagaaugacaacgaaaucaaagauuaccugcaggcuaauaaccuugacuaucugauugaguacaucgccaagcucccgacguuuaauaaauucaagcaucugucucuggucgcuaugaaacgcauuauccccuuuauggagaagggcuacaaguauagcgaugccugcaacauggcggaacucgacuucaccggguccucuaaacuggagaaguguaauaaacuuacaguugaaccuauuaucgagaacgugaccaaccccguggucauucgggcccugacacaggcuagaaaggugaucaaugccaucauucaaaaauacggacucccuuauaugguuaacaucgagcuggcucgcgaagccggcaugacccggcaggauagagacaaucugaagaaagagcacgaaaacaaucgcaaggcccgggagaagauuagcgaucuuaucagacagaacggccggguggcuuccgggcucgacauucugaaauggcgccugugggaagaccagggaggcagaugcgcguacagcgggaagcccaucccggucugugaucuccugaaugacucucuuacgcaaaucgaucauauuuauccuuacucccggagcauggacgauucuuauaugaacaaagugcugguucucacagacgagaaucagaacaagagauccuacacccccuacgagguguggggaagcaccgaaaaaugggaggauuuugaagcccgcaucuauuccaugcaccuuccucagucuaaggagaagcggcugcuuaauagaaacuucauuacaaaagaccucgauagcuuuaucucccgcaaucugaacgacaccagauacauuucucgguuccugaagaauuauaucgaaagcuaccuccaauuuuccaacgauagccccaaaucuugcgucgugugugucaacggccagugcacagcucagcugcgcuccagaugggggcuuaauaagaaccgggaggagagcgaccugcaccaugcccucgaugccgcugugaucgccugugcggaccgcaaaauuaucaaggaaauuacgaauuauuacaacgagagagaaaaucacaacuauaagguuaaauacccccugccuuggcauucuuuccggcaggaccugauggagacccuugcuggaguguuuaucucccgcgccccgagacggaagauuacaggccccgcccacgaugaaaccauccgcagcccuaaacauuucaauaagggccucacaucugucaaaaucccccugaccacggugacccuggagaagcucgagacaaugguuaagaacaccaaagggggaauuagcgacaaggcuguguacaauguccugaaaaacagacuuaucgaacacaauaacaagccucugaaagccuuugcugagaagauuuauaaaccccucaagaauggcacaaacggggccaucauucgguccaucagaguggaaaccccgagcuacacgggaguguuccgcaaugagggcaaggggauuucugauaacucccugaugguucgggucgacguguucaaaaagaaagauaaguauuaccuggugccuaucuaugucgcgcacaugaucaaaaaggagcuucccagcaaggccauugugccucucaaacccgaaucccaaugggagcugaucgacucuacacaugaauuucuguucagccucuaccagaacgauuaucugguuauuaagaccaaaaagggcaucacagagggauacuacagauccugccaccgcggcaccgggucucuuagccugaugccucauuuugcuaauaacaaaaaugugaagauugacaucggaguccggaccgccaucuccauugaaaaguauaacguggauauccucggcaauaaaucuauuguuaagggggagcccagacgcggaauggagaaauacaacagcuucaaguccaauuga

SEQ ID NO: 3757 - RNA, 3072 nt, Artificial Sequence
  Cas9 variant
augaagauccugggcuucgacauugggguggccagcaucggaugggcuuuugucgagggcgaugaaauuagagacugcgggguucggaucuucaccaaagccgagaaccccaagacaggagaaucccucgcgcugccucgcagagaggcucggggcgugcgcagacggcuugcccgcagacgggugcgccugaauacgauuaaaaagaucaucuguaaagaauuugaucucagacugucugacuacauugccgaugacggggagcuuccgaaggcuuaucagaccaacaaggauacaaaaagccccuacgagcugcgguauaaggcccucaaugaacgccuguccaaagaggaacuggcuagagucauccuccacauugccaagcaucggggauacggcaacaaacacgcgaaggacggcgaugacaaggauucugggaaagugaagaaagccaucggagagaauaagacccugcuugagcaaaaaggcuaugaaagcguuggggaguacugcuuccgcgaauuuuucaaguccauuaaagacaaggauggagagacacauaacaucccuucucagaauauuagaaacaagaaaggcaauuaugaccggugugugagccagaagcagcuggaagacgagcucaaacugaucuuugcuaagcaaagaaaacuuggguucaacaaggaguuugaagaugccauccuggaggucgcuuucuaccagcgcccccucaaggacuuugaugacaaaauuggagauugcaucuucuuugacaaugaaaagcgggccccuaaagaguccauuagcgcgaucgaguucguggcccugaccagaauuaucaacacacugaaguaccucucuaaaaccacgggcgaaguuuaugagaaggaaaucauuaauaagaucuggcagaaaauucuggagaacggcaagaugaccuacgcugaacuucgcaaaauccuggcccucgauuccagcguguucuuuaaggacaaagaucuggacuauacacuugggauuaaggaggcugaaaagaucaaauucaucgaguuuaagaaacugauuaaguucaaaaaggcccucggaucuuuugauggccugucccgggagauccuggacaauauugccaugcagaucgcuauuaccaaagacagacaacgccuccuggaaaaacuugaggucuucccccugaacaaggaacagaaagagaaccucagccagcugaauuuuucuaaguacaucgaucuuucccugaaagcgcucaaccagauucugccuuucaugcgggaggggagacgcuaugacgaagccaaggaugacgcuaaacugcaagagaaggccaagaauacaaagaaggaagaguuucucccgccccugaaagaguucgaucuuaaccugaccaauccugugguggcccgggcucucgccgaauuuagaaagguccugaacgcgcugcuuaaaaaguacggaaagguucacaaaauccaucucgaguucgcucgcgacaugcggcuggauuuugacgaaagagagcggcugaucagcauucagaaugauaacuucaauaagcgccagcucgccgaagacuucuguaaagagcacggccuggaacccuccaacgccaauauccuuaagauuaaacuguggcaagagcagcaguggcacugcauguauucuggggagcucaucggcauuccugaucugaaggaccccacgaagcugcaaguggaucauaucuacccguacagcagauccuuugacgacagcuauacaaacaaagugcuuguccgggcugaauggaaucaggagaagggaaaccacaccccuuucgaagccuuuggcggggauaaaaauaagugggacaaaaucguggcucucgccgagaagcugcccccuucuaaaaagcugaacagauccgaaaagagcaaaaaggauaaacuccuggacgagaaguucaacgauaaagagcuuggauuucuggcgcgcaauauuguugacacaggcuacaucgcccggcucguggcuaaguauauugauauguaccuggaguuccugccccuugaagaaaacgagaauaccucucucgccagaggggagaagggaagcaaaaagcauaucggcauugucaacgggcgccugaccuccgaagugagacacaauuggggccuggaccccaaagaucgggacaaccaccuccaucacgcuaucgaugccaucguuauugcguauaugaaugacaagcgcaucaaagccuuugcugauuucagacggcugaaggagcuuaagauuaaacgcuacggaagagaaaucacagaggacgaauaucaggagaagaaaaaggagcugucuugugccccuuuugacgauuuccggaaccgcacgcucgaaaauauugacaaaaucuuugugagcagaccgccccggaagcgcgcuagaggcacccugcaugaggaaacauucuacuccaucgaugacaagaaacugcuuaaggccuacgggggaaaagagggcaugcagcgggcccucagccuggggaagauuagacagaucggaaccaaaauugucaagaacggcacaauggugcgcgucgauaucuuuaaggacaaacgggggagauucuauggcgugccuauuuacaccauggauuucgcucugggaguucuccccaauaaggcggccgugucuggcaaagacaagaacgggcugaucaaagaaugggcugagauggauuccggauaugaguuuugcuucagccuuuuuaaggacgaucugauucucguccaacgcaaagaaaugcaggagccugaacuguguuacuucgugucuuuugacuccagcaaugcccagaucgacguucggucccacaacaaucauuucucugugcugaacgagaaccagaaacuucuguuuaagagcgccacgcaagcugaagucaucggcgaguccauugggauccagaaucucaagguguucgagaaguggcacgugucuccccugggagaaguuagaaaagccgaguuuagcccgcgcggcgaagcgaagcucaaaacauccaagaagcggaaaaaguga

SEQ ID NO: 3758 - RNA, 3072 nt, Artificial Sequence
  Cas9 variant
augaagaucuacagcuucgacauuggcguggccuccaucgggugggcuuuuauugagaacgaaguccugcaggauugcggaaucagaauuuucaccaaagccgagaaucccaagaacggcgcgucucucgcucugccucggcgcgaagccagagggguucggaaacgccuugccagacggcgcggaagacugaauacaaucaagcaacuccuguguaaagaguuuggccuucagcuggaagacuaucucagcaacgauggggagcugccgaaggcuuacacggccuccaaggcuaauccccugaaaucuccuuaugagcuccggacccuggcccuuagccagaagcuggacuccaaagaucucgugcgcgugauccugcacauugcgaagcauagaggauacggcaacaaacacgccaaggacucuaaggauacagaaagcggcaaagucaagaaagcuaucgaguucaaucggaagacccuugccgaaaaaggguaucgcuccgugggagaguaccuguauagagaguuuuuccagcaaagccggauuucucagaacaauggcgcuacagaauuuaucaacguucgcaauaaggccgggaacuacgagcauugcguggcgcaggacaugcucaaagaagaacuggaauccauucugaaugcccagagacaauucggauuuagccucaagcaggauuucgagucuaagcugcuuaccaaaaucuuugagcagcggccccugaaguccuucgcugacaaagucggcaacuguugcuuuauugccggggaaaagagagcuccuaaagauagccccucugccaucgaguucaucgcccucucccgcacaauuaauacccugaucaaccuuagcaaggaauccggagagauuuacaaccgggcuaucauucugcagaucguggaaucuacgcucaagaaaggcgagaucagcuauaaggagcugagagaaauuauccgccuggacgagcggcucagauucaaagauccucgccuggacuacucccgggaaauuaaggaggcggaaaaaguuaaguuucuugaguucaagcaacugaaaggcuuuaagaaagcccucggggagagcuucaccacacuggcuaucucucagcuugacgaaauugccgagcacaucgcccugaucaaggauagagugaaacucaaugaaaagcuggaguccuaugcucugaccaaggagcagcgcgaagcccucagcaaccugucuuuuagcgcgcauauuaaucuuucccugcaagcucucaaacagauccugccguucaugcggggagacaacggcgagcagugucuggauuacgacgaaucugucgagaaggccgggcuuaaagcccucagcaaggauacacugaaaggacagaugcugcccccucucaaugaauuugagcccuaucuguccaacccugugguggcuagagcccuugcugaguaccgcaagguccugaauguucuccugaaacaauauggcagcccccacaagauucacaucgaauacgcccgggaggcgaagcugucuuccaccgaaagacagaaauacgagaaggaacagaaagacaacuaugccgcuaaucaggccgcucauaagaaaugccaagagcuugggcucgagccgagcucuacgaaccugcugaagcucaagcuguggcaggaacagggaggccuuugucuguacuccggcgccaaaauuacaaucagcuaucuccaggauccuaccgcgcugcaaguggaccacauuuaccccuauucccggucuuucgaugacagcuacaugaauaagugccuggugcuuacaaaagccaaccaggagaaggggaaucgcaccccuuuugaggcuuucggaaccgauuccgccaaauggggcgucaucacaacgcucgcucagaagcugccccauaagaaaagacggagaauccugaacaccgccuuuaaugacaaggaggccggguucaaacuccgcaaccugaacgacacaucuuauauugcucggcuuguggcggauuacaccgaaacauaccuggaguuucucccccugguugagagcgaaaauaccacgcuguccaagggacagaaaggcagcaagaagcacaucgccauugugaacgggguccuuacaucuaccaugagauauuaccucggcuucgcuuccaaagaccgcgauaaucaucugcaccacgcccuggacgccgugaucauuggauucaugaacgauagcguuaucaaggcuuuuucugacuucaaaaagacccaagagacauccaaagccgcguauuacgcucauacccucagcaagcaggaauauaaaaagcagagagccuuuauccaacugccuucuggcgagaauuuccgggugagcguccuugagaagguggaauccgucuuugugagcaaaccgccccgcaagagaguucgcggggcccugcacgaggcuacauucuacucuccuaacgaucccaaacuccugaagaauuauggaggcacgaaagggguggaacgggcccuggcgcuuggaaagaugagaaaggucggcgcuaaaauuguguccaacggggccaugguucggguggacaucuuucgccauaagagcuccggcaaauucuacggagucccuguguacaccauggauuuugcccugggcauucuccccaauaaggcugugguugucgggaaagaccagaacggagugaucaaggauuggcuggagauggacucuagcuaugaauuuauuuucucccucuacaaggaugacgugauccugguccagaaaaaggagaugcagagaccggagcuuuguuauuucgugucuuuugacacaagcggcgccuccaucaaaguugcuaagcacgauaauaacuucucuacccugacagaaaaucaaaaacuccuguucagcaacgccaccaaggaggaaguggucgggaaguccauuggaauccagaaucugaaaguguuugagaaguggcagguuagcgugcuuggcgaagucaaacggacgcagucuuacccucgcgagaacauuucccuggcgagcaaggccaaaaaguga

SEQ ID NO: 3759 - RNA, 3075 nt, Artificial Sequence
  Cas9 variant
augaucagaacccugggcauugacaucgggauugccagcaucggaugggcugugauugagggcgaauacacagauaaggggcucgagaacaaagaaaucgucgccuccggaguucggguguucacgaaggcggagaaucccaaaaacaaggaaucucuggcccuuccucgcacccuggcuagaagcgcccggcgcagaaaugcucggaaaaagggccgcauccagcaagugaagcacuaucucuccaaagcccuggggcuugaccuggagugcuuuguccagggagagaagcucgcuacacuguuccagaccucuaaagauuuucugagcccgugggaacucagagagcgggcccuguaccgcgugcuugacaaggaagaacuggcgagaguuauucuccauaucgccaaacggcgcggcuaugaugacauuacauacggcguggaggauaacgacuccgggaagaucaagaaagcuauugccgaaaauucuaagagaaucaaagaggaacaguguaagaccauuggagagaugauguauaaacuguacuuccaaaagagccuuaacguccggaauaaaaaggaauccuauaaccgcugcgugggcagaagcgagcugcgggaggaacucaagacaaucuuucagauccagcaggagcugaaaucucccuggguuaaugaggagcugauuuacaagcuccuggggaacccugaugcucaauccaaacaggaaagagagggacuuaucuucuaccagcgcccccugaagggcuuuggggacaaaauuggaaaguguagccacaucaagaaaggcgaaaauucuccuuaucgggccugcaagcaugcgcccuccgccgaagaguucguggcucucaccaaaagcauuaacuuucugaagaaucuuacgaacagacacggccuguguuucucucaggaagauaugugcgucuaccucgggaaaauccugcaagaggcccagaagaaugaaaagggacugaccuauuccaaacucaagcugcuucuggaccucccuagcgauuuugaguuccugggccuugacuacuccgggaaaaacccggagaaggcuguguuucugucucuccccagcacauucaaacugaacaagaucacccaggaccgcaagacacaagauaaaauugccaauauccugggagccaacaaggacugggaagcuauucucaaagagcuggaaucccuucagcugagcaaggagcagauccagaccauuaaagaugcgaagcucaauuucucuaaacauaucaaccugucccuggaggcccuuuaucaccuccugccucugaugcgggaaggcaagagauacgacgaggggguggaaauccuccaagagcgcggaauuuuuagcaagccccagccuaaaaaucggcagcugcuucccccgcugucugaacucgcuaaggaggagagcuauuucgauaucccuaaccccguccugagacgcgcccuguccgaauuucggaaaguugugaaugcccuucucgagaaguacggcggcuuccacuacuuucauauugaacugacgagagacguguguaaagcuaagucugcccgcaugcagcuggagaagaucaacaaaaagaauaaaagcgaaaacgaugcggcuucccaacuccuggagguccuugggcugccuaauacauauaacaaucggcucaagugcaaacuguggaagcagcaggaggaauacugucuguauagcggagagaagauuaccaucgaccaccuuaaagaucagagagcccuccaaauugaccaugccuucccccugucucggucccuggaugacagccagucuaacaaggugcucugccugacauccagcaaucaggaaaaauccaacaagacccccuacgaguggcuuggcucugacgagaaaaagugggauauguauguugggcgcguguacagcuccaacuuuucuccuagcaagaaaagaaagcugacccagaaaaauuucaaggagcggaacgaggaagacuuucucgcuagaaaucuggucgauacaggauauaucggccgcgugacgaaagaguacaucaagcacucccugagcuuccuuccgcuccccgacgggaaaaaggaacacauucggaucauuucuggcuccaugaccagcacaaugagaucuuuuuggggaguucaagagaagaaccgcgaucaucaucugcaccacgcccaggacgcuaucauuaucgccuguaucgagccuuccaugauucagaaauacaccacauaucugaaggauaaagaaacccauagacucaagagccaccaaaaagcgcagauccugcgggagggcgaccacaaacuuucucugcgcuggcccaugagcaauuucaaggauaaaauucaggaauccauccagaacauuaucccuagccaucacgugucucauaaggucacgggggagcuccaccaagaaacagugagaaccaaagaguuuuacuaucaggccuucggaggcgaggaaggggucaagaaagcucugaaguucggaaagauccgggagauuaaucagggcaucguggacaacggggccaugguucgcguggauauuuuuaaauccaaggacaaaggcaaguucuacgcuguccccaucuauaccuacgauuuugccauuggaaaacugccgaauaaggcgaucgugcagggcaagaaaaacgggaucauuaaggacuggcuugaaauggacgagaauuaugaguucugcuuuagccuguucaaaaacgauugcaucaagauucaaacaaaagaaaugcaggaggccguucucgcuaucuacaaguccaccaauucugccaaggcuacaauugaacuggagcaccucagcaaauacgcccugaagaacgaagacgaggaaaagauguuuacggauaccgacaaggagaaaaauaagacaaugaccagagaguccuguggaauccagggccuuaaaguguuccagaaggucaagcugucugugcucggggaagugcuggagcauaaaccucggaaccgccaaaacauugcccugaagacaacccccaaacacguuuga

SEQ ID NO: 3760 - RNA, 3078 nt, Artificial Sequence
  Cas9 variant
augggcggguacaugccccagcugaugagauaucggcucgcccuggacaucggaagcaccuccauuggcugggcuaugauccgccuuucuaugcaaaacgagccuauugccaucauuagaaugggggugcggaucuucagcgauggacgcaauccgaaggacggcuccucucuggcggucacaagacggguugcucgccagaugagacggcgcagagaucggcuccugaaacgcaagacgagacuucugaacgcccucgugcagaaaaaguuuuuccccgaagacgccgaugcucggaaagcccuggugguccugaauccuuacgagcuccgcaaggaagggcuguauagacagcuuagcggacccgaguuuggccgggcucuguuccacaucucccaaagacgcggcuuucucucuaaccggaagaccgacaaaaaggauaaugacagcuccgugcugaaaaaggccauuguugaucuuagacagcagcuggaaguggagaacugccagacaaucggggaguggcuguucaaacaacagcagagcggaaagucuguccgcgcgcggcucagaggcaagacccagaaagacaaggccuacgauuuuuauauugaccgcgcuaugaucgcccaugaguucgauacacugugggugucccaagcuaaauacgacccucuccuguuuaaugaagacgcccgggcgauucuuagagauauccugcucuaucagcgcccccugaagccuguuaaaccggggcgguguacccuuauucccgacgaaagcagagccccucuggcucucccccugacacagcaagcccgcaucuaccaggagcugaaccaccuccggaucaccacgccugcucugggagcccaggcccuuaccguggcucagagaaauacaauugcggcccugcucgagaagucugaugucaccuucgugaaaaucgcuaaggcccugggccuuacauccaccacggaauuuaaccugcaagacauuaagcgggaucgccucaaagggaaugccacagcuaucauucuggccagaaaccaguacuucggacggagauggcaugacuuuaaugcggaucugcagaaccucaucguggacaagcuggucaaugagggcagcgaaaccgcucuuaucgaguggcugaaagccaacacagauguugacgaaucugccgcugagcgcguguccggcgugacccuccccgagggguauggaagccuguccgucgccgcucugcggagacuucucccggcccugaaggaagaugugguuguguacucugaggcggucaaacgcgccggcuucgacagccacuccgcucugagccucauugaacagaccggggagcuguaucaagaacuuccuuacuauggagaggugcugcagagacauguuggcuucgggucuggagaccccaacgauuccccugagcggcgcuuuggcaagaucgccaaucccacagugcacauuggccucaacgaacugagaaagaucauuaaugcucugaucaaacgguacgggaaccccgccgaggucguggucgaacuugcgcgcgaccucaagcugagcagagagaaacggaaggaaauccaggaggagcagaaacaacgccaggauagaaaugaaaagcggauuaaggacgccugcgagauccugggaauugauccucucgugaucgaccgcggcaaaagacgggaaauuucucagaagaugcagcugugggaugagcuuaacccgaaagacgcugccaauagacgcugucccuauacgggggaucaaaucagcauugagaagcugcucuccgcugaaguugagaucgaacacauccugccuuucucuaaaacccuggacgauagccuuaacaauaagacaguggccaugcggagagccaaccgcgacaagggaaaucggacccccuacgaggcuuuuggcgaaucccucaacccugauuacgacuaugacgcgauucugcagagagccagccugaugccccgcgagaaacggaagagauucgcuucugauggguaccagcaauggcuccgcgacgauaaagacuuucugucccgggcccuuaaugauacagccuaucugagcagaaucgcuaaggaguaccucacccugauuugcccgccuaacucuguccgggccauccccggccgcaugacggcgcagcugagagcuauguucggacuuaaucggcuccuguccgaaggcgggauuaaaaaccgcgaggaccauagacaccaugccaucgaugccgcugugaucggaguuacagaccagggccugcuccagaaguuuagccgggccuccgcgagaacccgcgaacugcaacuuucucggcugguggaugacaugccucuccccugggauaccuauagagagcacgucacacgcgcucuggaacaccugguggugagccauaaaccugaccacggguaccagggaaagaugcaugaggauaccgccuggggccuucgggacaacgggcagguuacaagacgcguccgguccgaggacggcggacccagacagcgccugcucgaaaauaagaacguggugaaaauuaauucuacgagagauuucagccggcacggcaucgacgagcaagggcaggucaacgccuauaagggauacgugggcggguccaauuacuguauugaaaucuggauugaugagaaaggaaaguggaacagcgacguugugucuaccuuucaggcuuaucagaucguccgcgaacugggcgagaaagccgcuuggcaaaagcucagaaauccgcugcuuucccugagcgccaagccucucgugaugcggcugaucauugaugacguugugaaaaugcagaucgcggggcagaacaagauuaugcgcgucgugaaaaucgcccaaaauggccagauuuucuuugcugagcauaacgaagccaauguugaugcuagagacaaggauaaaaacaaucccuucaaguacaucucuaagacagccggaucccugcagaaagccggcgggauccacauggcuauuagccccaucggagacgcgcggccugugagauauggccgcuga

SEQ ID NO: 3761 - RNA, 3084 nt, Artificial Sequence
  Cas9 variant
augaaguacacccugggccucgacguggggacaaacagcaucggaugggccguccuggagcuuaauacgaacggcgaaccccagagaauugagaaacuggggucccggaucuucaccgauggacgccacccuaaggacggcacaacccucgcuucuaaaagacggcaaaagcgccaugaaagacggcgcagagaucggcugcaccagcgcaaaaagcugguucuuaaucagcucgugagcauggggcuguuuccgcaguccgagcaagaacagcaggaccugaagucucucgaugugcugacacuuagagccaacggagucagcaaacagcuguccgcguaugagcucggccggguguucuacuaucugaaucuuaagcgcggcuuuaaaucuaacagaaaagggggaagcgaggaagacaaagcuaauaagauuuccgagcggaucaagaaacugcaagaacagcucaaggagaacgauuucaaaaccguuggccaguaccugcaugaccgcuauauuaaggggcugagcacaaaagccaccaucgagaaugauuuucaccuccugagacagcuuaucgaagacgaguucgauuuuauuguggaaacgcaaucuaaguucuuucccgagaucuccgacgaacaguggaacacccugcggaauagaauguuccaucagcgcccucucaaacccgucgagacaggaaccugcagccuguuugaggauaagaagcggacauacaaauauaugccuucuuucgaagaguacagauuucuuaccgaacuguucaaccucuccuaccaagacgagaauuuccacagccacucucuguccagcgaacagauuuuuaagguguuccaugagcugaaaaacacgcgcgaggccacauauaccaagaucaaaaagcuccugaaacuucccuccgaccugucuuuuagcauugaacgguccaagagcaaggauaaaaucaagauuucuacaaccaaucacuucuuuuccaaaagccuccuguucgcugaggaaugggccucucuugaccugaagcucaaggaugagguugcugaaaucuacuuuagcgacauguccguggaggagaucaaaaagggccugcugcagcucaaaauugauucugaaaucauugagaaccugcuugaagagaaggucccuaacgugcaggaggccaccuguagcuauuccaaagaagcgcugcaaaagaucgugagccucauucuggaggaagagagacauccgacacugaucgucgacgaucuuuucaagaaugaaaaagaggagacgucucucaucgaccgccuggauuacuauggggccuccauucccgacagcaugcagccuaucccccagcacauuaaggauaacaaucugacccucaacgaagacgagaaacgguacggaaagaucgcuaauccuacaguucacgccgcucugaaccagauuagacaaguggugaaugaccuuaucgaacaguauggcaaacccaccaacauccauauugaguuugcccgcgaucugaagaaaucuaaggaggaacgggacuucgauaauagaaagaaaaagaaaaacgaggaacucaaugagcagguccgcgacuuuaucgaaaagcacaaccagaaaccguccgcguucaauuuugagcgggugaagcugugguucgaacuggaugccaugaacaaucaaguuugcgcuuacagcggcaagacaauuuccgccagaauggugcuuucugacgagguccagguggaucauauccucccuuucagccggacccuggacgauucccuggcuaacaaaguucucgugcuggccucugagaacgucaagaaacgcaauagaacgcccuacgaagccuuugggcaggacacagagaagugggcuagcauucaggaacuugcgaaacggcugccuuaucacaagcaauggagauucgccgaggaugcuaucaagaaauuugaggaaaaggaccaguuccuccagcgccaucugaacgauacccgguacauuuccaaaaucgccaagaaauaucugggaagcaucaccgaccccuacaagauuguggccucuagaggccaaaugacauccaucauucgcgggaaacuuggacucaaucaguuuauccagaagcccgacggcaccaagaacagagaggaucaccggcaccaugcuauugacgcccugacagucgcgcugacgagccgcucuuaucucaaaagaaucuccgaugcuagcgcccggaaucaggacccuaaccgcaucccgauucccgaaccuuggaagggguucaucaaagaugccgacgugaaguuuaaugagauuaucguuucucacaaaguggaucauggaaagaacggccccuucauggaagagaccuguuuuggccugauuaagaauccuaacaaauacgaggaagagaaugacuucaaacuuaucacaaccaagagccuggauuccgucaaggaccccagcacaaucagaucucaaucccuccagaaccuggcugaaaagagcggggugauuucccuggccaagucuggaguuaagaaacuucggguguaugaugucaccaaggagaauccggcugacaucggccucauugaaagcgggcuggccaaaaucacgcacggaaaggauaaacagcacgugaagcauuaccagaagggcgacauuaacuaccuggcgaucuggugccucccucaaaauaucacccugaaauccgacaaccacaagaaacgcaagacagauuauauuuuuaccgccaucaaaacauucgaccuuaacucuaagaaucccaacgaucugagaccucaucccgcugccaagcucgugaccaaaguuuacaagggggacacggucgcucuggaggugaauaaccagcugaauuauuacauugugaaaagcauccgggccgcgaacaagaaacuuuauuuucugaagauuaaucaguccucugagcucgccaacgaaacacaguucaucccugcuuacaccaagcuggucgauuauaaauuccgcaaggugagcguuucccccacaggcgugauuaccgacaauggaccgcuccugaaauga

SEQ ID NO: 3762 - RNA, 3090 nt, Artificial Sequence
  Cas9 variant
augagaagccugcgguaccgccucgcccuggaccuuggcuccaccucucuggggugggcucucuucagacuggaugccugcaaccggcccacagcggugaucaaggcuggaguccgcauuuuuagcgacggcagaaauccuaaagauggguccucucuugccguuacgcggcgcgccgcuagagccaugcggcgcagacgggaccgccugcucaagagaaaaacccggaugcaggcuaagcugguggagcacggauucuuuccggccgaugcgggcaaacgcaaggcccuggaacaacucaaccccuaugcucugagagccaaggggcuucaggaggcucugcucccuggagaguucgcccgggcgcuguuucauaucaaucagagacgcggcuucaaaagcaaccggaagacagacaaaaaggauaaugacuccggcgugcuuaaaaaggccauugggcagcugagacaacagauggcugaacagggaucucgcaccgucggcgaauaccucuggacacggcugcagcaagggcagggagugagagcccgcuaucgggagaagcccuacaccacagaggaaggcaaaaagagaaucgauaaaagcuaugaccuguacauugaucgcgcuaugaucgagcaggaauuugacgcccucugggccgcucaggcggccuucaacccuacccuguuucacgaggcugcccgggccgaucuuaaggacacgcugcuccaucaaagaccccugcgcccuguuaaaccggggcgguguacccuucugcccgaggaagagagagcuccucucgcccugcccuccacacagcgguuccgcauccaccaggaagugaaucaucugagacuccuggacgagaaccuucgggaagucgcgcugacccucgcucaaagagaugccgugguuacagcccuggagaccaaggcuaaacuuagcuuugagcagauucgcaagcugcucaagcugucuggauccgugcaguucaaucuggaagacgccaaacggacggagcucaagggcaacgcuacaagcgccgcgcuggccagaaaagaacuuuuuggcgcugccuggucuggguucgaugaggcucugcaggacgaaaucgucuggcaacucgugaccgaggagggagaaggcgcccugauugcguggcugcagacacacaccgggguggaugaggcccgcgcucaggccaucgucgacguuucccuuccugaaggauauggcaaucucagcagaaaggcucuggcccggauugugcccgcccugcgcgcugcggugaucaccuacgauaaagccguccaggcugccggguucgaccaccauucucaacucggauuugaguacgaugccuccgaaguggaggaccugguucacccggagacaggcgaaauuagaagcguguucaagcagcuuccuuauuacggcaaggcucugcagcggcaugucgccuuuggguccggaaaacccgaggauccugacgaaaagcgcuauggcaaaaucgcgaaccccacggugcacaucgggcucaaucagguuagaaugguggucaacgcucugauucggcgcuacggaagacccaccgagguggucaucgagcuggcccgggaccuuaagcaaucucgcgaacagaaaguggaggcccagagacggcaggcugauaaucaaagacgcaacgcccggauuagacgcagcaucgcggaaguucucggcauuggggaggaacgggugagaggcuccgacauccagaaguggaucugcugggaggagcugagcuucgaugcugccgaccgccgguguccuuauucuggaguccagauuuccgccgcuaugcugcucagcgaugaaguggagguugaacacauccugccguuuucuaagacacuugacgauagccugaacaauagaaccguggccaugcgccaagcuaaccggauuaaaagaaaucggacacccugggacgcccgcgcggaguucgaagcccagggcugguccuacgaggauauccuccagagagcugagcggaugccucugcgcaagagauaucgguuugcccccgacggguacgaaagauggcugggagaugacaaagauuuccuugcucgcgcccucaacgacacccgguaccugucuagagucgccgcugaguaucugcgccucgugugcccuggcacgcgggugauucccgggcagcugacagcgcuucugagaggaaaguuuggccucaaugacguucuggggcuggauggcgagaaaaaccgcaaugaccaucggcaccaugccgucgaugcuugugugaucggagugaccgaccaaggccuuaugcagagauucgccaccgccagcgcucaggcccgcggggauggacucacaagacuggucgacggcaugccgaugccuuggcccaccuaccgggaucacguggaacgcgcgguuagacauaucugggugucccaccggccugaccacggguuugaaggagcuaugauggaggagacaagcuauggcauucgcaaggaugggucuaucaagcagagacggaaagccgacggcuccgccggaagagaaauuagcaaccugauccgcauucaugaggcuacgcaaccccuccggcacggcgucucugccgaugggcagccucuggcguacaagggauaugugggcggguccaauuacugcaucgaaauuaccguuaacgacaaaggaaagugggagggcgaggugaucagcacauucagagcuuauggggucgugcgcgccggcggaaugggccggcuuagaaauccccaugaagggcagaacggacggaaacugaucaugcgccucguuauuggcgauuccgugagacuggaggucgacggggccgaacggaccaugcgcaucgugaagauuucuggaagcaauggccagaucuuuauggcuccgauucacgaggccaacguggacgcuagaaauacagauaaacaagacgccuucaccuacacguccaaguacgcgggcucucugcagaaggccaaaacccggcgcgucacaaucagcccuaucggggaaguuagagaucccggauucaagggcuga

SEQ ID NO: 3763 - RNA, 3090 nt, Artificial Sequence
  Cas9 variant
augaaguacagacuggcccucgaccugggcagcaccucccuugggugggcuaucgugcagcugaacgccaaagaugagcccugcgcgauuguccgggcuggaguucgcaucuucccugacggcagaaauccgaaggaugggucuagccucgccgugacacggcgcaacgccagagcuaugcggcgcagacgggaccgccugcuuaaaagaaaggcccggaugcaacgccugcucauugaacacgaucuguuucccgcugacgaggccgcgagaaaagcccuggaaacgcucaauccuuaugagcugcgggcuaagggacuugaugccgcucugacccccgccgaguucgcgcgcgcccucuuucaucugaaccagagacggggcuucaaguccaauagacgcacagaccggaaagauaacgacucuggggcucuuaaggccgcuaucggaggccugagagcccagcucgauaccgccggcgcugacgggcgcgcgcggacagugggagaacugcuguggagacgcaugagcgauccuaauguccucaccgugcgggccagauaccgcgagcagcggauuacaaaagacgacggcaagaccagaguugauaaauccuaugaccuguacguggaucgcgcuauggucgaagccgaguuugacgcccuuugggcuaagcaagccgaacugucucccacgcaguucggggaggcggcucgggccacccucaaggauugucugcuucaccagagaaaccugcggccugugcgcccgggaagaugcacacucgagcccgacgaaccucgggcuccccuggcucugccuagccagcaaagauuucgcauccuccaggagguuaaucaucugcggcuucugggcgggagacuccuggaagagucccuuagcguggaacagcgcgauaaacuggucgccgcucucgaggacggaucuaaguccuucaaaaccgccauccccaagcugcugggccucccgggcacagugcaguuuaaccuggcggaugccaaaagaaccgagcuuaaggggaaugcuacgagcaugcugcucggcaaaaaggacuucuuuggaccugccuggcacggguucucugaagcucggcaagaugagauugugaugcgcauccaggaagaggaauccgaggccagacuggucgacuggcuggcgacaagcaccggaguugacgaggcccaugcucuuaagauugccaacgcugcccuccccgaaggcuaugggucucuguccgccaaagcucuggcgaagauccucccugccaugcgggcugaggugauuacauacgauaaagccgugcuggccgcuggauaugaccaccacagccauaucucccacgccgcgucuaccggcgaaauucuucccgagcugcccuacuacggcgaauaucuccagcgccaugucggguuuggaaccggcgagcugaaugauacaccugagaagagauucgggcggaucgcuaacccgacggugcacaucggacugaaucaaguucgcguggucgugaacgcccuuauuaaaagauacggccaccccaccgaaguuaucguggaggucgcccgggaccucaagcagagccaggaucagcgcagagaaacacaagagcagcaggcuaagaaccagaaacggaaugagagacugcgcaaggacgccgcggcuauucuggggaucgccgaugaacgggugagacucgccgacauucaaaaacugauccuuugggaggaacuguccuucgauaucgcugaccgccgguguccuuauagcggcguccagcucucugccgcuauggugcuguccgagcagguugaaauugagcauauccugcccuuuagcaugacccuugaugacucucucaacaauaagacaguggccaugagacuggucaaccgccugaaaggaaaucggaccccuugggaugcgagagaggccuucgcuggccaggggugggacuacgacggcauucucaugcgcgccgaacggaugcccagagcuaagcggcaacgcuuugccccggauggacuggagaaguggcuuaaagaagacaaggauuuccuggccagagcucucaacgacacgcggcaccugagccgcguggcgagagaguaucugucccuuguuugcccugccucuacacgggugauccccgggcagaugaccgcuaugcucagagccaaauuuggacugaaugauauucugggccucaacggggaaaagaaucgcaacgaccaucggcaccaugccgucgaugcuugugugguggccguuaccgaccagggccugcuucagagauucgcgcaagcuagcgccgaugcccgcggaaaaggccuggaccggcucgucgagacaaugccugaucccugggacuccuacagagagcacgugcagcgcgcugugaauagcaucugggucucucacaagccugaucauggguuugaaggagccaugcacgaggacaccacauaucggcccccgcaucuggacccuaagaacauguggagaacgcgcggcaucgggggaggcaaacccaaugaaaaggaggcggauuccaaagcuauggugggguucaccggccccgaacaucugcagagacaccaccgggacaaggccggacaacagcuuccuuacaaaggcuacguugccagcccgaaguuuugcauggauauugugcgcaacgacaaagggagaugggagggagaggucgugucuacauucgaagccuaucggcugguuuccgaguuuggccgcgaugccgcucucgcccacauccagagcaaguccagaucuauuagcgggaagccccuggugaugcggcuccagggaggcgacauggucagauucgaugacgaugaagggcgcccugugguucugcggguggucaauaugaccggcaacggacaaaucuuuuucgcgccccauaacgaggccaauggcgacgcuagaaaccgcgauaaacaggaccaguucguguaccuuuccaaguaugccgggucucugcagaaagcucggggaagacgggugacagucagcccugccggcgagcuccgcgaccccggguuuaaggaauga

SEQ ID NO: 3764 - RNA, 3090 nt, Artificial Sequence
  Cas9 variant
augagaagccugcgguaccgccucgcccuggaccuuggcuccaccucucuggggugggcucucuucagacuggaugccugcaaccggcccacagcggugaucaaggcuggaguccgcauuuuuagcgacggcagaaauccuaaagauggguccucucuugccguuacgcggcgcgccgcuagagccaugcggcgcagacgggaccgccugcucaagagaaaaacccggaugcaggcuaagcugguggagcacggauucuuuccggccgaugcgggcaaacgcaaggcccuggaacaacucaaccccuaugcucugagagccaaggggcuucaggaggcucugcucccuggagaguucgcccgggcgcuguuucauaucaaucagagacgcggcuucaaaagcaaccggaagacagacaaaaaggauaaugacuccggcgcccuuaaaaaggcuauugggcagcugagacaacagauggccgaacagggaucucgcaccgugggcgaauaccucuggacacggcugcagcaagggcagggagucagagcucgcuaucgggagaagcccuacaccacagaggaaggcaaaaagagaaucgauaaaagcuaugaccuguacauugaucgcgccaugaucgagcaggaauuugacgcccucugggcugcgcaggccgcuuucaacccuacccuguuucacgaggccgcccgggcugaucuuaaggacacgcugcuccaucaaagaccccugcgcccugugaaaccggggcgguguacccuucugcccgaggaagagagagccccucucgcgcugcccuccacacagcgguuccgcauccaccaggaaguuaaucaucugagacuccuggacgagaaccuucgggaaguggcucugacccucgcccaaagagaugccgucgugacagcucuggagaccaaggccaaacuuagcuuugagcagauucgcaagcugcucaagcugucuggauccguucaguucaaucuggaagacgcuaaacggacggagcucaagggcaacgccacaagcgcggcccuggcuagaaaagaacuuuuuggcgccgcuuggucuggguucgaugaggcccugcaggacgaaaucguguggcaacucgucaccgaggagggagaaggcgcgcugauugccuggcugcagacacacaccgggguggaugaggcucgcgcccaggcuaucguggacgucucccuuccugaaggauauggcaaucucagcagaaaggcccuggcccggauuguucccgcucugcgcgcggccgugaucaccuacgauaaagcugugcaggccgccggguucgaccaccauucucaacucggauuugaguacgaugcuuccgaagucgaggaccuggugcacccggagacaggcgaaauuagaagcguuuucaagcagcuuccuuauuacggcaaggcccugcagcggcauguggcguuuggguccggaaaacccgaggauccugacgaaaagcgcuauggcaaaaucgcuaaccccacgguccacaucgggcucaaucaggugagaaugguugugaacgcccugauucggcgcuacggaagacccaccgaggucgugaucgagcuggcccgggaccuuaagcaaucucgcgaacagaaagucgaggcucagagacggcaggccgauaaucaaagacgcaacgcgcggauuagacgcagcaucgcugaagugcucggcauuggggaggaacggguuagaggcuccgacauccagaaguggaucugcugggaggagcugagcuucgaugccgccgaccgccgguguccuuauucuggagugcagauuuccgcugccaugcugcucagcgaugaagucgagguggaacacauccugccguuuucuaagacacuugacgauagccugaacaauagaaccguugcuaugcgccaagccaaccggauuaaaagaaaucggacacccugggacgcgcgcgccgaguucgaagcucagggcugguccuacgaggauauccuccagagagccgagcggaugccucugcgcaagagauaucgguuugcucccgacggguacgaaagauggcugggagaugacaaagauuuccuugcccgcgcccucaacgacacccgguaccugucuagaguggcugcggaguaucugcgccucgucugcccuggcacgcgggugauucccgggcagcugacagcccuucugagaggaaaguuuggccucaaugacgugcuggggcuggauggcgagaaaaaccgcaaugaccaucggcaccaugcuguugaugccugugucaucggagugaccgaccaaggccuuaugcagagauucgccaccgcuagcgcccaggcgcgcggggauggacucacaagacugguggacggcaugccgaugccuuggcccaccuaccgggaucacgucgaacgcgcugugagacauaucuggguuucccaccggccugaccacggguuugaaggagccaugauggaggagacaagcuauggcauucgcaaggaugggucuaucaagcagagacggaaagccgacggcuccgcuggaagagaaauuagcaaccugauccgcauucaugaggccacgcaaccccuccggcacggcgugucugcggaugggcagccucuggcuuacaagggauaugucggcggguccaauuacugcaucgaaauuaccgugaacgacaaaggaaagugggagggcgagguuaucagcacauucagagccuaugggaucgugcgcgccggcggaaugggccggcuuagaaauccccaugaagggcagaacggacggaaacugauuaugcgccucgucaucggcgauuccgugagacuggagguugacggggcugaacggaccaugcgcauugugaagaucucuggaagcaauggccagauuuuuauggccccgauccacgaggcuaacgucgacgccagaaauacagauaaacaagacgcguucaccuacacguccaaguacgccggcucucugcagaaggcuaaaacccggcgcgugacaaucagcccuauuggggaagugagagaucccggauucaagggcuga

SEQ ID NO: 3765 - RNA, 3096 nt, Artificial Sequence
  Cas9 variant
augcccgccaucuacagacuggcucucgaccugggcagcaccucccuugggugggccgugcugcggcucgagccugcggcucuggaaccgauugccaucauuaaggccggaguccgcaucuucucugauggcagaaaccccaaagacggggcuagccuugccguuacacggcgcgcugccagagcgaugcggcgcagacgggaucgccugcucaagagaaaagcccggaugcaggacaagcuggugaaacacggauuuuucccuuccgauauggacgagcgcaaggcucuggaaagacucgaucccuaugcccugcgggcuaagggccuucgcgaggcccugacgccuggggaauuugcgagagcccucuuccauauuaaucaacggagaggauuuaaaucuaaccgcaagaccgacaaaaaggauaaugacagcggcgcucugaaaaaggccaucucccaccuucggcagcagauggaggcuggcgggcauagaacagugggagaucaccuguggucucgccuccagcaaggccuggggguccgggccagauaccgcgagacccccuucacaaacgacgaaggaaagaaacggaucgauaagagcuaugaccuguacauugacagagccaugaucgagcaggaauuugaugcucucugggcggcccaggcugccuucaauccugcccuguuucaugagguggcucgcgccgaccuuaaagauacccugcuccaccagcggagacugcgcccgguuaagcccggccggugcacacuucugccugaggaagagagagcgccccucgcucugccuuccacccaacgguuccgcauuuaucaggaagugaaccaccugagacuccugggggaggaccuucgggaagucgcccugacgcucgcccagagagaugcuguggccaaugcucuggagagcaaagcccgccuuaccuuugagcagauccggaagcugcucaaacugucuggauccguucaauucaaccuggaagacgcgaagagaacagagcucaagggcaaugccaccagcgcugcccuggcucgcaaagaacuuuuuggcgccgcguggggaggguucggcgaggcccugcaggaugaaauuguguggcagcucgucacagaggagggggaaggagcucugaucgccuggcugcaagcucauaccggcguggacgaggccagagcccaggcuauugcggaugccucucuucccgaaggguacggaucccucagccggaaggcucuggcccgcaucgugccggcccugagagcuggcgucguuacguaugacaaagccgugcaggcggcuggcuucgaucaccauucucagcucggguuugaguacgacgccggagaaguggaggacuggguccacccugauacaggcgagauccggcccguguucaagcaacugccuuacuaugggaaaccccuucagcgccacguugccuuuggauccggcaagcccgaagacccugaugagagacgguacgggaagauugcuaacccgaccgugcauaucggccugaaucagguccgcacagugguuaacgcccucauuagacgguauggacgccccaccgaaguggucaucgagcuggcgagagaccugaaacagagccgggagcaaaagguggaagcucagagaaaacaggccgagaaucagcgccggaacgcccgcauuagaaaguccaucgcugaaguccuuggcaucggggaggaacaagugcggggagccgauauucagaaauggaucuguugggaggagcucucuuucgacguugcugaaagacgcugcccuuacagcggcgugcagauuuccgcccggaugcugcugagcgaugaggucgaaguggagcacauccuccccuuuucuaagacccuggacgauucccuuaauaacagaacaguugcgaugcgccaggccaaccggauuaagagaaaucggacgccuuggaccgcucgcgacgauuucgaagcccaaggguggagcuaugagggaauccugcagagagcugagcggaugccccuccgcaaaagauaccgguuugccccggacggcuaugaaagauggcugggggaugacaaggacuuccuggcccgcgcucuuaacgauacacgguaccucucuagaguggcggccgaguaccugcgccuggucuguccuggcagcggaacccgggugauccccggccagaugacagcuagacuccgcgggaaauuuggacugaauggcgugcuugggccugacggagaaaagaaccggaaugaucauagacaccaugccguugacgccugcgucauuggcgugaccgaucaagggcugaugcagcgcuucgcuaacgccuccgcgcaggcuagagaggacggccucacgcggcugguggaugacaugccccgcccuuggcccacauauagagcccacgucgaacgggccgugcgccacaucuggguuucucauagaccggaucacggauuugagggcgcuaugauggaggaaaccagcuacgggauuggaaaagacggcuccaucaagcagcggagaaaggccgaugggagcccuggacgcgagauuaccaaucugauccggauucaugaagcgacacaaccccagagacacggcgcugggcccgacggccagccucuuccguauaaaggauacgugggcgggucuaacuauuguaucgagaucacccgcaaugauaagggaaaaugggagggcgaagucauuuccacauuccgggccuacgggaucgugagaacgagcggacucggccagcugcggcacccccgcguuggccaaaacgggagagagcuggugaugcggcucgucauuggagacucugugcgccuggaaaucgacggcauugagagaaccaugcggaucguuaagaucuccgggagcaauggacagauuuuuauggccccuauccaugaagcuaacguggaugcccgcaauuccgacaaacaggaugcuuucgccuauacaucuaaguacgcgggcagccuucagaaaaccaaggccagauucgucacaauuucccccaucggggaggugcgggaccugggauuuaagggcuga

SEQ ID NO: 3766 - RNA, 3099 nt, Artificial Sequence
  Cas9 variant
augaagaaaagaauccugggccucgacauugggaucgccagcgugggaugggcucuggucgaguucgaugacgaauuucaggauaacaagaaaaagggcaccauuaucaaauccgggguucggauuuucacacgcgccgagacgcccaaggaaagagagucucuugcgaagccucggcgcgaagcuagaagccaacggcgcagaauccggcgcagaguggagcggcugaauagcauccgcgagcucuuugugaaaaacggagucguggaagaguggucuguuagcaagaaaaauccgaacaauauuuacaucacccugaaccagauuaagacacccuggcagcuuagaauggaaucccuggaccggaaacucaccaaugagcaguucgccgugguccugacacaccuggccaagcaucgcggcuauaagucucucagaaaagaugacaaggcugggaaagugcuggaggccaucagccaaaacaagaaacggcuuaaugauuccgacuacagaacccugggagaaauguuuugcaagaacgagagcuauaaagaacacaagcgcaauaagggcggcgaguacauuaacucuguugcucgggaacucaucgaggaggaaguggagaaaauuuucgucaagcagagagaaaaagggaauaacuuugccgaugugaauacagagcgcgaauaucugaagaucgcguucucccagaaaccugccggaagcaucucuaagauggugggcuuuuguaccuucgagaacggggagaagcgggcucccagagacuccuacagcgccgaacuuuuuaaaguccugugcacgauuaacaauaccacauucaccgauaugaagacaggagagauccgcucuuuuuccaaagaagagauuggcaagacccucgaaacgguuaaaaacgugaaggacgugaaguaugcuaaaauccggaaggaucuggggcuggaggacagcgucaaauucuccggaguggacuacagagagaaugccaagucuaaaggcgaaggcgagauuuucguuagcaugaagacauaccaugaaaucaaguccaaaaucgagaagcucagcaaagagaagugggauaaccugaaagggaauaccgaacuucuggacucuauugugaacaucauugcgaaucucaaggaugacgaguccaucaaaaaggaauuucagaagcugaaaauugaugaggacaucaucgauguccuucugaacuucgaauuuaagaaauucauuaaucucagcuuuaaggcccugcgcaaaaucauuccuuuccaauuucagggacagaaguauaucacagcuucuaccagcgccggcuacucccugaagcaggaggggauuaaaaacaagcucgugcccccugcuaaagagaauaucaacguugccguggucgcccgggcuuucgcgcaaaccagaaaggugauuaaugccgucauccgcaaauauggacaguuugaccagaucaacauugaacuggcuacagagcuuaaaaauucuaaguucgaucggagcaagaucgaagagggccaaaagaaauuucagucccagaaggacaaaauuuucaaggaagugcaggagcugagagggggaaugacgccguccucuucccuccugcuuaaguaccggcuguggcgcgagcaagaugaaagauguguuuauagcggccggaaaaucucuuuugaggaccuccuggacaccggcuuccuggauauugaccacaucauccccuacuccaagagcauggaugacuccuucaacaacaaagugcucugccuggccgaagagaauagaaacaagaaaaaugauauuccuuuuaacuauuaccagcgcaucgaccgggauuggaaucuucugauuucuaucauuacaagcaugaagaacaugaaaaucgccaagaaguccagacuccugaaacaggaacugucugacaucgagggguucauugagcgcaauaucaacgauaccagauacgcuacacgguauauuaaggacuuucuugaaaauaaccucgaguucaaagaaaaugaguuuaucaaggucaaagugcaggcccgcagcggaggccugaccuccguucugagcuacaacugggggaugucuaaggauagagaggaauccuauuuccaucacgcgaaggacgcuauuaucguggccuguagcacgcaaggaaugguccaguacaucucuaaaauuucccagcaguaugagaaugauaaggacaaaaugaagaaaaucaaggacaagacagaaaacugcauucccaaaccuugggauagcuuucgggccgacguggaggaaucuaucgagggcauuuucgugagcuuugcuccccgccacaagguuaccggguccgcccauaaagagaccaucuacagcaagaaacaccucgaaaaggagagauaugucacagugaagaaaucucuggauaagauuaaacuuuccgaccuggaaaauaucccguguaacgagaacugcggcaucauucgggugcucaaggaacgccuggagaaauucaagaaugauagccugaaggcuuuugccgacccuguccauaugcccaccaaauguccuaacaagaaaggacccgugaucagauccguuaagauuaaagagucuaauaagacaggcaucgaagugcggaaagggcuugcggagcgcggagaaauggucagaguggauguuuucauuaaggacaagaaauacuaccucgugcccaucuaugucagcgauuuuaagaacaaagaccugccuaauaaggccaucgcugcccugaaacucgagaacgaauggauuaugaucgauaagacguacuccuucaaguucucucuguuuaaagacgaucuuauuaagaucaaaaagaaaaaggaggagauuuucggcuauuuugggggagugcaccggagcaccggcacaaucaagaucaaauccagacacaagccgaaagaaauugacgaggggaucggcucucgcugccugcucgacuuccggaaguuucaaguugaugugcugggaaauuacaccgaagucaaacaugagaagagaaugcccgcuuauauuacacgcaaggacaaaaagcacuga

SEQ ID NO: 3767 - RNA, 3105 nt, Artificial Sequence
  Cas9 variant
augaagauccugggcuucgacauugggaucgccagcauuggaugggcuuuuguggagaacggcgaacucagagauugcgggguccggaucuucaccaaagccgagaaucccaagacaggagacucccuggcgaugccucgcagagaagcucggucuguucgcagacggcuugcccgcagaaaaggccggcuggagacgcucaagcgccugcuugccaaagaaugggaucuguguuacgaggacuauauugcugccgauggggagcucccgaaggcuuuuaugggaaagaaccugaccaaucccuacgugcugagauaugaagcccuccagcggcugcuuggcaaagaggaacuggcgcgcgugauccuccacaucgccaagcauagaggcuacgggaacaaaaaugcuaagauuacaaaaagcgaggaguccaagcgggaacaaggaaagauccugucugcccuugcuaccaacgccagcgucauugcgcgcuauagaacagugggcgaguacuucuauaaagaauuuugcgagguuaucaagaauccucaggggcugaacaccaaugaaaacuguacacagcccaaagugcggguccucaagccuauuagaaauaaaggaggcgaguacaccaacugcauccugcaggaggaccugcaacgcgaacuccgguguauuuucgagcaccagaagggguuuggauuccccaucacgcaggaauuucaggauaaaauccugaagauugccuucuaccaaagaucccuuaaggacuuuucucaucuggugggcaaaugcaccuucuauccugaugagccgcgcgcucccaaguuuagccucuccgccaucgaguucauuacaaaagcuaagaccaucaaucugcuuguuggcauugugaaagagagcggggaggucugggacaaggaacaguggcgggagagacuggauucuguguucuccgccgugugugaacgcggaaaccucacauuugcccagaugcggaagauccugaaaaucgacgagcgcauucaguucaaggaagucgauuacaccgcuaaaaauccugagaacaagaaauuuguugaguucaagaaccugaagaaauuuugcgaaauccucggcgcgauugugggggacagagcccuggcugacagcaucgcccgggauaugacgcuuauuaaggacgaggaagaacuggcccaaaaacucagaggauauggcaaguucucucaggagcagaucacacaacugggggcucuuaauuuuucccaccauaucaaccugagccucaaagcccugucugaaauucugcccuucaugcgcgagggaaugcgguacgaugaagcgugucaggaggcuaagcuccaggccaagcacaaugacaaaaaguccaaauuucugccucccuucugcggcagcaucuaugccgaugaacuuaccaacccggugguccacagagcuauugccgaguaccggaagauccugaaugcucucauugccaaauauggcaacgugcauaagauccacauugagcugacacgcgacguugggaaaaauuuucaggaaagagagaaguacaagaaagaaaucgaguccaacuacaaggcgcgggugcaagccaugcaggaaugugagaaacugggacuuacccucucugagggcaauauccugaagcugagacucuucauggaacagaacgagcgcugcgucuauagcgggcggaaaauuacccuggcuaaucuuaaggaacagggagcccuggagaucgaucauauucucccuuacuccagaagcucugacgauuccuauaugaacaaggugcugguuuuuacaaaugaaaaccaaaauaaaggcaacaagacgcccuacgaggcuuucgggggcgacagccagaaauggggagagaucgaaucucuggcccuucgcagcggcuauccuaagaaaaaggcgaagcggauucucgauaaaggguucggagacagagaggccggcuuuaagucccgcaacaucguggacucuggguacaucgcuagacugauugccaauuauaccaaagaauaccugaaguuccucccccuggauagccacgagaacacagcucuuaucgccggagagaaagacuccaagauucacgucgaagccgugaagggcaugcugaccgcuacaaugcggcauuuuugggggcucggcagcaaaaaucgcuacgagcacacccaucacgcgaucgaugccauuaucaucgcuuauauuaacgccgccaugauccagagauucucucaguuucggcaaaaucaggaaucccugaaggcucgcuucuacgccaaagagcuggcgaaggaagaguuuaaaacgcagagagcuuucuuugagcccuucagcggauuucgggaacagguccuugccaaggugggccaaauuuucguuucucgcccuccgagaaaacgggccagaggggcucuccaugaggaaacauuuuauuccaucgacgauaagaagcugagcgagaccuacggaggcaaagaaggggugcagcgcgcccugucccucggaaagauucggcagaucggcaccaaaaucgucgcgaacgggcccauggugagaguugacauuuucaagcacaaaaagucuggccgcuucuaugcugugccuaucuacacaauggauuuugcccugggcauucuucccaauaaggccgucgugagcggaaaagacaacgaucggaucauuaaggacuggcuggagauggauuccaauuaugaguucugcuuuucucucuucaaagacgaugugaucgaaguucaaaagaaagacauggagaagccugaacuggcuuacuuugucagccugaacaccuccagcgccucuauugcucuugugaagcacgacaauaaauucgagacacucacguccaaccaggccaagcuguuuagcaaugcgaaagaaaacaaugugaucgccgagucucuggggauccagaaccucaaggucuucaaaaaguacaaggugagcccccugggagagauuaaagaagcuaaguaugagccgagacagccuaucgcccuuaaaaccucccccaagaaacaucgcaagcaaaacaaugcucaguga

SEQ ID NO: 3768 - RNA, 3108 nt, Artificial Sequence
  Cas9 variant
augagacggcugggccucgaccuggggaccaacagcaucggauggugccuucuggaucucggcgacgauggggagcccguguccauuuuccgcacaggagccagaaucuuuucugacggccgggauccuaagagccuggggucccuuaaagcuacgcgcagagaagcccggcugacccgcagacggcgcgacagauucauucagcggcaaaagaaucucaucaacgcgcuggucaaauacggacugaugccggcugaugagauucagcgccaggcccucgccuauaaggaccccuacccuauccggaaaaaggcucuggaugaagccaucgaccccuaugagaugggcagagcuauuuuucacaucaaucagcgcagaggcuucaagucuaaccggaaaagcgccgauaaugaagcggggguugugaagcaauccauugccgaccuugagaugaaacugggagaggcuggcgccagaacaaucggggaauuucucgcugaucgccaggccaccaacgacacagugcgggcgagacgccugucuggaaccaaugcccuuuacgaguucuauccugaccgguacaugcuggaacaggaguuugauacacucugggcuaagcaggccgcuuucaaccccagccuguauauugaggccgccagagaacgccugaaagagaucgucuuuuuccaacggaagcucaagccucaggaagugggcagauguauuuuucuguccgacgaggaucgcaucagcaaagcgcuuccgucuuuccagcgguuuagaaucuaccaggaacuguccaaucucgcuuggauugaccaugaugggguugcccaccgcaucaccgcuagccuggcccuucgggaccaucuguucgaugagcucgagcacaagaaaaagcugacguucaaagccaugagagcuauucugcggaagcaaggaguggucgacuaccccgugggcuuuaaccucgaaucugauaaucgcgaccaucugaucggcaaccuuaccuccugcauuaugagagaugccaaaaagaugaucgggagcgcgugggaccggcuggacgaggaggaacaggauucuuucauccucaugcugcaggacgaucaaaagggagacgaugaaguuagauccauucuuacacagcaguauggccugagcgacgauguggcugaggacugucucgauguccgccugccugacgggcacggaucccugucuaaaaaggccaucgaucggauucuccccgugcugagagaccagggccuuaucuacuaugaugccgugaaagaggcugggcugggagaagccaaucucuacgacccuuaugcugcccugagcgacaagcuggauuacuauggcaaagcgcuugccggccacgucaugggggcuuccggaaaguuugaggacagcgaugaaaagcgcuacggcaccauuucuaaccccacaguucauaucgcccucaaucaagugagagcuguggucaacgagcugauccggcugcacgggaaaccggacgaagugguuauugagaucggacgcgaucucccuaugggcgccgacgggaagagagagcuggaacgguuccagaaagagggccgcgcgaagaacgaaagagcccgggaugagcuuaaaaagcugggacauauugacucccgcgagagcagacagaaguuucagcucugggaacaacuggcuaaagagcccguggaucggugcuguccuuucaccggcaagaugaugucuaucagcgaccuguuuuccgauaaagucgaaauugagcaccuucuccccuucucucugacgcuggacgauagcauggccaauaagacagugugcuuucgccaggcuaacagagacaaagggaaucgggcccccuucgacgccuuuggaaacuccccugcuggcuacgauuggcaggaaauccucgggagaagccagaaucugccguaugcgaagcgcuggcgguuccuucccgacgccaugaagagauuugaggcugauggaggcuuccuggagcgccaacucaacgacacccgguacauuucuagauauacaaccgaauacaucuccaccaucauuccuaaaaauaagaucuggguugugacagggcgccugacgagccugcuucggggcuucuggggacucaacucuauucugagaggccacaauaccgaugacgggacacccgccaaaaagucccgcgaugaccaucggcaccaugccaucgaugcuauugucgugggaaugaccagcagaggccugcuccagaaagucuccaaggccgcgcggcgcucugaggaccuggaucuuacaagacuguuugaagggcggaucgacccuugggacggauuccgcgaugaggugaaaaagcacaucgacgcuauuaucguuagccauagaccccggaagaaaucccagggcgcccuccacaacgauaccgccuaugggauuguggaacacgcugagaauggcgccucuacggucgugcauagaguuccgaucacaagccugggaaagcaguccgacauugagaaagugcgcgauccucugaucaagagcgcgcuucucaacgaaaccgcuggccugucugggaaauccuuugagaaugccguccaaaaguggugugccgacaacagcaucaagucucugcggauuguggaaaccguguccaucauucccaucacagauaaagagggaguugcuuacaagggcuauaaaggggacggaaaugccuacauggauauuuaccaggacccuaccagcucuaaguggaaaggcgaaaucgucagcagauucgaugcuaaccagaagggguuuauccccuccuggcaaagccaguucccuacagcccgccucauuaugcggcugagaaucaacgaccuucugaagcuccaggauggcgagauugaggaaaucuaucgcgugcagcggcugucuggauccaaaauucugauggcgccccacacggaggccaauguggacgcuagagaccgcgauaagaacgacaccuuuaaacuuacaagcaaguccccgggcaaacugcaaucugccagcgcuagaaagguccauaucuccccuaccgggcucauucgggaaggauga

SEQ ID NO: 3769 - RNA, 3108 nt, Artificial Sequence
  Cas9 variant
auggagcagcugaacuacauccucggccuggacauugggaucgccagcgugggaugggcugucguugaaauugaucacaaugaggaccccaucagacuuauugaugugggcgugcggaccuucaacaaggccgaagucgcgaaaacaggggagucccugucucucauccgcagacuggcucggggaagccgcagacuugugcggcgcaagaaaaugagacugcucacggccaagcggcugcugaaauccgaaggcauccucucugaccuggauuuuaauaagggggccauucuuaaccugccuaauaacugcugggagcuccgcguuaagggacuggacaaaaagcugagcgauaaagagugggcugccgugcugcuccauaucauuaagcacagaggcuaucugucccagcggaaacaugaccgcaagaccgaugacaaggaacugggcgcucuccugucuggggucagcaaaaaucacucccuucuggaggaaggagaguucagaacagccgcggagcucgccaucaacguguuuuguaauagcaagggccauauucggaaccaguggggagauuacucucacaccuucucccgccuggaccuucagaaagaaaucaagcagcuguuuguuagccaaagagagcucggaaauccguauacaucuuccagcuucgaagagaacauuaucucucugcugaugaaacagaaggaagcuaucuccggcaaugauauucucaaaaugcuggggaagugcaccuacgagaagaacgaguauaaagccgcuaagaauacauacagcgccgaacgguuuguguggcuuaccaaacugaacaaccucagaaucgucgacgacggaguggagcgcgcgcuuaauuccucugaacggaaacuucugauugaugagcccuauaagaaggccaagcucacguacgcucaggugagaaaaauccuggaacugccugacagcgccgucuucaagggcguucgcuacuuugcugauaacgccgaguccagcacccucauggagaugaaauucuggcacucuauucggaaggcccuggaauccaauaaccuuaaagacgaguggcuggugcucaagacaaagcccgaacugcuggaugagaucggcaccggguuuagcaucuauaaaacagacgaugacauuaccucuuaccuuagcaauaagcucgauaaaaaggugcuggacauccugcucgucgaaguguccuucgauaaauuuauugagcugucucuuaagugucugagaaagaucauuccucucauggagaaaggauaucgcuacgacgaggcuuauaaguacaucuauggcgagguuaacaucgaauacaaucugaacgacauuaaaaaucccgugguccugcggagcuucucccagagcagaaaggugaucaacgcgguuauucgccuuuacgggucuccugcccggauccauauugagacggcuagagauaucggaaaauccuucaaggagcgcaaagccauugaaaagcaacaggagaagaaucggcucgaaaaagugagagccgcugagcacuuuaagcagcuguucccgaacuaugucggcgaacccaaagccaaggacauccugaaagugcggcucuacgagcagcaacaggggaagugccuguauagcggaaagauccuugauauuaaacgccugauggagcauggcuacgucgaaaucgaccacgcgcucccuuuuucuagaacaugggaugacuccuucaauaacaaggugcugguucuggcuaaugagaaccagaacaaaggcaauaagacccccuaugaaugguuuaacgggaaagauaauagcgacuccuggaagcgguuccuugcccucgugaacaauucuggauuuagcgccgucaagaaacaacacauucugaugaaggagaucgaugaagagggcuucaaacagagaaaccugaaugacacacgcuacauuacccgguuucucuguaacuggguggagaauaacaucccucugcuugggaagggaguuaaaagaguguucgcuccccagggcaagaucaccgcccugcuccgcuccaauugggggauuagaaagguccgggaagauaacgaccgccaucacgcuaucgaugccauugugguggcgugcacaacgguuucuauccagcaaagaauuaccaauuaugucaaaaacagcgagaucaaucggaagaucaaacgccagaacuaccugaaguuuccggaaccuuggaaauucuuuagagaggacauuuccauccggguguucagcaacaaucccauugaagaacugaagcagcagcuuucugaccgcccugaggccaaccaucaauucgugacaccccucuuugucuccagagcucccgugcggaaaaugaccggccagggacacgaagauacaauccgcagcgccaagagaauuucugagggcaucuccguucugcgggugccucugaccaagcucaaugacaaaagccuggaacuuauggucaacagagagcgcgagaaggaacuguacgaugcucucaaacagcggcugcuggaguucaagaaugacccggaaaaagccuuugcggagcccuucuauaagaaagggggacagcaagugaagacgguuagaaucgaacgcgugcagaagaacggcguccuugugaauaacaauacagggauugccgauaacggaaauaucguucggguggacgucuuucugaaaaagaaaaaguacuuccucgugccuauuuauucuuggcaaguggcuaagggcauccugcccaacaaagccauugucgcucauaagaaugagugugauugggccgacauggaugggagcgcccaguuucucuucucccuguacaccaacgaccuuaucgagguugugcugaaagauagcaccauucucggcuauuuuucuuccaucgacagagcuacagcggccaucauuaucaaggaaccugauauggagaaaagcaagggaaaggaaggcauucaccgcgugggggucaaaaccgcucgguccuucaucaaguacaauguggacguucuggggaaaaacauuucuagaugccgcaaggccaaacggcugcccgugagauga

SEQ ID NO: 3770 - RNA, 3108 nt, Artificial Sequence
  Cas9 variant
augcugagaaagaugcacuaccggcucgcccuggaccuuggcagcaccucccuggggugggcuaugauccgccucaacgccggaaaugagcccugcgcggugauuaaagcuggcgucagaaucuucucuaacgggcggaauccuaaggauggaagcucccuggccguuacacgcagagaagcccgggcuaugcgcagacggcgcgacagacuucugaaacggaaggcccgcaugauucagacgcucaucgaguauggcuuuuucccggcuaaagaagaucaaagaaaggcccuggagauuaugaaccccuuugcgcugcgggccaaggggcucaaugaagcucugaccccugccgaguucgcucgcgcccuuuuucauaucaaccagagacggggauucaaaucuaauagaaagacagacaaaaaggauaacgacagcggcgcgcugaaaaccgccaucaauaagcuccgcgagacacugaagaccgaaaacugucggacagugggcgaguggcuuaauaaaagagauguggcugggcugaccguccgcgcccgguaccaccaggacaagacgauuaaagaagauggaaaguccaaaaucaacaaguauuacgaccucuauauugauagagcuaugaucgagcaugaguuugacgaacuguggaaaaagcaggccgagcugaaucccacccucuucacagaagccgcucgcgcggaucugaaggacgugcuucugcaccaacgggcccucaaaccuguuaagcccggcagaugcaccuuuaugccugacgaggaacgcgcuccgcuggcccuucccucuacacagcgguucagaauguaccaggaggugaacaaucugcgcauucuccgggaugggcugaaagaggaaagccugacccucaaccagagagacgaucugaucgccgcucuugaggaaaacaauaagcggacguuuacacaaauuaaaaagcugcucggacugggcggggucgugaaguucaacuuugaggacccuaaacgcgaggaacuuaagggaaauaccacauccgccauccugggcaaagaugagcauuucggcagcguuugguucaaguuugacgaagcgaaacaggaugcuaucgugaugcagcuuuucaaggaggaaaacgaggccaagcugcugagauggcuccagaaugaaaccgggauugacgagaaacgggccgagaccaucgcuaacgucggacugcccgaaggcuaugggucucuuugugcccuggcucucgcccgcauucugccugagcugagacgggauguggugcccuacuccgacgcggccaaggcugccggauuucaccacagcgauacaucuaauaaccaagaagucccgggccuuacguucccuaucgagcucguugugaccgagacaggggaaauuaaaaccaagcauaucuuucacgagcugcccuacuauggagaauaccugcagagacaugugggcuucggcuccgggaaaccugaggacagcgcugaaaagcgcuauggaaagaucgccaaucccacaguccacauuggccucaaccaggugagacugguugugaauacccuuaucaaacgguacgggcaccccucugaggucauuguggagguugcgcgcgaccugaagcaauccaaagaucucagagacgaagagggaaagcggcaggccgaaaaccagaaacgcaauaagagaauccggacggcuauugccggcgugcugcagacaagcgaggaacgcgucagacgggaugacaucgagaaaaugauccugugggaggaacuuuccuuugauccugcugaccgcagaugcccguauucuggggugcaaauuagcgccgccaugcuccuguccgaugaggucgaaaucgagcauauucugcccuucagccagacccucgacgauucucugaacaauaagaccguggcucuccggcaggcgaacagaguuaagggcaaccgcacaccuugggaagccuuuggagcucaguccaccgccggcuucgacuacgccacaauccuggcucgggccgagcacaugcccaaagggaagagauaucgcuuugcggaggauggauaccaacgguggcucaaagacgaugcuggcuuccugccuagagcccugaaugacacgcgccauaugagcaagguggcccgggaauacaugucucuuauuugucccaacaccagagucaucccggggcgcaugacagcuaugcuccggggaaaauuuggccugaaugacgugcuggggcucaacggcgagaagaauagaaacgaucaccggcaucacgccguugacgcgugcgugauugcugucaccgaucagggacugcuucagcgcuucgccaaggccagcgcuuccgccagagaacagcaacugaaucggcucguggagaacaugccucugcccugggagucuuaucgcgaacacguggagagagcuaucgacgccaucuggguuagccauaaaccugaucacucccaugaaggcgcgaugcacaaugacacagccuacgggcugcuuggagauggcaaggucagcauucacaaaaugguggaggggaagcgggaaagaaucgaggagucucucaaagugauugcuuucaccaacgccaaggcuaaugaccgccauggacugcuggauaacggcgaaccccggccuuauaagggguacaaaggcgacuccaauuauuguaucgagauuaucagaaacgaaaagggaaaaugggagggcgaagucaucagcacguuugaugccuaccagcucgugcgcgagcacgggguugcccggcugagacaucccacccuuucuguguccggaaagccgcuggucaugcgccucaugaaagacgagacaauucggauggugaccaaugaaaagccuaucacagcuagaguuugcugggugcgcagcgauaccagaauugcguucgccuccacgucugaggcuaacgucgacgcccgggaccgcgauaagaacgacagcuuuuccuauaucgugaaaacagccucuguucugcagaagcugcaggcuagacggauuagcaucucccccaccggcgaacuucgcgaucccggguucaaagaguga

SEQ ID NO: 3771 - RNA, 3108 nt, Artificial Sequence
  Cas9 variant
auggagcagcugaacuacauccucggccuggacauugggaucgccagcgugggaugggcugucguugaaauugaucacaaugaggaccccaucagacuuauugaugugggcgugcggaccuucaacaaggccgaagucgcgaaaacaggggagucccugucucucauccgcagacuggcucggggaagccgcagacuugugcggcgcaagaaaaugagacugcucacggccaagcggcugcugaaauccgaaggcauccucucugaccuggauuuuaauaagggggccauucuuaaccugccuaauaacugcugggagcuccgcguuaagggacuggacaaaaagcugagcgauaaagagugggcugccgugcugcuccauaucauuaagcacagaggcuaucugucccagcggaaacaugaccgcaagaccgaugacaaggaacugggcgcucuccugucuggggucagcaaaaaucacucccuucuggaggaaggagaguucagaacagccgcggagcucgccaucaacguguuuuguaauagcaagggccauauucggaaccaguggggagauuacucucacaccuucucccgccuggaccuucagaaagaaaucaagcagcuguuuguuagccaaagagagcucggaaauccguauacaucuuccagcuucgaagagaacauuaucucucugcugaugaaacagaaggaagcuaucuccggcaaugauauucucaaaaugcuggggaagugcaccuacgagaagaacgaguauaaagccgcuaagaauacauacagcgccgaacgguuuguguggcuuaccaaacugaacaaccucagaaucgucgacgacggaguggagcgcgcgcuuaauuccucugaacggaaacuucugauugaugagcccuauaagaaggccaagcucacguacgcucaggugagaaaaauccuggaacugccugacagcgccgucuucaagggcguucgcuacuuugcugauaacgccgaguccagcacccucauggagaugaaauucuggcacucuauucggaaggcccuggaauccaauaaccuuaaagacgaguggcuggugcucaagacaaagcccgaacugcuggaugagaucggcaccggguuuagcaucuauaaaacagacgaugacauuaccucuuaccuuagcaauaagcucgauaaaaaggugcuggacauccugcucgucgaaguguccuucgauaaauuuauugagcugucucuuaagugucugagaaagaucauuccucucauggagaaaggauaucgcuacgacgaggcuuauaaguacaucuauggcgagguuaacaucgaauacaaucugaacgacauuaaaaaucccgugguccugcggagcuucucccagagcagaaaggugaucaacgcgguuauucgccuuuacgggucuccugcccggauccauauugagacggcuagagauaucggaaaauccuucaaggagcgcaaagccauugaaaagcaacaggagaagaaucggcucgaaaaagugagagccgcugagcacuuuaagcagcuguucccgaacuaugucggcgaacccaaagccaaggacauccugaaagugcggcucuacgagcagcaacaggggaagugccuguauagcggaaagauccuugauauuaaacgccugauggagcauggcuacgucgaaaucgaccacgcgcucccuuuuucuagaacaugggaugacuccuucaauaacaaggugcugguucuggcuaaugagaaccagaacaaaggcaauaagacccccuaugaaugguuuaacgggaaagauaauagcgacuccuggaagcgguuccuugcccucgugaacaauucuggauuuagcgccgucaagaaacaacacauucugaugaaggagaucgaugaagagggcuucaaacagagaaaccugaaugacacacgcuacauuacccgguuucucuguaacuggguggagaauaacaucccucugcuugggaagggaguuaaaagaguguucgcuccccagggcaagaucaccgcccugcuccgcuccaauugggggauuagaaagguccgggaagauaacgaccgccaucacgcuaucgaugccauugugguggcgugcacaacgguuucuauccagcaaagaauuaccaauuaugucaaaaacagcgagaucaaucggaagaucaaacgccagaacuaccugaaguuuccggaaccuuggaaauucuuuagagaggacauuuccauccggguguucagcaacaaucccauugaagaacugaagcagcagcuuucugaccgcccugaggccaaccaucaauucgugacaccccucuuugucuccagagcucccgugcggaaaaugaccggccagggacacgaagauacaauccgcagcgccaagagaauuucugagggcaucuccguucugcgggugccucugaccaagcucaaugacaaaagccuggaacuuauggucaacagagagcgcgagaaggaacuguacgaugcucucaaacagcggcugcuggaguucaagaaugacccggaaaaagccuuugcggagcccuucuauaagaaagggggacagcaagugaagacgguuagaaucgaacgcgugcagaagaacggcguccuugugaauaacaauacagggauugccgauaacggaaauaucguucggguggacgucuuucugaaaaagaaaaaguacuuccucgugccuauuuauucuuggcaaguggcuaagggcauccugcccaacaaagccauugucgcucauaagaaugagugugauugggccgacauggaugggagcgcccaguuucucuucucccuguacaccaacgaccuuaucgagguugugcugaaagauagcaccauucucggcuauuuuucuuccaucgacagagcuacagcggcccugaucauuaaggaaccugauauggagaaaagcaagggaaaggaaggcauccaccgcgugggggucaaaaccgcucgguccuucauuaaguacaauguggacguucuggggaaaaacaucucuagaugccgcaaggccaaacggcuucccgugagauga

SEQ ID NO: 3772 - RNA, 3111 nt, Artificial Sequence
  Cas9 variant
augagaaucuucggcuuugacauugggaucaccagcauuggaugggccuacguggaguccaacgaacugaaggauugcggcguccggaucuucacaaaagcugagaaucccaagaacgggaaaucucucgcccugccucgcagagaagcgcggggagcucgcagacggcuugcccgcagaaaggcccggcugaaugcuauuaaacgccuccuguguaaggaguuuggccuuaacguuagcgacuauuucgccaaugauggggaacugccgaaggcuuacgagacgaccaaagacacaaagucccccuaugagcucagaucucuggcccuggaacagaaacucgagccuaaggaacuggcgcgggugauccuucacaucgccaaacaucgcggauacggcaacaagcacgcuaagaccggcagcgauaaagacuccgggaaggugcugucugccauuaaagucaaugagacagcuaugaaggauaaauaucaaagcgugggagaguaccucuauaaggaauuuuaccagaaacugagacuugaguccgaaaagaagggcaacaauaucaccaaagaguucaagaacguucggaauaaaggggaaaacuacgagcauugcguggcccaggagcagguccgcgcggaacuggagcucauuuuugccaagcaaaaagacuucggagcuacauuuagcgaaaauuucgagucucagaucauugaaaccgccuuuuaucagagagaucugaaguccuucgaggacaaggugggcaaauguguguuuuacgagaacgaaaaucgggcucccaaggauagccugucugccauggaguucguugcccucacgagaaucauuaacacccugaaaaaccuugaagagaaguccaaaaaucuggggaucggagaagucuauggcaaggacaagauccaggagauucucaaaaucgugcuggauaagggcgagaugagcuacaaaaagcugcgcgaaauucugcaccucgacgagcauauccuguucgcuaaagacucuaagcuggauuauacacaaggggugcaggaagcggagaaggccaaauuuauugagcucaagaaccugaaagccuucaagaaagcuaugggaggcgacuuuuccaauuucgcccgggaagaacuugauaagaucgcuaccgacaucacacuggucaaaagcaaggaaaaccucgccaagaaacugcagaauuacuccgcgcuuucuaaggagcagguugaagcucugagcaaccucuccuuugccaaacacauugaucugagccugaaggcccucgagcaaauccugccuuucaugagaggggacaaaaccggaaagugccuucgcuaugaugaggcugugaagaaagccgaacugcaggagcaccggaagcauaaacagaagggcgaauuucucauuccccugaaagacuacgagccuuaccuggcuaauccgguggucgccagagcgcuuucugaauaucgcaaggugcucaacgcccugcugcggaaguacgggaaaguucacaagauccaucucgaguucacgagagaggcuaaacuguccgccaaggaacgccaaaaauaugagaaggaacagaaggagcacuuugaagcuaaucagcgggccauucagcaaugugagauccuuggacugcccaucaacggcacaaauauucucaaaaugaagcuguggcuggagcagggcgaaugcugugcguacagcggggagaaaaucaccagagaacaccuucucgauucuaacgcccuucagguggaccauauuuauccuuacagccgcuccuucgaugacucuuauaugaauaagguccugguguuugcuaaagagaaccaggacaagggaaauaaaacacccuucgaggccuuuggcggggauaaggaaaagugggaccggauccucagccuguccgcuaaacuuccuaagcaaaaacagagacggauuagcaacaccaacuucaaggauaaagagggaggcuuccuggcccgcaaucucaacgacaccggguacaucgccaagcuggcuucucaguggacaaaggauugccuggaauuugaggaccuuagagaaaaugagguuacgauugcgggcgagaaaggauccagcgugcacaucgaagucgugucuggccagcucaccuccaugcugcggcauuacugggggcugggaaacaaggauagaaauaaccaccuccaucacgccgucgacgcugugauccuggccuauacaaauaacgccaugauuaaggcuuucgccaauuuucgcaaaaaccaagaggaaaauaaaaagaaguucuacgcgaaacagaucgcugagagcgaauauaaggccaaaaaggccuuuuucgagcccuguaaaaacuuucggcagagaguugaggaaaagauuaaggagaucuucguguccaaaccgccucgcaagagaguccggggcgcccuucaccaggaaaccuuuuaccccuucgagaaacugugcaaugauaaggaauauucugagaaacucaagauggacuacgggggagagaagggcaugcaaaaagcuauugcgcuggggaagauccgccagaucggcacaaaaauugugagcaacggagcuaugguuagaguggauaucuuuaaggacaaaaagggcaaauucuaugccgucccuauuuacaccauggauuuugcccuggggauccuucccaauaaggcuguggccauuggaaaggacaaagacggcgugaucaaggauuggaucgaaauggacuccaacuacgauuucuguuucucucucuuuaaagacgaucugauucugguucagaagaaagagauggaacgggcugagcucugcuauuucgucagcuuuggguccacgaacgcccaaaucaauguggagaagcauaacaauaaguucgaaggacugagcgagaacgagaaaauucuuuacucuaaugcgacacagaaggagguggccggcaaauccaucgggauucagaaccugaagaccuuugaaaaauaucaggucagcccccucggcgaggugcaaaaggcugaguucgaaccucaccaggagaucaagcugaaaucuuccccgaagcgcaaagacuga

SEQ ID NO: 3773 - RNA, 3111 nt, Artificial Sequence
  Cas9 variant
augcugcacaagaugcauuacagacucgcccuggaccuuggcagcaccucccuggggugggcuaugauccggcucgaugccgacaaccagcccugcgcggugauuaaagcuggaguccgcaucuucucuaauggcagaaacccuaaggaugggagcucccuggccguuacacggcgcgaggccagagcuaugcggcgcagacgggaccgccuucugaaaagaaaggcccggaugaugcgcacgcucauugaauauggauuuuucccggcugaggccgcgcaaagaaaagcccuggaaaccaucaaucccuuugcucugcgggccaagggccucgaugaggcucugaccccugccgaguucgggcgcgcgcuuuuucacauuaaccagagacggggauucaagucuaauagaaaaacagacaagaaagauaacgacagcggcgcccugaagacagcuaucggcaaagugcgcgccaccaucgaggcugaggggugucggacagugggagaauggcuccauaagagagaugucgccggccugaccgugcgcgcccgguaccaccaggacaagguuauuaaagaggaugggaagacgaaaaucgacaaguauuacgaucuuuauauugacagagcuaugaucgaacaggaguuugacgagcuguggaaaaagcaagcggaacucaaucccgcccuguucaccgaggcugcccgcgccgaucugaaagacgugcuccugcaucagcggccucuuaagcccgucaaguccggaagaugcacauuuaugccugaugaagaacgcgcuccgcuggcccuccccucuacccagcgguucagaauguaccaggaagugaacaaucugcgcauucuucgggacggccugaaagaggagccucucacacugaagcaaagagaugaccugaucgcggcucucgaaaagaacagcaagcacuccuuuacccagauuaaaacgcugcuugggguuggaggcgccgugcaguucaauuuugaggaucugaagcggcaggaacucaagggcaacacaaccagcgccauccugucuaaugacaaacacuucgggaaggcuugguucacauuugaugaggccaaacaagacgcuaucguccuucagcuggugaaggaagagaacgaggccaaacucgugcgcuggcugcaggaugaaaccggaauugacgagaagagagcggaagccaucgcuaaugucggccugcccgagggguauggaucccucugugccaaggcucuggcccggauucuuccugaacugagacgcgacguuaugaccuacgauaaagcggugcaagccgcuggcuucgagcaucacagccggcucgggucuaacacagagauccccggacugacguuuaagauugaauccaucgaccaggauagcggcgaggugaaacaguuccauauccacaagguccugccguacuauggcgaauaccuucagagacacgugggguuuggaucuggcgagccugaggaccccgccgaaaaacgcuaugggaagauugcuaacccuaccguucauaucggacucaaucaaauuagacugguggucaacgcccugcucaagcgguacggccaccccuccgaggugaucguugaacuggcccgcgaucuuaaacagagcaaggaccagagagaugaggaauccaaacggcaggcugagaaucaaaagcgcaacaaaagacugcgggacgcgauugccgggacacucaagaucucugaggaacgcgugagacgggaugacauccagaaaaugauucugugggaggaacugagcuucgaucccgcugaccgcagaugcccuuauuccggcgcccagaucagcgccaccaugcuucucucugaugaggucgaaguggagcauauucugccguuuucccagacacuggacgacagccucaauaacaagaccgucgcucugcggcaagccaauagaaucaagggaaaccgcacgcccugggaugcguucggcgcucaggccguggccggguuugacuacgagucuauucuuguucgggcugaaggaaugccuaaagccaagagauaucgcuucgcggagaauggcuaccagcgguggcugaaagaugacgcuagcuuucucgccagagcccugaacgauacacgccacauguccaagguggcuuucgaauaccugaaacuuaucugucccaauacccgggucauuccugggagaaugaccgccaugcuccgcgcuaaguuuggacugaacgacgugcugggccucaauggggagaagaaccggaaugaucauagacaccacgccguugacgcgugcgugaucgccgucacagaucagggccugcuucaacgguucgcuaaagccucugcuagcgcccgcgaacagcagcugaacagacucguggagaacaugccccugccguggggauccuaucgggagcaugugcaacgcgccaucaaugcuauuuggaucagccacaagccugaccauucucacgaaggcgcgaugcacaacgauaccgccuacgggcugagaggagacggcaaaguuuccuuccauaagauggucgagggggugcggacacacagcgaagauaaucuuaaagugauugagaucucuaacgcuaaggccacggacagacauggacuccugcccaauggcgagccucgccccuauaagggguacaaaggcgacuccaacuauuguauugaaaucguccggaaugagaagggaaaaugggaaggcgaggugaucagcaccuuugaagccuaccagcugguuagagagcacgggauugcucgccuccggcauuccacacugucugugagcggaaaacuucuggucaugagacucaugaucgaugacgugguucgccugauuaucgaugagcagacccggacaaugagaauugccacccuguccggcaacgggcagaucuucauggcggacacgucugaagcuaauguggaugcccgcaacagaagcaaagaggaaaccuuugccuaugucuccaagauggcuggaagccuucaaaaggccaaugcgcggcgcaucaacauuucuccuaucggcgagcugagagaccccggguucaaagaauga

SEQ ID NO: 3774 - RNA, 3114 nt, Artificial Sequence
  Cas9 variant
auggagagaaucuucggcuuugacauugggaccacaagcaucggauucuccgugauugauuacucuagcacgcaguccgccggcaacauccaacggcuggggguccgcauuuuucccgaagcuagagacccugauggaaccccgcucaaucagcagcggcgccagaagagaaugaugcggcgccaacugagacggcgcagaauccggcgcaaagcccuuaacgagacacugcacgaagcgggcuuccuccccgcuuaugggucugccgacuggccuguugugauggccgaugagcccuacgaacugagacggcgcggacuugaggagggccugagcgcuuaugaauuuggcagagccaucuaccaucucgcucagcaccggcauuucaaggggagagagcuggaagaguccgacaccccugaucccgacguggaugacgagaaagaagccgcgaaugagcgcgccgcuacacugaaggcccucaaaaacgaacagaccacacugggagcuuggcuugcccggagaccuccgucugaucgcaagcggggcauucacgcgcauagaaaugucguggccgaggaauuugagcgccugugggagguucagagcaaguuccaccccgcucucaaauccgaagagaugcgggccagaaucagcgacaccauuuuugcucaacgcccuguguucuggcggaagaacacgcugggggaaugcagauuuaugcccggagagccucuuugucccaaaggcucuuggcugucccagcagcgccggaugcucgaaaagcugaauaaccuggccaucgccgggggaaaugcuagaccgcucgaugcggaggagcgggacgccauucugagcaaacuucagcaacaggcuucuauguccuggccuggcguccgcagcgcccugaaggcccucuauaagcagagaggcgaacccggggcugagaaaucucugaaguucaaccuugaacugggaggcgaguccaaacuccuggggaaugcccuggaagcgaagcucgcugacauguuuggaccugauuggcccgcccacccccggaaacaagagaucagacaugccgugcacgagcgccugugggcugccgacuacggcgaaaccccugauaagaaacggguuauuauccuuagcgagaaggacagaaaggcucaucgcgaagccgcggccaacuccuucguggcugauuucgggaucacaggagagcaggccgcucagcugcaggcccucaaacugccgaccggcugggagcccuauucuauuccugcgcuuaaucuguuucucgccgaacuggagaagggcgaaagauucggggcucuggucaacggacccgacugggagggcuggcggcgcacaaauuuuccucacagaaaccaacccaccggggaaauccucgauaaacugccgagcccugccuccaaggaggagcgggaacgcauuagccagcuuagaaaccccacgguggugcggacacagaaugagcugcgcaaagucguuaacaaucucaucggacuguacggcaagccugaccggauuagaaucgaaguggggcgcgaugugggcaagucuaaaagagagcgggaagagauccaguccggaauuagacgcaacgagaagcaacggaaaaaggcuaccgaagaccugaucaaaaauggcauugccaaccccagcagagaugacgucgagaaguggauccuuuggaaggaagggcaggagcgcugcccuuacacaggagaccagauuggcuucaaugcccucuuucgggaagggagauaugagguggagcacaucuggccccgcucucggagcuucgauaacuccccgagaaauaaaacccugugucgcaaggacguuaacaucgaaaaaggaaaucggaugccuuuugaggcuuucggccaugaugaagacagauggucugcgauucagauccggcugcaagggauggugagcgccaagggcggaaccggcaugucccccgggaaagucaagcgcuuucucgcuaagacaaugcccgaggauuucgccgccagacagcugaacgacacgcgguacgcugccaaacagauucuugcgcagcugaagcgccucuggccugauaugggaccggaggcucccgugaaaguugaagccgugaccggccaagucacagcccagcugagaaagcuguggacccuuaauaacauccucgcugacgauggggagaaaacacgggccgaccacagacaucacgcgauugaugcucugaccguggccugcacgcauccuggaaugacaaauaagcugagccgcuauuggcagcuccgggacgaucccagagccgaaaaaccugcucugaccccgccuugggacaccauccgcgccgacgcugagaaggccgucucugaaauugugguuucccaccgggugagaaagaaagucagcggcccccuucacaaggagacaaccuacggggauacaggcacggacaucaaaaccaagucuggaacauaucgccaauuugugacccggaaaaagaucgagucccugagcaagggcgaacucgaugagauuagagacccgcgcaucaaagaaauuguugcggcccauguggcugggagaggaggcgauccuaagaaagccuuucccccuuaccccugugucucccccgggggaccugagauccggaaggugcgccugacaucuaaacagcagcugaaccuuauggcucagaccggcaacggguaugccgaccucggcagcaaucaccauauugccaucuacagacugcccgauggaaaggcugacuucgaaaucgugucccuguucgaugcgucucggcgccucgcccaaagaaacccuauuguucagcggacgagagcugacggcgccagcuucgucaugucccuggccgcuggggaggccaucaugauucccgagggaagcaagaaaggcaucuggauugugcagggggugugggcgucuggacaggucgugcuugaacgcgauaccgacgcugaucacuccacaaccacacggcccaugccuaauccgauccugaaggacgacgccaaaaagguuagcaucgaucccauuggcagagugcgcccuucuaacgacuga

SEQ ID NO: 3775 - RNA, 3117 nt, Artificial Sequence
  Cas9 variant
auggccaaacaggugagauaccggcugagccucgaccugggcuccaccucucuugggugggcuaucuuccgccuggaugccgacgcgcaccccacagcuauuaucaaggccggagucagaauuuuuagcgauggccggaacgccaaggacggguccucucucgcuguuacgcgcagagccgcucggagcaugcgcagacggcgcgauagacugcuucggcgcaaaaccagaaugcuggacgcccuccuggaguauggauucuuuccucaagaugcggcccagcggaaggcucuggaacgccucaauccguacgcccugagagcugagggccuugcccggccccugacaccuggggaguucgcgagagccaucuuucaucucaaccagcgccggggauucaaauccaauagaaagaccgacaagaacgauaaugacucuggcgcucugaaaacagccaccagccagcuucgccaagauauucaggcuuccggcugccggacagugggggaauggcuguggacccagagacuccagaagaaacccgaaggagugccucaccaaggcguccgcgcccgguauagagagacgccccauaucaacagcgaggggaagaaacgcaucgaaaagaaguacgaccuguauauugaucggucuaugaucgaggccgaauuugacgcucugugguccgcgcaggccaccuucaauccugugguuuuucacgcuacagcccaugagaaacucaaggacauucugcuuuaccagagaccgcugcgccccgugaaaccuggacgguguacccuccugcccgaggaagagagagccccucuugcucugcccagcacacagcgguuccgcaucuaucaagaacucaacaaucugagacugcucgucgaucagcugaacgagcagccgcuuacccuggcccaacgggacacgauugcgacacucauggaaggcagagcuaagaucucuuuugaucagauucgcaaagcccugaaacuuggguccaugaccaaguucaaucuggaggacgauaagcggaacgagcucaagggaaaugccacaggcagccagcuggcuaaaaaggaauuuuucggcccugccuggcaccaguucgacgaggcucugcaagaugacaucguguggcaccuccugucugaagagaacgaauccgcccuuaucagcuggcugcaggauagaaccgggauugacgcggccaccgcucaggccguuuccaaugcuucucuccccgagggauacggcagccugucccgcaaagcccuggaggugauccuuccuagacuccggagcgaagucauuacauacgauaaggcggugcaggccgcuggguuuucucaucacucccaacugggauucgaguaugaccccgacgauguggaagacuggaucgaucaugccacgggcgaggucaaacccauuuuuaagcgccugccuuacuaugggaaggcucuccagagacacguugccuucggaagcggcaaaccggaagacucucaggagaagcgguacggcaaaaucgccaaccccaccgugcacaucgggcugaaccaggugcgcgucguggcuaaugcgcuuauugccagauauggacggccuacagagaucauuaucgaacuggcucgcgaucucaagcaaagcagagagcagcggcagcaggaccaacgcagacaggccgauaaccagaaacggaaugcccgcauuagaaacuccaucgcucaagcccugggcaucgcggaagcucggguuagacgcgaggacauucagaaguggauccugugggaggaacuugaucccggggacgccaugcaucggugcuguccuuacucuggagugcccauuagcgccuccaugcuccugagcgagcaggucgaaaucgagcacauucugccguuuucuaugacccucgaugacucccugaauaacagaacagugagccuucgccaggcuaaucggaucaagagaaaccgcucuccuugggaugcccgggaagacuucgaggcgcaaggcuggcauuaugacgggauucugcagagagcuggccucaugcccguucagaaacgguaccgcuuugccgccgauggauaccagagauggcugcgggacgaucaagacuuccuggcucgcgcccuuaaugauaccagauaucucucccggaucgcugccgaguaccugagacuggugugcccucagggcacgcgcgucauccccgggcagcucacagcgcugcuucggagacgcuuuggacugaacgacauucucggccuggaaggggagaagaaucggaacgaucacagacaucacgccguggacgcuugugucaucggaauuaccgaucacggccugaugcagcgcuucgcccgggcuagcgcccaagccagagaacaggggcuuacccgccucgcugaggaaaugccucugcccuggccgacauauagagaccauguggaucgggcgguuucccugaucugggugucucacaaaccugaccauggccacgagggagccaugauggaggaaaccgcuuacggccucaugaaggaugggacaauucgccagagacacaaagccgacggaacgaagggccgggaggucgccaaugugauccgcaucgcugaacccgcccaacccaccagacaugggguugacgaucagggacggccucugccguauaagggcuacauugggggcagcaacuauugcaucgagauuacaagaggagcgcagggcaaaugggaagggaccgugaucuccacaucugacgcuuacggaauuguccgcgcccggggcaucgccgggcuuagaaauaccagccagggacaaaacggccacccccuggugaugcgccucgugaucggggauucccugcggcugagaauuaacgacgcccuucagacgaugcggguuaccaagaucagcggcaauggacaggucuuuauggcuggcgugcaugaggcgaacguggaugcucgcaauagagacaaaucucaggccuucgcccuggucuccaagauggcugggagccuccaagccgcucaggcccggcaggcgacaauuucuccuaucggagagauucgcgaucccggcuuuccuggguga

SEQ ID NO: 3776 - RNA, 3120 nt, Artificial Sequence
  Cas9 variant
augaagaaaagaauccugggccucgacauugggaucgccagcgugggaugggcucugauugaguucgaugacgaauuucaggauaacaagaaaaagggcaccaucauuaaauccgggguccggaucuucacacgcgccgagacgcccaaggaaagagagccucuugcgaagccgcggcgcgaagcuagaucucaacggcgcagaaucagcugccggguugagcgccugaauuuugugagagaacucuucgugaaaaacggacuggucgccaaggaauccgugaauaaaaacaaucccaacaauauuuacaucacccuuaaccagauuaagacaccuuggcagcugcggauggaggcccucgaccgcaaacugaccaaugaagaguuugcuguugugcugacacaccucgccaagcauagaggcuauaagucucugcggaaaaccgauagcaaggacaacaaaacaggggagaugcuuaaggcuaucaaucagaacaaagaacgccuggauaauuccgacuacagaacccucggagagauguucuguaagcacgaaucuuauaaagagcauaagcggaacaaggauggcgaauacauuaauagcgucacgagagagcugaucgaggaagaggccgaaaagauuuuugcgaagcaacgcaaagagggcaacaacuucgccgacguggauaucgaacgggaguaucuuaagaucgcuuuuucccagaaacccaccgggagcauuaauaagaugguuggauucugcacauuugagaacggcgaaaagagagccccucgcgacucuuacuccgcugagcuguucaaagugcucaauaccaucaacaauacaaccauuacggauaugaagacaggggaaacccggaacuuuacaggagccgagaucaaaaagauuaucgaaaucauuaaagacaccaagggcaucaccuaugucaagauuaaaaaggagcugaaacuggggagcucucaguucuccggaguggacuacagagagaaugcgaaaagcaaaggcgaaggcgagaucuucgugucuaugaagacauaccacgaaauuaaguccaaaaucgagaagcucagcaaagagaaguggaacaaacugaaggaaaauacggagcuucuggauuccaucgucaacauuaucgccaauuuuaaagacgaugaaucuauuaagaaggaguuccagaaacucaagaucgacgaagauauuaucgacguucugcuuaacuuugaguucaaaaaguuuauuaaucugagcuucaaagcucuccgcaagaucauccccuuucaauuccaggggcagaaguauauuaccgccuccaugagcgugggauacucucugaaacaggagggcaucaagaacaaauuucugcgggugccuucccaagaagagaaugucaacgugccgguuguggcuagagccuucgcccagacacgcaaggucauuaacgcugugauccgggaauaugggcaguuugaucaaauuaauaucgagcucgcgaccgaccugaaaaacagcaaguucgauagaucuaagaucgaaaaaggacagaaggaguuucagagccagaaagacaagguuuuccaagaggugcaggaucuuacaggcgaaauuauccccuccucuagccugcuccugaaauaccgccuuuggcgggagcaggacgaaagauguauuuauuccgggcggaagaucagccgcaaggaccugcucgauaccggauuccuggacauugaucauaucaucccuuacucuaaauccauggacgauggcuuuaauaacaagguccugugccucgccgaggaaaauagaaacaaaaagaaugacauucccuucaacuauuaccagcggaucggcagagauuggaauuuucugauuagcaucauugcuucuaugaaaaacaugaaguacgugaaaaagaagcgccuucugaaacaagagcucuccgacaucgagaucgagagcuucauugagcggaauaucaacgauacgagauaugccacacgcuacauuaagaauuuucuggaaaacaaucuggaguucaaagagaacgaauuuaucaaggccaaaguccaggcuagacacgggggacuuaccuccgugcuccgguauaacuggggcauuucuaagaaucgcgaggaaagcuaccugcaccaugccaaggacgcgaucaccguugcuuguuccacacaggggauggugcaguauauuucuaacaucagccaaaaauacgagaauggaaaguauaaaaugaagcagaucaaagaaagaaccgagaaccggauuccuaagcccugggauuccuucaaggacgaugucgagcgcagcaucaaugacauuuuugugucuuucgccccgagacacaaaguuacaggcuccgcccauaaggaaacgaucuacagcaaaaagcaccuggagaaaggguacgugaccauuaagaagucucucgacaaaaucaagcuguccgaucuuaaaaacaucccuugcgacgaaaauugugauauuauccggguccugaaggagcgccucgaaaaauuuaacgacgauagccugaaggcuuucgccgaccccgugcacaugccuacaaagugcucuaauaaaaagggccccauuaucagaagcgugaaaauuaaggagaacaauaaaaccggaaucgagguucggaagggccuggucgaacgcggggauauggugagaguggacgucuuuaucaaagauaagaaguauuaccuugugcccauuuauguuuccgacuucaaaaacaaggaucucccuaauaaagcuaucgugagcucuaaguccgagaacgaauggauuaugaucgacaaaacauacagcuucaaguuuucccuguucaaggaugaccugauuaaaaucaagaauaaaaagggagagauuuuuggcuaucucgggggaguccaucggcugaccggcgggaucaacaucaaaucuuguuacaagccgaaggaaaaagacggcaacauuggaagcaagugccuucuggauuucagaaaauuucaggugggcauccucggggacuauaaugagguuaagcacgagaaacgcaugcccgccuacauuaacacgaagaaggauaaagaacauuga

SEQ ID NO: 3777 - RNA, 3123 nt, Artificial Sequence
  Cas9 variant
auggacagacgggaugcccgcgcuaugagacggcgcagagaccgguuccagcaacgccagagagcccugcucaaguaccugguggcggauggccuuuuucccgaggacgaaggggagcggaaagcucuggccgcccucgauccuuaugcucugcgcgccagagcucuugacgaagcccugagccuccacgagcugggacgggcgcuguuccaucucaaccagcgcagaggcuuuaaguccaaucggaaagccgaucgcaaggcugacgaugacgccgggaaaaucgcuauuggagucgauagagcccgggaagcgauggccgagaacggcgcuagaaccuacggggaguggcugcaccgccggagagccucugcuacagacgccaaugccaucccgcccguucgcacgcggcuuagaccugaaagcggagaggaugcuaagggcgacggcuaugacuucuaccccgggcgcgaucugcucgaagaggaguuugcggccauuugggaagcucaggccgcccaucacccugacgugcugaccgaugacguguaugagcggcuuuucgaaaucgucuuuuaccaaagaccccugaaggcuccucagauuggaaugugcacacucaucgccggcgaucgccggcugccgaaagcgcauccccuguuccagagacgccggcuccuggaggaacuuaacgcucugaugaucgugagaccuggggagguugcccagcggcucacccgcgaggaaagagacacacuguuucuuaagcugaaagaucggaauaagguguccuucgagucucucagaaaaacccugaagcuggaccccgaugcccgcuuuaacaaggaaagcgagaaucggacagaacucaaaggagacgaggucgcugccgcuaugggcuccaagaccagauucgggaaccgcugggugcaccugucuauugaggaacaaugggccguuaucgagagacuuggagauguggaaagcgacgcggaggacgccgcuuuucgggccuggcuggcugaacgcuaugagcucacgccugagcagaccagagccgucacaaaugcgccccugccgcagggcuacggccgguucggggaaaccgccacacgcaaacuuauugaugcucugagagacggagagaaggauggccgggugcucguguacuccgaagccgucaccgcugccgggcugggacaccauagcgaccgcagaacgggcgagguuuucgaggaugaagaggggcggccucagcugcccuauuacggaguggcccucgaacgccacaucaugccuggcacaggcgaccccucugauuccgacgagaugagaguggggcggcugaccaaccccacaguccauauuggacuuaaucaacugagacgcaucgugaaccggcucauuagagcuuauggcccuccggcggaaaucgccaucgagcuggcucgcgagcugaaacuuaccgaugaagacaagaaacggauuaauaaggagaacaauagcaacagacucgaugccgaacgccggucugagaagcugcuggccaucgggaaacccgacaccggagcuaacagagcccuccugaaacuuugggaggaacugaauccugcgaacguucucgaucgccgguguauuuacuccggcgugcagaucagcauugacaugcuguuuucugcugccgucgagguggaccacauccugcccuucacagccacgcuugaugacuccaaugggaacaagaucguuugcaccagagaagcuaaucgggagaagcgcaaaagaagcccuuaugaagccuggggccacuccgcgcggugggaggaaauugcugcccgcgccgcucagcuccccagaaacaagcgguggagauuugagccggaugccauggagaaguucaaagacgauggaggcuuucaagcucgccaucugaucgacacacaguaccuggcccggcucucuagagaauaucuggcgacccuuuacccugauaagggggagggaagcggccacauuugggugucccccgggcgccugacagaaaugguccggagaaaacucggacugaaugaccugcuuccugaucauaacuucggcgggggcgccgaccaggcuaagaaucgccucgaucaccggcaucacgccaucgacgcuguggucguggccauuguugauagaggaaugcugaaccgcaucgccagagcuagcggccaggagggggcggagggacgggaacgcaucauuauccccgagccuugggaaggcuuuagagacgaccugcggaccgccgugaaugcuauuacggucucucaccgcacagaucaugggaccgccuccaaagccggacuccccaagggcaaggacgcuaccgccgggagacugcacaacgauacagcguacggcuucaccggagagagcgacgcuaaaggcaauucuaucgugguucggagagugccgcuuagcuccuuuaagaaacuggccgauauugaccgcguccgggauccugaacucaaggccgcucuguaucaacaucuggacgggcuugagggaaaagccuucgagaaggcgaucggcgaauuugggucuagagaguggcaccccuacggaggcgugcgccgggugagaguuacagaaccccucagcgucauuccuauccgggaucgcaacgggcacaucuauaagggcuacaaaggagacuccaauuauagauacgaugugugggagcugccgggcgggaagugggugaacgaagucgugagcauguucgacgcucaucagcccggauggcagucugccauucgggccgcuaacccuacggcccgcaaaguucugucccuccacagagacgaugugcuggcuaucgagcggaauggcgccgagcgcgaacuugucagagugguuaaguuuagcgagaaacaguucgcgguggcucccccuaacgaagggggagcccugaaggcccgggacgcugauaaaggcgaccccuucaaguauucuuacccuucccccaauacccucaaggcccugcgcgccagacaaguccggauugaugagcugggcagagugcuugacccgggguuuccugcucgcacaaaacagcggaagaccagaaaacccaacuga

SEQ ID NO: 3778 - RNA, 3132 nt, Artificial Sequence
  Cas9 variant
augcagagagacaacccccugguguaccggcucgcccuggaucuuggcagcaccucccuggggugggcugucuuccgccucgacgccgagggaucuccucuggcgaucauuaaggcuggcgccagaaucuuuagcgaugggcggaauccgaaagacggauccucucuugccguuacacgcagagcugcccgggcuaugcgcagacggcgcgauagacugcucaagcggaaagcccgcaugcugggcgcgcuggaaagacacggguucuuuccccaagacgagagcgcccggaaggugcucgaaacgcugaacccuuuccuucugcgcgcucagggacucgagguggcccugaaacccgaagaguuuggcagagcucuuuuccaucugaaucagcggagaggcuuucaguccaaccgcaagaccgaucggaaggacucugauagcggggcccucaaacaagcgauuggaacacugagagcccagaugcacgaguccggcugccgcaccgucggggaaugguucuggaaggugcggauggagcauaaaccugaaggaguuaagggccagggggugagagcucgcuaucgggagacacccuuuaccacagacgagggcaaaaagagaaucgauaagcgcuacgaccuguaugucgaucgggccaugguggcucaggaguucgacgcccucugggccgcucaagcggccuuuaauccugcucuguucaacgaggccgccagagcugaacuucgcgacauucugcuccaccagcggaaacugagaccgguucagcccggacgguguacccuugugccugaggaaccccgcgcccugcucgcgcugagcucuacgcagagauuucggaucuaccaagaggucaaucaucugagagugcuccacgaugagcugcgcgaagagacccuuacacuggcucagcgggaccagaucguggcccuccuggaaaagcaagccaaagucaccuucacagcuaugagaaaggcccuuggcuucuccgcucuguuuaaccucgaggaugccaaacgcgacgggcugaagggaaaugcgaccgccgcugcccugagcaaaaaggaucucuucggcccucugugggcuggguuuggaacggcccuucaggacgaaauuguuacacagcugaugaccgaggagucugaacccagacucaucgcguggcugcaggagcacacaggcguggaugaagcccgggcucaagccauugcuaacaccgggcugccggagggauauggcucccuuggccgcaccgcccucgccagaaucgugccugaacugcagcgggacgucauuacauacgauaaggcugugcaggcggccggguucgcucaucacagcgaccugggauuuucuuucgagcauggcgccgaugagguugaacgcaucggggagagaacgauugccuccaccggagaaaucaaacccguguuugcuuucaagcagcucccuuauuacggccgggcccugcaacgccacgucgcguuugcuaaagacaaucccagaaacgacgaggagcgguacgggaagaucgccaaucccacagugcacauuggccuuaaccagguucgcguggucgugaaugcccugaugagacgguauggaagaccugcugaagucgugaucgagcucgcccgcgaucugaaacagagccgggaacagaagcuggaggcgcaacagagacaggcugacaaccagaagcgcaacgcccggauuagacgcuccaucgccgaaguucuuggcauuucugaggagcgggugagaacccucgauauccaaaaauggauccugugggaagaacugagccaugacgcugccgaucgccggugcccguacuccgggguccagauuagcgcuucuaugcuccugggagaaagaguggagaucgaacacauucuucccuucuccaugacacuggacgauagccucaauaaccggaccguugcccugcgcgaggcgaauagaaucaagcggaaccgcgccccuugggaggcuagagccgacuuugaagcucagggcuggucuuaugaugggauucugcaacgggccgagagaaugccccuucgcaaacgguacagauucgccccugacggauaugaacgcuggcucggcgaggauaaggacuuucuggcucgggcgcugaaugauacgagauaccucagccgcguggccgcugaauaucugcggcuugucugucccggguccgccacaagagugaucccgggccagaugaccgcccugcuccgcggaaaauucggccugaacgacgugcuggggcuugacggagagaagaauagaaacgaucaucggcaccaugcuguugacgccugcgucaucggcgugaccgaucagcgcaugaugcagagauucgcgcaagcuaaugcccaggcccgggaggacgggcucacacgccugguggaagauaugccucugcccuggccuaccuacagagaccacgucgagcgggcugugcaccauauuuggguuucucacaagcccgaucauggauuugaaggcgccaugauggaggagacaagcuacgggauccucagagacggcuccauuaaacagcgccggaaggcggauggaagcgcuggcagagaaaucucuaaccugauucgcaucgccgagccugggcagccccaacggcacggaguggacgccgaaggcagaccgcuuccuuauaaaggguacgucggaggcuccaauuauuguauugagaucacggugaacgauaaggggaaaugggaaggccagguuaucagcaccuucgacgcuuaccggauugugcgcgagggaggccugagacagcuccggcaccccacacaggggcaaaauggacgcgcccuggcuaugagacuggucaucggcgauucugugcggcuugaggccggggaaggaucccugcagacccuccgcguugcgaagaugagcgccgcuggccagguguuuauguccgaggucaaccaagccaauguggacgcuagaaaccggaacggcgaccugcccuaugugucuaagauggccgggagcuuccagaaagcccgcgcuagacaggucacaauuuccccuaucggagaacuccgggauccgggcuuuaagggguga

SEQ ID NO: 3779 - RNA, 3135 nt, Artificial Sequence
  Cas9 variant
augaaguacacccugggccucgaccugggguauaacagcaucggaugggccauucuugagaaugaugaaaacggcucccccaucaaacuguucaaugcuggggugcacauuuuugagccuucuaucgaagacauugagaucgauggaaagggcaaaacaaagaacgucaaaagacgggaagcccgccucagacggcgccagcuguucagaaagacgaagcggcuugagaaacugcucaacuuuuucauccaagagggguuuuuccagaaucagaagguucugauuaaugacccguuugaacgcgcggaguuccuguaccagcucgauaaaaagagcagaaaccccuauauccugcggcgcgaagcucuugacaauagacugucccucgaggagauugcccggaucuuuuaccauauugcccaacaccgcggauucaaaucuaccaagagagaacuggcugagaugaacaaggaugaaaagaagaaaaaggaggacggcaucauucagagcgaaaucaauacacuuaaagaggagaucaagaaaaacuccugccggacccugggcgaauauuuugccaaacucuucgagaauggggaaaagauucgcggaagacauacagaucggaaaauguacgaggaagaguuucagaagaucuucaacaaacagaaggaguucuauccuaauauuuuuaccgacgaguucaaaaagaagcuguacaaacugaucuuucaccaaagagaacucaagucucagaaagauaaggugggcuucuguagccuggaacgcgggaaaaagcgggcuccccuugcccugcucgugucccagagauaccgcuauaugugcaaggucaacaaccugaaugugauugacacagagaccggagaaaaccgggagcuuacgguugaugagaaaaagaaacuguacgaaaagcucgagaauagcgaaaaacugucuuuuaaggagaucaagaaaauccugaaccucuccgagaagagauauauuuucaaucuggaaaagagcgagaaguacaucauuggcaacaaaaccaaugugaagaugaaaaacaucauuaaggacugggacaauuuugaugaagacaagaaaaacuucuuuaucaaugaggcgcgcacagucgugaagaucgaaacccuugagcggagagggaaaaagcugggacucucugaugaggaauccaaagaguucagcaagguuguguuugaagacggcuaucugaacuucucuaagaaagccgucgagaaacuucugccuuaccucaaagaaggcaagaaagaguaugaggcuauuaagcuggccuaccccgaaaauuccgugcagaacgauaaucugaaggagcucgacuuucugccuccgaucaaaagcaaggaacuuaaaaaguacuucgaggugcgcaaccccauugucgaaaaagcucugacagagacccgguaucucguuaacuuccugaucaagaaguacgggaaaccugagacgauuaagaucgaacuggccagagagcuuaaacucuccaauaagcaaaaagaacgcaagcauaaagagaaccaggagaaucggaagaagagagaagaggugauugaaaaacugaagaacgaucugaaaaucucugagcccacagaaacccagauccaaaaguaucuccuggcggaggagugugacugcaaauguccuuacacaggacggagcauuuccauggauagccuuuuuggcgaacacccccuguucgacaucgagcacauuaucccguuugaucgcucucucgacaauuccuuccugaacaagacccugugcuauagcgaagagaauagaaaggugaaacauaacaagaccccuuacgaagccuauuacgggacagagaaaugggaggcuauuaucgaacgggucaagaaauuuaagucuaaugugagaaacgagaaacuucgccgguuccagaugacgaaagaagacguugagaauuacauccagaacuuuagcacccagaaucucaacgauacaaaguaugccuccaaacuggcuaagaaauaccugggacuccuguauggcucuauuaaugaagacgggaucgauaagaacagaaagcgcagaauuuucgccagcuccggaaaagugaccagcacacuucgguacgcccugggccucaacaccauccugaaugacgagaacauuaagacgcgcgaggaucacagacaucacgcuaucgacgcgaucacaauugcccugaccgauucuuccaugaucaaaaagauuagcgacgcuucuaaacgggaaaagaauaucaacucccuuuuuaaggauuuccaagcccccugggagaauuuucgcaaagaagucgaggagauuaucgccaagaugaacaucagcauuagaaucaauaaaaagguguccggccagauucacgacgaaaccuucuauaaaaagccuuuuaaagaggaagagaagucuuacacacaucagcggaucaaccucgaggaacugaccauuaaggaugaggacaaaaagaaacagagcuccaagcugaucgauaauauuguugacucuaaaauccgcaacaucauuaucaauagccucaacggggaaaagcccaagauuagauucaaagaccccaaggaucacccuuauaucauucaaaagaauggaaagaaaauccagauccauaaggugacaauuaagacgaaacuggagaccuacaacgaaaucggcccggagaaggcuaaacgguacgucaaguccagcgacucucaccauauugaaaucuucgaggaucuuaaaacaaagaagugggacggguauguggucucccugcucgaggccuacgaacgcaaaaagaaaaagcugcccauugugaauaaaaaccugggagagggcaagaaauuucuuuucagccucgcgaagggggaaaucaucgagcuggauaccgaaaacggcaagagagagcuguuuguugugcggauuaucucugcuuccaauaaccagauuaaauucacaagaaucaaugacagccgcaagauuaccgauaucccugccacgggacucaccgccugucccucuagccugaaaaagcggaacugcaaaaaggucgugauuaauauccuuggcgagaagcacuauuccaacgacuga

SEQ ID NO: 3780 - RNA, 3135 nt, Artificial Sequence
  Cas9 variant
auggccgagaagaaauucaaguacagacugggccucgaccuggggaccaacagcaucggauggugcaugcuucggcugaauaaagauaacgaacccgcugccgugauuaaguccggcguccgcaucuuucacgacgggagaaaugagaaaacaaaggaaccucucgcgguugugcggcgcaacgcuagaucuauucggcgcaaucuggauagaaagaucagccggcgcaaccaucuucugaauacgcucgugaaauauuuccugcugccguccaacgagauugaaagaaaggcccucgccguccugaaucccuacgagcuucggucucgcgcugugaacgagagacuggaacucuuugagcugggacggcuucugaugcaccucagcaaacgcagaggcuucaaguccaaucggaaaguugacaaggaagauucuagcgggaagaucaaaccugccaucgagagacugaagaacaaaaugcaggagaccaauaagaaaacagcuggagaauaucuguacucccucaugcaaaacggcaagcccgugcgcgcccggcugggcagaauugacgggagcaauggauaugagaucuaccuugaucgcgcgcugauugaagaggaauauaaccucaucaugaacgagcagaaaaagcaucacaaggagcugaccgacgauauuaucaaugaaauuuuuaacaucaucuucuaccagcggccucuuaaaaagcagauuaucggcaaauguucucugacaggggaggacaccaagcucaaaaaggcccauguccuggcucaagauuuuauucugcuccagaaggugcaggaccugagaguuuucgaugacaaucagcuugaauuucgcccccuguccaacgacgagaaagauaucauuaagcgggaacucagaaagaagaaagaggugagcuacgagaauauccgcaagcugcuuaagaaauauuacgaaaacgucaaguauggaauguucucucacgagacacuguacaaaaagcuccaaggcaauaaaaccaacgcccugauguccgacaaggaaaucauuggggauagcugguauucucuguccccugaggugcaguacgacaucauugaagaacucuauagcgauaaggacaaugaugagcuguccaaacuuuacucugaaaaguuuaaccugaaugagagccagaucaacggacuccugaauaaagcuauuuaccggcuggacuccggcuauaucagauacggcaagacggccgugaccaaccuuaauagcaucauggauaaagacaaccucaaccugcacgaugcgcgcgaagaggccggguaugagaaggaaaauaaacaggacgcuucugaguaccuggaauauuacggaaagguccucccggacuccguuguggauccccaaauugagaacccuaagaaugacgaggagcgguauggcaaaaucgccaaccccacagugcaugcugcccugaaucagcuuagaaagcuggucaacgagcucauuaaacuguacgggaagccugaacagaucgugauugagcuggcccgggaucuuaaaaauagccgcaaggcuaaggacguuaucaacaaaaagauugcggaaaauagaaaacucaacgaggaaguggauaagacccugcaagaguacucugagaaauauaauacacacaucgucaagaacaagcugaaucgggacaaagugaagcucuggagagaacugggaaaagauccccuugagcgcaagugcaucuacaccggcgaacagauuaacaucgccaaacuguucagcgacgagguucagauugaacauaucgugccguauuccaagacgcucgaugacucuuuuaauaacaagacacugagcaugaaacaggcuaacuacuauaaggggaauaaaaccccuuacgaggccuucaaggauuccaaagacggauauaacuacgaugacauuaucgcccgggcuaagcugcuuaauaacgacaauaaauucaagagauuuacaaaggaugccauggacaucuacaaccgcgauggcaaagacuucauugcgagacaacucagcgauacccaguaucugucuacccgggcucugaucuaccuccagucccuguaugagaaggcccaccacagcucuauuuggacaauccccggccagcuuacggcccugauucgcaauuaccucgggcugaacacccugaucuccaaugacaaaaacaagaauagaaacgaucaucggcaccaugcugucgacgccuuuguggucgcugugacaagccgcucccuucuccagaaaaucucuuaugccgcgagccugcaagaagaucuggacaauagaaacguuuccucuuaccggaauaagcuccuggagaagaugccugaacccuuccccaacuaucgcaaaagccuugagcuggccauugauaacaucaagaccucccacaaagcugacagaagcauuucuggaaagcuccaugaggauacagccuacggcaucguggaaaaugacgacaaauacaacgucgugacccgguggacgguugauaaguuuaaggagcagaaacacuucgaaacaauucgcgacaaugagcugaaggaaaucgcuuguuccgauaaagagcuguuugccaagaucguggagaccagaaaaauuaagagcauccggaaacuugcgaaagaaaacccugucauuaagaucaaagacaagucugggagagauuauaaagccuucgcuggaggcaauaacauuugcguggagaucuacgaaguggacgggguucgcaaguccgaggucauucagcuguuugaugccgcucaaaagggcuucaugccggaauggaugaaaaaguaucccaauggaaaacuccugaugcggcucuuuaagggcgacgugaucggguucaucgagaacagaaaauacaauuauuacaccauuaagggaaucagcauugccgaucagaaccugaaacuucuggccaucaauaaggcugagggcauuuuuaagaaagggcucaacauccuguucgacucuaauaacaagaauagccugaacgcgaaacaguucaauaucuccgugacaggaauugucaccaagaaaaagacagccgaugugaacuuuuggaagaaccgcaaauga

SEQ ID NO: 3781 - RNA, 3135 nt, Artificial Sequence
  Cas9 variant
augcugcacaagaugagauaccggcucgcccuggaccuuggcagcaccucccuggggugggcuauggugcgccucaacgccaaucagcaacccugcgcggucaucaaagcuggaguuagaauuuucucuaacggccggaauccuaaggaugggagcucccuggccgugacacgcagagaggcccggucuaugcgcagacggcgcgacagacuucugaaacggaaggcucgcaugaugagaacgcucaucgaauauggauuuuucccggccaacgagacccagcggaaagcucuggaaaaucugaaccccuacgcccuccgcgcgaagggccuggaugaggcccuuacaccuagcgaauuugcuagagcccuguuccauauuaaucagcggagaggguuuaaguccaaccgcaaaaccgacaagaaagauucugacagcggagcucucaagacagccaucaaacagcugcacuccgugcuugauccccaaggcaaugacggcaagccucggaccgucggggagcugcucuauaagagauucacagaucugagcaaacugcccaaggaccgcaccgugcgggcgagauaccgccaggauaaaauuguuaaggacgauggaaaaacgaagaucgacaaauauuacgaccucuauaucgaucgggccaugauugagcaggaauuugacgcucuguggaagaagcagucugagcuuaacccuauccuguucaccgaaaaugccagagcugaucucaaagacgugcugcuuuaccaacgcucccugaagccggucaaacccggccgguguacauuuaugagcgaggaggaaagagccccucucgcccugcccucuacccagcgcuuccggauguaccaggaggugaacaaucugcggauucucagagaagggcugaaggaggaaucccuuacacugcagcaacgcgaugaccucaucaacgcucuggagaaaaauaacagacggaccuuuacgcagauuaagaagcugcugggaguuggcgggagcgugcaguucaacuuugaggauccuaaaagagaggaacucaagggaaauacaaccucugcgauccugggcaaauccgaacauuucggcgaggccugguucgcuuuuaacgaagccaagcaagacgccauuguccugcagcucaucaaagaggagaaugaagcuaagcuggugcgcuggcuucaggaugagacagggaucgacgaaaagcgggccgaggugauugcgaacgcuggacugcccgaaggcuaugggagccucugcaucgaggcccuggcccgcauucugccggagcuuagaagagaugucguuaccuacgacaaagcugugcaggccgcuggauucgaacaccauuccaagcucaaucggaacgaggaaaucccugacauuaccuuuaaaaucgagucuaucgaucgcaauagcggcgagauuaagcaauuccaccuucacaaagaacugcccuauuacggggaguaucuccagagacaugugggauuuggcuccggcaagccugaagacagcaucgagaagcgguacgggaaaauugccaaccccacaguccacaucggacugaaucaggugcgcguuguggucaacgcgcuuauuaagagauauggccaucccucugaaaucaucguggagguugcccgggaucugaaacaguccaaggaccgcagagaugaggaaaauaaacggcaagcugagaaccagaagcgcaaugaaagacuccggaaagacauugccgauauccuggggauuagcgaggaaagagugcgccgggacgauaucgagaagaugauucugugggaggaacuuucuuucgacccugcugauagacgcuguccguacagcggaguccagguguccacggucaugcuccugucugacgagguggaaguugagcacauccugcccuuuagccagacccucgaugacucccugaacaauaagacaguggcccuucggcaagcgaacagaauuaaaggcaaccgcaccccuugggaagccuucgggacaagcaauaucucuggcuuugacuacuccggaauccugacccgggcugagcucaugcccaaggccaaaagauaucgcuucgcugaggauggcuaccagcgguggcugaaggacgaugccggguuucuggccagagcucuuaacgacacgcggcaccucagcaaaauugcgcgcgaauauaugucucugaucugcccuaauacaagagucauucccggacagaugaccgccaugcugcggcgcaacuucggccucaaugaugugcuggggcuuaacggagagaagaauagaaacgaccaucggcaccaugcuguugaugccugugugaucgccgucaccgaccagggccugcuccaaagauuugcugccgcguccgcuagcgcccgcgaacggcagcugaauagacugguggagaacaugccgcuuccuugggaguccuaccgcgaacacgugcggagagccauugaugggaucuggguuucucaucgccccgaccacagccacgagggcgcuaugcauaaugauacagccuauggacuccggggcaacgggagagucuccuuccacaagaugguggaaggaaaacgcgaguacaucgaagacaaucugaaggugauugagaucaccgauacaaaagcgauugacagacauggccugcucccuacggggaagccccggccuuauaaaggauacaagggcgacucuaacuacugcaucgagauuguccgcaaugaaaaggggagaugggagggcgaaaucaucagcaccuucgaugcuuaucagcuggugcggaaauacggaauuguucaacuucgcuaucccgugcuguccgucagcggcaagccgcucgugaugagacugauccggaacgacuuuguuagacuggagcacgaagggauuacacgcacccuucggguguguaaaaugagagaggauggacaggucgcccuggccgacgugacagaggcuaacguugaugcccgcacccggacgaaggaaaucugcuacguguucaaaaccggcgggucucuccagaaggcuaaggccagacggauuacaaucuccccuaucggagagcugcgcgaccccggcuuuaaagaauga

SEQ ID NO: 3782 - RNA, 3138 nt, Artificial Sequence
  Cas9 variant
augcagaaggagaaaccccuggccuacagacucgcucuggaccuuggcagcaccucccuggggugggccgugcuccggcugucugcgccuggagaaccgagcgcugucauccgcgccggcuccagaauuuucucugaugggcggaaccccaaggacggaagcucccuugccguuacacgcagagcugcccgggcuaugcgcagacggcgcgauagacugcucaaacggaaggcccgcaugcuggcggcccuggagagacacggcuuuuucccucaagacgaagcugcccggaaagcucucgagaagcugaaucccuaugggcuucgcgccagaggacuggaaucugcgcucaagccugaggaguuuggccgggcccuguuccaucuuaaccagagacgcggcuuucagagcaaucggaaaacggauagaaaggacuccgauagcggggcucugaaacaggccaucggaacccuccgcgcucaaaugcacgaaucuggcugccggacagugggggagugguucuggaaggugagaauggaacgcaaacccgagggagucaagggccagggggugcgggccagauaccgcgagaccccuuuuacaaccgacgaaggaaagaaacggauugauaagagauaugaccuguacguugaucgcgccaugguggcucaggaguucgacgcgcugugggccgcucaggccacauuugccccggcucucuucaacgaagccgcgcgggcugagcugagagauauccuucugcaucaacggaaacuccgccccguccagccuggcagauguacccuggugcccgaagaaccucgggcccuucuggcccuccccuccacgcagagauuucgcauuuaucaggagguuaaucaucugcgggugcugcacgacgaacucagagaggaagcucugacccuugcccaacgcgaccagaucgucgcucugcucgagagacaggccaaggugacauucaccgcgaugcggaaagcccugggcuuuagcgcucuuuucaaccuggaagaugccaagcgcgacgggcucaaaggaaaugcuacaaccgccgcgcugggcaagaaggaucuguucgggccgcucugggccggauuugacacggcucugcaagaugagaucgugacacagcuuaugaccgaggaaucugagccuagacugauugccuggcuccaggaacacacaggcgucgacgaggcucgggcccaggccaucgcuaacgcggggcugcccgaaggauacggcucccugggccgcaccgcccuugcuagaauuguuccugagcuccaacgggaugugaucaccuaugacaaagccgugcaggccgcuggguucgcccaccauagcgaucugggauuuucuuucgagcacgacgcggaugaagucgagcgcauuggcgaaagaacaaucgcuuccacgggggagauuaagcccguguuugccuucaaacagcugcccuacuacggacgggcccuccagcgccauguugcuuuugccaaggagaauccuagaaacgacgaggagcgguauggcaaaaucgcgaauccgaccgugcacaucgggcugaaccaagucagagugguugugaaugcucuuaugugccgcuacggccggcccacagaagucgugauugagcuggccagagaccucaagcagagccgcgaacagaagcuggaggcccagcaacggcaggcugauaaccagaaaagaaaugcccgcauccggagauccauugcugagguccugggaaucucugaggagcgcgugcggacccuugacauucagaaguggauccucugggaggaacugagccacgaugccgcggacagacgguguccuuauuccggcguucaaaucagcgccucuaugcugcucggggaacgcguggagauugagcauauccugcccuucuccaugacacuugaugacagccugaacaacagaaccgucgcucuccgggaagccaaucgcauuaaaagaaaccggacgccuugggaugcuagaacagacuuugaggcccacggauggucuuacgauggcauccugcagcgcgccgaacggaugccccagagaaagcgccaucgguucgcuccggacggguaugagagauggcugggagaagauaaagacuuucuugcgcgcgcccucaaugauacccgguaccugagcagaguggcugccgaguaucugcgccucguuugcccuggcuccgccaccagagugauucccgggcaaaugacagcucugcuucggggcaaguucggacugaacgacguccucggccuggacggggagaagaaucgcaacgaucacagacaucacgccguggacgcgugugugaucggaguuaccgaucagcggaugaugcagcgcuuugcucaggccaaugcccaagcuagagaagacggccugacacggcuugucgaggauaugccucuccccuggccuacguacagagcccacguggaacgcgcggugcggcauaucugggucucucacaaacccgaccauggguucgagggagcuaugauggaggaaaccagcuacggcauucugagagaugggacaaucaagcagcgccggaaagccgacggcuccgccggaagagagauuagccggcugauccgcauuaccgaaccgucucagccucagagacacggcguggaugcugaggggcggccccuccccuauaagggauacguuggcggguccaacuauugccuggaaaucacagugaaugacaaaggaaagugggagggccaagucauuagcaccuucgaugccuaccgcaucgugagagaagggggccuucggcagcugcgccacucuacgcagggacagaacggccaagcucucgccaugagacugguuaucggggacuccgugcggcuggaagucgaugagcaggaacgcgugaugagaauuguuaagaucaauggaaacaauggccagguguuuauggcgccuguccaugaggccaacguggacgcucggaauagcgacaaaaacgaagccuucgcuuauaccuccaagauugccgggucuuuucagaaaacaaaggccagacaagugaccaucagcccgauuggagagcuucgcgaucccggcuucaaaggcuga

SEQ ID NO: 3783 - RNA, 3138 nt, Artificial Sequence
  Cas9 variant
augaagcccagaaaccugaauuacauccucggccuggaccuugggauugccagcgugggaugguccgucguugagaucgaugaaaacgaguauccuauucggcugaucgacgugggcgugcgcaccuucgaaagagcugaggucccgaaaacaggggaaucucucgcccuggcgcggcgccuugcuagaagcacgcggcgccugauuagacggcgcgccuuuagacuccugaaggccaaacggcugcucaagcaccaucagaucgugaaugcugaggagcugacccaacuucccaaccagugcugggaacugcgcguuaaaggacucgauucccugcuuucuaauacagagugggccgcugugcugcuccaucugcugaagcacagaggcuaccucagccagcggaagaacgaagcccagaaugcggacaaagagcuggggaagcuccgcgagggaauggauaacaauuccaaacugcuccuggaaaacaauuauagaaccccugccgacaucgcugucaagaaauucgccguggaggaaggccacaugcggaaccaaagaggcgcuuacacacauaccuuuaaucgccuugauauucuggccgagaugcagcuccuguucaagacacagcgggaacuggggucuaccuaugcgaacggagagcucgagcaggccuuuugugaacugcuucuguggcaaaagcaggcucucaauagaagccagaugcugucccuuguuggcaaaugcacguucgagaaggaagagaaacgcgccgcuaaggccagcuacucugccgaacgguuuguggcuauccagaaacugcaaaaccuccgcauucuggagaacggggaggaaagaggacuguucgacuccgaguuuagccuccugcuugaaaaugcguauaaccugaagucuggccucaccuacaaacagguccggaagauccugucccugagcgagaaugccauuuucaaggggcuucccuaccucucugaugaccuggaaaaaccugagaagacacaguuucuggcuuucaaauuuuaucaccaacucgccgauauccugaagaacaauggauucuccgacgaguggcagaaacuuagccaggaacccacccugcucgauaagcugggcacagagcugucccuuuguaaggaagagaacgaguucauugcccaguuuaauggcgaacucccugaggcuaugcugucuacccuguucaaccacacgaauuuugacaaauucauccauaucagccucaaggcccugaacaauauucuuccgcugauggaacaagggaacgacuacacaaaagcguggagaaagguguaucccgagccuaccaaaaaggaugaaaagacacuucccccuauccccgcugacgagauucgcaauccggugguccugcggucccugagccaggccagaaaaguuaucaacgccgugauucgccuuuacggaucuccugcucggauccacaucgagaccgccagagaacucggcaaguccuaugaugaccggcagaaaauuaagaaacagcaagauaagaauagcgacgagcgcgaucaggcugugaagaaauuucuggaagagugccccaacuucgccaacaaggucaaagggaaggacauccugaaaauuagacucuacaucaaucaggauggaaagugucuguauucuggcaaaccucuugacccccaucggcugcucgaaauuggguacguggagaucgaucacgcgcugcccuuuagcagaaccugggacgacucccagaacaauaagguucuggugcuugccaacgagaaucaaaacaagggaaaucagacaccuuucgaauggcucggcaaagaugagcaccagugggcucuguuugucgcccgcgugaacggcugccgguucccguacgcuaagaaacagagaauccugacgaagaaacucgacgaacaaggguuucugaagcgcaaucuuaacgauaccagauauguuucugccuaccugaugaagcauauuaaagagaaucuccaccuggugggaaagggcagcgacaaagucuucgcguccaacggacaggugacaaauuuucugcggcgcuguuggggacuugaaaagaaaagagaggagggcgaucggcaucacgcccuggacgcuaucgucguggccugcagcaccgcuucuaugcgccagaagauuacacucuucaagaaauaucaaagauggaaccugaagaccgggaaacauaucgaucaggaaacgggcgagauuaucccccuccacuucccugcccccugggacuuuuuccggcaggaaguuaugauucgcaucuuuuccgagaugccucaggaggaucugaucaugcaacuucccgacagaccgcaggccaaucacgaguucgugcagccucuguuugucagccgggcucccucucgcaagauguccggacagggccaugaagcgaaacucagaagcgcccggaugcuggaagcuacagggaaguccauuaagaaagaguuccugaccgaucuuaccaucaagaaccuggaacacauggugaacaaagagagagagccugaacucuaccaagcccugguugagcauuuuaagaaauauggagacaagcccaaagaaaaguucuuuaagaaaggcgggguggaggucaagucuauucgcaucagcaaaacacagaauaaguccgugaaccucggaaauaaaaccauugccgauaacggcgacaucgugcggacagaccuguuccuuaagaauaagaaauacuauuuuguuaacaucuacgcuuggcaggucucuaaggggauucugccuaaagaaacgaccacaggcaauauccucgauaacagcuacgaguuccaguuuucccuguucaagaaugaccugcuugagauuccccacccgaaaaacgaaaaugauagcauccuggccuauuucauuagaccugacgaugagcgccgguggauccucaaguuucacgacaacgcgaagauccccgauauuuacgggaaaaaggacgaaaccucuaucagacuguccauucaaggccagaaauucaucaagaaauaucagguggaugagcucgggaagaauauucgccccugucggccuacaaagagacaaggagugcgcuga

SEQ ID NO: 3784 - RNA, 3141 nt, Artificial Sequence
  Cas9 variant
augaagaucuacagcuucgacauuggcguggccuccaucgggugggcuuuuauugagaacgaaguccugcaggauugcggaaucagaauuuucaccaaagccgagaaucccaagaacggcgcgucucucgcucugccucggcgcgaagccagagggguucggaaacgccuugccagacggcgcggaagacugaauacaaucaagcaacuccuguguaaagaguuuggccuucagcuggaagacuaucucagcaacgauggggagcugccgaaggcuuacacggccuccaaggcuaauccccugaaaucuccuuaugagcuccggacccuggcccuuagccagaagcuggacuccaaagaucucgugcgcgugauccugcacauugcgaagcauagaggauacggcaacaaacacgccaaggacucuaaggauacagaaagcggcaaagucaagaaagcuaucgaguucaaucggaagacccuugccgaaaaaggguaucgcuccgugggagaguaccuguauagagaguuuuuccagcaaagccggauuucucagaacaauggcgcuacagaauuuguuaacgugcgcaauaagaccgggaacuacgagcauugcgucgcccaggacaugcucaaagaugaacuggagcugaucuucagaaagcagaaggaacucggacugcaccuuuccgacggcuuugagaaacaacugcucgauaagauuuucgagcagcggccccugaaauccuuugcggacaagguggggaaaugucaguucaucgccggagcuaagagagccccuaaggauucuauuuccgcuaucgaauuuguugcccuuagccgcaucauuaauacacuggccaaccucucuaaaaaguccggcgagauguacgacaaagcuauggugcugaccauccuggacagcguccucgaaaagggcgagauguccuauuacgcgcugcgggaagccauuaaucuugaugagaaaaucagauucgcugacucucgccuggauuauagcaaggagauuaaggaaacggagaaagugaaguucguggaaugcaaaaaccucaaguccuuuaaaaagguccuggggaacuguuacaagacccuugagcggaaacauaucgacagcaucgccgaaagaauugccguuaucaaggauguggagaaacugcacaaggagcucgaaucuuauugcgcuacagagcagcugucccugaccagcgaacaaauucaggcccucucucaccugaauuucagcucccauaucucucuuagccugaaagcgcucgagcagauucugcccuuuaugcgcggagagcgggaagcuagauccagcgacgccgauuacuguaucggcaucgacgagucuggggaaucccaaugccugcgcuaugaugagagcguggaaaaggccggacuuaaagcucucucuaaggacacacugaagggccagauucugccuccgcucaacgaguucgagcccuaccuggccaauccugucguggcucgggcccuugcggaauacagaaaaguucugaacgcccuccugaagcaguaugggagcccccacaaaauccauauugaguacgcucgcgaagccaagcugaauaccacggagcggcagaaauaugaaaaggagcaaaaggauaacuacgcugccaaucaggcggcccacaaaaagugucaggagcuuggacucgaaccuagcuccacaaaccugcugaaacucaagcuguggcaggagcaaggcggccuuugccuguauucuggggcuaaaaucaccauuagcuaccuccaggaccccacagcccuucagguggaccacaucuauccguacuccagaucuuuugaugacagcuacaugaauaagugucugguccugaccaaggcuaaccaggaaaaaggaaaucggaccccuuucgaggccuuuggcacagauuccgccaaguggggagugauuacgacccucgcucaaaaacugccccauaagaaacgcagacggauccugaacacagcguucaaugacaaggaagccggauuuaagcucagaaaccugaaugauaccagcuauaucgcucgccuuguugccgacuacacagagaccuaucuggaguuccucucucugguggaauccgagaacacgacacugggcaaagggcagaagggcagcaaaaagcacauugccaucgucaacggagcucuuaccucuaccaugcgguacuaucucggcuuugccuccaaagauagagacaaucaucugcaccaugcgcuggaugcugugauuaucggguucaugaacgacagcgucauuaaggccuuuucugauuucaaaaagacacaggaaaccagcaaggccgcuuacuaugcccacacacucuccaaacaggaguacaagaaacaacgcgcguucauccagcugccuagcggagagaauuuuagagcuaacgugcuugaaaaggccgagucuguuuucguguccaaaccuccccggaagcgcgucagaggcgcccugcacgaagagagcuuuuacucccagaaugacacgaagcuccugaaaucuuaugggggagcugaaggcaucgagaaggcccugcaacuugggaaaauucggcagaucggcaccaagauugugagcaacggagcuaugguucgcguggauaucuucaaacauagaaaguccggcaaguuuuacgggguccccguguauacaauggacuucgcccuggggauucucccgaauaaagcggugguucagggcaaggacaaaaacgaugucaucaaggacuggcuggagauggauucuagcuacgaauuuaucuucucccucuauaaagacgaucugcuucuggugcagaagaaggagauggccgaacccgagcucugcuacuuugugucuuucgacaccagcggggcuuccauuaaagucgccaagcacgauaauaacuuuagcacacugaccgaaaaucaaaaacugcuuuucucuaacgcuacgaaggaggaggugguuggaaaauccaucggcauucagaaucugaagguguuugaaaaguggcaggucagcgugcucggggagguuaaacggacccagucuuauccucgcgaaaacaucucccuggccagcaaggccaaaaaguga

SEQ ID NO: 3785 - RNA, 3144 nt, Artificial Sequence
  Cas9 variant
augaagcugcucagauacauccugggccuugaccuggggauugccagcgugggaugggcuaucgucgagauugaugaaaacgacuuccccauccggcucauugauaucggcguucgcaccuuugacaaagccgagguguccaagacaggggaaucucuggcgcuugcuagacggcuggcccgcagcacgagacggcucauccgcagacgggccuuccgccugcugaaaggaaagagacuccugaaacagcacaaugugauuaacaaggaggcucuuaccacacugccuaccgauugcugggcccuccgggucaagggccuggacgaacgccuuuccccgacagaguggucugcugugcugcuccaucugcugaaacacagaggguaucucagccaacggaagaaugaggccaaauccgcggauaaggaaaugggagcccugcuuucuggcguugcuagcaaccaucagcugcucguggagaaucaguuucgcacccccgccgaaaucgcugucaaaaaguucgcccuggaggagggccacauuagaaaccagcuuggggcguacacacauaccuuuaaucggcuggaccuccuggccgaaaugaagcugcuguuccaaacgcagagagagcugggaaacccucacaccuccggccagcuugaacaggaguuuugugaacugcucauguggcaaaaacccgcucugagcggggaugccauccuuaagaugcugggaaaaugcacauucgagaccaaugaguauaaggcugccaaacacucuuacacagccgaacgcuuuguguggcucaccaagcugaacaaucugcggauucucgagcauggcuccgaaagaguucugaacacggacgagcgcagccuucugcucaaucagccuuaugaaaaagcuaagcugacauacacccaggugcggaagcugcuugggcucucugaggaggcgagauucaacggaguccgcuauggcaaagaaaaggccgaggaugcuacacugaucgaacugaaagccuaccacgccauucggaaggcuguggagaaagccgacaaguccgcgugggaaacccucaagaaucagaccgcucugcuugaugagaucggcacaacguuuagcaucuacaaaaccgacgacgauauuacagagcaacugaacgggaagcucucugacaccgugcugaacgcccugcuugaaaaucucaacuucgauaaauuuauccagcugucccucaagagccucuauaauauugucccccugauggagcagggacuuagauacgacgaagccugucaacagaucuauggcgaucauuucgggaaaaaguccggagagauuaaccgccugcucccuccgauccccgcugacgagauccggaauccuguugugcugagaucucugacacaggcccgcaaggugauuaacgcugucauccggcuuuacggcagccccgcccggauucacaucgaaaccgcgagagagcucgggaaauccuauaaggaucgcaaagaaauugagaagagacaggaacaaaaucgggccgagagagagaaagcuacggcccaguucaagacacuguuuccuaccuucaucggagaacccaagggcaaagacauccugaugaugcgccucuacgagcagcagaacggccaaugccuguauagcgggaagccgcuuaaucugaaccggcuccuggaaaaaggauacguggagauugaucacucucugccuuuuuccagaaccugggacgauagccagaauaacaagguucuugugcucgcuggcgaaaaucagaacaaagggaaucagacacccuucgaguggcugggaaaggacgagcaucaaugggcccuguuugucgcgcgcgugaacggcuguagauucccuuacgccaaaaagcagcggauccucacccagaagcuggacgaacagggguuuauugagcgcaaccuuaaugauacaagauauaucgcucgguuccugguuaacuuugugcgcgaaaaucuccaccugacgggcaaaggaaagaacagagucuucgccucuaauggccaaauuaccgcuuuucugcgggggcgcuggggacuuagcaaagugagagaggaauccgaccggcaucacgcccuggaugccgucgugguugcuugcucuacaguggcgaugcagcagaagaucacccgcuucgucaaauaccaagagggcaaccuccagacagccgagagaauugaccgggaaaccggggagaucaucccccugcauuuucccgauccuuggcacuucuucagacaggaagugaugauucgcaucuuuagcgagaauccgcaggaggaccucauuauccaacugcccgaucggccugaagcuaaccacgaguucguucagccccuuuuuguguccagaaugccuacgcgcaagaugagcggacagggccauauggaaaccauuaagucugccaaacggcuggacgaggggaucuccgucagcaaggugccccucacacagcugaaacugaaggaucuugacaauauggugaacagagaacgcgagaaagcccuguaugaggcucucaaggcccggcugaaugcguucaacgaugacccgaccaaggcuuuugccgaaccuuucuacaaaaagggcggacaacagguuaaagccgucagaguggaacaggugcagaagucuggcgucgugguucgcaaugggaacggaguggcugauaaugccuccaugguccggguggacguuuuuaucaaaggcgggaaguauuuccucgugcccauuuacacauggcaagucgcgaagggaauccugccugacagagcugugguugccgccaaagaugagagcgagugggaacuuauggacaagaccgcucaguuucuguucuccauguuucccaacgaucucauucaggugaaaacgaagaaagagacauucuuuggcuauuacaacgggcuggaccgggccaccggcgcuaucaaucugaaggagccugauucuaacauuaauaaaggaaagagcggccuucaccgcuccaucggggucaagacagcccugucuguggaaaaauaccaaguggacgagcucggaaagaacaucagacccugucggccgagcaaacgccaggcggucagauga

SEQ ID NO: 3786 - RNA, 3147 nt, Artificial Sequence
  Cas9 variant
augaagagacugggccucgacaucgggaccaacagcauuggauggugccugaucgaggaugacggcgaugggaaaggacggauuaucgacauuggcgcccgcaucuucuccgaugggagagaccccaagucuggagcuagccuugccguggaucggcgcgcggcuagagccaugcggcgcagacgggaccgcuaccugggcagacggacagccuuucucaaagcucugaagcgcuucggccuuaugccugccgaugaauccgcugccaaacugcucgcggacagagauccguaugagcugcgggcccgcgcucuggacgaaagacucgagccccacgaaaucgggcgggcccuguuucaucuuaaucagagacgcggauucaagucuaaccggaaggcugagagaaaaacgaaggaugccgaggacggcaaaauugcgaauggggccaaggcucuggaccaagccauggcugaaagcggagccgagacccucggccaguuucuguccucucgcgauacaaaacgggucagaauggggagcgacgcccagggauacgauuucuauccucagcgccggcacguugaauacgaguuugacaccaucugguccagacaacagcagcaucaccccgcccuucugacagaggaagcgcgcaagaagcuccaugauauucuguucuuucagcggccucugaaagagcaagaagugggcguguguaccuucguccacaacgagugcagacuccccaaggcccacccucuguuucaggaacgccggcuuuaugaggaggugaaucagcuggaaaucacaaccccgggcgcucccaacagaaaacucacgauggacgagcgggaugcccugauucuugaacugcgcagcagaaaggagcggucuuucgacucccucgccaaaagacugaagcuggcuccugggcagagcuuuaauaaagccucugaaucccgcacccggcucagaggagaugagguuuacgcggugauggcucauaagaagcgcuucggcgacagauggccccaccuggaucgggaccgccaaugggccaucauuaaaagaaucaucgaggaagaggacccugauaaacuucaugccuuccugacaggggaauggggacucaccgacgagcaggcucuggccacagcucgggcuccccuuccggaacuguauggccgccucgggccuaccgcgacggcccggauucuggaggagcugaagaaggaugucaucacauacgacgaagcugugcggcgcgccggauggcaccacagcgaugacagaaccggcgagauucucccccagcugccuuacuauggcgaacuucugacacgggauaucccucccgggacccaagaccccaacgauccgcccgagcagcgcuggggaaaaauuaccaauccuacaguucauaucggccucagacagcuggagaagcuggugaacgcuaucauuaagguccacgggcggcccgaccagaucgugguggaacuugccagagagcucaaacugaaugaaaaggauaaagaggaacauaaccgccggauuagacgcgacacggcggccgcucaacugcggucugccaagcuccaguccgagggaaucccugauaccggcgcuaauagaaugcugcuucgcauuugggaggaacugaaccccggggagguccucgaccggagauguccguacugcggcgaaccuguuggaaugcgcaugcuguuugccggcgaggccgacaucgaucacaucauucccuauagccggucccuggacgauucugcugggaauaaagugguggcgcauagaagcuguaaccgggccaagggaaaccgcacaccuuacgaaaaguggguccacgaccccgauagaugggacgugaucuccacccagguugcucggcuucacaaaagcaagcaguggcgcuucggcccugaugccauggccagaguggagaaagacgggggauuuauugcucggcaacucacagauacccaguaucugucuagacuggccggccgcuaccucuccagccuguaucccacgaaggacgaugggucugucuacgugaucccgggccggaugacagcgaugcuuagacgccgguggggacugaauagccuccugccugaccauaacuucguugauaaugagcacuccaacgcucccaaaaauagacuggaccaucgccaccacgccauugacgccgcuguggucgccgugaccacccgggcgcuuaugcaggaaaucgcuagaacagccggccgcgccgaggauaaggaccucgauagacuguuugaagaccugccccagccuugggagggguuccgggaggaacucggagagaagcugguccgcgugaccguuucucauaaaccggaucacggcagaaaggggcuucccccuaaaaaccgggacgugacagcuggacgccugcauaaugauacggccuacggccucaccggggacgucgcugccgauggcaagacacccauugugguucacagagugccucugaugagccugaaacccgcggacaucuccgauccugaccggauccccgacccggcccuuagaagcgcucuccaucgcgccaccgauggacugucuggcaaggcuuaugacgccgcccuggcuggguuugcgaaaacacacccucaauucgccggcauucggagaguccgcgugcgggaaccccucaccgugaucccuauugcugauagagacggacggcccuuuaaggccuacaagggggaugccaacucccgcguugacaucuggagaaugccggauggaaaauggcugagcgacgucgugacgauguaugaggcucaccggcgcgaucauucugacagacggccucaccccgccgcgaagaaacuuaugucccugcgccagaaugauaugauugcuguggaaagagacggcgccccucggcagaucauggucgugaagcagaucuggcccacccaaauuaaccucguugagcauaaagagacagggaaucugaaggaucgccacagcaacgaaaccgaccccuucagauuuuucgccccuacagcuggcggacugaagaaaaugaaggccagacaggugagaaucgacccgcuuggccgcauuuuugaucccgggccucgguga

SEQ ID NO: 3787 - RNA, 3147 nt, Artificial Sequence
  Cas9 variant
auggccaacaucgcugagaaucugguguucggcauugaccucgggaucggaagcugcggcugggccguccugaaccagaaggcgaaagaugaaaauauuguugcucuuggguccugguguuuugacgugcccgagaccgauaaggaaagaaucccuacaaaccaaauucggcgcgccaauagacugcuccggcgcgugaucagacggcgcagaaaccggauggccgagauccgcagacuguucgcuucuaaaggaaugcuugacacggccgauccggacgcucuggccaagauuagcgcggaucccugggaaaugcgggccaaaggccucgacuaccagcugaccccucaggaguuugcugucgcccuggggcacaucgcuaagcgcagaggauucaaguccgccgcgaaacgggugucuacaaaugcccccagcgaggauuccaagaugcucgcugcccuggaaaagaccaaggagcagucugcucaauaucgcacaauuggcgaaauguuugccagagacccugccuacgcugaucggagacgcaaccgggacggcugcuucgauagaaccaugagccgcgaggaccuuuuuaaagagacacagauccuguucgaaucccagcggagacucgggaauuuuagcgcgaccucugagacggaacaggccuucauugacaucgcuuuucgccaaaagcccaugcaggauuccgagcggcugguugaaaccugucuuuucgagccugacgagaagagagccagccgcuuugccccgucuuucgaacgguucagacugcucugccgccuggugaaccugcgggucacagauggacucgaggacagaccccugaccccugaagaacuucggcuggcuugugaagaugccggcaaaacacgcaagcucuccgugaaaaagguuagaagccugauugggcuucgggacgaucagagauuuaccacgauucccccugaccaggagcaacaugauaucgcggcucgcacaggagacgcccugaccggcacagccaccuuccgggcuauccucggggagucuuuuuggagacagcugcugccccacccggaacagcucgaucgcgccgcuuggaucauuuccuuccaugagcugaccgacacaaucauuagcaaacuugccacgaucggacugccuuccgaagugauggagcucaucagaaaggcgcuggaagacggcaaauuuucuaaguucaagggcgccgcuagccuuuccgauaaagccgcucggaagcugauucccuuucuccaagaggggcugaccuaugacaaagccugccagaaggcgggauacaaucacgccgcuagcaaauucacacauuaugauucuaucgacaccaaggccaaguuuaacucccugauggaugacguccgcgauagcauuacaaauccuguggcuagaaaagccaucucugagggcaugaaacaggugugggccaugcggaaccagugggggcuccccggagcuauuuguaucgaacuggcgcgcgacgucggcaauagcgccgagaaaagacgggaaaucgaguccgggauuaagaaaaacaccgcucaacgcgagagagaacggcaggaggccaaggaacaccuuaaccagucugauaucagcuccgagacgcugcuccgcuacagacuguggaaggaacagggaggccggugcuguuauacagaccaacccauuaccccuagccagcugaucgccucugauaauuccguucagguggaccacauucuuccguggagcagauucggcgaugacucuuaccucaacaaagcucugugcaccgccaaggcgaaucaggagaaaaagaaccgcacacccugggaguggauccauaaucaaaaagggguggaggcuuggaaccacuuuaccgccgccgucgagucccggaaggaaacaagaggacugaagaaacgcaauuuccuccuuaagagcuccaaagagacggaggaacgguuuagaucucgcaaccugaaugacacccgguacgcugccagagugauggcggaggcuguucgccugcucuauccuagcggcaaccgggccgaaaaagggggagugaagagagucuucacacggcccggcgcccugaccgcugcccugcgccaugcuuggggcguggagucccuuaagaaaauuaaugggaagagacucaacgaugaccggcaccacgcccuggaugcggccguuguggcugccgucucugaaaaggagauccagaaacugacaaagagcuuccagaucugugaacagaaaggacucgcucgcccuaugagagacgugcccaugccgugggagggcuuucggcaucaacuggagaccgccuacgccgauauuagagucgcucgcccugaacggagacgcgcgcgggggaagggacacgacgccacgaucagacagcuucgcgaggaaaaagauggccccgugguuuaugagcggagagcuauuuccgaccugaagcucaccgaucuggagcgcaucaaggacccugaaagaaauagcgccauuaucucuucccugcggacauggaucgagaaagggaagcccgccgauuacccuccccagagcccgaaaggagacgaaauucgcaagaucagagugaugucucggaacaaaccugcugucuccgugcgcggcgggaccgccgauagaggcgagaugacacggguugacguguucaccaagaugggaaagaaaggcaagcccgaaugguuucuuguccccauuuauagacaucaagugaucgaccgcauucaguggccucagccgcccaaucaggcggcugccaacgggaaaagcgagaagaacuggccuacgaugggacucgagcacgaguuccgguuuucucuguaccccagaagcuaugugcaaaucguuaaacgcgauggcgaaaucauugaaggguacuucgccggacuggaccggacagucgcugccuuuucccuccugucuagcuccgauccuaccagcauccagagaggcauuggggcgaagacacuugaguccauccggaaguacaaugugaaccgcuucggcgacauuucuaugguggaacaggagaccagaaccuggcauggagaugucugcaucagccccgaccagccugauuccgcuuga

SEQ ID NO: 3788 - RNA, 3147 nt, Artificial Sequence
  Cas9 variant
augguggagaagauccugggcauugaccucgggaucagcucccugggaugggccgucguugaauacgauaaagacaacgaugagaauaacaagauuaucgacugcggcgugagacuuuucaccgcugccgaaacacccaaagagaaggaaucuccuaauaaagcgcggcgcgaugcuagagggcugcggcgcgugauuaagagacggcgcgucagaaugaacacgaucaagaaucuccugaucaccuauaaacuuauugacaagacacugcucgaugaggagaugggaauguuucacagccaguccaaccggguggacguuuggaaacugcgccaugaugcccuguaccaccuccugucuggcgacgaacuugccagagugcugauccauauugcuaagcaccggggguauaaauuccucggagaugacgagagcgaugaagaguccggcaaggucaagaaagccggcgcugagcugaagaaaaaguuucuugaagccgggugucaaucugugggagaguggcuguggaaagaacgcggccuccaggggaagaaaagaaauaagagcggagacuacgagaucuccauuccgcgggacuuccugguugaagagauccagcgcauuuuugagacccagcaaaaguucggcagcacauuugcgaccucugaacugcagaaagccuauacagauaucgcuuucuacgugaagcccaugcaguccaucgaggacauggucggguauugcaccuuuuacccuaaaauuaagagcaaaaaccaggauggagaaaagagagcccccaaggcuucuccuuccgccgagcaauucgugauccucagcaaaaucuuuucuacgauugugauugacgaaaauaagcaggagaaaaagcugaucgagcuuaaauccaucgaacagcugauucagaucgcgcggagcaaggagacccucaaguacaaacaacugagaaaggaacuuaaccuggccaaagauauuuccuucaagucuaucagcgacgaggaaaagacauggauuaaucucgucggcaacgcuaaguuuaagaaaauccugggccugaauuaugagaccuuccucaagaacacagagaucuccgaugaaauugccaaaauccugaccuacgacaagacguucgagcagaaagaaacaaaacuuaaaaaucugcucguuaacauugauuggaucgacaacaaucauauugcugagcuggccaaacuuagcuuuucucaguucaaccaacugucccucaaggccaucaaaauuaucagcaagaucaugauugagggguaugcucgcuacgaugaagcggugcaguaugccuuugagaauaaccugcugcccaaaccuucucacgaaaagagcauccuccugccgccccuuaaagagaccaauauugcuauccugaacccuacagugauucgggccuucgcccaguuuagacaggucgcuaaugcccucguguccaaguacggaucuuucgacaagguucacuuugaacuggcgcgcgaggugaacaccaaagaggaccggaagagaugggaaaaagaucgcgacaagaaugagaaaaugcaucggcaaaucaccgaaaagcuggucgaggaaggcgugaagcccagcuauaaaaacauccuuaaguccaaacucagaagcgagcagaaggauacauguccuuacugccagaaaaaucugcacuaccccaugauuuucgaggacggguaugcugaaaucgaucauauucugccgcucucucagucccaagacgauagcuacguuaacaaggugcugguccacucugccuguaaucagaacaagaaaaaucgcacgccuuuugagugguuccaggacgaaaagaaagauugggacaccuuuaaguccuauauccuuauggagagcacacugggagaaaagaagcggaacuaccucauuaaagagaacuucuccgauccccagucuagaaaggaguuuaucagccgcaaucugaacgacacccgguauauguccaaggccaucaaaacauacugcgaaaaucacuggaagcugucucaugaugacgacaaacuucgcauucaagugcggagcggcaagcucaccuccacgcugcgccaccagugggggcuggauaacaaaaauagagagacacauacccaccaugcuauggacgccaucaugauugcuuucagcacccagggaauggucaagaagcucucugauuauuucgccaaaaaggaagcgaaaguggagaaggacaaaccuguucugaucacacccauuaagcaguuuaaggaggccguggaacaagcuaccacacuugagcggcaggaauccauccagacgaaagccggcgauaccaucacacugaacagacuccugauuagcagacccccucgggcuucugucaccggcgccgcgcacgagcaaacagccaagccguaccccagaaucaaaccuauuaagaauaaauacaagcgcagacggauccccauugacgaagauaaguucgagcuguuucgcaacgacaaaguggcuuccgggaaugauaagaacuucuauaauagcucuaccaucccuagaguugacauuuacaaaaaggaugacaaauaucacgugguccccaucuaccuuagcgauaugacgaaggccgaggugccgaacaagucccucggaaccaauccugaaggcauggacgagaaauauuuuuguuucagcguguuuaagaacgaccugaucgaacuggagacaaaagcuacccccaagaaaccuucuaagaaacuccugggguacuucaagcagcuuaauggagccaacuuuauucugaacuccauccauaauggcauuaucgauggguucguuugcagccccauuacacucuuuaagcagcagaaagacauguguaagaaaugccugccugaagaucgggccaucggcaacuguucccaagagacccuggaguucugggaagcugagaauaucaagguccccaaaaaggacuuugaaugcgaucagggaauuaaguucgcgaucgccgugcgcaaauauacgauugacccgcuuggcuacuaccacgaggugaagggggaaaaacuccugggaacaaucccucagggcgcuaagaaacaucccaagagacagaaguga

SEQ ID NO: 3789 - RNA, 3150 nt, Artificial Sequence
  Cas9 variant
augaucaacgagagacugaccuucggcauugaccucgggaucggaagcugcggcugggccgugcugcggcacgcugaugccgcgggggaacccggagucauugagggccuuggguccugguguuuugacguuccugaaacaucuaaggagcgcaucccgacgaaucaggugagacggagcaaccgccugcucagacgggugauucgcagacggcgcaauagaauggcugaaauccggcgccuguuccaugcccaaggacuucugcccuccgccgaugaggacgcucucaaaagaccucggcuggaucccugggagcugcgcgccagaggccucgaccagugccugucugcugaagaguuugccgucgcgcuuggccacaucgcccggcauagaggguuccgcagcuccgcuaagcggaaagccgcuaacaccucuggagaagauagcaagaugcuguccgcccuccuggugacaagagagcgcaccgcgcgguacagaacaguuggcgagauguuugcccgcgacccugaauauagcgcucggagacgcaaucgggaugggauuuucgacagaaccguggcccgcgaugaccuuauccacgaggucggaaaacuguuugaagcucagcgggccagaggcucugccuucgcuucccccgaucucgaggcggacuuuaacgccauugcuuuccggcaggccgaaaugcaagacagcgagcgccugguggggaauuguccuuuugagagagaugaaaagcgggccgcuagaugggccccgucuuucgagcgcuuucggcugcucacaagacugaucaaccuucgcauugcgaccgcugaaggagagagacgguucacgcccgaagaccuggcccgcguuuccgccgagcucggcgcuaccgccaagcugccugugagcagaguccgggcucuuaucggccugcuccccgaugagcgcuucacaaccauuagaguggaagacgaggaucgggacaucguggcccgcacaggggaagcggccccuggaaccuggagacugcggaaaacgcugggcgaggcucucugggccgaaaugcaggcucgccccgaucagcuggacgccaucgcgcauguccuuagcuuuuucgaggccacagcuaagauuagauccgagcuggaucggcucgggcugccggccgcuguuaucgaagcccuugacagaggacuggaggauggcgccuuugcuaaauucaagggggcgggacacauuagcgccaaagcgugccgcaaucuccugccucaucugcagcaaggccaccgguacgaccaggccuguagacucgccggcuaugaccacgcugccuccacccugucucauacagcucagguggugagcaaggcuggguuuaacgcccuugucaccgaacugggagaguccaucgccaaucccauugcucgcaaggcccucaccgagggccugaaacagauccgggcgaugugcgcuagaugggggcugccuggagccauccacauugaacuugcccgcgaggugggcaacagcaucgaaaagcggagagagcucgaaucucaacgcgagacaacgaccaaacggagacagacagagcgggaugaaauucgcgggcugcuggcucucgaggacguugaugacgauacccugcuuagauaccggcuguggaaggaacagggcggaaaaugucucuauacaggcaaggacauccacgugcgccaacugauugccaccgauaauuccguccagguggaccauauccugcccuggagcagauucggggaugacucuuuuaacaauaaaacgcuuugccucgcuagcgccaaccagcggaagagaggacagacacccugggagugguucucccugaccggcaccccugaagcgugggagguuuuugccucucgcguggagacaagcaaggaucugcggggguucaaaaagagaaaccuccugcuuaaaaaugcugacgaagucgcccaacgcuuucgguccagaaaccugaaugauacccgcuacgcugcccggcuccuggccgaggcugcgaagcuguucuauccggccggagacagacaggaaaaagacggccgcagacgggugcuuacacgccccgggccucucacggcugcccugagacacgccuggggccuggagagccucaagaaggcugauggaaaacgggucucugacgaucgccaucacgcccuggacgcgcuugcuguggccgccaucuccgaaagagagguucagcggcugaccagaucuuuucaggagugggaacaacagggccucgcucgcccccugcggcauguggccccucccuggccgggguucagaggagauguccuggcggcuuacgcccaggccuucguggcucgcccugagcggagacgggcccgcggcaaggggcacgacgcuucuauuagacagguugugggagaaggccccgaggcccaagucuuugagcggcgcgggcuugcggaucucaaagaagccgaccuggauagagugaaggacccugagcggaaccaggcuaucauugaagccgugcgcgcuuggauccuggccggcagacccgccgaugcuccuccccgguccccgcgcggagacguuauugucaaacucagaacagcgccugccaagaagaucaaacccgcugugcccgugcggggcgggaccgccgauagaggagacaugguccgcauugacguguucacacggccuaauagaaagggccgcgaugagugguaccugguuccgaucuauccccaccaggugaugaaccggaaagccuggccucaucccccuaugagaagcgucguggcuuacaaggacgaagccggguggaccgagaucggagcggagcacuccuuucgcuucucucuuuauccccggagcuacguucagcuggugaaauccaauggcgaugucauugaaggguaucucgugucuauggacagaagcacgggcgcuuuucgcguuuucgugcauaacaauccugccgagauggccaagggaaucggcgcuaagacccugcugaaccuucggaaauuuaaugucgauagauucggggugcgcacagaagugaaguccgagguccggaccuggcacggagaaguuuguacaagccccgugccgccugacuga

SEQ ID NO: 3790 - RNA, 3150 nt, Artificial Sequence
  Cas9 variant
augcagcugagcaagcucaacuacauccugggccuugaccuggggauugccuccgugggauggucugucaucgagauugaugaaaccgagaugcccaucagacucauugacguuggcgugcggacauucgaacgcgcugaggugccuaaaacgggggaaagccuggcccuugcgagacggcuggcucgcuccaccagacggcucauccgcagacgggccuuucgccugcugaaggccaaaagacuccugaagaaucaccaaaucgucucugcugaugagcuuagcacacugccgaaccauugcugggagcuccgggugaaaggacuggacgaacgccuuaccugucaggagugggccgcuguucugcuccaccuucugaagcauagaggcuaucucucccagcggaagucugaagcccagaaugcggauaaagagaugggggcccugcuuagcggaguggcuaacaaucacaagcugcucuccgagaaccauuaccgcacacccgccgaaauugcugucaaaaaguucgcccuggaggaaggccacaugagaaaucaacggggcgcguauacccacacauuuaacagacuugaccugcucgccgagaugcgccugcuguuccagacccagcgggaacucgggagcccuuacgcuucuggagagcuggagcaggaauuuugcaaacuucugauguggcaaaagcccgcccucuccggcgaugcuauccugaagaugcuugggaaauguacgcuggagccuaccgaauauaaggccgccaaaaauacauacaccgcugagagauucguguggcucacaaagcugaacaaucugcgcauucucgaaaacggaagcgagcgggcgcugaaugccgacgagagagcucugcugcucaaccagcccuaugaaaaagccaaguuuaccuacgagcaggcccgcaaacugcugcagcuuaaugaagcugcccgguucaacucuguuagauacggcaaggagaacgcggaaaaguccacgcucauggagaugaaggcuuaucaugccauccgcaaagccguggagacagcugauagcucugccugggcuacccugaaaacacaaccucugcuccuggacgaaauugggaccgccuuuuccaucuacaagaccgaugaggacauuaaaacacagcuucagggaaagcuggcggauaaugucaucgacgugcuccuggaaaaccugaauuucgacaaguuuauccaacuuagccucaaagcccuguauaagauucugccgcucauggagcagggccugcgguacgaugaggcuugcucccagaucuauggcgaccacuucgggaaaaaggaacagaaaaacgauagacuucugccccaaauuccugccgacgagauccgcaaucccgugguccuccggacgcugucucaggcuagaaagguuauuaacgccgugauccggcuguacggaagcccugcgcgcauccauauugaaaccgccagagagcuuggcaaguccuauaaagaucggaaggaaaucgagaaaagacaggagcagaaucgcgcugaacgggagaaggccguggacaaauuuaaggaacucuuccccaacuucauuggggagccgaaggcuaaagauauccugacaaugagacuguacgaacaacagaauggacagugucucuacagcggcaagucucuggaccuucaccgccugcucgagaaaggguaugucgagauugaucacgcccugccuuuuuccagaaccugggacgauagcuucaacaauaaggugcugguucuugccggagaaaaccagaauaaaucuaaccaaacacccuuugaguggcucggcaaggacgaacagaaaugggcucuguucaccgcgcgggugaauagcugccgcuuuccuuacuccaagaagcagagaauccugacgaaaaagcucgacgaugagggcuucauccagcggaaccugaacgacacacgcuauauugccagauuucuugucaauuucgugaacgauaaucugcaucucaccgggaaaggaaagcggcgcguuuuugcuucuaacggccaaaucaccgccuuccugagagggcgguggggacugacaaaagugcgcgaagagagcgacagacaccaugcccuugaugcugucguggucgccuguuccaccgugagcauucagcagaagaucacacgguuuguuaaguaccaagagggcaaucugcagacggcggaaagaauugaccgcgagaccggggaaaucauuccccuccacuuccccgauccuugggccuuuuuccgggaggaggugaugaucagaaucuucucugaaaugccgcaggaggaccuggucauuaaacuccccgaucgcccucaggcuaaccaugaauuugugcaaccccuguucguuucccggaugccuacaagaaagaugagcggccagggacacauggagaccaucaaaucugccaagcgccuugacgaaggcauuuccgugagcaaagucccccugacacagcucaagcugaaggaucuggagaauauggugaaccgggacagagagaucgcucuuuaugaagcccugaaagcgcgccucaccgaguuuaaggaugacccggcuaaagccuucgccgaaccuuuuuacaagaaagggggagugcagguuaaguccguccggguggagcaagugcagaagucuggcgucgugguuagaaaugggaacggaguggcugacaaugccagcaugguccggguggauguuuucauuaaaggcgggaaguauuuucuggugcccaucuacacguggcaggucgcuaaaggcauccucccugaccgcgccgugauugcguacacccccgaaaacgagugggagcugauggaugacuccgcccaguuccaauuuucuaucuauccuaaugaucuuauuaagcugacaaccaaaaaggcuaucuucuuuggauacuauagcggcuucaacagacucacaggggccauuaauaucaaagaacacgaccugcagaucuccaagggagauaagggcguucaucuggggcuuggagugaaacuggcucucagccuggagaaguaccaggucgacgaacucggcaaaaacauucggcccugccgcccgacccaaagacagaacgugcgguga

SEQ ID NO: 3791 - RNA, 3153 nt, Artificial Sequence
  Cas9 variant
augagcuccuacagauucucuuuugaccugggcaccaacagcaucgggugggccguguucgagcucgaucccaagacacggccugucgcucuggccgacugcggaguucgcauuuuuccggauggcagaaaucccaaagacaagcagucccuugcgguggcucggcgcgaagccagagccgugcggcgcagacgggaucgcuaucugaaaagacggucugagcucauggaacgccuggucgcuaaggggcuuaugccugagagcagagacgaucaaaaagcccuggaaggacucgaccccuacgcucugcgggccgcgggccuggaugacgcccucccuccccaccauuucgggcgcgcucuguuucaccuuaaccagagacggggauucaaguccaauagaaagacggaucgcggcgagaacucugagaccggcaucacaaaaauugggaugaagaaacugcaugaagcccuccugagcgagggaugucggacccuuggcgaacugcagcacagacaucacgaggcuaaucagaccccugccauggacaccaacccgaaguccgugcgcagcaaacuccggggagagggagcgaaggccguuuaugauuuuuaccccucuagagacgcuguggaagacgaguucaauaagcugugggauucccaaaaacgcuuucacccugaccugcucacagauagcgcccgggacgcuaucagagaugccauuuucuaucagcgcaagcugaaaacccccgacgccggccggugcucuuuuaacccugcugaagagagagucgcgcgcgccaugcccaucgcucagcauuuccggauccuucaguuugugggggaucugagacucauugacaaugaucugguucggcacccgcuuaacaaugaccaaaagaaagcccuguaccgcgaucuccuggccaagggaaaacugacguucaaggcuaugagaaagaccaucggcauuggcuccgaauaugccuucagccaugagucugagaaacaguccgaauuuagaggggacgagacagcggcucggcucgccggaccuaaguacuucggccccaaauggcgcgaacugagcuuuaacgaccaguccgagaucguggaucggcuucugcacgaagagaaugaggaaacccucauucaguaccugcaagacagauucggguuugaucacgaccgcugugaggucaucgccgaugcuccucuucccgacggacauacaagacugggcaagaccgcccucgaaacgcugguggagauuaugcgggaugaccaccuucccuaugaucaggcuugcacaaaagccggguacgaacaugcgcucccuccggacggagugauccuggaugaccuucccuauuacggcaucgcccuggagcgccacgucgcuuucggcgaugggaagucugagaacccugaaaagagauauggaaaaauugccaaucccaccguucauaucgcucucaaccagcugcggaaggugauuaacgcccugaucgcgcgcuacggccacccugaccaaguggucauggagauugccagagaccuuaaacagagcaaggcuaaacgggaugacaucuccaaggaacagaagaaaaaucaggaucgcaacgaccaaagacggaagaaacuccaggaggcccacaucgcugugaaugccgagaacaugcugcgcaugagacugugggaggaacucgaugaagacaaugccgcugcgcgggccugucccuuuacaggggagaccauuagcauggcuagacuguucucuccggaaguugagaucgagcauauucuuccuuuuucccgcagccuggauaacucucccgccaauaagacccucugcauggugugggccaaccgggcuaaaggaaauagaacaccuugggaagccuucggccgcgaccgggagcccggguuugauuggccugaaaucgcggcuagagccgcccgccugcccaagaacaagagcuggcgguucggcccggacgcuauggagagacuggaacgcgagggagauuuucuugaccggcagcucacggauacccaguaucuguccagaauugcccgggaguacgucacaaaaaucugugacccuaaucaaguguggguuacccccggccgccugacagcguggcucagacggaacugggggcugaauggaauccuucccaccggcaacgcuacgaagaaucgcgacgaucacagacaucacgccauugacgccaucguggucgggcugacagaucgggggauucucaacagagugucucgcagcgcugcccuggcugaagccgaggaccuggaucgguccaucgcggaaaugccugacccguucgauggcuucagagacaacauucgccacauccuugagcagauuaucgucagccauaaacccgaugccggguuugugccuggccaccccaagggaaauaccaccccuggcgcucuccauaacgacacagccuacgggaucauuaaaaccgaugcuaagggaaugucugaaguugugacacggaaagacguccuguccuucaagggcacgaaggagaucgagagcauuagagacgccgccacccgccagucucugcucgaugcuguggcggggguucccuccggacuggccuuuaaagaagcucugcgggacuggagcgugagaacaggcaccaagcgcgucagagugacauucaauauguccgugaucccuauucaggaucgggacgggaaagccuauaagggcuacaaaggagauggcaaccugugcgccgagaucuaugaacgccccgacgggaaguggggagaugagaucauuucuagauuugacgcuguucaaccgggcuucaccccucaguggcagcgggaucaccccgccgcgcaucgcgucaugagacucuuucgggacgauaugaucauggcugagauugacggggugaugacgguguguagaaucgucaagaugagcccuggaaaagugguuuucacaccccaccacgaagccaauacagauucccgcaaccgggacaaggacgauccguuuucuuuccauaccugcagcggcgagucccugagaaaacgcaaggcccagaaacuguuuguggacccucuugggaagauucggggcuacagagcuaaggaaggauga

SEQ ID NO: 3792 - RNA, 3153 nt, Artificial Sequence
  Cas9 variant
augggcgagaacaugaucgacgaaagccugaccuucgggauugaucucggaaucggcuccugcgggugggccgugcugagacggcccucugcuuuuggacgcaagggcgucauugaggggaugggaagcugguguuucgacguuccugaaacauccaaagagagaacgccgaccaaucagauccggcgcucuaacagacuucugcggcgcgugauuagacggcgcagaaaucggauggccgcgauccgcagacuccugcacgcugccggccuucugcccagcacagauuccgacgcccucaagcggccuggccaugaucccugggaacugcgcgcuagagggcuggacaaaccucucaagcccguggaguuugccgucgugcugggacacaucgcuaaacggagaggcuucaagucugccgcgaagcgcaaagccaccaacauuagcuccgaugacaagaaaaugcuuacagcucuggaggccacccgggaaagacucgggcgcuaccggacaguuggagagauguuugcuagagauccugacuucgccagccgccggagaaaucgcgaaggcaaguaugaucggaccacggcgagagacgaucuggagcaugaggugcacgcccuuuuugcugcccaacgccggcuggggcagggauucgcuucuccggaacucgaggaagccuuuaccgccuccgcuuuccaucagagacccaugcaggacagcgagcggcuggucggcuuuugcccuuucgaacgcacagagaaaagagcggccaagcugacccccucuuuugagcgguucagacuccuggcucgccuucugaaccuccggaucacaaccccugacggcgaaagaccccugacgguggaugagauugcccuuguuacacgcgaccuggggaagaccgccaaacucuccaucaagagagugcggacacugauuggacuggaagauaaucaacgcuucaccaccaucagaccggaggacgaagaucgggacauugucgcucgcacaggcggggccaugacgggaaccgcgacacucagaaaagcucugggcgaggcccuuuggaccgauaugcaggagcggccugaacagcuggacgccaucguccaggugcucagcuuuuucgaggcuaacgaaacaaucaccgagaagcugcgcgaaauugggcuuacgcuggccgugcucgauguucugcugacagcucucgacgccggaguguuugcgaaauucaagggcgccgcucacaucucuaccaaagccgcuagaaaucugcuuccccaccuggagcaaggccggcgcuacgaugaggccuguaccauggcgggguaugaccaugccgcuuccagacucagccaccauggacagauuguggccaagacacaguuuaacgcucuggucaccgaaaucggcgaguccauugccaauccuaucgcccggaaggcucugaucgaagggcuuaaacagauuugggcgaugagaaaccacuggggacuccccggcucuauccacguggagcuggcccgcgacguugggaauagcauugagaagcggagagaaaucgagaaacauauugaaaagaacacagcucugcgcgcccgggagagacgcgaagugcacgaucuccuggaccuugaggaugucaauggcgacacgcugcuccgguacagacuguggaaagagcaaggaggcaagugccuguauaccgggaaggccauccauauccgccagauugcugccacagauaacuccgugcagguugaccacauccuucccuggagccgguucggagaugacucuuuuaacaauaaaacccucugucuggcguccgcuaaccaacagaagaaaagaagcacaccuuacgaauggcugucuggccagaccggggaugccuggaaugccuucgugcagcggauugagacgaacaaggaacuccgcggauuuaaaaagagaaauuaucugcuuaagaacgcuaaagaggccgaagagaaguuccggagccgcaaucugaacgacaccagauacgcggcucggcucuuugccgaggccgucaaacugcuguacgcuuucggcgaaagacaagagaaagggggcaaucgccggguguuuacaagaccgggagcccuuaccgcugcccuccgccaggcguggggcgucgaaucccugaagaagcaggaugggaagcggaucaacgacgauagacaucacgcccuggacgcucucacaguggccgcuguugacgaggccgaaauucagcgccugaccaaaucuuuccacgagugggagcaacagggacuuggccggccccugagacgcguggaaccucccugggagagcuucagagccgaugucgaagcuacguauccugagguguuuguugcgcggcccgagcgcagacgggcccgcggggaaggacaugcugccacaaucagacaggugaaggagcgggaaugcaccccgauugucuucgagagaaaagccguguccagccucaaggaagcugaccuggagcgcaucaaagauggcgagcggaaugaagccaucguggaggcgauuagaucuuggaucgcuacagggcgcccugccgacgcucccccucggucccccagaggcgauauuaucaccaagauucggcuggccaccacaaucaaagccgcgguuccuguccgcggaggcacggcugggagaggagaaauggugcgggccgacguguuuagcaagcccaaccgcagaggcaaggaugagugguaccuugucccgguguauccucaccagaucaugaaucggaaagccuggcccaagcccccuaugcgcucuauuguugcuaacaaagacgaagaugaguggaccgagguggggccggaacaucaauucagauuuucccucuacccccggagcaauaucgagauuauccgcccuuccggagaagucauugagggcuauuucguggggcugcacagaaacacaggcgcccugaccaucucugcucacaacgaccccaagagcauccauuccggaauuggcacaaaaacccuccuggccaucucuaaguaccagguugaucgguuugggagaaagagcccugugcgcaaagaaguccggacguggcacggagaggcguguauuucccccacaccucccggcuga

SEQ ID NO: 3793 - RNA, 3153 nt, Artificial Sequence
  Cas9 variant
augaagauccugggcuucgacauugggaucgccagcauuggaugggcuuuuguggagaacggcgaacucaaagauugcggggucagaaucuucaccaaggccgagaaucccaaaacaggagacucccuggcgaugccucggcgcgaagcuagaucuguucggcgcagacuugcccggcgcaagggcagacuggagacgcucaaacggcugcuugccaaggaaugggaucuguguuacgaggacuauauugcugccgauggggagcucccgaaggcuuuuaugggaaagaaccugaauaaccccuacgugcugcgcuaugaagcccuccagagacugcuuagcaaggaggaacuggugcgggucgugcuccacaucgcgaaacaucgcggcuacggcaauaagaacgccaaaaucaccaaguccgaggagucuaagagagaacaagggaaaauucugagcgcucuugccacaaaugcuuccgccaucgcgcgguaucgcaccguuggagaguacuucuauaaggaauuuugcgaggugauuaaaaacccucagggccugucuacaaaugaacacuacacccagagcaaggucagagugcucaaacccauccggaacaaagggggagaguacacaaauuguauucugcaggaggaccugcaaagagaacuccgcugcaucuucgaguaucagaaaggcuuuggguucccuauuacccaggaauuucaggauaagauccugaagaucgccuucuaccaacggccccuuaaagacuuuucccaucugguuggaaaguguacguucuauccugaugaguuuagagcucucaaaugcagccugucugccguggaguucauuacccuuuccaagacaaucaacguccugaccuacauuagcaaagaaucuggcgagguguauuccaagggccaguacgaacagaugcucgacagcguguucaaggcugucugugagaaagggucucuguccuuugcccagcugcgcaagauccuccacauugaugaacggaucagauucaaagagguugacuauauggcccgcaagagcaaaaauacauccggagauucuacccauaagcaaaagacgagcaacccggaaacgaaaaaguuuaucgagcacaaaaaucugaagaaauucugcgagauucuuuccgaaaucgcugaggaccgggcgcuggccgacagcauugcuagagauaugacccucaucaaggacgaagagaagcuggcccagaaacuucacggcuacgggaaguuuucucaggagcaaauuacacagcuguccgcccucaacuucagccaucacaucaaccugucucugaaagcucucagcgaaauccugcccuuuaugcgcgagggaaugcgguacgaugaagccuguaaacuugcgggccugaaagcuagacauaaugacaagaaauccaaguuccucccucccuuuugcgagucuauuuaugccgaugaacugaccaacccuguggugcaccgcgccaucgcugaguaccggaagauucugaaugcccuuaucgcuaaauaugggagcguccacaagauucauaucgagcucaccagagacgugggaaagaacuuccaggaacgggagaaguacaaaaaggaaauugaguccaauuauaaggcccgcguucaggcgaugcaagaaugugagaaacugggccugacacucagcgagggcaacauccugaaacuuagacuguuucgggaacagaaugagaucugcguguacucugggagaaagauuacgcucgccaaccugaaggaacagggagcucuggagaucgaucacauucuucccuauucccgcagcucugacgauuccuacaugaauaaaguccucguguucaccaacgaaaaucagaacaagggcaauaagacaccguacgaggccuuugggggagacagccaaaaauggggcgagaucgaaucccuggcucugcggucuggguauccuaagaaaaaggccaaacgcauucucgauaagggcuucggagacagagaggcgggcuucaagagcagaaacaucguugacuccggguacaucgcccggcugauugcuaauuauaccaaagaauaccuuaaguuucugccccucgauucucaugagaacacagcccugaucgcuggagagaaagacagcaagauucacguggaagccgucaaaggcaugcugaccgccacgaugcgccauuucugggggcuuggauccaagaacagauaugagcacacacaccaugcuguggaugcgaucauuaucgccuacaucaaugcugccaugauucagcgguuuagccaguuccgccagaaccaagaaucucucaaagccagauuuuaugcuaaggagcuggccaaggaagaguucaaaacccagcgggcguuuuucgagccuuuucgcggcuucagagaacagguccuggcuaagguggggcagaucuuuguuucccggccuccccgcaaaagagcccggggcgcccuccacgaggaaaccuucuacagcauugacgauaagaaacugucugagacauacggaggcaaggaaggggugcaaagagcucuuucccugggaaagauccgccagauuggcaccaaaaucgucgccaaugggcccauggugcggguugacaucuuuaagcauaaacagagcagacgcuucuaugcggugccgauuuacacaauggauuucgcucucggaauccugcccaacaaggccgucgugucuggcaaagacacaaagagcaaggugauuaaagauuggcuggagauggacuccugcuaugaguuuuguuucagccuuuuuaaggaugaccucaucgaaguucaaaaaucugauauggagaagccugaacuggccuacuucgucucccuggacgcuagcgacgggcggauuaaagugagacaccacugcaaugauaucaccaagauuaacgagaaucagaagaaacucuuuuccgaagccaucgagaaggagguggucggccgcggaucuauccagaaccugaaaguguucaagaaauauaagguuagcccccuuggcgaaauuaaggaggcuaaauacgaaccucggcagcccaucgcccugaagacauccccgaaaaagcauagaaaacaaaauaacgcgcaguga

SEQ ID NO: 3794 - RNA, 3156 nt, Artificial Sequence
  Cas9 variant
augaacaauuacauccugggccucgacauugggaucaccagcgugggauauggcauugucgauuccgacacaagagagaucaaggaugccgggguucggcuguuccccgaagcuaacguggacaauaacgagggacgcagaucuaaacggggcgcccgcagacuuaagcggcgccggauucacagacuggaucgcgugaaacaucuccuggcggaauacgaccuucuggaucucacgaauaucccuaagagcaccaacccguaucagacaagagucaaagggcugaaugagaagcuguccaaggacgaacucgugaucgcucugcuucacauugccaaacggcgcggaauccauaacguuaaugugaugauggaugacaacgauucuggcaaugagcugagcaccaaggaccaacucaaaaagaacgccaaagcucuguccgauaaguacgucugcgagcuucagcuggaaagauuugagcaggacuauaaggugcggggcgagaaaaaucgcuucaagacagaagacuuuguuagagaggcccggaaacuccuggaaacccagucuaaguucuuugagauugaucaaacauucaucaugagauacauugaacugaucgagacccgccgggaauauuuugaggggcccggaaaaggcagcccuuucgggugggagggaaacauuaagaaaugguuugaacagaugaugggccacuguacguacuuccccgaggaacucagauccgugaaguacagcuauucugcugagcuguuuaaugcccuuaacgaccugaacaaucucgucaucacccgcgaugaagacgcgaagcugaacuacggggagaaauuccagaucauugagaauguguuuaagcagaaaaagacaccuaaccuuaaacaaaucgccauugaaaucggagugcaugagaccgaaauuaagggcuaucgggucaauaaguccggcaaacccgaguucacacaguucaagcuguaccacgaucucaaaaacaucuuuaaggacccuaaauaucugaaugauauccagcugauggacaacauugcugaaaucauuaccaucuaccaggaugccgagagcauuaucaaggagcucaaucaacugccggaacuucugucugagagagaaaaggagaaaaucuccgcucucagcggguauucuggaacgcaccgccugucccuuaagugcauuaaccugcuccuggacgaucugugggagagcucccucaaucagauggaacuguucacaaaacuuaaccugaagcccaaaaagaucgaccucucucagcaacauaagauuccuagcaaacugguugacgauuuuauccugucccccguggugaagcgggccuucauucagagcauccaggucgugaaugcgauuaucgacaaauacggccuuccugaggauaucauuaucgaacucgccagagagaacaauucugacgaucgccggaaguuucugaaccagcugcaaaaacagaacgaagagaccagaaagcagguugagaaagugcuccgcgaauacgggaaugacaacgcuaagcggauuguccagaagaucaaacugcacaauaugcaagagggaaagugucuuuauucccugaaagauauuccccucgaagaccugcugagaaacccgcaucacuacgagguggaucacaucaucccucggagcguugccuucgacaauucuaugcauaacaaggugcuuguccgcgcugaugaaaauagcaaaaagggcaacagaacacccuaucaguaccucaauuccucugagagcucccugagcuauaacgaguuuaagcagcacauucugaaucucucuaaaaccaaggaccggaucaccaaaaagaaaagagaauaccugcuugaggaacgcgauauuaacaaguucgacgugcagaaggaguuuaucaaucggaaccuggucgacacaagauaugccacgcgcgaacucaccucccugcugaaagccuacuucagcgcuaauaaccuugaugugaagguuaaaacaauuaacgggucuuuuaccaauuaccucagaaagguguggaaauucgacaaggaucggaacaagggauauaaacaucacgcggaggacgcccugaucaucgcuaaugccgauuuucuguucaagcauaacaaaaagcuccgcaauauuaacaaaguccuggacgccccuuccaaggagguggauaaaaagagaguuacagugcaaagcgaagacgaguacaaucagaucuucgaagauacccagaaggcucaggccauuaaaaaguuugagauccggaaauucucccaccgcgucgacaagaaacccaacagacaacuuauuaaugauacgcuguauucuacacggaacaucgacggcaucgaguacgugguggaaagcauuaaggauaucuauuccguuaauaacgacaaggucaaaaccaaguuuaaaaaggacccccaccgccuccugauguacagaaaugauccucagaccuucgagaaauuugaaaagguguucaagcaguaugagucugagaaaaacccguuugcgaaguacuacgaagagacaggcgagaaaauucggaaguucagcaaaaccgggcaaggacccuauaucaauaagauuaaguaccugcgcgaaagacuuggccggcauugcgacgugacaaacaaauauaucaacuccagaaauaagauuguccagcucaaaaucuacagcuaucgcuuugauaucuaccaguaugggaacaauuacaagaugauuacgaucucuuacauugaccuggaacagaaauccaacuauuacuauaucagccgggagaaguacgaacaaaagaaaaaggauaaacagauugacgauucuuauaaguucaucggauccuuuuacaaaaaugacaucauuaacuauaauggcgagauguacagagugaucgggguuaacgauagcgagaagaauaaaauucagcuggacaugaucgauauuucuaucaaggacuacauggaacucaacaauaucaagaaaaccggcgugauuuauaagacaaucggaaaaagcaccacacacauugagaaguacaccacggacauccugggcaaccuuuauaaagcugccccucccaagaagccucagcugauuuucaaauga

SEQ ID NO: 3795 - RNA, 3159 nt, Artificial Sequence
  Cas9 variant
auggagaacaagaaucugcacuacauccucggccuggaccuugggauugccagcgugggaugggcugucguugaaaucgaugagaaagaaaacccccugagacucauugacgugggcgugcggaccuucgagcgcgccgaaacacagaagggggagucccuggcgcuuucuagacggagcgcucgcuccgccagacggcugacgcaacgcagagucgcccggcucaaaaaggcuaaacgccugcugaagucugagaauauccuccugagcaccgaugaaagacuuccucaucagguguggcagcugcggguugagggacucgaccgcaagcuggaaagacaggagugggccgcugugcuucugcaccucauuaaacaucggggcuaucugucccaacgcaagaacgagucuaaaagcgaaaauaaggagcugggggcccuccuguccggagucgcgagcaaccacgaacuucugcagcaggccacauacagaaccccggcugagcucgccgugaaaaaguuugaaguugaggagggccauauccggaaucagcaaggcgcuuauacacacaccuucucuagacuggaucuucuggccgaaauggagcuccuguuuucccgccagcagcacuucgggaaccccuuugcgagcgaaaagcugcucgagaaucugacagcccuucugauguggcagaaaccugcucucucuggagaagacauccugaagaugcuuggcaaaugcaccuucgaggaugaguacaaggccgcuaaaaacacguauaccgccgaacgguuuguguggauuacaaagcugaauaaccucagaauccaagagaaugggcuggaacgcgcccuguccgacaacgagcggcucaugcugauugaacagcccuacgagaaagcuaaacuuaccuaugcgcaggucagaagcauccugaaucucucugaugacgccauuuucaagggagugcgcuacuccggcgaggauaagaaggcuaucgaaacaaaaaccacgcugauggagaugaaggccuaccaucaaauucggaaagugcuggaagggaacaaccuuaaggccgagugggucgcucucaaggccaauccuacacugcuggacgagaucggaaccgcguuuagccucuauaaaacagaugaagacaucuccgcuuaccuggccggcaaacuuucucagcccguucugaacgcccuccuggagaaucugagcuucgacaaguuuauucagcuuucccucaaggcucuguauaaacugcucccucugaugcagcaaggccuuagauacgaugaagccugucgcgagaucuauggggaccacuacggaaagaagaccgaagagacccaucacuuccugccgcagauucccgcugaugagauccggaacccuguggugcucagaacacugacgcaggcccgcaaagucauuaauggcgugguucggcuguaugggagccccgcgagaauccacaucgaaaccggacgggaggugggcaagucuuacaaagaccgccaugaacuuaagaaaagacaggaggaaaaccggaagcaaagagagaagacaauuuccgagaucaaaacccucuuuccuaauuucagcggggaacccaagggaaaagauauucugaagaugcgccuguacuaucagcagaacgccaaaugccucuacucuggcaagccgcuggagcuucaccggcuguucgaacagaaauaugucgagguggaccaugcucucccucugagcagaacaugggaugacuccuuuaauaacaagguucuggugcuugccaaugaaaaccaaaauaagggcaaccucacccccuucgaguggcuggaugggaaaaauaacucugagcgcuggagaacguuuaaggcucuggucgaaacaagcgccuucccuuacgcgaaaaagcagcggauccucucccagaaacuggacgagaagggauuuauugaacgcaaccuuaaugauaccagauauguggcccgguuccuguguaacuuuaucgcugacaauaugcaccucaccggcgaggggaagcgcaaagucuucgccagcaacggacagaucacagcucugcugagacggcgcuggggccuugccaagucuagagaggacaaugaucggcaucacgcccuggacgcugugcucguugcgugcuccaccguggccaugcaacagaaaauuacacgcuuugucagauucaaggcuggggauguguuuacgggcgaacggaucgacagagagaccggagaaauuaucccccugcacuuccccacaccuuggcaguuuuucaaacaagagguugaaauucgcaucuucagcgauaacccgaagcucgagcuggagaaucggcuucccgacagaccucaggccaaccaugaauuugugcagccccuguucgucucucgcaugccuacccggaagaugacaggccaggggcacauggagaccgugaaauccgccaagagacucaaugaaggaauuagcaugaucaaaaugccccugacgaagcugaaacuuaaggaucuggagcucauggugaaccgcgaacgggagaaggaccuguacgaugcucucaaaaccagacuggaggccuuuaaugacgauccggcgaaggcuuucgccgaaccuuuuaugaaaaagggcggggccaucguuaaauccguccgcguggagcaagugcagaagucuggaguccuugugcggcagggcaacgggguugcugacaaugccagcauggugagagucgauguguucacaaaagacggcaaguauuuucugguucccauuuacaccuggcaaguggcgaagggaauccucccuaacaaagcugucauucagggcaaggacgaagaggauugggaagacaucgaugacgccacauuccaguuuucccugcaucccaaugaucugauuucugugaaaaccaagaaagacgaguuccuuggguacuuuaacggacugaaccggcacacgggcgggaucaauauccgcacacacgaucucgaaaagagcaagggaaaacagggcauuuucgaggggaucggcguuaagauugcccuguccuuugagaaauaucagaucgacgaacucggaaagaacauuagacuguguaaaccuagcaagcggcaacccgugcgcuga

SEQ ID NO: 3796 - RNA, 3159 nt, Artificial Sequence
  Cas9 variant
augaagaacaccagccugaauuacgugcucggccuggaccuugggaucuccucugucggaugggccguuguggagauugaugaaaaagagaacccccugagccucaucgacgugggcgucagaacauucgaacgggcugagacgcagaagggggaaucccuggcccuugcgcgcagacuggcucggucugcccgcagacucacccaacggcgcguggccagacugaaaaaggcuaaacggcugcucaagagcgagaauauucugcuuuccacagaugagugccugccucaccagguuuggcagcuccgcguggaaggacuggagagaaaacuugaacggcaggagugggccgcuguccugcuccaucugaucaaacaccgcggcuaucugucucaaagaaagaacgagagcaaauccgaaaauaaggagcucggggcccugcuuagcggaguggcgaacaaucauaaacugcuccagcagaccacauaccggaccccggccgaacuggcuguuaagaaguuugagguggaagagggccacauucgcaaccagcaaggcucuuauacacauaccuucuccagacuugaccugcucagcgagauggaacugcuguuuucucggcagcagcacuucgggaaucccuuuacguccgagaaacuccuggaaaaccuuaccgcccugcucauguggcagaagccugcucugagcggagaugccauccuuaaaaugcugggcaaguguacauucgagaaugaauacaaagcggccaagcacaccuauucugcugagagauuuaucuggauuacaaaacucaacaaucugcgcauccaagagaacgggcuggaacgggcccucaaugacaacgagagacuggcucuuaugaagcagcccuacgaaaaggccaaacugaccuaugcccagguccgcuccauucucaaccugagcgaugaggcuaucuucaagggacugcgguacuccggcgaagacaaaaagacgucugagacaaaaaccgugcuuauggagaugaaggcguaccaucaaauuagacucgcccuggaaaagaaugaucugaaaacagagugggcugaacucaaggugaacagcucccugcuugacgagaucgggaccgccuuuagccuguauaaaaccgaugaggacauuucuacaugccucgccggaaagcugucccagccuguccugaaugcucugcucgaaaaccugaauuucgauaaauuuauccagcugagccucaaggcccugcacaagauccuuccccugaugcagcaaggccuccgcuacgacgaggcgugugcugaaauuuauggcgaccauuacgggaaaaagacggaggaaaaccaccuucugcuuccucagaucccggccgaugagauucggaaucccguugugcucagaacccugacacaggcccgcaaagugaucaacggagucgugcggcuguauucuagcccugcucgcauucacaucgagaccggcagagaaguugggaaguccuaccaggaccggagagagcucgaaaaacggcaagaggaaaaucgcaagcagagagagaaggccaucucugagauuaaaacacuguuccccaacuuuagcggagaaccuaaggcuaaagauauccuuaagaugcggcuguauuaccagcagaaugccaaaugccucuacuccggcaagccccuggagcugcauagacuucucgaacaaggguauguggagauugaccacgcgcugccguucagccgcaccugggaugacucuuucaacaauaaaguccuggugcucgccaacgaaaaucagaacaagggaaaccugacgccuuuugaguggcuugauggcaagaauaacuccgagcgguggaaggcuuucaaggcccugguugaaacaagcgcuuuucccuacaccaaaaagcagagaauccucucucagaaacuggacgagaagggcuucauugaacgcaaucugaacgauaccagauauguggcccgguuucuuuguaauuucaucgcggacaacaugcaucugacaggggagggaaagcgcaaagucuuugccuccaauggccaaaucaccgcucuccugagagggcgguggggacucgccaagagccgcgaggauaacgacagacaccaugcucuggacgccguggucguggccugcuccacaguuucuaugcagcagaaaauuacgcgguucgugcgcuuugaagagggcaaugucuucaccggggaaagaaucgaucgggagacaggcgaaauuaucccucuucacuuucccgcucccuggaaguucuuucgcgaggagguggaaauuagaaucuucagcgacaacccuaaacuggagcucgaaaaucggcugauugcgagaccgcaagccaaccacgaguucguucagccccuguuugugucccgcaugccuacccggaagaugacaggacagggccauauggaaaccaucaagucugcuaaaagacuuaaugaggggcugagcgucaucaagaugcuccugacgaaacuccgccugaaggaucuugaguccauggugaaccgggaaagagagaaagaacuguacgaggcccucaaggcccgccuggaggcuuucaaugacgaacccgccaaggcguuugcugagccuuucaugaaaaagggaggcgccauugugaaaagcguucgggucgaacaggugcaaaagucuggggugcuggucagagauggaaacggcguggccgacaacgcuuccaugguucgcguggaugucuuuaccaaagggggcaaguauuuccuugugcccaucuacacauggcagguugccaaaggcauucugccgaauaaggcggugauccagggaaagaacgaggaagacugggaggucauggaugacgcuaccuuucgguucagccuccaccagaaugaucuggugaaacucguuacaaagaaaaagaccauuuuuggguauuucaacggacugaauagagccacgggcaacaucgacaucaaagagcaugaucuugaaaagucuaaggugaaagacgggauucaccaauccaucggaauuaagcuggcccugagcuuugagaaauaccaggucgacgaacucggcaagaauauccggcuguguaaaucuagcaagcgccaggcugugagauga

SEQ ID NO: 3797 - RNA, 3159 nt, Artificial Sequence
  Cas9 variant
augaucggcgagcacgugagagggggaugccuguucgacgaucauuggacccccaacuggggcgccuuucggcucccuaauacaguccgcacguucaccaaggcugaaaacccgaaagacgggagcucccuggccgagcccagacggcaggcgcgcggacuuagacggcgccugagacggaagacacaacgccucgaagaucugagacggcuucuggcuaaagagggcguucucucucugagcgaccuggaaacccucuuucgcgagaccccugccaaggaucccuaccagcugagagccgaggggcuugaccggccucuguccuuccccgaaugggugcgcgugcucuaucacauuacaaaacauagaggauuucagucuaaucggagaaacccugucgaggauggccaggaacgcagccggcaagaggaggaaggcaagcugcuuuccggggugggagagaaugaaagacugcuccgcgagggcggguaccggacagcuggagaaaugcuggccagagacccgaaguuccaggaucaccgccggaacagagcuggcgacuauucucauacccugagccgcucccuccugcuugaggaggcccggagacuguuucagagccagcgcacgcucgggaauccccacgcgucuuccaaccuggaagaggccuuccuucaccugguugcuuuucaaaauccuuucgccagcggagaagauauccggaacaaagcuggccauuguucucucgagcccgaccagauuagagccccucggcgcuccgcgagcgccgaaaccuuuaugcugcugcagaagacaggcaaucucagacugauccaccggagaaccggggaggagcgcccccuuacagauaaagaacgggagcagauucaucugcucgcuuggaagcaagaaaaagugacccacaagacgcugagacgccaccuugagaucccggaagaguggcuguucacaggacucccuuaccauagaucuggcgacaaggccgaggaaaaacuguuuguccaccuggcugggauccaugagauucggaaggcccucgacaaaggacccgauccugccgugugggacacccugcgcuccagacgggaucuucuggacagcaucgcugauacacucaccuucuauaagaacgaagacgagauucugccccgccuggagucccuuggccucucucccgaaaaugcgagagcccuggcuccucugagcuucuccgggaccgcccaccucagccugucugcccuuggaaaacugcucccgcaucuggaggaaggcaaguccuacacacaggcucgggccgaugcgggcuaugcugcucccccucccgaccgccacccuaaacugcccccgcuugaggaagccgauuggagaaacccuguuguguuucgggcucucacgcagacccgcaaggucgugaaugcccuggugagacgguacgggcccccuuggugcauccaccuggagacagcuagagagcucagccaacccgccaagguccgccggagaauugaaaccgagcagcaggcgaacgagaaaaagaaacagcaagccgaacgcgaguuccuggacaucguuggaacagcuccuggccccggggaucuucugaagaugcggcucuggagagaacagggaggcuuuuguccguacugcgaggaauaucugaacccuacccgccuggccgagcccggguacgcugaaauggaccauauucuucccuauucucggagccucgacaauggcuggcacaacagagugcuggugcauggaaaagauaaucgcgacaagggcaaccggacgccuuucgaggccuuugggggagauacagcgagaugggaccggcuggucgccugggugcaggcuucccaccucucugccccgaagaaacgcaaucugcuuagagaagauuucggcgaggaggcugaacgggagcugaaggaccgcaaccucaccgauaccagauuuaucacaaaaaccgccgccacacugcugcgggacagacuuacguuccaccccgaagcuccuaaggaucccguuaugacccucaaugggcgccugacagcguuucugcggaaacaguggggacuccauaagaacagaaagaauggcgaccugcaccaugcccuugaugcugccgugcuggccgucgcuagccgcuccuucguguaccggcucagcucucacaacgccgcguggggagagcugccuagaggccgcgaggcugaaaauggauuuucccugcccuauccugccuuccggagcgagguucuugccagacugugucccacccgcgaagagauccuccugagacucgaccaaggcggggugggauacgaugaagccuuucggaacggccugcgcccggucuucgugucuagagccccuucccggcgccuuagagggaaagcgcauauggagacacugcggagccccaaguggaaagaccacccugagggacccagaaccgcuucccgcauuccgcucaaggaccugaaucuggaaaaacuugagcggauggucggcaaggauagagaccgcaagcuguaugaagcccuccgggagagacuggccgcuuucgggggcaacgggaaaaaggccuuuguggcuccuuuccggaaacccugccgcucuggcgaagggccucucguuagaagccugcggaucuuugauuccggauacucuggcguggagcuucgcgacgggggagaggucuacgccguggcggaucacgaaagcaugguuagaguggacgucuaugccaagaaaaaucgguucuaccuggugcccguguauguugcugaugucgcccgcggcauugugaagaacagagcuaucguggcccauaaauccgaggaagagugggaccucgucgaugggagcuuugacuuccgguuuucucuguuccccggcgaucugguggaaauugagaagaaggacggagccuaccuuggcuauuacaaauccugucaccgcggggauggaagacugcuccuggaccggcaugacagaaugccucgcgagagcgauugcggcacguuuuauguuucuacccggaaggacgugcucuccaugagcaaauaccaggucgauccgcugggggaaaucagacuugugggaucugagaagcccccuuucguucuguga

SEQ ID NO: 3798 - RNA, 3162 nt, Artificial Sequence; identical to SEQ ID NO: 3702
  Cas9 variant

SEQ ID NO: 3799 - RNA, 3162 nt, Artificial Sequence
  Cas9 variant
augaagagaaacuacauccugggccucgacauugggaucaccagcgugggauauggcauuaucgauuacgagacacggaaugucauugacgccgggguucgccuguucaaagaagcuaacguggagaauaacgaaggaagacgguccaagcgcggcacgagacggcuuaaacgcagacggcgccacagacugcagcgggugaagaaacuccuguuugaucauaauuuccuuaccgacaacucugagcugagcgggaucucccccuaugaagcccgcgucaagggacucaaucaaaagaucucugaggaggaauuuagcguggcgcugcugcaccucgcuaaaagacggggcguucauaacgugaaugaggucgaagaggauacaggcaacgagcuguccaccaaggaacagauuucucgcaauagcaaagcccuugaggaaaaguacguggccgagcugcagcucgaaagacugaaaguugacggggaggugcggggagcugucaacagauucaagacauccgauuaugugaaggaggcccagcaaauccuuaaagugcagaaggcuuaccaccaguuugaccagagcuucauugauaccuauaucgaccugcucgaaacacgccggaccuacuacgagggcccuggggaaggaucuccguuuggcuggaaagauauuaaggagugguaugaaaugcugauggggcaaugcacguacuuccccgaggagcugagauccgucaaauaugccuacaaugcggaccucuauaacgcccugaaugaucuuaacaaccugguuaucgcucgcgacgaaaaugagaagcucgaauacuaugagaaauuucagauuaucgaaaacguguucaagcagaagaaaaagccuacccugaaacagaucgccaaggagauucuugugaaugaggaagacaucaaaggauaccgggucacaagcaccggcaagcccgaguuuacaaacuucaagguguaccaugauauuaaaucuaucaccuccagaaaggaaauucuggagaaugcugagcuccugaaccaaaucgccaaaauccugacgauuuaucagagcucugaagacauccagggcgagcucgcgcgccuguacuccgaacuuacacaagaggaaauugagcagaucagcaagcuggccggguauaccggaacacaccggcucucccugaaagcuauuaaucuuaucaucgaugagcuguggcacaccucugacaaccagauggaaauuuuuaauagacucaagcugguuccuaagaaaguggaucugagccagcaaaaggagauccccaccacacucgucgacgauuucauucuguccccugugguuaaacgcagcuucauccagucuauuaaggugaucaacgccauuaucaaaaaguacggcuuuccgaaugacaucauuaucgaacuugcucgggagaagaacuccaaagaugcccagaaguucauuaaugaaaugcagaaaagaaaccgccaaacgaaugagcggaucgaggaaauuaucagaaccacagggaaggagaacgccaaauaucugaucgaaaagauuaaacuccaugacaugcaggagggaaagugucuguacagccuggaagcuaucccccuugaggaucuccugaacaauccuuuuaacuaugaggucgaccacauuaucccccggucugugagcuucgacaauuccuuuaacaauaagguccuggugaaacaggaagagaacucuaagaaaggcaaucgcaccccuuuccaguacuuuagcuccagcgauucuaagauuuccuacgaaaucuucaaaaagcauauccucaaccuggcgaaggggaaaggaagaauuagcaagaaaaagaaagaguaucuucuggaggaacgggacaucaauagauuuucuguucaaaaguacuucauuaaccgcaaucucguggauacacgguaugccaccagagagcugaugaaccugcuucgcuccuacuuuagagucaaugaccucgauaucaaggugaaaagcauuaacggcggcuucacguccuuucugcggaagaaauggaaguucaaaaaggaacgcaauaagggguauaaacaccacgcugaggacgcccugaucaucgccaacgcugauuucauuuuuaaggaauggaaaaagcucgacaaaacaaacaagguuauggaggaucagaucguggaggaacagcaggccgagucuaugcccgaaauugagaccgaacaagaguacaaagagaucuucauuaccccgcaucagauccaggacauuaaggauuuuaaggacuauaaauacagccacagagucgauaagaaaccuaaucgggaacuggugaacgacacacuuuacuccacccgcaaggacgauaaaggaaauacacugaucgugaacaaucucaagggccuguaugacaaggauaacgacaaacugaagaaacuuaucaauaagucucccgagaaacuccugauguaccaucacgauccucaaacguaucagaagcugaagguuauuauggaacaguacagcaacgagaaaaauccccucuauaaguaccaugaagagaccgggaacuaucugacaaaauacuccaagaaagacaauggacccgucaucaagaagauuaaauacuauggcaacaaacuuaauguguaccuggauaucaccagagacuaucucaagagccggaacaagauugugaaacugucucugaagccuuaccgcuucgaugucuaucuugacaaugggguguacaaguuuguuacagugaaaaaccucgauaucaucaagaaagaggacuauuacgaagucgauuccgacagcuacgaggaagcgaagauugugaaaaagguuucugagcaggcucaauucguggccuccuuuuauaacaaugaccugaucaaagucgauggcgagcuguucagagugauuggaguuaacaaugaccuccugaaccggaucgaagugaauauggucgauauuaccuacaaggaguaucuugaaaacaucaaugacaagaaaagcucucgcaucauuaagacgaucagcuccaaaacccagagcauuaagaaauacucuacagauauccugggcaaccucuaugaggccaaguccaagcagagaccgcagaugaccaugaaaggguga

SEQ ID NO: 3800 - RNA, 3162 nt, Artificial Sequence
  Cas9 variant
augaagagaaacuacauccugggccucgacauugggaucaccagcgugggauauggcauuaucgauuacgagacacgggacgucauugaugccgggguucgccuguucaaagaagcuaauguggagaacaaugaaggaagacgguccaagcgcggcgccgggagacuuaaacggcgcagacggcaccgccugcagagagugaagaaacuccuguuugacuauaaccuucugacggaucauucugagcucagcggaaucaaucccuacgaagcgcgggucaagggccugucccaaaagcugucugaggaggaguucagcgcugcccuccugcaccuugccaaacgcagaggcgugcauaacguuaaugagguggaagaggacaccgggaacgagcuguccacaaaggaacagaucucucggaauagcaaagcucucgaggaaaaguaugucgccgagcugcagcuugaacgccugaaaaccgauggagaggugagaggcuccauuaaccgguuuaagacaagcgacuacguuaaggaggcuaaacagcuccugaaggugcaaaaagaauaucaccagcuggaucagucuuucaucgacaccuacauugaucuccuggagacaagacgcaccuacuaugaagggccuggagagggcuccccguuuggguggaaggacaucaaagaaugguacgagaugcuuaugggacauugcacguauuuccccgaggaacugcggagcgucaaguacgccuauaaugcggaucucuacaacgcccugaaugaccuuaacaaucuggugauugcuagagacgagaacgaaaaacucgaguauuacgaaaaguuucagaucauugagaacguguucaagcaaaagaagaaaccuacccugaagcagaucgagaaagaaauccuggucaaugaggaagauauuaagggcuaccgcguuacaucuaccggcaagcccgaguuuuccaaccucaaaguguaucacgacaucaaggauauuacagcccggaaagagaucauugaaaaugcugagcugcuugaccagaucgccgaaauccugaccauuuaccagagcucugaggauauccaagaagaacucgugaagcugaacuccgagcuuacgcaggaagagauugaacagaucagcaaucugaaaggguauacaggaacccacaaccucucccugaaggcgauuaaucugauccucgacgagcuguggcauacaaacgauaaucaaauggccaucuucaacagacuuaagcuggucccuaaaaagguggaccucucucagcagaaagaaauucccaccacccugguugaugacuuuauccugagcccuguggucaagcgcuccuucauucagagcaucaaagugauuaaugcuaucauuaagaaguacggccuuccgaacgauaucaucauugagcucgcccgggagaaaaauucuaaggacgcucagaaaaugaucaacgaaaugcaaaagagaaaucgccagacaaacgagcggauugaagagaucauuagaacgaccgggaaagaaaacgccaaguaucugaucgagaaaaucaagcugcacgacaugcaggagggaaagugucucuacucccuggaagccauuccccuugaggaucugcucaauaacccuuuuaauuaugaaguugaccauaucauuccccgcagcgugucuuucgauaacagcuucaauaacaaaguccuggugaagcaagaggaaaauuccaaaaagggcaaccggacaccuuuucaguaccugucuagcuccgacagcaaaaucucuuacgaaaccuucaagaagcacauucuuaaucucgcuaaagggaagggaagaaucuccaaaacaaagaaagaguaucugcuggaggagcgggauaucaaccgcuuuagcguccagaaggacuucauuaauagaaaccucguggauacccgguacgcgacgagagaacugaugaaucuucugcgcucuuauuuucggguuaacaaucucgacgugaaggucaaauccaucaacggcggcuucaccagcuuucugagacgcaaguggaaauucaagaaagagagaaacaagggguacaagcaccaugccgaggaugcucugauuaucgccaaugccgacuuuauuuucaaagaauggaagaaacuugauaaggcuaaaaaggugauggagaaccagacaguugaagagaaacaagccgaauccaugucugagaucgagaccgaacaggaguauaaggaaaucuuuauuacaccccaccagauccagcauauuaaggacuucaaagauuacaaguauagccaccggguggacaaaaagccgaaucgcgagcucaucaacgacacccuguacuccacaagaaaagaugacaagggaaauacgcugauugucaacaaucucaacggccuguaccauaaggauaaugacaaacuuaagaaacugaugaacaagucuccugaaaaacuccugauguaucaccacgauccccaaaccuaccagaagcugaaacuuaucauggagcaguauggggacgagaaaaauccucucuacaaguauuacgaagagacaggaaacuaucugaccaaauacagcaagaaagauaauggccccgugauuaagaagaucaaauacuaugggaacaagcugaaugcgcaucucgacaucacagaugacuaccccaacucccggaacaaagugguuaagcugagccuuaaaccuuaucgcuuugaugucuaccuggacaauggcguguauaaguucgugaccgucaagaaccucaaugugauuaaaaaggaaaacuacuaugagguuaauucuaaaugcuacgagaaggcuaaaaagcugaaaaagaucuccgaucaagccgaguucauugccagcuuuuacaacaaugaccugaucaagauugacggagaacuuuauagagugaucggcgucaacacggaucugaucaaucggauugaagugaacaugguugacaucaccuaccgcgaguaucucgaaaauaugaacgauaaaagaucuccgcggauuuucaagacaaucgcuuccaaaacccagagcauuaagaaauacucuacagacauccuggggacccucuaugaggugaauagcaagaagcacccccagaugaucaugaaaggauga

SEQ ID NO: 3801 - RNA, 3162 nt, Artificial Sequence
  Cas9 variant
augagcggcaugguguucgggaucgaccugggaauugccuccugcggcugggcuguccucagacagccccaacgggauggggacccuggagagaucguugaucugggcucuuggauguuugacgugccggaaaccgauaaggagcgcacacccacgaaccaggugagacgggggaaucgccuucugagacgggucauucgcagacgggcccagcgcaugguggaaaucagacgccucuuccacgaccauggacugcuugcgggccacgcuccugaggcccugaaacgggccggccucgaucccugggaccugagagcucggagccuggauaagguucucgaaccugccgcucuggccguggcgcuugggcauauugccaaacgcagaggauuuaaguccgcugcccggagaaaagaggcuaacaccgccggcgacgaucagaagaugcugaaggcgcucgaggccacacacgaacgccuggggcgguacagaaccaucggagagauguucgcucgcgaccccgauuuugaaucucggaaaagaaaucgcgacggcauguucgaccggacacaagggagagaugaccuucugcaugaggucggagagaucuuuaaggcccagcgccggcucggcagcgcucuggccaccgccgaacuggagcaggcuuucacagcgauugccuuuagacagcucccuauccaagauuccgaacgccuggugggccuuugucaguucgagccgaaagaaaagcgggcugccagauuugcccccucuuucgagcgguuucgccugcuccagagacugaccaaccuucggguugugacggucgagggggaaagaccucugaccgcugacgagauugccgcggcugccgccgaucucggacgcacagcuaaacugagcgugaaggaagugcggaagagaaucggccuggccgcugaccaccgcuucgccgcguucaaagccgaugaggaagacagagauauuaucgcucggaccggggaggcccuccacggaacauaucgccugagaaaggcucuuggcgaggggcugugggccgaaaugcuccccggacagcuggacgcgauugcccaugcucuuuccuuuuucgagacccaagaugucauccugaaagaacucgacaagcuggaccugccugccggcguucgggaugcuaucgccacgggccucgacgccggggcuuuugcgcgcuucaaaggaacaggccacauuagcgccagagcugcccgggcccugcuuccccaucuggaggcugggcuccgcuacgaucaggccugcaccaaggcgggauaugaccacgcugccucuagaugggccaaacgggaacagguggcugauaaggccgcguuuaaucgccuggugacagacaugggcgcugagaucgccaacccgauugccagaaagucccugaccgaggcucuuaaacaacucugggccaugcggaauagaugggggcugccugaugcuauccacauugaacuggcccgcgacgucggcaacagccucgagaagcggagagaaaucgagcgcgcgaucgagaaaaauaccgccgcucgggaaagagagcgcggagaagcccgggaucugcuuggcauugacgaugugucuggggacacacugcucagauaccgccuguggaaggagcaggcuggacggugucccuauacggaugccccuaucccucccggcgccauuaucgcuaccgacaacuccuuccagguugaccauauucugcccuggagcagauuuggggaugacucuuucgcgaauaaagugcuuugcgccacagcugccaaccagcggaagaagggacaaaccccgugugaauggaucacagccgcucagggcgaggaggggugggccaccuuugucgcgcgcaucgaaggcaaugcugccuucagaggacccaaaaagcggaacuacgugcucaaaaaugccaaggaggcugaggaacgcuuuagagcccggaaccugaacgauacgagauaugcggcucgccugcucgccgaagccguuaaacuguucuacccugagggcgagcggcaggacaaagggggagugagacgcgucuuuacacggcccggcgggcuuaccgcugcccugagacacgcuuggggaguggaagcccucaagaagcgcgauggcaagcgggucgacgaugcgagacaucacgcccuggacgcucuggugguugccgcuauuggggagggcgaagugcagcgccuuaccagauccuaccaagagugggaacagcagggacucgcccggccucugcgcagagucgaucccccguggggcgacuuccauagcuuccggcgcgaggugaaagaugccuaugacgggaucuuuguugcuagaccugagcggagacgcgcgcggggagaaggccacgccgcuacaauuagacaggugcgcgagcgggauggggccgccgucguguucgaaagaaaggcuaucgccgaccuguccgagaaacggcucgcggacauuaaggaucccgagcgcaaucaagcuaucguggaagccauuagacaguggaucguugacggacggccugccgaucgccugcccagaucuccugcuggcgacgagauccggaagguccgccuuagaaccaaagggaagcccgccguccaggugcggggcggagcggccgaucgcggcgaaauugugagaguggacguuuuuacaaaaccgaacaagaaagggaagaaugaguucuaccuggugccuaucuauccccaccaggucaugaacaaagcugaauggcccacgccuccgaugcgggccgugguugcuuacaaggaugagagcgaguggacccuccuggacgaaaauuuuggauuccuguuuucccuuuuccccagaagcuauguggaggucacaaagccuggcggggaagugcucucuggauacuuucaaggcauggaucgcuccaccggcgccauuagccuguucaaccaucgggacucuagaagccugacagaugacuccggaaauucuacccgcgggaucggcgcuaaaacgcuccugaccaugaagaaauauagcguugaccgguuugggaagagagccgaggugaaauccgaaguccgcacauggcacggaguggcgugcaccuaccccacaccucccggcuga

SEQ ID NO: 3802 - RNA, 3165 nt, Artificial Sequence
  Cas9 variant
augaagcugacaccccucaacuacauccugggccuugaccuggggauugccagcgugggaugggcugucguugagaucgaugaacaggagaauccucucggccugauugacgugggggugagaaccuucgaucgggccgaagucgcgaaaacgggagagucccuugcucuggcccgcagacucgcccggucuagccgcagacuggugaagcggcgcgcugacagaaucaaaaagguuaaacggcugcucaaguccgaaaacauucugcuuucugccgaugagcaacugccgaaugacguguggcagcuccgcgucaagggccuggaucagaaacuugagagacaggaaugggcugccgugcugcuccaccuucugaagcaucggggguaucucagccaacgcaaaaacgaguccaagucugaaaauaaagagcugggagcgcuuagaagcggcguugccgcuaaccaccagauccugcaguccgccgaguaccggacccccgcugaaaucgccgugaagaaguuucaugucgaggaaggccacauucgcaaucagagaggggcguauacacauaccuucagccggcucgaccugcuugccgagaucgaacugcucuuuacaagacaaaccgagcugggaaacccucacacaucugcuaaacugcucgagaaucugaccgcccuucugauguggcagaagcccgcucucgccggcgaagccauucugaaaaugcuugggaagugcacguucgagccuaccgaauacaaagcugcgaagaacuccuauagcgccgagcgcuuuguguggcugacaaaacucaauaaccugcggauccuggaacagggagcugagagagcccucaccgauaaugagcgcuucgcccugcuugaccagcccuacgaaaaggcuaaguuuacauaugcccaagcgcggaccaugcuggcucucccugaugaggccauuuucaaaggcgugagauaccagggggaagacaagaaagccgucgagacgaagacaauccugauggaaaugaaggcuuaccaccagauucgcaaagcccuggagaacgcugaucuuaaggccgaguggaaugaacucaaaaacaacucugagcugcuggacgacaucggaaccgcguuuucccuccauaagacagaugaagacaucugucgguaucuggauggcaaacuuagcgagucuauucugaaugcccuccuggagaaccugaauuucgacaaguuuauccaacuuucccucaaagcucugcagcagauucugccgcucaugcugcagggccaaagauacgaugaagccguuagcgcuaucuauggggaccacuacggaaagaaguccgccgagauuaaccgccuucugcccaccaucccugcggaugaaauccggaaucccguggugcucagaacccugacacaggcccgcaaagucauuaacgcugugguucggcuguauggcucuccugccagaauccauauugagacggggcgggaagugggaaagagcuaccaggaccgcaaaaagcuggagaaacagcaagaggauaauagaaagcaccgggaauccgcuguccagaaguucaaagaguauuuucccaacuucgugggcgaaccgaaggggaaagacauccucaagaugagacuguacgagcugcagcaggccaaaugccucuacagcggaaagucucuggaacuucaccgccugcucgagaaaggcuauguugagguggaucaugcccugccuuucucccggaccugggacgacagcuuuaauaacaagguccuggugcuugcuaaugaaaaccaaaauaagggcaaccucacacccuacgaguggcuggaugggaaaaauaacucugaaccuuggcagaacuucgucgcgagagugcagaccagcggauuuucccacacaaagaaacagcgcauucugucucauaagcucgacgagaaaggcuucaucgaaagaaaucugaacgauacccgguauguugugcgcuuucuuuguaauuucaucgccgacaacaugcugcucacggggaagggaaagagaaaagucuuugcuagcaauggccaaauuacagcccugcugcgggggcgcuggggccuucagaaggugagagaugacaacgaucggcaccaugcccuggacgcuguuguggucgccugcuccaccguggcgaugcagcagaaaaucacccgcuucgugagauacgaggagggaaauguuuuuagcggcgaacggauugaucgcgagacaggggaaaucauuccccuccacuuccccucuccuugggccuuuuucagagagaacgucgagauccggaucuuuuccgaaaauccgaagcuggagcucgaaaacagacugcccgacuauccucaauacaaucacgaguucgugcagccccuuuucgugagccgcaugccuacccggaaaaugacaggacagggccauauggaaacggucaagucugcuaagagacuggaugaggggcucuccgugcugaaaguuccccugacccaacuuaagcugaacgaccucgagcgcauggugaaucgggaaagagagauggcccuguaugaaagccucaaaguccgccuggagcaguuugauaacgacccggcuaaggccuucgcggaaccuuuuuacaaaaagggaggcgcucuugugaaggccguucggguggagcagacacagaaauccgggguccuggugagagacggcaauggaguugccgauaacgcuucuauggugcgcgucgacguguucaccaaggccggcaaauacuuucucgugcccauuuauacauggcaagucgcuaaggggauccugccuaacaaagccguuaccgcgaauguggaugagauugacuggcuggaaauggaugagagcuaccaguucaucuuuacgauguaucccaacgaccuugugaaggucaaacugaagaaggaagaguucuuuggauacuauggcgggcucgaucgggccaccggagcuauugugaucaaagaacacgaccuggagaaguccaaaggcagacaggggauuuaccggaucggcguuaagcucgcccugucuuucgagaaauaucagguggaugaacuuggaaagaauauccgcccuuguagacccacaaagcggcaacauguccgcuga

SEQ ID NO: 3803 - RNA, 3165 nt, Artificial Sequence
  Cas9 variant
augagaauccugggcguggaccucggggucgccagcguuggaugggcucuggugaacgauaagaauaacaaaauuaucgacuccggcgugcggauuuucacccagucuacaaaucgcgaggggaagacgcuugccgcggucagacggagcuuucgcggaggcagacgggugcugucccgcagaaaacaacggcucaaccagcugaagaaacuuuucaucgcucacaagcugcucucuaagagcgaauuuaaacaucuguucaauuccaagaaccgccuggauauuuggcagcucagagccaaagggcuggagcagcaacuuaauaacaaggaaugggcccggguucuguaccacaucgcuaaacgcagagccuaucagucuaaucggaaguccgaggaauccggaaacaccgacaagaaaaaggugcucagcggcaucucuaaaaaugagaagaaaaugaacgagcugggcuacaagacaauuggggaaaugcuuuauaccgagaaucgcuaccccgauaacagaauccggagaaauaaaaaggaccaguauaagcauuccauuagccgcgaucugcuccggaaagaaaucgacguccuguuugagucucagagagauuucggaaaccaauuugcuacagacggccugaaggagcacuacaaagauauugccuucacccagcgcccuaucaaguuuaaagcggaccucguggggaagugcacauucgaaacccaggaguaucggggagccaagaacuguuuuuccguugaaaagagcacgcugcuuucuaagauuaauaacaccgaucugaucgacaaauccacaggcgagaucaagagacucuucgaaauuagcgaguuugacaaacugcuugauaucuucuacuccauuaaggaggugaaguacaccacacugcgcaaacagcucaagaucaccgacgcuuucaaauuuaagcaacuggauuaucaucagaauuucgaauacaaaacgaacauuaaggccaagaucgaggacuuuuauaaacuggaagauuggcucacaccggagcagaagguccugcuugaaaaacaagugcuggacgauaagaaagagaaguucaaaugcuacaaguauucuagcauccgguccauucucagccugucugagucccagaaguuuaauggggugaaauacgacaccaaggucgaaaacacaguuuucggaaaacuuaauggcuaucacagcaucaagaaagagcugaacaaggaaguguuugaucuccuguucauugacaaggauaaauuuaauaagaucgcugagauucugucuuaccagaaagacgacaagagcgccacccaggaucucaaaaagcaaguguucaacgacuuuaauauggauaagaccaucgucaacgaagcgaucaauucccugcuuaacauuucuuucagcggcuuuaauucccugagccucaaagccaucaacaagcugcugcccuaccuuugucaggggcucaaauaucacgacgcuguggcccauucugaguacaagcaccauucccaguucaaagcugccaacccucagcaauaucugagaccccugaauaaggaggaaaacuaccagauuacaagcccuacgguuaagcgcguguucucucaguuucggaaaguccucaaugccgugaucagaaagcacggauccuucgaugcuaugcacauugagauggcgcgcgaacugaaaaacagcaagaaaaucaaguuugagauucagaccggccaaaaagaguaugcccaggaaaaggaggcuauccggguuaaguuccuugaaaucuuuaaauacgagggguccggaagagaccugcucaagcugcggcuguaugaacagcagcauggcaaaugcauuuacucuaagaaagagaucgagauuaauaaacuucucgaagauggguacguggagaucgaccacauucugcccuggagccgcacauucgauaacucccugaauaacaaggcccucugucugucugccgaaaaucaaaacaaagcuaaucagaccccuuuugaguaucuuacaaacagcgacaagaauagcaaagauagcaaggaauggcaggaguacaaaaacuaugucucuuccuucgccggaaucaagcaagcgaagaaacauaagcugcucaauaccacgcugccgcccagacggggcaacgacuuuagcgaugacaucaaaaacccugagucuggcuuccuggcuagaaaucuuaacgacacagccuacgccucccgcuuuauuaagaauuucgugcagaaccaccuccaguuuagccagaaugauaccaucaaacaaaaggucaaggugcggucuggggcucugaccaaccagcugagauauaauuggggaauugaagagaaaaaccgcgacaauaaccuccaucacgccgaagaugcuaucauucuggccuucgcgacacagggcgagguucagagaaugagcaccaucuccgccaagcgggaagacuucaaauaccaaacagcuaaggagcgcaaaaucaaguuuacgcccccuuucagcgauuuuaagucugugcuugacgaguccgucggggauauuuucgugagcuuugcccccagacggaaaaucuccggagcugcccacaaggcgaccauuaaaccgaaggacacaggcgggaaauauaaguucccuguuaauaacggcauggccgaaaauggagugauccagcgcgucgauguguuuaaaaacgcuaagaauaaguaccaguucauuguguuuuaccccgccgacuucuauaaagaugacuuuccugagcuggaucucaagggcaacgaaaucgacaaaaacguucaguuccuguucucucuguuuaaggacgaucuuaucgaguucaaaaccaagaagacaaaaaccaaggacagcaaacaucuccuggcuuacuuuaaguauauuagauccgaugggaaaaucgccuuccaacagaauuacaaggccgagauugaacggaaggagucugacaacaaaaagggauauaaagauauccugcucgcuacgggcagcgggcuggcgucccuuaagaaauaccaggucucugugcugggagacauugccgaagugaagaaugagaagcgccucccccugaucaaacaaauguauaagagcaaacccaagaaaaaguga

SEQ ID NO: 3804 - RNA, 3165 nt, Artificial Sequence
  Cas9 variant
augaaccagaaguucauccugggccucgacauugggaucaccagcgugggauacggccugauugauuaugagacaaagaauaucauugacgccggggucagacuuuuucccgaagcuaacguugagaauaacgaaggacggcgcuccaagagaggcucucggcgccugaaaagacggcgcauccacagacucgagcgggugaagaaacugcuugaagauuacaaucugcucgaccaaagccagaucccucaguccacgaacccguaugccauucgcgugaaggggcugucugaggcgcugagcaaggaugagcucgucaucgcucugcuucauauugccaaaagacggggaauccacaagauugacgugaucgauuccaaugacgauguuggcaacgaacugucuaccaaagagcagcucaauaagaacagcaaacugcuuaaggacaaguucgugugccaaauucagcuggaacgcaugaaugagggccaggucagaggggagaaaaaccgguuuaagacagccgauaucaucaaagaaauuauccagcuccugaaugugcaaaagaacuuccaucagcuggacgagaauuuuauuaacaaauacaucgaacucguugagaugcgcagagaauauuucgagggacccggcaagggguccccuuacggaugggagggcgaucccaaggcuugguaugaaacccugauggggcacuguacauacuuuccugacgagcuucggagcgugaaguacgccuauucugcugaccuguucaacgcccucaaugaucugaacaaucuugucauucagagagacggacuguccaagcucgaauaccaugagaaauaucacaucaucgaaaacguguuuaagcagaaaaagaaacccacccugaagcaaauugcgaaugagaucaacgugaauccugaggauauuaagggcuaccgcaucacaaaaagcggcaagccgcaguucaccgaauuuaaacuguaucacgaccucaagucuguccuguucgaucaguccauucuugagaacgaagacguucuggaucaaaucgccgagauccucacgauuuaccaggacaaagauagcaucaagucuaagcugaccgaacuugacauucugcucaaugaggaggauaaagaaaacaucgcucagcugacaggguauaccggaacacaucggcugucccucaagugcauuagacuggugcuugaggaacagugguacagcucccgcaaucaaauggagaucuuuacccaccugaacauuaaacccaagaaaaucaaucucacggccgcuaacaagaucccuaaggccaugauugacgaguucauccugucucccguggucaaacggacauucggccaggcgauuaaucugaucaacaagauuaucgaaaaauacggggugccugaggacaucauuaucgaacuugccagagagaacaauagcaaggauaaacagaaguuuauuaacgaaaugcagaaaaagaaugagaacacccgcaagcggaucaaugagauuaucggaaaauauggcaaccaaaaugcuaagagacucguugagaaaauccgccugcaugacgaacaggaagggaagugucuguacucccucgagagcauuccccuggaagaucuucugaacaauccgaaccacuaugagguggaccacaucauuccucggucugucuccuucgauaauagcuaccauaacaaagugcucguuaagcagucugagaauagcaagaaauccaaccugacacccuaucaguacuuuaauucuggaaagagcaaacuguccuauaaccaauucaagcagcacauccuuaaccucagcaaaucucaggacagaauuuccaagaagaaaaaggaauaccugcuggaggaacgcgauaucaauaaauuugaggugcagaaggaguucaucaaccggaaucucgucgacaccagauacgccacccgggaacugacaaacuaucuuaaggcuuacuuuagcgccaauaacaugaaugugaaggucaagacgauuaacggcucuuucaccgauuaucugcgcaaaguguggaaguuuaaaaaggagagaaaucauggcuacaaacaccaugccgaagacgcucucaucauugcgaacgccgauuuccuguuuaaggagaauaaaaagcugaaggcuguuaacuccgugcuugaaaaaccugagaucgagagcaagcaacucgacauucaggucgauuccgaagacaauuauucugagauguucaucauucccaaacaggugcaagacaucaaggauuuucggaacuucaaauacagccacagaguugacaagaagcccaaucgccagcugaucaacgauacacuguauuccacccggaaaaaggacaacucuacauacauugugcagaccaucaaagauauuuacgccaaggacaauacgacacucaaaaagcaguucgauaagagcccugaaaaauuucugauguaucaacacgacccgagaaccuucgagaaacuugaagucaucaugaaacaguacgccaacgagaagaauccccuggcuaaauaucaugaggaaaccggggaguaccucacaaaguauuccaagaaaaacaauggaccuauugugaaaagccugaaauacaucggcaacaagcuggggucucaccuugaugugacccaucaguuuaaauccagcacaaagaagcucguuaaacugucuaucaagcccuaucgcuucgacgucuaccugacggauaaaggauacaaguuuauuaccaucuccuaucucgacgugcugaaaaaggauaauuacuauuacauuccugaacagaaauaugacaaacuuaagcugggcaaagccaucgacaagaacgcgaaauucauugcuagcuuuuacaagaaugaucucaucaaacuggacggggagaucuauaagauuaucggcgugaacucugauacaagaaauaugauugaacuggaccuucccgauauccgguacaaggaguacugcgagcugaacaauauuaaaggagaaccgcgcaucaagaaaaccauuggcaagaaagucaacagcaucgagaagcucacaaccgacgugcuggggaauguuuucacgaacacccaauauacaaagccucagcuccuguuuaaaagaggaaauuga

SEQ ID NO: 3805 - RNA, 3165 nt, Artificial Sequence
  Cas9 variant
augaagcugacaccccucaacuacauccugggccuugaccuggggauugccagcgugggaugggcugucguugagaucgaugaacaggagaauccucucggccugauugacgugggggugagaacauucgaucgggccgaagucccgaaaacgggagagucccuugcgcuggcucgcagacucgcccggucugcccgcagacuggugaagcggcgcgcugacagaaucaaaaaggccaaacggcugcucaaggcugaaaacauucugcuuagcgccgaugagcaccuccccaaugacguuuggcaacugcgcgugaagggccuggaucagaaacuugagagacaggaaugggcggccguccugcuccaucugcugaagcaccggggguaucucucccagcgcaaaaacgagucuaagagcgaaaauaaagagcugggagcccuucuguccggcguggagaccaaccaucaaauccuccagucugcugaauacagaaccccugcugagaucgccguuaagaaguuucacguggaagacggccauauucggaaucagcgcggggcguauacccacacauucagcagacuggaucuucuggccgagauggaacuccuguuucagcggcaaaccgaccugggaaacccccacacauccgcuaaacuccuggagaaucuuaccgcccugcucauguggcagaagccugcucuggccggcgaggccauccuuaaaaugcuggggaagugcacguucgaacccaccgaguacaaagcugcgaagaacagcuauucugccgaaagauuugucuggcucacaaaacugaauaaccugcgcauucucgagcagggagcugaacgggcccugaccgauaaugagagauucgcccuucuggaccagccuuacgagaaggcuaaguuuacauaugcccaagcgcgcaccaugcucgcucugccggaugaagccaucuucaaaggcgugcgguaccagggggaggacaagaaagccguggaaacgaagacaauucugauggagaugaaggcuuaccaucagaucagaaaagcccuugaaaacgcugaccucaaggccgaguggaaugagcugaaaaacaacuccgaacugcucgaugacauuggaaccgcguuuagccugcacaagacagaugaggacaucugucgcuaucuugauggcaaacugucugaauccauccucaaugcccugcuggagaaccuuaauuucgacaaguuuauucaacucagccugaaagcucugcagcagauccucccccugaugcuucagggccaacgguacgaugaggccgucucugcuauuuauggggaccauuacggaaagaaguccgccgaaaucaacagacugcucccuaccauucccgcggaugagauccgcaauccuguugugcugcggacccugacacaggccagaaaagugaucaacgcugucgugcgccuuuauggcagccccgcccggauucacaucgaaacggggagagagguuggaaaguccuaccaggaccggaaaaagcucgaaaaacagcaagaggauaaucgcaagcagagagagucugcugugaagaaauucaaggaauauuuuccgaacuucgucggcgagccuaaagggaaggacauucugaaaaugcggcuguacgaacuccagcaggccaagugccuguacagcggaaaaucccuugagcugcacagacuccuggaaaagggcuauguggagguugaccaugcccugcccuucagccgcaccugggaugacucuuuuaauaacaaggugcuuguccucgcuaaugagaaccaaaauaaaggcaaccugacaccuuacgaauggcuggaugggaagaauaacuccgagcacuggcagaacuucguggcgcggguccagaccagcggauuuucucauaccaaaaagcagagaauccucagccacaaacuggacgaaaagggcuucauugagcgcaaucuuaacgauacaagauauguggcccgguuucuguguaauuucaucgcugacaacaugcuccugacggggaagggaaaacgcaagguuuuugccuccaauggccaaaucacagcccugcuuagagggcgguggggccugcagaaagugcgcgaugacaacgauagacaucacgcucucgacgccgucgugguugcgugcucuaccguggucaugcagcaaaagauuacccgguucgugcgcuacgaagagggaaauguguuuagcggcgagagaaucgaucgggaaacaggggagauuaucccccugcacuuccccuccccuugggcuuucuuccgcgaaaacguugagauuagaaucuuuagcgagaauccgaaacucgaacuggagaaccggcuucccgacuauccucaguacaaucaugaauuuguccagccccuguucgugucuagaaugccuacccgcaagaugacaggacagggccacauggagacggugaaguccgccaaacggcucgaugaagggcugagcguccugaaggugccccuuacccaacugaaacucucugaccuggagagaaugguuaaccgcgagcgggaagugacacucuaugagucccugaaggccagacuugaacaguuuggaaaugacccggcuaaagccuucgcggagccuuuucauaagaagggcggggcugucgugaaagccguucgcguggaacagacccaaaagagcggcguccuggugcgggauggaaacggcguugccgacaaugcuuccauggugagagucgauguguucacaaaagggggaaaguacuuucucgugcccauuuacaccuggcaggucgccaaaggcauccugccuaacaaggcuguuacggccaacguggacgagaucgauuggcuggagauggacgaaucuuaucaguucauuuuuaccauguaccccaaugaucuugugaaagucaagcugaagaaagaggaguucuuuggguauuacggaggccucgaccgcgcgacaggggccaucgugauuaaggaacacgaucuggagaaaagcaagggcaaacagggaaucuaucggauuggcguuaagcucgcucuguccuucgaaaaguaccagguggacgagcuugggaaaaacaucagaccuugucggcccaccaagcgccaacacgucagauga

SEQ ID NO: 3806 - RNA, 3165 nt, Artificial Sequence
  Cas9 variant
augaaggagaaauacauccugggccucgaccuggggauuaccagcgugggauauggcaucauuaacuucgaaacaaagaaaaucauugaugccggggugagacuuuuucccgaggcuaauguugacaacaaugaaggacggcgcuccaagagaggcucucggcgccugaaaagacggcgcauccacagacucgagcgggugaagcugcuucugacggaauacgaucucaucaacaaggagcagauuccuaccagcaauaacccguaucaaauccgcgugaaagggcuguccgagauucugucuaaggacgaacucgccaucgcgcugcuucaucuggcuaaaagacggggcauucacaauaucaacgucagcuccgaggaugaagacgccucuaaugagcucagcacaaaggagcagauuaaccgcaauaacaaacugcuuaaggauaaguacgugugcgaaguucagcugcagagacucaaagagggacaaauccggggcgaaaagaaucgcuucaaaaccacagacauccugaaggagauugaucagcugcucaaagugcagaaggacuaucauaaccuggauaucgacuuuauuaaucaguacaaagaaaucgucgagaccagacgggaguauuucgaagggcccggacaaggcuccccuuuuggguggaacggagaucuuaagaagugguacgagaugcugaugggccacuguacauacuucccccaggaacucagaagcgugaaauaugccuacucugcugaccuguuuaacgcccuuaaugaccugaacaaucucauuauccagcgcgauaacuccgagaagcuggaauaucaugagaaauaccacaucauugagaauguuuucaagcagaaaaagaagccuacccugaaacaaaucgcuaaggaaauuggggugaaccccgaggacaucaaaggauaucggauuaccaagagcggcacgccucaguuuacagaguucaaacucuaccacgaucugaagucuaucgucuuugacaaguccauccuugaaaaugaagccauucuggaucagaucgcggagauucucaccaucuaucaagacgagcagagcauuaaagaggaacugaacaaacuuccggaaauccugaaugagcaggauaaagccgagauugcuaagcucaucggcuacaacgggacacauagacugucucugaaaugcauccaccucauuaaugaggaacuguggcagaccucccgcaaccaaauggaaaucuucaauuaccuuaacauuaagcccaauaagguggaccugagcgagcagaacaaaaucccuaaggauauggugaacgacuuuauucucucccccgucguuaaacggacguucauccagucuaucaaugugauuaacaaggugaucgaaaaauauggcauuccugaggauaucauuaucgagcuggccagagaaaauaacagcgacgaccgcaagaaauucaucaauaaccugcagaagaagaaugaggcuacacggaaaagaauuaacgaaaucauuggacaaaccgggaaucagaacgccaagcgcaucgucgagaaaauucggcuucaugaucagcaggaaggaaagugucucuacucccuggagagcaucgcgcugauggaccuccugaauaacccccaaaauuaugagguggaucacaucauuccgagaucuguugccuuugacaacuccauccacaauaaagugcuugucaagcagauugaaaacagcaagaaaggcaaccgcacaccuuaccaguaucucaauucuagcgaugcuaagcuguccuacaaccaguucaaacaacauauccugaaucugucuaagagcaaagaccggauuuccaagaagaaaaaggauuaucuucucgaggaaagagacaucaacaaauuugaggugcagaaggaguucauuaaucggaaccugguugauacccgcuacgccaccagagaacugacaagcuaccucaaggcuuauuuuucugccaauaacauggacgugaaggucaagacgaucaauggguccuucaccaaccaucugcggaaaguguggagauuugauaaguaccgcaaucacggauauaaacaccaugccgaggacgcucuuaucauugcgaacgccgauuuccuguuuaaggaaaauaaaaagcuccagaacacaaauaaaauccuggagaagcccaccauugaaaacaacacaaagaaagucaccguggagaaggaggaagacuacaauaacguuuucgagacgccuaaacugguggaagacaucaagcaauaucgggauuacaaauuuagccacagagucgacaagaagcccaaucgccagcuuauuaacgauacacucuauucuaccagaaugaaagacgagcacgauuacaucgugcagaccaucacagacauuuacggcaaggauaauaccaaccugaaaaagcaguucaauaaaaaccccgaaaaguuucugauguaucaaaaugacccuaagacauucgagaaacucuccaucauuaugaagcaguacagcgaugagaaaaacccgcuggcuaaguauuacgaagagacgggcgaauaucuuaccaaauacuccaagaagaauaacgggcccaucguuaaaaagauuaaacugcucggaaauaaggugggcaaccaucuggacgucacaaauaaauaugagaacucuaccaagaagcuggugaaacuuagcaucaagaauuaccgguucgauguguaccucacagaaaaaggguauaaguuuguuaccaucgccuaccugaacgucuucaaaaaggacaacuauuacuauauuccuaaagauaaguaccaggagcugaaggagaaaaagaaaaucaaggacacggaccaguuuauugccuccuucuauaaaaaugaucucaucaagcugaacggagaccuuuacaagauuaucggcgucaauucugaugaccgcaacauuaucgaacuggauuacuaugacaucaaauacaaggauuauugcgagauuaauaacaucaaaggggaacccagaauuaagaaaaccaucggcaagaagacagagagcauugaaaaauuuaccacagacgugcucggaaaucuguaccugcacuccaccgagaaggcuccucaacuuaucuucaaacggggccuguga

SEQ ID NO: 3807 - RNA, 3165 nt, Artificial Sequence
  Cas9 variant
auggagaacaagaaucugaacuacauccucggccuggaccuugggauugccagcgugggaugggcugucguugaaaucgaugagaaagaaaauccccugagacucauugacgugggcgugcggaccuucgagcgcgccgaagucccuaagacaggggagucccuggcgcuuucuagacggcuggcucgcagcgccagacggcucacgcagcgcagaguggcccggcugaaaaaggcuaaacgccugcucaaguccgagaacauccugcuuucuaccgaugaaagacugccgcaccaaguuuggcagcuccggguggagggacuggaccauaaacuugaacgccaggagugggccgcuguccugcuccaccugauuaagcauagaggcuaucugagccagcggaagaaugaguccaaaucugaaaacaaggagcucggggcccugcuuagcggaguggauaauaaccacaaacugcuccaacaggcgacauaccgcucccccgccgaacuggcuguuaagaaguuugagguggaagagggccauaucagaaaucagcagggcgccuauacccacacauucagccggcuugaccugcucgcugagauggaacugcuguuuucuagacaacagcacuucgggaacccuuuugccuccgagaaacuccuggaaaaucuuaccgcgcugcucauguggcagaagcccgcccugagcggagaggcuauccuuaaaaugcugggcaagugcacauucgaagaugaguacaaagccgcuaagaacaccuauucugccgagcgcuuugucuggauuacgaaacucaauaaccugcggauccaggaaaaugggcuggagagagcccucaacgacaacgaacgccuggcucuuauggagcaaccuuacgauaagaaucggcuguucuauucccaggugagaagcauucucaagcugucugacgaagcgaucuuuaaaggacugcgcuacuccggcgaggauaagaaagccauugagaccaaggcugugcuuauggaaaugaaagccuaccaucagauccggaagguccucgaggggaacaaucugaaggccgaaugggcugagcugaaagccaaccccacacuccuggacgagauuggaaccgcguucagccuuuauaagacagaugaagacaucuccgcuuaccuggccggcaaacucucucaaccuguucugaaugcccugcuugagaaccucagcuuugacaaguucauccagcugucccugaaagcucucuauaagcugcuuccgcugaugcagcagggccucagauacgaugaagccugucgcgagauuuauggggaccacuacggaaagaaaaccgaagagaaucaucacuuucugccccaaaucccugcugaugagauucggaaccccguggugcugagaacgcuuacacaggcccgcaaggucaucaauggcgugguucggcucuaugggagcccugcgcggauucacaucgaaaccggaagagaggugggcaaaucuuacaaggaccgcagagaacuggagaaacggcaggaagagaacagaaagcagcgcgagaaugccaucaaggaguucaaagaauacuucccccauuuugcuggggaaccgaaggccaaagauauucugaagaugcggcucuauaaacaacagaacgcuaagugccuguacuccggaaaaccuaucgagcuucacagacugcucgaaaagggcuaugucgagguggaccaugcccugcccuucagccgcacaugggaugacucuuuuaauaacaagguucuggugcuugcgaaugagaaccagaacaaaggcaaucucaccccuuucgaauggcuggaugggaagcacaacagcgagagauggcgggccuuuaaagcucuggucgaaaccuccgccuuccccuacgcuaagaaacagcgcauucucucucaaaagcuggacgagaagggauuuaucgagagaaaucuuaacgauacacgguauguggcccgcuuccuguguaauuuuauugccgacaacaugcaucucacgggcgaagggaaaagaaaggucuucgcuagcaauggacagaucaccgcgcugcugcggucccgcuggggccuugccaaaagcagagaggacaacgaucggcaccacgcucuggacgccgugguuguggccugcucuacagucgcuaugcagcagaagaucacccgcuuugugagauucgaagccggggauguuuuuacaggcgagcggauugacagagaaaccggagagaucauuccccuccauuucccuacgccguggcaauucuuuaaacaggagguggaaauccgcauuuucuccgauaaucccaagcuggagcucgaaaaccggcugccugacagaccccaggcgaaucacgaguuuguccaaccucuuuucgugagccgcaugcccacacggaagaugaccggccaggggcauauggaaaccgugaaaucugcuaagagacugaacgagggaaucuccguuauuaaaaugccgcucacaaagcugaaacugaaggaucuugagcugauggucaaucgcgaacgggagaaggaccucuacgauacccugaaagccagacucgaagccuuuaacgacgauccugcuaaggccuucgcggagcccuuuaucaaaaagggcggggcuaucgugaaaagcgugcgcgucgaacagauucagaaguccggagugcugguucgggagggcaaugggguggccgacaacgccucuauggucagaguggauguuuucacaaaaggcggaaaguauuuucuugugccuaucuacacguggcaagucgcuaagggcauucugcccaacaaagccgcuacccaguacaaggacgaggaagacugggaggugauggauaauagcgccacauucaaauuuucccuccacccuaacgaccugguuaagcuggugaccaaaaagaagacaauccuuggguauuucaauggacugaaccgggcgaccggcaauauugauaucaaagaacacgaccucgauaagucuaaagggaagcagggaaucuuugagggcgucgggauuaaacuggcccucagcuucgagaaguaccagguggacgaacugggcaagaacauccgccuuuguaaacccuccaagagacaaccggugcgguga

SEQ ID NO: 3808 - RNA, 3168 nt, Artificial Sequence
  Cas9 variant
augaacaauuacauccugggccucgacauugggaucaccagcgugggauauggcauugucgauuccgacacaagagagaucaaggaugccgggguucggcuguuccccgaagcuaacguggacaauaacgagggacgcagaucuaaacggggcgcccgcagacuuaagcggcgccggauucacagacuggaucgcgugaaacaucuccuggcggaauacaaucuucuggaccucacgaacaucccuaagagcaccaauccguaucagaucagagucaaagggcugaacgagaagcuguccaaggaugaacucgugauugcucugcuucacaucgccaaacggcgcggcauucauaauguuaacgugaugauggacgauaaugacucuggaaacgagcugagcacaaaggaucaacucaaaaagaaugccaaagcucuguccgacaaguacgucugcgagcuucagcuggaaagauuugagcaggauuauaaggugcggggcgaaaagaaccgcuucaagaccgaggacuuuguuagagaggcccggaaacuccuggaaacacagucuaaguucuuugagaucgaccaaaccuucauuaugagauacaucgaucugguggaaacacgccgggaguauuuugaagggcccggaaaaggcagcccuuucgggugggagggaaauauuaagaaaugguuugagcagaugaugggccacuguaccuacuuccccgaagaacucagauccgucaaguacgcuuauagcgccgaacuguuuaacgcgcuuaacgaccugaauaaccucgugaucacgcgcgaugaggaagccaagcugaauuacggggagaaauuccagaucauugagaacguguuuaagcagaaaaagaccccuaaucuuaaacaaaucgcuaaggaaauuggagucucugagacagacaucaagggcuaucggguuaacaaauccggcaagcccgaguucacccaguucaaacuguaccaugaucucaagaauauuuuugaggacagcaaauaucugaacgaugugcagcugauggacaauaucgccgaaaucauuacaaucuaccaggauccugagucuauuaucaaggagcucaaccugcuuccggaacugcucuccgagaaggaaaaagagaagauuagcgcucugucuggguaugccggaacccacagacuuucccugaaaugcaucaaucuccugcuggacgaucucugggagagcucccugaaccaaauggaacuuuucacgaagcugaaucucaaacccaagaagaucgaccugucucagcagcacaaaauuccuaucaagcugguggacgauuuuauucuuagccccgucgugaaacgcgcguucauccaauccauucagguugugaacgccaucauugacaaguacggccucccugaggauaucaucauugaacuggcucgggagaauaacagcgacgauagacgcaaauuucugaaccagcuccagaagcaaaaugccgaaacacggaaacaggucgagaaggugcugagagaguacgggaacgacaaugcuaagcgcaucguucagaaaauuaaacuucauaacaugcaggaaggaaaaugucuguauucucucaaggauaucccccuggaggaccugcuuaaaaauccgaaccacuacgaaguggaucauauuaucccucgguccgucgccuucgacaauagcaugcacaacaaggugcucgucagagccgaggaaaauucuaagaaaggcaaccggacccccuaucaauaccugaauagcuccgagucuagccuguccuauaacgaguuuaagcagcacauccucaaucugagcaaaacaaaggaucgcauuaccaaaaagaagagagaauaccuucuggaggaacgggacaucaacaaauaugaugugcagaaggaguucauuaauagaaaccucguugacacccgcuacgcuacacgggaacugacgucucugcuuaaagcguacuuuuccgccaacaaucucgacgugaaggucaaaaccaucaacgggagcuucacaaauuaucugagaaagguguggaaguuugauaaagaccgcaacaagggauacaaacaucacgcugaggaugcccugauuaucgccaaugcugacuuccucuuuaagcauaacaaaaagcugagaaauaucaacaaaguucuugaugccccuucuaaggagauugacaagaaacgggugaccguccaguccgaagaugaguauaaucaaauguucgaagacacacagaaggcgcaggcuaucaaaaaguucgagauucgcaaauuuagccacagaguggauaagaagcccaaccggcagcugaucaaagacacccucuacuccacgcgcaauauugauggcaucgaguaugugguugaaucuaucaaggacauuuacagcgucaacaaugauaaagugaagacaaaauucaagaaggacccccauagacugcugauguaucggaacgacccucaaaccuuugagaaauucgaaaagguguuuaaacaguacgaguccgaaaagaauccguucgccaaauacuaugaggagaccggcgaaaagauccgcaaguuuucuaaaacagggcagggacccuacauuaacaagaucaaauaucuuagagagcggcucggccgccacugcgaugucaccaacaaguacauuaauagcagaaacaaaaucgugcaacugaagauuuauuccuaccgguucgacaucuaucaguacgggaauaacuacaagaugaucacaauuagcuauaucgaucuggaacagaaaucuaauuacuauuacauuuccagagagaaguaugaacagaaaaagaaagacaagcaaaucgaugacagcuacaaauuuauuggaucuuucuauaagaacgauaucaucaauuacaacggcgagauguaccgcguuauuggggugaaugacuccgagaagaacaaaauccagcucgauaugauugacaucagcauuaaggauuauauggaacugaauaacaucaaaaagacgggcgucaucuacaaaaccauuggaaagucuacaacccacaucgagaaguauacaaccgacauucuuggcaaucuguacaaagccgcuccucccaagaaaccucagcucaucuuuaagcgggggauggaauga

SEQ ID NO: 3809 - RNA, 3168 nt, Artificial Sequence
  Cas9 variant
augacccccaucagcgagucccuucucuucggccuggacguggggauuucuagcugcggaugggccguccuuaagcacuccgauacaacgggccauaucgaagcucuggggucuugguguuuuaacgccccugagaccaaaacagaaagaaccccgacaaaucagauucggcgcagcuccagacuccugcggcgcguugugagacggcgcagaaaccggaugaccgagauccgcagacuuuucgcgcggcacggacugauugacaaugaucgccccgacgcucucagacaaccugccaucgaucccugggaaaugcggggccaggggcuggaccgccagcugacaccugaggaguuugccguggcucucgcccauaucgcuaagcacagaggauucaaaucuagcgccaagcgggucaaauccaacgcgagccccgaugacucuaagaugcuggccgcucuugaaaagaccaaagagcuguccgcccaguacagaacgauuggcgaaauguuugcucgcgauagcgccuaugugcaacggagacgcaaucgggacggccucuucgauagaaccaucucucgcgacgaucugauugacgaggcgaagauccuuuuugaccggcagagaaaacuggggaacccuguugccuccacagagauugaagaggcuuucacccgcaucgccuuuuggcagaauccgaugcaggauagcggagugcucgucgcuucuugccccuucgaaccuaaggagaaacgguccagcagauuuucccccucuuucgaacgcuuucggcugcuguguagacucauuaaccugcgggugacagacggcccugaggagcgcccccuuaccgaagaggaacugagacucgccuacgagcaugccgggaagacgcggaagcugacagcugcggccaucagaaaacuuaucggacugcgcgaugaccaacacuucaccacaauuccgccugaacaggagaagcaggauaucaccagccggaccggcgagacauucgcugggacggccaccuuuagauccguucucggagaaagccuguggcgccagcugcucccccacccugaguggcuggacaaugccgcuuggauuaucucuuuccaugaacuuacagagaccauuaucaaaaagcugggcgaaaucggccuccccguggaggccuaugagcugauuugcgaugcgcuuaaauccgacaagagccccuuugcuaaauucaagggggccucuagccuguccgauaaggccgucagagcucucaucccuuaccugcaacagggacugacauaugacaaagccugucagaaggcuggcuacgaucacgccgcgucucgguuuagcgggcgcgccaccauugacacgaaagcuaaguucaacgcccucauggcugaagugagagacuccaucgccaauccgauugcgcggaaagcccugagcgagggaaugaagcaacuuugggcuaugcgcaacagauggggccugcccggggccaucugcaucgaacucgcucgggaugugggaaauucucuggagaagcgcaaagagauugaaagaaaccugaagacaaccgccaaacagcgggcccgcgagagagaagaggcuugugaacuucucaaucugaaggaggucuccagcgacauccugcuccgguauagacuguggaaagagcagggcggccgcugcuguuacucugggaaguccauuaccccugauaugcuuauggcgcaggacaaccggauccaaauugaucauauccugcccuggagcagauuuggagacgauuccuacucuaacaagggccucugccuggccaaagaaaaucaggcuaagaaaaaccagacaccuuaugaguggauucacgggcagggaaccacagcccaaaaggaacagugggacaaauucguugccgauguggagagccgcaagaauacgaagggccugaaaaagcggaacuuucuucucaaaggguccaaggaaaucgaggagagauuccgcucucggaaucugaacgacaccagauacgcugcccgccugaugguggaagcggcucggcuccuguaucccgccggccagagaggagagaaaggcgggacacggcgcgucuuuaccagaccgggagcccuuacagcugcccugcggcacgcguggggcguggaaagccucaagaaaaucgauggggagcgccugcaugacaauagacaccaugcucuggaugccgccauuguugcugccguguccgaagcugagauccagaagcugaccaagagcuuccaagagugugaacagaaaggacucucucggccuaugagagacgucgcgcccccuugggacggcuuucgcgaucagcugaaggagaaauacgaaacgauuuucguggcccggcccgagagacagcgcgcccgggggcaaggccacgaggcuaccaucagacagguucgcgaagaggaaacaggaccugugauuuaugagcggaaggccgucuccgcucugacccucgccgaccuggccaaaaucaaggaucccgacagaaacgcuggccuuaucgcgagccugcgccaguggauugaagccgggaagccggcugauaaaccucccagaacacccugccaucaaucugccgccggacacgagauccggaaggugcgccucgcuaccauuaucacgccugccgucccggugagaggcgggauggcgaaacggggagagaugacacgcguugacauuuucaaggugaucggcaaaaaggggaagcccgaaugguacaugaucccuauuuauccccaccagaucaugaauagaucccaguggccugcucccccuaacaaagccgucguggccggcaagagcgaggcugauuggcccauuaugggagccgaagcgcaguuucaauucucucuguacccgugcagcuacguucggcuguuuaaagagggcaccgugaucgaaggguauuucuguggaugccauagaucccgcgcuuacauuacacuugcccucagcaccggcgccgcuccucugcagaaggggaucggaaucaaaacccaggagcacauucagaaguuuucugucaaucgguucggcgagcugucccccgugaagcaagaaacaagaacguggcaugggguggccuguaccagcccugaccagcacgauuga

SEQ ID NO: 3810 - RNA, 3171 nt, Artificial Sequence
  Cas9 variant
augaaggcccugaacuacauccucggccuggaccuugggauugcuagcgugggaugggccgucguugagaucgaucagaaugaacugcccauuagacucaucgaccugggcgugcggaccuucgagcgcgcggaagugccuaaaacaggggauucccuugcucuggccagacggcucgcccgcucuagcagacggcugguccgcagacgggcugugcgccugcucaaggccaaaagacugcuuaagcaagaggggauucugcaggcugacgauuuucacuccucucaucucaaaccgcugcccaacaauccuugggaacuucggguuaagggccugaaccaccuccuggaccgcaaggagugggccgcggugcugcuccaucugcuuaaacacagaggguaucugagccagcggaagaaugaguccaaaacggauaacaaggaacucggagcccugcuuaaaggcgucucugagaaucgccagcugcuccaagcucaggccuucagcacccccgcugaaaucgccaucaagaaguuucagcaggaggagggccauauuagaaaccaacggggagcguacucccacacauucgacagaaaugaucugcuggccgaacuccgccugcuuuuucagaaacagcgggaguucaacaauccuuauaccagccagucucuggaacaagcuaucgccgagcuccugauguggcagaagcccgcucuuuccggagaagccauucugaaaaugcucggcaagugcacauuugagccuagcgaguacaaagccccgaagaacucuuauuccgcugaauacuucguguggcugaccaaacugaauaaccucagaauccuggagaauggggcggaccgcggacuuacagccgaggaacggcagcugcucauuaaccaacccuuugaaaaggcuaaguucaccuaugcccaggccagaaaacugcuggagcuuagcgaucucgcuaucuuuaagggcguucgcuacgggaaagacaacgccgagucugcgacgcugauggaaaugaaggcuuggcacgccauucggaaagcccuggaguccaauggacucaagaccgaauggaacggccugaagacaaaaccugagcuucuggauaagaucggcaccgcuuucagcaucuacaaaacagacgaagacauuucccaguaucucaauggggagcugucucccgccgugcugaacgcucuccucgagaaucugagcuuugauaaguucaucagacugucccuccagagccuggccaaaauucuuccucugauggaacaaggacuccgcuacgacgaggcguguaagcaggucuauggcgaucauuacgggaagaaagaacagcuggagcugcgguuccuucccaagaucccgguggaggacauuagaaacccugugguccuccgcacccugucucaggcccggaaaguuaucaauggaguggugagacuguauggcucccccgcucggauccacauugaaacggggcgcgaggucggaaagagcuuuucugaaagacgggauaucagcaaaagacaagaggaaaaccgcaaugagcggcagagagccguggagaaguucaaggaauuuuucccucauuuuguuggcgagcccaaagcuaaggacauucucaaaaugcgccuguacgaacagcagcacggcaagugccuuuauuccgggaaagagcuggaucucaacagacugcuggaaaagggauacguggagaucgaccacgcccuucccuucucucggacaugggaugacagcuuuaauaacaaaguccucgugcuggcguccgagaaucaaaacaagggcaaucagaccccuuacgaauggcugaacgggaaggagaacgccgaacgcuggaaacucuuccaggcucugguuaauggaagcagauuuccguauucuaagaaacagcggauucuuacaaaguaccuggaugaggacggcuuccgcgaaagaaaccucaaugacacccgguauguggcccgcuuucuguguaacuucaucgaggauaauaugcaacuggucgggcagggcaaaaagagaguguuugcuuccaacggacagaucaccgcccuucugcggcgcagcuggggcauucaaaaggucagagaggacaaugaucggcaucacgccguggacgcuguuguggucgcgugcucuacaagagcccuccagaaaaagaucacggauuacgugcgcuauaaagaaaugaacguuuucaccggggagaagauugaccaggaaacaggagagaucauuaaauuccauuuucccgagccuuggaaguucuuucggcaggaaguggagaucagagucuucuccgaaacccccgcugaggauguggugauugcccugccugaccgcccccaagccaaucacgaauuuauccagccgcuuuucguuagccgggcuccuacaagaaagaugaccggccaggggcauauggagacgaucaaauccgccaagcgccuggcggagggacuuucugucagccgggugccccugacacagcucaaacugaaggaucuggaaaacauggugaauagagagcgcgaaaaagcucuuuacgaggcccugaagguccggcucgaaaaguuuaacaaugacccugccaaagccuucgcugaucccuuuuauaagaaaggcgggcaacaggugaaggcgguuagaguggagcagguccagaaauccggcgugcugguucggcaagagaacggaguggcugacaaugccucuaugguccgcguggauguuuucauuaagggcgggaaauacuuucucgugccuaucuacaccuggcaggucgccaagggcauucugcccaacagagcugccacccagggaaaggaagaggaauauugggacaucauggacgagacagcuauuuuccaauuuagccuuuaccagaacgaucugaucaaacucgugaccaagaaaaagacaaucuucggguauuucaauggacugaaccgggccacguccaauauuaacaucaaagaacacgaccuggauaagagcaagggcaaagacgggauuuaccuugaggugggcgucaagcuggcgcucucucuggagaaauaucagguugaugaacucggaaagaauauccagccgugucgcuccaugaaaaagagaccucccgugcgguga

SEQ ID NO: 3811 - RNA, 3171 nt, Artificial Sequence
  Cas9 variant
augcccaagcagaaaagcaccagauaccggcuggcccucgaccugggcuccacaucucuugggugggcugugcugcgccucaacgagcaacacgaaccuaaugccaucauuagagcgggaguccggaucuucagcaacggccgcaauccgaaggauggguccucucuggcuguuacgagacgggccgcccgcgcuaugagacggcgcagagaccggcuucugaaacgcaaggccagaaugaugaacaaacucguggaguauggauuuuuccccgcugauguggccgaacggaagaagcuggagcgcauuaauccuuacgaacugagagcgaaaggccucgacgcuccccugaccccuggggaguuugcccgggcccuuuuccauaucaaccagagacgcggauuuaagagcaaucggaaaacagauaagaaagagaacgacuccggcgcucugaaggccgcgauuucucaccucagacagcagcugcaugaacgcaaggcccggaccgucggcgaguggcuuuggcaaagacugcaggcugggcucggaacacgcgcccgguauagagaaagccgcguggcucaggccaauggcaaaacccggaucgagaaguccuacgaucuguauguugacagacagaugaucgccgaggaguucgaugcucugugggcggcccaagcugccuuuaacccccagcaguucagcgagcaggcccgcggggaacuccgggacgugcugcuuuuucaaagagaucugcggccuguccgcccgggaagaugcacacuccugcccgacgaggaacgggcuccucuugcccugcccucugugcagagauuccgcauucuccaggaggcgaaucaccuucggcugcuccauccugaucugagagaggaaccccuuucccuggcucaacgcgacgccguuguggacgcccucgagcacaacagcaaaagaaccuuugaacagcugcggaagcugcugaaacucaauggcacggucaaguucaaccuggaggaugaaaaacgcaaggagcugaaggggaaugcuaccucugccacacucuccaaagacggacuguuuggcgagaacugguggaaccuugaugaagcucugcaggacgccaucguguggcagcucgugagcgagcaaucugaagagaagcugcagaauuggcugcaggcgaacaccggcgucaaugccacacaggcugaaaccauugccaacgcugggcuuccggagggauacggcucccucagcuauaaagcccuggcgagaaucauuccugcccugcgggggacggagguugcuaauggaaucgaugugccccgcacauacgaccaagccgugcaggcugccggcuucgcccaccauuccgaucucgacucuggguucgauuuugaacacagccaugacgaggucgaaagaauuggagagcgggugaucgcuuccaccggcgagguuaagccuguguucgcguuuaaacagcugcccuacuauggcaaggcccuucgcagacacgucgcuuucgccaaggaacacccccggaacgaggaagaacgcuacgggaaaaucgccaauccuacagugcauauuggacugaaccagcucagaguuguggucaaugcucugauccggagauauggccgcccgaccgaaguggucguggagcuggcccgggaucuuaagcaaagcagagagcagcgccaggaggaacagaaacggcaagcggacuaccagaagagaaacgaacacauucgccgggagaucgcuucuaugcaugggugugccgaagagagaguuucccacgccgacgugcagaaauggauucucugggaggaacugagcuuugaugucgcugaccgccggugccccuauucuggagugcaaaucagcgcccagaugcugcucuccaaucagguugagaucgaacauauucugccuuucucucagacccuugauaacagccugaauaacagaacaguggcgaugcggcaagcuaaucgcaucaagggcaacagaacgcccuggcaggcccgggaggacuuugaacgccaggggugguccuacgauagcauucuccagagagccgagcggaugccuaaggcuaaaagauaucgcuucucucgggacggcuacgagagauggcugaaggaagauaaagacuuucuggcccgcgcucuuaacgauacccgguaccucuccagagucgccaagacauauauggagcugguguguccccugggaacccgcgugaucccgggccaaaugacagcgcuccugcgggccaaauucgggcuuaaugacguucugggacucaacggcgaaaagaauagagaugaccaccgccaccaugcugucgaugccugcgugauuggggugaccgaccagggacugcugcagagauuugcucaggccagcgccgacgcucggggcaacgggcuugagaagcucgucgagaauaugccugugcccugggcgacguaccgcgaucacguuaaaagagccauccaauguaucugggugucucauaagccugaccacggcuaugaaggacccaugauggaggaaacagcuuacggcauucggaaagauggguccauccgccagaagaccaaagccgacggaagcaccggcagagagauuacacaccugauccggauuaccgaaccuacacagaaccugagacauggggucgaugcccaaggacagccccucgcuuauaagggcuacguugggggcuccaaugacugcaucgagauuacgcagaacgagcagggaaaaugggaaggcaaugugaucaccacauuccaagccuaugauaucgugcgccggcuggggucuaagcagggaccgagacgccuucggcacccuacccuggcgcagacacucgacgucuacggcaagcccaaaaagcuggugaugagacugaugauugaugacuguguucggcuugagcuggaugggaacaaaaagacccuccgcguggucaaaaucacgggaaauggccagguguuuauggcucccgugcaugaagccaacgucgacaagagaaauagcgauaagaccgacccuuucgccuacguuuccaaauaugcugggucuuuccaaaaggccaaagcgcggcgcauuacaaucagcccgauuggcgagcugcacgaccccggauuuuga

SEQ ID NO: 3812 - RNA, 3174 nt, Artificial Sequence
  Cas9 variant
augagcgacaaguccaaaauccugggcuucgauauugggaucaccucuauuggaugggccuacguggagggcgaagaacucaucgacugcggggucagaauuuuuacaaaggcugaaaaccccaaaacgaaggagagccuggcccuuccucggcgcgaagcgagaggaguucggcgcagacuggcucggcgcaaaggcagacucaaugccaucaagcagcugaucuguaaggaguucgggcuuaacuaucaagauuacauugcccaggacggagagcugccgaaggcuuaugccggcaaacucaucaaucccuacgaacugcgguccaaagcucugcgcgagaagcucgaaaaagaggagcuggccagagugauucuucacaucgcgaagcaucggggcuaugggaacaagcacgccaaagaaaccgaugacgcugagucuggaaagauuaaaaaggccaucagcaauaacgagaaaauucugaaugagaagggcuaccaguccgcuggggaauaucucuaccaggaguuuuuccaaaaagagcgccugcaggaagagaagaagggaaacaauacaaccaaagaauuuaagaacgugagaaauaaagccggcgauuacgagcauugcaucgcgcagacacagaugcaaaacgaacuucggcugaucuucgagaagcagcgcgaguuugggcucaauuucucugaagaguuuaaaaagaagguccuggaaaccgccuucuuucagagaccucugaaagacuucagcgauaagauuggagacuguacauuuaucgagggcgcuaaacgggcccccaaggauucccucagcgcuauugaguucguggcccugggcagaaucauuaacacccuuaaaaaucugcagaacacgucuggggaaguuuauucccgcgacaagaucaacgagauccuccaaauugugcuggauaagggagaaaucagcuacaaaaagcugcgggagauucuggacaucgaaucuuccgucagauucaaagacagcaagcucgauuauaccaaagagcugaaggaggccgaaaagacaaaacuguuugagucuaagaaucuccagaaauucaagaaagcucugggcuccuuugaagggauuagccgcgagauccuugacuccaucgcgaaggaaauuaugaucaccaaagauaaggagaagcuggccaaagagcucaagaaauucccucuggacgaaacacagauucaaaaccuuucuaaucugagcuuuucccagaccaucaaccucagccuggaggcucugucucagauucuccccuucaugcggggagaaagagaggauaagugccugcgcuacgacgaagccguggagaaagccggccuuaaggagguugcuaagaauaaauccaaggaugacuuucugccuccgcucgaaaacuaugagcccuaccuggccaauccuguggucgcgcgggcucugagcgaauauagaaaagugcuuaacgcccuccugcgcaaguacgggaaaaugcacaagauccauauugaguucacgcgggaagugggaaagucuaaagaggagagaaauaagaucgaaaaagagcagaaggaaaacuuugccaaaaaucaagaggcucagaagcagugugagauccugggccuccccauuaacggcgccaauauccugaagaugaaacuuuggcgcgaacagcaagagagcugcgucuacuccgggaaggaaauugcuaucgaugaccugaaaaacccugccauucuccagguugaucacaucuaucccuacucucggagcuucgacgacuccuauaauaacaaggugcugguguuuagcaaagagaaccagaauaagcugaacaaaacaccguucgaagcguuuggagagaauaaggauaagugggagaaaauccuuucucucgccuccaagcugccuaaacccaagagacagcggauuuacaacaugcaauucaaagacaaggaacagggcuuccugacccgcaauaucaacgauacaggguauauugcuagacucgucagccaguggaccaagaauugucugucuuuugagaaacuuuccgaagacgaggugagcaucgccggagaaaagggcuccaaaguucacguggaggucauuucugggagccugaccgcuaugcuccggcauuacuggggccugggagauaagaacagagacaaucaccuucaucacgccguggaugcgaucaucauugccuauuccaacgagaaaguuaucaaggcuuucucugacuacaagaaacaccgcgaacagaauaaggccaaauuuuacgcuaaggagauugccgaaagcgaguauaaaaagcaaaagguguucuuugaaccuacaaaccauuuccggcagaaaguccuugagaagaucgauuccauuuuugugagcaaaccucccagaaagcgcgccagaggcgcucuccacgaggaaacguucuacucuuuugagcggcugugcaaugacaaagaauaugcgaagaaggagaaaauggauuacgggggaaaggccggcauccagaaagcuaucgcccuggggaagauucgccaagucggaaccaaaaucguguccaacggcacaaugguuagaguggacauuuuccagcauaagagcaaugggaaauuuuauggcguccccaucuacaccauggauuucgcccucggagugcugccgaacaaggcuguugugucuggcaaggacaaacagggggucauuaaggacuggcuugagauggauuccaacuaugaauuuuguuucagccuguucaaagacgaucucauccuggugcagaagaaagagauggaaaaggccgagcugugcuacuacacagacuuuaauucuaacaccgcgggaauuaaguucgaaaaacacaauaaccuuuaugugaaucucaacgagaaugagcggaagcuguuuacgagcaaagaaguugucaagggcgggaaaaagaacguguggaaggauaaaacacccaaggagaucgaacaacuggagaaaaaucgcaagaucauuggaggcuucgugaccaucgaagaccucaaaaccuuugagaaguaccaggucuccccucugggggaggugcagaaggcugauuucgcccccagacaggccauuacacuuaaaagcucuccuaagcaucggaucaacaaauga

SEQ ID NO: 3813 - RNA, 3174 nt, Artificial Sequence
  Cas9 variant
augagcaacagagugcccuaccggcuggcccucgaccugggcaccaauuccaucggguggugccuucuggaucucaacggaaauggcgacccuugugggguccgcagaaugggaguucggauuuucccggauggccgcgaccccaagucuaaagagagccuggcugccgauagacggcuugcgcgcuccaugagacggcgcagagaccgguaucugcgcagacggucugcucucaugaacgcccugguggccgcugggcugaugccugccgaucgcgcuaccagaaaggcccucgaaagcgaggaccccugcgaacugcgggcgagagcccuuuuugagccucugacggcuggacaggugggccgcgcccucuuccaccugaaucaacggagaggcuuuaaauccaaccgcaaggcugccggggaagagaaugaggcgggaaaaaucaaggccggcauuucugcucuuaaggccgaaaucgaggcuagcggggaaaccacacugggagccuggcucgccgcucggcauagaaaacgcgagaccguccgggcgagacuggauggcgccggggcuaaggccuccuacgaguucuaucccgaacgcggacuggugcacgacgaguuucaggccauucggacagcucaggcccuccaucacccugcgguuaccgcugaacagugggauagaguggagagcgucaucuuccgccaacggccgcugagacccgugcggccuggcaaauguacacuuuuucccgaccaggaacgcgccccuugggcccugcccguugcucaggaguucagaauccucaccgagauuggcaaccugaaacuuuaccggccgggggaagaaccuagagaacugucugccgaucagcaugcucaacucuuugccaagcugugccgcuccgcggaccugacguucgagaagauccggaaggaacucaaacuggaccccggacuuaaggugaaucuggagggcgagaaaagagaucgccucaagggggacgccgucaccagcgcucugucugccaaaaagagauuuggaccuaaauggaacgcucuuacacccgaugaccggcgcgauauugugggcagacugaucgaagccgaggacgaagcggagcucgccggguggcuggaauccgugcacggacugcccagcgagaaugcugcccacaccgcugccucuccuggccucccggauggcuauugucggcuguccgagaaggcccuugucaagcugguuccccucaugcgcgaacagagacugcgguacgacgaggcugugcuggcgcuuaaccuccaucacagcgauuuccgcccugaagggcugcuggacgagcuccccuauuacggagagccucuggaaagauuuauugccuucggcuccggggagcccucugauccgccugaacagcaucuuggacgguuccccaauccuacagugcacaucggccugaacgagcuccgcaaacuggucaauagaauuguggaacggugggggaagcccgcugacaucguuguggagcuggccagagaccuuaaacgcagccgggaugagagagacaccauccagcgcgaacaagcccagaaccagcggaagaacgaggauagauuugcuaaaauuaaggaacucggcaucgacccucgccccgauuccaugcugcggcugagacucugggaggaacugccgaaggucggagugggccacguuugcguguacacgggggagccuauuggaauccgccggcuucuggagggcgacgucgauauugaccauauccuccccuucagcagaacacugucugauggggccgacaauaaaaucguguguguccggcgcgcgaacagauuuaagcgggaucgcucccccugggaggcuuucggagugaccgccguugacggcuaugauugggccgcuauugcccaaagagcggaggaacugccuaaaaauaagcgguggagauuucuuccggacgcuauggaccgcuucgagggggaacggggcuuucucgauagacagcugguggagacacgccaccugagccgggucgccagacaguaccucgccucuaucguggaccugaacaaaguucgcguggcucccggaaaacuuaccgccaugcugcgggcuagauggggccucaauaagauucugagcgaugggaaccugaagaaucgcuccgaccauagacaccaugccaucgaugcggccguccuuggaaugauugaccagcggcucgugcaacugguggcucaggccgcugcccgcgccgaggcuaacgaacuggagagacucuucgauggccugccugaccccuuugaugggcuugcggccaccucuuucggagaccagguucgggaaaagauccgcggcaucacagucagccacagagcugagcacggguggcagggccggaugcauaaugauacggccuauggaccuguggaggccgugaacggcguccacaccgugguuacaagaaaaccccuguccgggcucaccgcuaaggacuuuccuaauauucgcgaucgggugcuggccaaagcgcuggaagaccaugucgcugccgaggccgcugccggacgcagcuucggcgacgcgcuugggucuuuuaaguggggaggccaacccgugagacggguuagaaugcuggaugugcucgggaacccgaucccuauucaggaccccuccggcacagucuucaagguguacaaaggagauagcaaugcuugguaugaaauccugcgggacccucgcggcagauggaccgggaagauuguuucuacguucgaggccuaccggcuccaccgcgaauggcuggccgagacaggaggcgauuccgggagaggaagcggcguguuucuugacugggcugccaaacgggucgugggcgaggcugggacaccccuguuccgccucuuuaagggagaucugcuggcccuuggcgaagcgccggacagacggaucgugcgcgucguuaaauucuccgagggacagguggcccuggcucuccaccuggaagccgggaaccucaaggcuagagaugccgacaaaggcgauccuuuuaaguaucaguacugcucucccgacagccugcggaagcaagccgcuagaccugcggggguggaccuucugggauacguccaugauaaaggcccccucgaguga

SEQ ID NO: 3814 - RNA, 3174 nt, Artificial Sequence
  Cas9 variant
augagacggcugggccucgacaucgggaccaacagcauuggauggugccugaucgaggaugacaagaaaauuguggauaucggcguccgcauuuucuccgacgggagagaucccaagucuggagccagccuugcuguugaccggcgcgaugccagagcgaugcggcgcagacgggaccgcuaccugggcagacgguccgcuuuucuccaggcccugguggugcacgggcuuaugccugccgaugcugacgaagccaaacuggucgcugaucgcgacccguaucaacucagagccaaggcgcugcauguggcccuggagcccuucgaaaucggacgggcucucuuucaccugaaucagcgcagaggcuucaaaucuaaccggaaggccgauagaaaggcuaaugccggcgaggacgggaaaaucgcggaaggagccaaggcucuugaccaggccaugagcgaggcuggcguugauacacuggggcaguuucucgcccugaaagagacgaagcgcgugcggcuuggauccgacggccaagccuacgauuucuauccucagagacgccauauugaauacgaguuugaccggaucuggaaaguccagucugaauaucaccccgcucugcucaccgaggcggccagagcugcccugcaucgcauucuguucuuucagcggccucucaaggcccaagaggugggguucuguacauuugcuggaguuaacggcaucgccgcgaaugaaagacgccugcccaaggcucacccucuuuuccagcagcggagacuguacgaggaagugaaccagcuccgcauugucagcgccggcgccgcugaucggccgcugacccuugacgagagagaucggcugauccuccgccugcaagacagaaagaagguguccuuugauacacuggccaaaaaggaccuccggcuggcugauggggaaagauucaauaaagagagcgagaaccgcaaggaacuuauuggagacgaggugcgggccgaaaugucugacaaaaagagauucggcacccgcuggguccacuuugggcuggaugagcagcucagaauccuggcgaaacuucaggacgaagagaaucccgaggcccugcucgauuggcugcgguccgaauauggacuggacgaggcugccgcugaaagcguugccaacgcgcgccucccugagggcuacgggagauucggagaaacagccacccggcugcuucuggaugcucucaaagccgaggugaucacguacgacaaggcugcccugcgcgccuuuggccaucacucugauuucagaaccggcgaggugcuggaccggcuucccuauuacggggaacuccugacacgcgagauugcuccuggaaaacccgaauauggcgauccgcuggagagacaauacgggaagaucaccaauccuacaguccauauuggacuccggcagcuggagaaacuugugaacgcgguuaucgccgugcacggccgccccgaccagauugucguggaacuggcuagagagcucaagcugaaugaaaaggagaaagaugaacacaagcggagaaucaaacgcgacaccgaugccgccaucgcucgggggagaaagcuggccuccgagggcuuuauugacaacggagcgaaucgcaugcuuaugcggaucugggaggaacucaacccugcuaacccccuggacagacgcugccccuauugugccgagccuauuggcauccgggcccuguucagcggggaagcugauauugaccauaucaucccguacucuagaucccucgaugacaauguuggaaacaaaguggucgcccaccgcagcugcaaucgggcgaagggcaacaagacgcccuaugagaaaugggggccucauauugaucccgaaagaugggagcggaucuccgaccagguggcucgccugcacaagucuaaacaauggagauuuggaccugaugccauggagcggauugaccgcgauggcggguuccuugccagacagcugacagacacccaguaccucagccgggucgcuggcaaguaccugagaucccuguaucccacagcccagagcggacgcguggauguuaucccgggccggaugaccgcuaugcuuagacgcaaaugggggcucaauucucugcugccugaccauaacuacguggaaaaugagcacuccaacgcccccaagaaucggcucgaucacagacaucacgcgauugacgccgcugucgccgcugugaccacacugagccuuaugcaacagaucgccgacgccgcuggacgcgcggaagauaagaaccuggaccggcucuuugaggauauuccucagcccuggccuggcuucagagaggaacugggggaggcccugcgcucuacgaccguuagccauaaagcugaccacggaagaaagcggcgccccuccagagaucgggacgugacagccgcccgccuucacaaugauaccgcuuauggccucacaggggacgucgccgcggauggcaaaaccccgaucguggugcauagaguuccucuggcuucucugaagcccgccgaccucaucgauccccugcggauuccugacccgguccuuagagacgcccuguacgcugccacgcgcgaucggacaggaaaagaauuugagcaggcgcucacccaauucgcuagacaccauccccuguuuaagggcauccgccgggugagagugcgggaaccucugaacgucauucccauccgcgacgccgccgggagagcuuauaaagccuacaagggagaugcuaaugcccgguucgacguguggcgccuuccuaacggcaaguggguuagcgauauuguguccauguucgacgcgcacuguauggccgauaaaagcgacagacggccccauccugcugccaagaaaguccugucucuccgccagaaugauaugguggcuaucgagagauccgggguuacccagaucgcccggguggucaaguuuagcacaaacggaucuauugcccuggcugcggacaacgaggccggcgcucucaaagcccgcgaugccgcucccaaugacguggauccguucaaguauaucuuuuccagcgggggcggacugaagaaccuuaaagccagacagguucggguggacccucugggcagagucuucgaccccgggccucgcgaauga

SEQ ID NO: 3815 - RNA, 3177 nt, Artificial Sequence
  Cas9 variant
augaagaacagcuacauccugggccucgacguggggauugccuccgucggauauggccugauccacucugauagcaaauccguuauugacgcuggggugagacuuuuccccgaggccaauguggaaaacaaugagggacggcgcgcgaagagaggcucucggcgccugaaaagacggcgcauccauagacucgaucgggucaaguaccugcuugcucaguaucaccugauuaucgacgauaaaaucccuaagagcaccaacccguacgccauucgcgugaaggggcucuccucugcccugagcaaauccgaacugguuaucgcucuccugcaucuugccaagagacggggcauucacaaugugaacgucgugauggacgagaaugaaagcacaaacgagcugucuacgaaagagcaacucaaggaaaaugcuaaacagcuggagaaccgcuauguuugcgaacuucagcuggauagacucaaugagcaguacaaggugcggggagagcgcaacagauuuaagaccgaagacuucguccgggaggccagacaaauccugacaacccagcagaaauaucaugauauugacgaacacuuuaucgagcaguacacacaccuucucgaaacccgccgggaguacuaugagggccccgggaagggaucccaauacggcugggaaggggaucugaaacagugguaugagaugcuuaugggaagauguacauacuucccugaagaacugcgcagcgugaaguaugcguacaccgccgaccucuuuaaugcucugaacgaucuuaauaaccuggugauugcccgggacgaaaacgagaaacucgaguauuucgaaaaguaccauaucaucgagaaugucuuuaaacagaagaagucucccacgcugaaacagauugcuaaggaaaucgacguuaaagaguccgauauuaagggcuacagaaucaccaaaaacgggaagccucaauucaccagcuuuaagcuguaucacgaccucaauaaaauuuuccuggauaagaaaaaccuugaaaauaucgagcugcucgacgagaucgccuuuauucugacacuuuaccaggauccccugucuaucaaggaagcgcucgaccagcugcaagaucugcucacagaguccgaaaaagaggccauugcucaucugaacggauauaccggcacgcaccgccuuagccugaagugccuccaucugcugaucgacgagauguggcagacaucccggaaucagauggaaguguucaccgcccuuaaccucaagccucagaaauaccaacugucuaagcagaaacagauuccgaagaaaaugguggaggaauuuauccugagccccgucgugaagagauccuucauccagagcauugagaucguuaauacaauuaucaagaaauauggccucccugaagagauuaucauugagcuggcucgcgaaaagaacucugaggaucggagaaaauuccuuaaucgcauccaaaaggaaaacgagaauacccggaaacagguggaagaggucaucagagaguacgggaaccggaaugccaagggacugguggagaaaauuaagcuccaccagaugcaggagggcaagugucuguauucccugcaaaacaucccccuugacgaucuccugcgcaacccuagccacuacgaaauugaccauaucauucccagaucuguuagcuuugacaauuccuucaacaauaaagugcuggucaagcaggaggaaaacucuaaaaaggggaaucggaccccguaccaguaucucaacagcaaugaguccgugcugagcuacguccaguuuaaacaacacauccuuaaccugucuaaguccaaggagagaaucagcaaaaagaaacgcgaauaucuccuggaggaacgggauauuaauaaguucgaggugcagaaagaguuuaucaacagaaaucugguugacacacgcuacgccacgagagaacuugugcagcuccugaagucuuauuucuccgcuaacgaucuggacgucaaggugaaaaccauuaauggcagcuuuacaaacuaccuccggaaggcguggaaauucgauaagucccgcaauaaaggauuuaagcaucacgccgaggacgcucugaucauugccaacguuucuuaucuuuucaagcaaagcaaagaacugaaggaggccaacgcuauccucgaaaauaacaaucugucccugaacaaaaauaaggauucuaaaaaccuucucaccgagcaggacuacagaaagauguuugagaucccuaaacaggugcaggauauuaaggacuacaaggauuucaaauauagccaccgggucgacaagaaacccaaucgccaacugaucaacgauucccuguacagcacaagagaagugaaugagaaccauuauauugugcagaccguuaaggacaucuacgccaaagacaauacgaagauuaaggaucucuuucugaaaacaccugaaaagcugcugauguaucagcacgacccccagaccuucgagaaacucaugcuggucaucaagcaauacggggaagagaaaaaccccuucgcgaaguauuacgaggaaaauggagaguaccugaccaaguaugcuaaaaacgaaaagggcccuacaaucaaacggcuuaaguacauuggcaaaaagguggggacccaucuggauaucucuacaaauuuuuccggagccaagcgcaaagugguccagcucagcauuaagccguucagauuugacguguuccacucuaaagccggcuaucacaugcugacgcucaccuacauggauaucaagaaaaaggagaagcauuaucagauucugaaaaacgaauaccaggcucuuaaggagcgguauaaaguucccuccgacgcccaauuuaucgggagcuucuacuacaacgaucugauuucuaucaaugacgagcucuuucgcgugaucggagucaacaauagcacaagaaacgugguugaacugaauaugguggauauuaacuauaaggacuacugcgaucugaugggcaucaaaaagaccccucggauuuucaaaacaaucaccaagaagacggggaaaauugagaaguauuccaccgacauccuuggcaaucaguuuaaagucaagcccagcaaaucuccucagcugaucuucaagagaggagugcucuga

SEQ ID NO: 3816 - RNA, 3180 nt, Artificial Sequence
  Cas9 variant
augagacggcugggccucgacaucgggaccaacagcauuggauggugccugacacagggccccggggaugaggccgacggaaucguggauauuggcguccgcaucuucuccgacgggagagauccucaaucuggaacgagccuugcuguugaccggcgcgaugccagagcggcucggcgcagacgggaccgcuacauuggcagacgguccgccuuucuggauacccucguggcccacggccugaugccggcugacgccgaugaagcuaaacuuguggccgcgcuggaccccuauacacuccgcgccagagcucuggaggccccucugacaccccaugaaaucgggcgggcucucuuccaccugaaucagcgcagaggauuuaagucuaaccggaaggccgagagaaaaaccaaugaugcggacgacggcaagaucgccaccgcugccuacgcucuugaucgcgccaugcuggacgggggauucgauacacucggccaguuucugaacgcccaggaaaccaaacgggucagaauggacggggaggcucaaggauaugauuucuacccucagcgccggcauguggaguaugaauuugacagaauuuggacggagcaggcgaagcaccaucccgcccuucugaccgaaacagcucgcuacgcccuccaccggauccuguucuaucagagaccucugaaggcccaaguugugggcaaauguaccuuuguccacagcgaggaucgccucgcuaaggcccauccgcuguuccagcagcggagacuuuacgaggaagugaaucagcuggagguuacaacccccggcgaagcgaaccgcaaacucacgcuggacgagcgggauagacuugugcgggaacugucccacaagaaagcuauugccuuuacaucucucgccgcuaagaucaagcuggagccugggcagagcuucaauaaagccuccgagacccgcacacaacuggcuggagacgaagucagagccgugcucggcgauaagaaacgguuugggcccgcgugggagcauuucgacagagaccgccaguggaccauuguggaacggcugcuugaggaagaggauccugacgcccugcacgcuuuccucacccaagauugcggacuggacgaugagcacgccgcugccacagcgaagacgagccuucccgaaggcuacgggagacugggagccaccgcuacagcccgcauccucgcugagcugcaggccgaagucauuaccuaugacgaggccguuagacgguguggcuggcaucacucugaucaucgcacaggcgaaauccugccgcagcucccuuacuauggggagcugcuuaccagagacauucccccuggaacgcaggaucccaacgaucccccugagaaacgguggggccgcaucacaaauccgaccgugcacaucgggcugaaccaagugagacagcucgucaaugcuauuguggcgguucauggacggcccgaccagaucguggucgaacuggcccgcgagcugaaacuuaacgaaaaggacaaggaggagcacaauagacggauucgcagagauaccgcugccgccaucaagcgguccgaaaaacucacacaggagggcuuuccugacaccggggcuaacagaaugcugcugcgccucugggaagaccugaaucccgccaacccucuugaucggagaugccccuacuguggcgcgccgaucggaaugcgcgcucuguucgccggcgaggccgacguggaucacauuaucccuuauagccggucucucgacgauuccgcugggaacaagguuguggcccauagaagcugcaaucgcgcgaaaggaaaccggacacccuacgaaaaguggucugacgauccugacagaugggaugcuauuacggcccaagucgcccgccugcaccgguccaaacaguggagauuuggccccgacgcuauggcccggguggagaaggaugggggauuccugagccgccagcuuaccgacacacaguaucucuccagacuggcuggccgguaccugucuagccucuacccuaccaaggaggaaggguccgucuaugugauccccggccgcaugacagccaugcugagacggcuuuggggacugaaugauauucucagcgaccauaacaucguugagaauaaacacucuaacgcgccgaagaauagacuggaccaccgccaucacgccaucgaugcugccguggucgcuguguccacccggagccugaugcaaagaauugcccgcacggccggccaggcugaagaccggaaccuugauagacucuuugaggggcuggacccucccuggcccggauuccgcgaucagcugcgggacagacuccuggcgguuaccgugucucauaaagccgaucacggccgcacagggaccccugucccgggaaaggacgcuacagccggcagacuucauaaugauaccgccuacgggcugacgggcgaaacaagcgcuaaaggacuccccaucguggugcaccggguuccucugaccucccugaagcccgccgacauuacagauccugaccgcauccccgacccuguccuuagagaugcgauugagcgggcuaccgccggcaagauggggaaagacuuuaccgaugcccucgcuaaguucggacgcucuggcgcccaggagacagacagaaaaggggaacggcuguuuagaggaacgcgccgggugagagugcgcgagccccugggcgucaucccgauugcggaugcuagcgggcggguguauaaggccuacaaaggcgacuccaacgccagauucgauguuuggcggcucccugacggaaagugggugagcgauaucgucucuauguuugacgcucaccgccccgaucaaggcgacagacggccucaucccgccgcuaagaaagugcugucccuucgccagaaugauaugaucgccauugaaagagacggggcgccgcgggagaucguucgcguggucaaguucagcaccauuggaucugugcagcuggccgcuacaaccgaagccggcccucucaaagcuagagacgccuccccucccgauguugaccccuuucgguauaucaacagcuccgccgggggacugaagaaaauuaaggcucgccaagugagaaucgauccccugggccggaucuucgacccuggcccgagauga

SEQ ID NO: 3817 - RNA, 3180 nt, Artificial Sequence
  Cas9 variant
augaucgagcggauucugggcguggaccucgggaucagcucccugggaugggccauugucgaauacgauaaggacgaugaggcugccaacagaaucauugacugcggcguucgccuuuucaccgcggcugaaacacccaaaaagaaagagucuccuaauaaggccagacgggaagcccgcgggaucagacgggugcugaaccgcagacgggugcgcaugaauaugaucaaaaagcucuuucugagagcuggacuuauucaggaugucgaccuggauggcgaagggggaauguucuauagcaaggccaaccgggcugacgugugggagcuccgccacgauggccuguacagacugcucaaaggcgacgaacuggcccggguucuuauccauauugcgaagcaccgcggguauaaauuuaucggagaugacgaggccgaugaagaguccggcaaggugaaaaaggcuggggucgugcugagacaaaauuucgaggccgcuggaugucggacgguuggcgaauggcucuggagagagcgcggggccaacggaaagaaacggaauaagcauggcgacuacgaaauuucuauccacagagaccugcuuguggaggaagucgaggcgauuuuuguggcccagcaggagaugcgcagcaccaucgcuacagaugcccugaaagcugccuaucgggaaaucgccuucuuugugagaccgaugcagcgcauugagaagauggucggccauugcaccuacuuccccgaggagcggagagcuccuaaauccgcgcccacagccgaaaaguuuaucgcuauuucuaaauucuuuagcaccguuaucauugacaacgaggggugggagcaaaagaucaucgaacgcaagacacucgaggaacugcuggauuucgccgugucccgggagaaaguggaauuuagacaccuccgcaaguuccuggaccuuagcgauaaugagauuuucaaaggacugcacuauaagggcaaaccuaagaccgccaagaaacgggaggcuacgcucuuugaccccaacgaaccuaccgagcuggaauuugauaaggucgaggccgagaaaaaggcguggaucucucuuagaggggcugccaaacugcgggaagcccucggaaaugaguuuuacggccgcuucguggcucuggggaagcaugccgacgaagcuacaaagauucugaccuacuauaaagaugagggacagaagagacgggaacucacaaaacugccgcuugaggccgagaugguugaaagacuggugaagaucggcuuuuccgacuuccucaaacugagccuuaaggcgauucgcgauauccugcccgccauggagucuggcgcucgguacgacgaagccguccucaugcugggggugccucacaaggagaaauccgcuauccugcccccucucaacaagaccgacauugauauccugaaucccacgguuauuagagccuuugcgcaguuccgcaaaguggccaacgcucuugucagaaaguauggagccuuugaccgggugcauuucgaacuggcucgcgagaucaauacaaaaggcgagauugaagauaucaaggagagccagagaaagaacgaaaaggagcggaaggaagccgccgacuggauugcugagaccucuuuucaagucccgcucacacgcaaaaacauccugaagaaaagacuguacauccagcaggaugggcggugugcguauaccggagacgugauugagcuugaacgccucuucgaugagggcuacugcgaaaucgaccacauucugccuagaucccggagcgccgaugacuccuuugcuaauaagguucugugucucgcccgcgccaaccagcaaaagaccgauagaacacccuaugagugguucgggcacgacgcugcccgguggaaugcguucgagacgagaaccucugcuccuagcaaccgcgugcggacaggcaagggaaagaucgauagacugcuuaaaaagaauuuugacgaaaacuccgagauggccuucaaagaccgcaaucugaacgauacccgguacauggccagagcuauuaagacauacugcgaacaguauugggucuuuaaaaauagccauaccaaggcccccgugcagguucgcucuggcaagcucacguccgugcugcgguaccaaugggggcuggagagcaaagacagagaaucucacacacaucacgcggucgaugcuaucaucauugccuucagcacccagggaauggugcagaaacuuuccgaguauuaccgcuuuaaagagacccaucgggaaaaggagagacccaaacucgccgugccucuggcuaacuuccgggacgccguugaagaggcuacacgcaucgaaaauaccgagacagucaaggagggcguggaagugaagagacugcucauuucucggccgccccgcgccagagucacggggcaggcgcacgagcaaaccgccaaaccuuauccccggaucaaacaggugaaaaacaagaaaaaguggagacuggcuccuauugaugaagagaaauuugagagcuucaaggccgaccgcguugcuuccgccaaucagaagaacuuuuacgaaacaagcaccaucccccggguggaugucuaucacaaaaagggaaaauuccaucuugugccgaucuaccugcacgagaugguucucaaugaacugccuaaccugucucuuggcacaaaccccgaggccauggacgaaaauuucuucaaguuuuccauuuucaaagaugaccucaucagcauucagacccaagggacgccuaagaagcccgcuaaaaucauuaugggcuacuucaagaacaugcauggagcgaauauggugcugucuuccaucaacaauagcccuugugagggcuuuaccugcacacccgucuccauggauaaaaagcacaaagacaaguguaagcugugcccggaggaaaacagaaucgccgggcgcugucuccagggauuccuggauuauuggucucaggagggccuucggccucccagaaaagaauuugagugcgaccagggggugaaguucgcucuggacguuaaaaaguaccaaauugauccccucggauauuacuaugaagugaaacaggagaagcgccugggcaccaucccucagaugcggagcgccaagaaacuggucaagaaauga

SEQ ID NO: 3818 - RNA, 3180 nt, Artificial Sequence
  Cas9 variant
augagcaagagacugcgguaccgccucgcccuggaccuuggcaccaacuccaucggguucugccugcucgaucugaauggagacggcagacccuguggggugcggcgcaugggagucagaauuuuuccugauuucucuaaacuucagcaaagccuggcugccgaccggcgccucgcgagauccaugcggcgcagacgggaucgcuaucugagacggcgcaaggcucugaugaacgcccucguugccgcugcccugaugccggcugaccccaaagccagaaaggcgcuugaggcccuggauccuuacgaacuccgggcugccgcuguggccggcccccugccugcgcaccagcuugggagagcccuguuucaucucaaucagcgccggggauucaaaucuaacagaaaggcugccggcgacgagaaugaagcuggcaaggugaaaagcgggaucuccgcccugaaggccgagcuggcugcgucuggagccggcacacucgggcaguggcuggcugcccgccacgccaaccggcaacccgucagagcucgccuuacgggaaccggcgccaaagcgacauauagcuuuuacccugaacgggcucuggugcaugaggaguuccaggccauuagagccgcucaggccccgcaccaucccgggguuaccgcugaacagugggaucgcaucgaguccgugauuuuucaccaacggccucucaagcccgucaaaccuggaaagugcacacuguaucccgaagaggagagagccccgugggcgcuuccuaucgcccagcgcuuccggauccugcacgaacuccauaaucugagaauugugcggcccggccagggcgaggaagggcugagcccugcugacuuugaucgcuucuuugacagacucugucggaagggagaucugaccuucaaaacacuugccaaggagcugaaacucccucccgacgcuagaaucaaccuggaagacgauaagcgcgaccggcuuaaaggcgaugccaccgcggacgcccugucugcugagaaggggaaaagacgcagaauuggagccgcuuggcacuccuuucccgccgaucggcagcgcgagaucguuggcagacucauugacgccgaagaugagggggaacuggcugcguggcugguggaggaacucggacugccgugggaggucgccauccuuacggcugagcggcccggccugccugacggcuacugccgccucagcgaaaaggcccuggagcaaguggugccccugaugcaugaggaacaccuuccuuaugaugaagccgucagagcucucgggcugcaccauucugaccaccggaccggagaguuccuggaugagcuccccuacuacggccugccgcuugaacgcuucauugccuuugggacaggagaggcggacgacccucccgaacugagaaucggccgguucccuaaucccaccguucauguggcucucaacgagcugcgcagaguggucaaucggaucauuagacgcugggggaagccugaggaaaucgugguugagcuggcccgggaucuuaaacaguccagagccgaccgcgauaagacacagcgggaacaagcugacaaccagaaaaagaauuggaccagaacgcagcagcuccgcgagcugggcauggaacccacaggagaggcccugcuccggcugagacuuugggaggaacugccgcgcauuggcagcgcgcacgugugugucuauaccgggcaaccuaucucuaugacacagcuccugcagggagauguggacguugaucauauucugcccuuuucccggacccuugcuaacggcgccgacaauaaaaucgugugccacagacgggccaaccgcaucaagagaaaccggacccccugggaggcuuucggggucgugagcgccgauggauacgacugggcugccauugcggaacgcgccgagucccucccuaagaauaaaagauggcgguuucugccgaacgcuauggaaagauucgagacagagcgcggcuuuaucgaucggcagcuggucgaaacgagacaccucucucgcguggcccgggaguaucugggguguauuguuccccuugaaaaggugagagcugccccuggccgccugaccgccaugcuccggggaagauggggccugaauagcauccuguccgacgcuaaccuuaaaaaucgcagcgaucauagacaccaugcggucgacgccgcugugcucgggguuauugaccaacggcuggugcagcgcgucgccgaugccgcuaagagagccgaggaaaaagagcuggagaaacucuucgacggacugcccgauccuuuugaaggccuucccgggccuucuuuccgggaccaggugcaggagcgcgcgcaaggaaucaucgugucccacaagcccgaacacggcuggcaggggagaaugcauaacgauacagcuuacggcccgguugagcggcugccugacggaacccacagagucgugacacgcaagccccucggcagccuggccgagaaggauuuugggaauauucgggacagagcccuggcugccgcgcuugaacgccauguggcugagcaggccgcccagggacggucucugggcgaagcucucagcugcuucaccuggacagggggagaggucagacgggugcgcaugcuggauaaacucggcuccccuguugccgugcaagacgaugacgggcacacguuuaagcuguauaaaggcgauucuaacgcuugguacgaaauccuuagagacggacggggccgcuggaccgggagaauugucagcaccuaugaggccuaccggcugcaugcggaguggcucgccgaacgcggagacggcgggagauccgaugcugccuuccccgacugggcugcccggcgccugugugccggaaucggcaagccgcuguucagacuuuuuaagggcgauaugcuggcuuucgggacagcgccuaaucgggagauuaugaaagugguuaaguuuagcgaaggaagaaucguguucgccggccaccgcgaggcugggaaccucaaagaacgggacgccgauaaggacgaucccuuuaaauacagaaccugcucuccugaggcccugcgcaaggcucaggcccggcccgucggaguggaccccgcgggcuucguucacgauagagggccucucgaguga

SEQ ID NO: 3819 - RNA, 3180 nt, Artificial Sequence
  Cas9 variant
augggcaucagauucgccuuugaccuggggaccaacagcauuggaugggcuguguggcggacaggccccggggucuucggagaggauacggccgcgucccucgacggcucugggguucugaucuuuaaggauggacgcaauccuaaagacggccagagccuugcuaccaugagacgggugccgcgccaauccagaaagcggcgcgauagauucgugcugcggcgcagagaccuccuggccgcccuucggaaagcuggccuguuucccgucgauguggaagaggggcgcagacucgccgcuacagacccuuaccaccuccgggccaaggcgcuggaugaaucucucacaccccaugagaugggacgcguuauuuuccaccugaaccagagacggggcuuuagaagcaaucgcaaagccgaccggcaggauagagaaaaggggaagaucgcugagggauccaaacgccuugccgagacacuggcugccaccaacugccggacacucggcgaguuccuguggucuagacaucgcgggaccccucggacgagaagccccacccgcauucggauggagggagaaggcgcgaaggcccuuuaugcuuuuuacccuacaagagagauggugcgcgccgaguucgaacggcuguggaccgcucaguccagauuugccccggaccuccugacacccgagcggcacgaagagaucgccggcauccuguuccgccaaagagaucucgcuccucccaaaauuggguguugcaccuuugaaccuagcgagcggagacugccccgcgcgcuuccgucugucgaggcccggggaaucuaugaaagacuggcucaucuccgcauuacgacaggcccuguguccgacagagggcugacccggcccgagcgcgacguucuugccagcgcccugcucgcuggaaagucucugacauucaaagccgugagaaagacccugaagauccucccucacgcgcuggucaauuucgaagaggcuggcgaaaaagggcuugauggagcccugaccgccaagcuccuguccaaacccgaccacuacggcgcugccuggcauggccuuagcuuugcugagaaggauacauucguggggaaacugcucgacgaggccgaugaagaacggcugauucgcagacuggugacggaaaaccggcucucugaggacgcggcccgcagaugugcuuccaucccccuggccgauggauauggccggcuugggcgcaccgcuaauacagaaauucuggccgcgcucgucgaggagaccgacgaaacaggaaccguugugacguacgccgaggcugugagacgggccggcgaaagaacagggcgcaacuggcaccauagcgaugagcgggacggcgucauccuggauagacugccuuauuacggagagauccuucagcgccacgugguuccgggcuccggggaacccgaggaaaagaaugaggcugcccgguggggaagacucgccaacccuaccgugcacauuggccugaaucagcugcgcaaagucgugaaccggcucaucgcugcgcaugggagacccgaccagauuguuguggaacuggcccgcgagcuuaagcugaaucgggagcaaaaggaaagacucgaccgggagaaccgcaaaaauagagaagagaacgaacggcgcaccgcuauccuggccgagcacggacagagagauacagccgagaacaagauucggcugagacuuuuugaggaacaggcucgcgccaaugcgggcaucgcucucugcccuuacaccgggcgggccaucggcauugccgaacuguucacaucugaggucgaaaucgaccauauucugcccgugagccucacgcuggaugacucccuugcuaacagaguccugugucgccgggaggccaauagagagaaacgccggcagaccccguuucaagcguucggagcuaccccugccuggaacgauaucguggccagagcugccaagcugcccccuaauaaacgcuggagauuugaccccgcugcccuggaacgguucgagcgcgaaggcggguuucugggaagacagcuuaacgagaccaaguaucucagccggcuggcgaagauuuaccugggcaaaaucugcgauccugaccgcguuuaugugacacccgggacccucacgggacugcuuagagcccgguggggccuuaauucuauccucuccgauagcaacuucaagaauagaucugaccaccgccaucacgcugucgaugccgugguuauuggggugcugacccggggcaugauccagagaauugcucacgacgccgcccgcgcugaggaucaagaccuggaccgggucuuuagagaugugccggugccuuucgaagacuuucgggaucauguucgcgagagagucagcacaaucaccguggcggugaaacccgaacacggaaagggcggggcccuucaugaggacacauccuacggacucguccccgauaccgacccuaacgcugcccugggcaaucuggugguucggaaaccgauucgcucucucacggccggggaaguggauagaguccgggaccgcgcucugagagcccggcuuggagcgcuggcugcccccuuccgcgaugagagcggcagagugcgggacgccaaggggcucgcucaggcccuggaggcguucggcgcugaaaacggaaucagacgcguucggauucugaagccugaugccuccguggucacaaucgccgacagacgcaccggcgugcccuaucgggcuguugccccuggggagaaucaccacguggauaucguccagaugagagacggaagcuggcgcggcuuugcugccucuguguucgaagugaaccggcccggguggagaccugagugggaagucaaaaagcugggaggcaaacugguuaugcgccuccauaagggcgacaugguggagcuguccgauaaagacgggcagcggagagugaaggucgugcaacagauugagaucagcgcgaaucgcguucggcucucuccccacaacgauggaggcaagcugcaggacagacaugccgaugcugacgauccguuucgcugggaccuugccacaauuccucugcucaaagauagaggguguguggcuguccggguggaccccaucggaguugugacccugcgcagauccaacgucuga

SEQ ID NO: 3820 - RNA, 3183 nt, Artificial Sequence
  Cas9 variant
auggccgucaagagccugaacuacauccucggccuggaccuugggauugcuuccugcggaugggccgugguugagauggaugaacaggagaauccccugagacucaucgacgugggcgugcggaccuucgaagaggcggaaaacccuaaagaugggucuagccuggcugagacacgcagacuugcccgggcccaacgcagacugauuucccggcgcgcuaauagaaugaacaagcuccggcgccugcugaaacaggagaauguccuccaggccaacgacuaugaugaaaagggacugaucauuggccuuccgaaucaggcuugggagcugagagcccaagggcucgaccggaaacuggaacccaaggagugggcggccgugcuuauccaccugguuaagcaucgcggauaccucucucagcggaaaaacgagagccagacggcugauaaggaacugggcgcccugcucuccggcaugaaucacaaccaucagcugcuucaaucucagagcaaucaguauagaaccccugcugagcuggccaucaaacaguuugcgacacaagacgggcacauucgcaaccagagaggagccuacacccauacauucaaucggcucgaucugcagaacgaacuuaaucaacuguuugacgcucagaccagacucggcaacccccacguguccgggagccugaagacagccaucaacgaucugcucaugaaucagaaagcugcccugucuggagacgccauucuugagaugcugggccgcuguaccuucgaaccuuccgaguauaaggcugcgaagaacacguacagcgccgagcgguuugucuggcucgggaaacugaccaaucuuagaauccaggauaacggacuggaaucugcucucucccgcgagcaacgggaacugcugcucaaugagcccuauaacaagacaaaacugaccuaccaacaggugagaaaacuucugcgccucccugaaacagccuucuuuaagggccugcgguacggcaaggacaaugccgagagcgcuacccugauggagaugaaaucuuaucacgccauuagaaagucccuugaaaacaagagccucaaauccgagugggaaaagcugaaaacgcagccgaagcugcucgaccugaucgggacagcguucucuauuuacaaaaccgaugacgagaucgcuggaugccuuaagaaucagcugcccgaaaacguuaucauugcccuccaggagcagcugaauuuuagcaacuucauggagcugucccuuaaggcccucgaaaaacugcugccucucauggagcagggccugcgcuaugaugaggcuuguacacaaaucuacgggaaucggcaugaaaagauugccgacaaaaccgagaaguuucuucccaacaucccugcugauaaacugagaaaucccgugguccuccgcacccugacacaggcccggaaggugauuaacgcgaucaucagacgguauggaagcccggcccgcgugcacauugaaacgggcagagaggucgggaagucuuucuccgaccgggauaaacugaagaaacagcaggaagagaaccaagaacagagacgccgggcuaucgacgaguggaagcaguuuuucccuaaugccgcucaugagcccaaagccguugauauucuuaagcucagacuguaccaacugcagcagggaaagugccucuauagcggccugccuaucgacgugcgcagacuucccgaaaaaggcuacguggagauugaucacgcgcugcccuucucucggaccugggacgacagcuuuaacaauaagauccucguccuggccuccgaaaaccagaauaaagggaaccaaacaccuuacgaguaucugcgcggagcugauaauucugaaagcuggagacuuuucguggagaacguucagaauugucaguuuuccccgaacaagaaacagaagaucauggccaaacaacucgacgagaagggcuuccuggaacggaaucugaacgauacccgcuacgugagcagauuucucugccaguucauuucugaguaucugcaccuuacagggaaggggaaaaagcgggucuuugcuuccaauggccagaucaccgcccugcuccgcgggagauggggccugagcaaaaaccgggaagagaaugaccgccaucacgccguggaugcuguuguggucgcguguucuacgguggccaugcagcaaaagauuacacaguucgucagauaccagaaaggaaacguguuuaccggcgaacggaucgacaaggagaccggggagguuauuuccauccauuuccccacaccuugggaacacuuuagagaggaagugaugauucgcgucuucgaugacaacccccugcggacccuuccugagaagcugcccaauagaccggaggcucuccaugaauaugugaugccucuguuuguuagccgcaugcccacacggaaaaugacgggacaaggccacaaggagaccaucaaauccgccaagagacucgaugagaaaaucucugugcugcgcgucccucuuacacagcugaagcucaacgaccuggaaaauauggugaaccgggaaagagagcccgcccuguacgaggcucuuaaggcccgccuggaacaguucaaaaaugauccugcgaaggcuuucgccgagcccuuuuucaaacagggaggacaacaggugaaggccguucgggucgaaauugugcagaaaagcggcaugcuccugagaaagaucaacgggguggcugacaauggcuccaugguccggguggauguuuuugagaagucuggaaaauucuaucucgugccgauuuacgccuggcaggucgcggaaggcauccugccuaaccacgcugugguucauagcaaggacgaguccgacuggauucuuauggaugagagcuaccacuuuaaauucgcccuguauaagaaugaccuccuggaagugcaaaccaaaaaggggugcaucaugggauacuuugccucucuggaucgcgcuacaggcgccaucaccauuagagagcaugaccgggauaaaaagaaguguaaagacggggaacaccgcuccaucggagucaagauggcuagcucuuucaagaaacuucagguggaugagcugggcaaaaacauucacgaaacgagaucccggaagagacccaauaucggguga

SEQ ID NO: 3821 - RNA, 3186 nt, Artificial Sequence
  Cas9 variant
augcacacccugcccuacacacucggccuggacaucgggauugccagcgugggagcugcccuucuguccgaugagucuauccucggcaugcaugucagaacguucagcgcggcugaaaccgacaaggagggggauccucugaacaaaauucggcgcgaagccagauccgcccggcgcagaauccggcgcagagcucaccggcuucugcgccucagacggcugcugaagcgcacaggacucauuucugacaccagccuggagguucuuaaaacauccaagaccccguggcagcugagaucugaaggccucgaucggcugcuuagccccuccgagcuggccgcugcccucuaucauaucgugaaacaccgcggguuucaaagcaauagaaaggcggagcugaagacagacgccaaagcuggacagaugcugucuggcguguccgccaaccagcagcucaugcgggauaagagcuacagaaccaucgcugaaauggucugcaaagacgaugccuucaaggaccauaaacgcaauaagggcgggucuuaucggaacacguuugcgagauccgaucuggccgacgagcuuaagacccugcucaaaaagcaacgcgaauacgauaauccucuggcuacacccgagcuugaggaagccgugcacacccugcucauggcucggagaccuguuuucaaagacgacgauauugagaagcuggugggauuuuguacauucgaacacggcgagaaacgcgcccccaaggccgcuuuuagcucugaacgguucaucuggcuggggaaacucaacaaucugagacuuauuuauccuggagagcagcgcucccugaccccggaggaacggagccagaucauuaaccuccccuuuacgcaggcguccgucaaguucucucaaaucagaaagaaacuggaccuuccugaguacgugcgcuuuaaucugguucgguauaagcccggcgaagagacaagcaaauccgaaaccgccacauucuuugaggcuaaggccuuccaugagcucagaaaaaccuaccgggaaagcgggauuucugagcugugggaacgcgaucagcacgacccucagagacuggaucagaucgccaccgcuaucgccguguaccgggacgaugagagaauuagaaacgaacucagcccccauacaaucgagaaugaggucguggaagcggugcugaacugcgacuucacgcaauuuauuaaucuuagccugaaggcucucaacaagauccugccguauauggagcagggacagcgguacgaugaagccuguaccucugccggcuaucaacaccacagcccucagcagaaugaggagaaauccggccgcauucccccucccgacaagaacgucauccgcaaccccguuguguacagaucucugaaucaggcucggaaacuuaucaacgccauuacaaagcgcuauggggcuccugccgcgauccaucucgaaauggccagagaucugagcaaaccguucuccgagcggaaguccauugaacgcgagcaagaaaaguacagaaaacagaaggugcagcugcggaaugaguauaucgagcacuuuggaaccgaacccaacggccucaaucugcuuaaauuccgccuguacaaggagcaggacgcucaaugcgccuacacacagaaagcucucgaccugucuagacugaacgaagccggguaugucgagguggaucauauucuuccuuacucccggagcuaugacgauucucuccugaauaagacccugguucucacggaagcgaaccgcgacaagggaaauagaacacccuuugaguucaugggcggggaugaccagucccagcacuggcaaaaauuugugcgguggguccagaugaacccuaagaucagacaggccaaacgcaaucgguaccugagaaaggauuucagcgagaaagcugcccgcgaauuucgggacagacaucuuaacgauacccgcuauaucggacgggagcugaaggcuaugauugaaucccacgugcaguggcaccccgacucuaaaagcaaggauuguugcguugugcucuccggccaacugaccgcccugcuuagaggccgcuggggguucaauaaggaccgggccgcuggagaucuccaucacgcggucgacgccgcuguggucgccgccgcuacaagaggcaugauccagcggauggcccgccauucuaaauuucacgagcugaagaacgugagaaccagcuacgcggacccggauacaggggaaguugugaaucuggcugccgcccgggaccucgagaaacacuucccucugcccugggauaacuuucgcaacgacacgcuugcuuaucugaauccuuccgccauuagcgcggaugagucugcucaggaaggacauagaggcguccggguguccagagcccccacccgccggaagcucggggccgcucaccaagagacaaucagaagcaaaggcaaggacaacauucugcuggaacagggacuuucugccguuaagaccccucucuccaaacugacacugaagaauaucgagaacauggugggcuacgaggauccccgcaaugcugcccucgucaaagugcugcgggaaagacuugaggcguucgggggagacggcgccaaggcuuucgccccgaaccagccucccguguacaaacccagcaagccugggaagcaggcuccggaaauucgcucuguuaaaauggccagcaaguccaaaggagcccugcauguccgggagggccucgcugauagcgggagaaugauccgcaucgacauuuaugaaaccaagaauggcuacgugggagugcccaucuaugucucugauaaagcgagauccaagcugccuaaggccuaccccaaaaagggcgaggaccgggcuaacuggccugagguggauacgaaugacaacuuucuguucagccuuuauuccaccgacuggauugaagccaaaacaaagaaagagaccaucgccggguacguuaagucuuaugauauuuuugacggacgccugcucguguacgcucacgauaauaaaaaggucgugagaaagcugacacucagcgcccuggcggaccuucaaaaacugcauguuuccauccucggcgaucuguacaaagggggaacccccaaguguucuccucugcggaagggccaggaacuuuga

SEQ ID NO: 3822 - RNA, 3186 nt, Artificial Sequence
  Cas9 variant
augcugagacucggccuggacaucgggagcaccuccauuggaugguuccuuuaccggaucacaaacggcaugauugccgagaucauugauugcggggugcgccuguuuucugacggaagagaugcuaagacgggcgucagcuccgccguugaacggcgcaaugcgagagcucuccggcgcagacgggaccgcuaucugagacggcgcgccgcccuuaugagacggcuggcugccgcugggcucaugcccgaggauccuucucaggccaaaccgcuggaacugcucgaccccuaccgccugagagcggaugcccuugaccggagacuggagcucaccgaacugggacgcgcucuuuuccaccugaaccaacggagaggcuuuaagagcaaucgccagacagaucggggcaacaaugaagggggaaaaaucaucgacggcuccgccagacucgaucaggcuaugauggccgugggggcgcgcaccuauggagaguuccugcaucugcggagaucucaggccgaagaccuccgccgggugccuagcgucagaacacgccugacccuucgguccguggauggcgggaaggcugagacaggauacgacuuuuaucccgacagacggcaccuggaagaggaguucaacaaaguuugggccgcucaagccgcccaucacccugugcucaccgauagccugcgccaugaagucuuugagacgauuuucuuucagagaccccuuaaggcuccugcggugggccggugucuguucuuuccggaacccagacucccucgcgcccacccccugacccagcggagaguucuguacgagacagugaaugcucuccgcaucagaaccgaaucuggcgccgccgucccucuggggaaggagcagcgggacaaagugauuaugcuucuggauggaaaggcucccgugaaagccaucgcguccgcuaagcucagccugaaagccauugccaagcaccuuaagcugcgcgacggccaaacauucacccucgagaaagggagagauuauaucgcuugcgacccgguccgggccucucugucccauccugaucgcuuuggacccagauggagcguucuggaagcugaggugcaggccgaaauugugggccggauccgcgacgaugacgauacgauggcgcucgucgaguggcugaaacaggugcacgggcuugacgacgcccaugcuagagccacagcugaugccccucugcccgaaggauacggccggcucggcgagaccgcgacacgcaagcugcuggacugucuuaaggccgagguucucaccuacucugaagcuguggggaaagcccuggaucagcaccacuccgacagacggaccggagagauccuggaaagccuccccuauuacggcgagguccugcaagcucaugugauuccugggacaggagaaccgcaccaugaugacaucacgagauucggccgcauuaccaaccccacaguucacaucgggcuuaaucagcugcggagacucgugaaccgcauuaucgcccgguauggcaagccugccgagaucgucguggagcuggcuagagaucugaaacaguccaccggacaaaagaaggcggccauugcucuuaaucucaaaaaccgcaaggccgccgaagcucggucugcccugcugacagaguggggcguccccgacaccggggcgaauagaauguacgugcgccucuggcaggaacugcaugaggauccuaugaugcggagaugccccuauacgggaacaaucauuagcccgucccuucuguucagcggcgcuaucgacauugaucacauccucccuuacucucggacccuggacgauuccaccgccaaccgcacacuguguaugaaagaggccaauagacagaagcggaacaaaagccccucugaagcucgcagagacgggaugcggaucugggcccuugaggacgauaaccucagacacauuccugaauuuaagcgcuggcgguucgcggaggacgcuauggccagauuugaaggagagcgcgauuucgaggcccgggcucugguugacacccaguaucugagcagaaucuccaaggccuaccucgaaacacuguacgauggcgcugacgggaaaucucaugugugggucgugcccggccgccuuacggagaugcugcggagacacuggggacucaauggcauucugaccgauccucugcgcgacguuacaaaggagaaaaacagaauggaucaucggcaccacgccaucgacgcggccguggucgcugccaccgaucgcgggcuuauuaaggcuauggccgagcaagccagaacagacguggaucagggacgggaagcucucgcgagcuccaucaugcccccguggccuggcuuucgcgaggccguggcugcccagguugacagaauuaucgucagccaucggcccgaccacgggagaaucgaucugaccacgcgcaugaaaggacgggaccagaccacaggcccccugcauagagauaccgccuaugggcucacaggccaaucugagaagggagugccucugguggucacccgcgaaccguucgacaaucuuacgcccacaaugauuggcaagauccgggaugagccucugaaagcugcccucgcggcugugaccgccgggaagaaagacgaugccuuugcugaagcccuggcgcacuucagagaccggcccggaccuuaccauggcauucgcagaguucggcugaucgagcccauuuccguggucgaaauccgcgaugcuagcgggagagccuauaagggauacaaaggcaacucuaaucacugcuuugagguguggcggcuuccugggggcgccaucacagagcacauuguuuccaccuucgacgcucaucagcccggaccggaaccucgcccccacccugccgcuaagagacugcuccggcuguuuaagagcgauauggugaaacucgacgacuccaaguucggccccgucaucgccaccgugguuauguuugaucgcaacgggaaaauuucucuggugccgcauacagcgagcaaugccagaaagcggugugagaaauauaaggaagaccuuuaccugagauucacggcucgcacccucaucgaggccggagcucggagaauuaucgucgaugagacaggccacuuccgcgacccugggcggaaaggauga

SEQ ID NO: 3823 - RNA, 3189 nt, Artificial Sequence
  Cas9 variant
auggccgagaagcagcacagauggggccuggacaucgggaccaacagcauuggaugggcugugaucgcccucauugaaggccggcccgcggggcuggucgcuacaggaucccgcaucuucucugauggcagaaauccuaaagacgggagcucccuugccguugagcggcgcggaccgagacaaaugcggcgcagacgggaucgcuaccugagacggcgcgacagauuuaugcaggcccucauuaacgugggccugaugcccggcgaugcugccgcucggaaggcccuugugacggaaaauccuuauguccugcgccagagagggcucgaccaggcgcugacccugcccgaguucggacgggcccucuuucaucugaaccaaagacgcggcuuccagucuaaucggaaaacagauagagcuaccgccaaggaaagcgggaaagugaagaacgcuaucgccgcguuucgcgccggaaugggcaaugcucggacaguuggggaggcccuugcuagacgccuggaggacggacggccugugagagcccgcauggucggccagggcaaggaugaacacuacgagcucuauaucgcccgggaauggauugcucaggaguucgacgcgcugugggccucccaacagagauuucaugcugaggugcuugccgaugccgcucgcgaccggcugagagccauccuccuguuccagcggaaacugcuccccguuccuguggggaagugcuuucuggaaccgaaccagccccgcgucgcggcugcccuuccuucugcccaaagauuccggcugaugcaggagcucaaucaccugagagugaugacccuugcugauaaacgcgaacggccccugagcuuucaggagagaaacgaccuccuggcccaacugguggcucgcccuaaguguggauucgacaugcucagaaaaauugucuuuggcgccaauaaggaagcguaccgguucacaaucgaguccgagcgcagaaaggaacugaaagggugcgauaccgccgcuaaacuugccaaaguuaacgcucugggaacgcgguggcaggcccucagccuggacgagcaggaucgccuugugugucugcuccuggacggcgaaaaugaugcggugcuggccgacgcucucagagagcauuaugggcugaccgaugcccagauugacacacuucugggacucucuuucgaagauggccacaugcggcugggccgcuccgcucugcuuagaguccucgacgcccuggagagcgggcgggaugagcaaggacugccccucucuuacgacaaggccgugguugcugcgggcuauccggcccacaccgcugaccuggaaaacggggagcgcgaugcccuuccuuacuacggagaacugcucuggagauauacacaggacgcccccaccgcuaaaaaugaugccgagcggaaguuuggcaaaaucgcgaacccuacggugcauauugggcugaaccagcugagaaaacuugucaaugcucucauccagcgcuacggcaagcccgcccaaaucgugguugaacuggcccggaaccugaaggcuggacucgaggagaaggaaagaauuaaaaagcagcagacagccaaucuggagcgcaacgaacggaucagacagaaacuucaagacgcgggcgugcccgauaaucgcgagaaccggcugagaaugcgccucuucgaggaacuggggcagggaaauggccuggggaccccuugcauuuauuccggacggcagaucagccuucagagacucuuuucuaacgacguccaaguggaucacauucugccguucuccaagacacuggacgauagcuuugcuaauaagguccucgcccagcaugacgccaaccgguacaaaggcaaucgcgggcccuucgaggcuuuuggcgccaacagagauggauaugcuugggacgauauccgggcccgcgcggccgugcugccuagaaauaagcggaacagauucgcugaaaccgccaugcaggacuggcuucacaaugagaccgacuuucuggcucgccaacucacagauacggccuaccugucccggguugccagacaguaucugaccgcuaucuguucuaaagacgauguguacgucagccccggccgccuuacagcgaugcuccgggccaagugggggcugaacagagugcuggacggaguuauggaggagcagggccgcccugcugugaaaaaccgggaugaccacagacaucacgccauugaugccgucgugaucggggcuaccgaccgcgccaugcuccagcaaguggcgacacuggcugccagagcccgggagcaggaugcugaacgccuuauuggagacaugcccaccccguggccuaauuuccuggaggauguuagagccgcggucgcucggugcguggugucccauaagcccgaccacggcccugaagggggccuccauaacgauacggccuacggaaucgucgccggccccuuugaggacgggcgcuauagagugcggcacagaguuagccuguucgaccugaagccuggagaucuuucuaaugugcgcugugacgcuccccugcaggccgaacucgagccgauuuuugagcaggaugacgcucgggccagagaagucgcgcugacagcccucgcugagcgcuaccggcaaagaaaaguguggcuggaggaacuuauguccguucugccuauccggccccgcggcgaagaugggaagacccuccccgacagcgccccuuauaaggcuuacaagggagauucuaacuauugcuacgagcuguucaucaaugagagaggccggugggacggggaacugauuagcaccuuccgcgccaaccaggccgcuuauagacgguuucgcaaugauccggcgagauuccggcgcuacacagccggcggaagaccccuucugaugcggcucuguaucaacgacuacauugcugugggcaccgccgccgagagaacaaucuuucgcgucgugaaaauguccgaaaauaagauuacgcuggcugagcacuucgaagggggaacccucaagcagcgggaugccgacaaagacgauccuuuuaaguaucugacaaaaucucccggcgcgcuuagagaccugggggcucgccggaucuucguugaucucauuggaagagugcuggacccuggcaucaagggcgauuga

SEQ ID NO: 3824 - RNA, 3189 nt, Artificial Sequence
  Cas9 variant
augaaccugaauuacauccucggccuggaccuugggauugccagcgugggaugggcugucguugagaucgaugaacaggagaacccccaaagacugauugacgugggcgugcggaccuucgaucgcgccgaaguccucaagacaggggagucccuggcgcuugcuagacggcuggcccgcucuagcagacggcucgugaaacgcagagccgaacggaucaagaaagcuaagcgccugcugaaagccgagaaucuccugcuuuccgcugacgagauucugccuaacgaagccuggcagcucagaguuaagggacuggaucagaagcuggagcggcaggaaugggcggccgugcugcuccaccuucugaaacaucgcggcuaucucucucaaagaaagaaugagagcaaauccgagaacaaggaacugggggcccuucugucuggagucgcuaucaaucaccagauccuccagagcgcugaguaccggacgccggccgaaauugcggugaacaaauuucaggccgaggaaggccauauccgcaaucaaagaggcgcuuauacccacacauucucccggcuggaccuucuggccgagauggagcuccuguuucagagacaggcuacccuggggaacccccauacaagcaccaagcuccuggaaaaucuuacagcccugcucauguggcagaagccugcccuggcuggagaggcgauucuuaaaaugcugggcaagugcaccuucgaacccacggaguacaaagccgcuaagaacucuuauuccgccgaacgcuuuguuuggcucaccaaacugaauaaccugcggauccucgagcaaggggccgagagagcucugacagauaaugaacgcuucgcccuucuggaccagccuuacgagaaggcgaaacucaccuaugcucaggugcggacacugcugggacuuagcgaugaagccauuuuuaagggccucagauaccaaggggaggacaagaaagccgucgaaaccaagacgacacugauggaggugaaggcuuaccaccagauccgcaaggcccuggagggacucgaucugaaagcugaauggaacgagcuuaagaacaaucccgcccugcucgacgaaauuggcaccgcguucucucuguauaagacagaugacgacauccaccgguaccuggauggcaaacuuuccgagagcgugcucaacgcccugcuggagaaucucaacuuugacaaguucauccagcugucucuuaaagcucugcagcaaauucucccucugaugcugcaggggcagagauaugaugaagccgucuccgcuaucuacggagaccauuauggcaagaaaagcgaugagauugaccgccuucucccgaauauccccaccgaugaaauucggaacccuguugugcugagaacccugacacaggcccgcaaggugaucaaugcggucgugcggcucuacgggucccccgccagaauccacauugagacgggacgggaaguuggcaagucuuaucaagaccgcaaaaagcuggagaaacagcaggaggaaaacagaaagcagcgggagaaugcugugaaaaaguuuaaggaauacuucccuaacuuugucggggagcccaaaggaaaggauauccuuaaaaugagacuguacgaacuccaacaggccaagugucuguauagcggcaaaucccuggagcuuuaccgccuccuggagaagggcuauguggaaguugaccaugcucugccguucagccggaccugggaugacucuuucaauaacaaagugcucguccuggccaaugagaaccagaauaaggggaacgccacaccuuacgaauggcuugacggaaagaacaauuccgagggcuggcagcacuuuguggcuagaguccaaaccagcggguucucuuaugcgaaaaagcagcgcgugcugauucaggaacucgaugagaaauccuuuaucgagagaaaccugaaugacacacgguacguugcccgcuuccugugcaaccacauugcugauaauaugcuucugaccggaaagggcaaaagaaagguguuugccagcaacgggcaaaucacggcccuccugcggggcuguuggggacuccagaagguccgcgaaaauaacgacagacaucacgcucuggaugccgugguuguggcgugcucuacaaaaagcaugcaggacaagaucaccaaauucgucaaguauaaagagggccggcuuuuuaaggauaagaaagacgggguguacaagggagaacgcauuaauagagagaccggcgagaucauuucccugcauuuccccacaccuuggaaauuuuucaaggaaaacguggagauccggauuuuuagcgaaaaucccaaacucgagcuggaaaaccgccugcccgauuacccucaguauaaucacgaguucguucaaccgcuuuuugucucuagaaugcccacccggaagaugacagggcagggacauauggagacggugaaguccgcuaaaagacuggacaagggccucagcgugcugaaagucccucucacccagcugaaacuuucugaucuggaacgcauggugaaccgggagagagaaauggcccucuacgaggcccugaaagaaugucuggagcaguucgggaaugaccccgcuaaggccuucgcggagccuuuuuauaaaaagggcggagcucuuguuaaggccgugcgcgucgaacaaacacagaaauccggcgugcugguucggaacgggaacggaguggccgauaaugcuaccggcagcaucgucagaguggacguuuucacaaaagggggaaaguacuuucucgugcccauuuauaccuggcaggucgccaagggcauccugccgaacaaagcugugauccaggggaaggacgaguccgaaugggaggaaauggaugagaaugccguguuccaauuuucuaugcacaagaacgaccucauuaaagucaagacgaaaaagggcgagaucuucggauacuuuaauggccuggaucgcgcgaccgggagcauugaaaucgaggaacacgaccuugagaaauccaagggaaagaacggcucucaucgggggcugggaguuaaaacagccuucuuucuggagaaguaucagguggaugaacucggcaaaaauauuagaccuugccgccccaccaagcggcagcacgugagauga

SEQ ID NO: 3825 - RNA, 3192 nt, Artificial Sequence
  Cas9 variant
auggagaaccacaucaauuacagacugggccucgacauugggaucgccagcgugggaugguccgucauuaaccuggauaagaaacggaucgaagaccuuggcguucgcauuuucaaugcugccgagcaucccaaggaugggucuagccuggcgcucccuagacggaucgcucgcggaagacggcgccugcuuagacggaaagccuaucgcgugaagagagugcggaaacugaucgucgacuacaacauucucaccaaggaucagcugaaugaccuguuuaagcaaaaaugccagaacuccgugugggaaauccgcguuaaggcccucgauaauaaagugacaaacgaggaaugggcuagacugcuuauuaaucuguguaagcggcgcggcuucaaaucuaacagaaagaaugaggccgacgauaaggagacgaaaaaggucaucaacagcauuaaauccaauaucaaggggaugaaagaaucuggaagccggaccauuggcgaguauaucuacacacagacccucuccagcggcgacaucucuaaguccuuuagaaacaaagaugggcaguauaauaacugcgugagccgcaagaugauugaagaggagaucaagauucuguucaaaaagcaacgggaacuuggaugugaguuugcuucugaagagaucgaagagaaauaccuggccauuuucaacucccagagaccguuuagcaaguucgaggaccucgaaaagaugguuggcuuuugcacauucgagaaggcgucuaaggaacgccgggcccccaaauguuccaucagcgcugaggaauuugugcuguaugauaauaugaacaagcuguccauccucaauaaaggggacaccagaaagcugacaaacgaggagcgcaaaauuaucgucgaaaaugccuucaagaacaaggagauuaaauacucuaaacuucggaaaauccugaaucucagcaacgacgaaagauuuuccacccugagcuacucuaauaagacggagcuuuccaaaaccgaaaacagcaaguucguggcucugaagggauaucacgagauuaaaucugccaucgaaaagagcuucggcaaagauacauggaaucgcgugaagaacaaucggaccaugcucaacgacaucgcguacguccuguccauugccaaaacagaugaagacaucauuaagcagcugucucucagaaauaucccucgcgagauuaucgaugcuguucuggggcuuagcuuuuccaaauucagcaaccugucuauuaaggccaucgaaaagauccuccccuaucugaaagacggacagcaauacaacgaggcuugcaaguccgccggcuaugauuuuaaagccaccuacaauggcgaaaagagcuauaaacuuccucugauugacaucgaugaaauugugaaccccguggucaaucgggcucucucucagacgagaaaggugaucaacgcgguuauugaccgguacggguccccuaucggaaucaauauugagcuggcccgcgaucuggcuaagaacuucaaagacagaagcaagaucaaaaaggaacaggaggaaaaucgggccaacaaagagaagauuaagaaugagcucaaaaugcugaugaacaaggaaccgacauccucugagauccuuaaauacagacuguggaaggaacagcgcgaggaaugugccuauagccaagagcggauuuacaucgaggaccucuuuaaagugggccaguaugaaaucgaucauauuauccccuucuccagaucuuuugacgauagccugaauaacaagguccuggugaaggcugccgagaaucagcgcaaagcgaaccggauuccuuacgaauauuucggguccgacgaggauagaugguaccgcuuugaaguuuggguggagcaaagcucucuuuccuucaagaaaaagaauaaccuccugaaaaagagauuuagccgggaggacucuaucgaguucaaagaucgcaaccuggucgacacccaguauauuuccagauacaucagcaauuuuaucaagucucggcucauuuucaaggagagcgauuccaaacagaaggugaucacaauuaacggacgcgcuaccagcuaccugagagccaaauggggccuucugaagguccgggaaaauggggacaaacaccaugcccucgaugcuaccgugaucgccguugcuacacagggaauggugcaagagauuucuaaguauuccaaggcccacgagcugaaauacauccgccagggcgacgaguucauugauaucgagacgggcgaaaucgucaaggugaaagaccacaagcaucugagcaaagacagacuucccgagccuuggcucggguuuuccucugaacugcggcugagacucagcgagaaccccauugaggaacugaagaaguccccgaucucuaccuaugaugaggaguucauucgcaaaacaguucggccuaucuuugugagcagaguccccuaccgcaaggugaccggacggcuuuucgaagaaacaguguauuccccuaaagcguuuauugacgagggcuucaucgccaagaaaaagcugcaggaucucacccugaaggacuuugagaauaucuacaacuauaauucugauaaaaagcuguacgacgcucuuagagaacgccucgaggaauacgggggaaacgccaaaaaggcuuucgccgaggaauuucggaaacccacgaagacaggcaagcuggggcccauuguuaaaagcaucaaggucaaaaccaagauuccuuucaaagauggcaucgaccugaauggaggcaaggugaaaaaggaugggcucgugagaauugacaucuaugagaaggagggaaaauacuaugucgugccgguuuaccgccuggauauccagcaaggcaacauucccaagaaagcggccguggcuaauaaggaagagaaagacuggauccuuauggaugaauccuauaacuuuaaguucagccuguacaagaaugaccucauuuauaucaaauacgacucuaagggggaguacuuuggauauuacgauggcuucgaccggcacaccggggccauuacacuggagagacaugauaacuccgaacgguaucgcggcaucggaauuaaaaccggcgucaaggagaucuucaaauacaauguggacguucuggggagauauuacaagguggcuaaguga

SEQ ID NO: 3826 - RNA, 3192 nt, Artificial Sequence
  Cas9 variant
auggagaaguuccacuacgugcugggccucgaccuggggaucgccagcgucggaugggcugccauugaaaucgauaaagagaccgaaacauccauuggccuucuggacugcgggguuagaacguuugagcgggcggaagugcccaagaccggagauucucucgcuaaagcccgcagagaggcccggagcacacgcagacugauccggcgcagaucccaucggcuucugcgccucaagagacugcugaaacgggagauuuuccgccagccugaaaccuuuaaggaccucccgaucaacgcuuggcagcugagagugaagggccuugauucucggcugaaugaguaugaaugggccgcuguccuccugcaccuugugaaacaucgcggguaccugagccagagaaaguccgagaugucugagacagacagcaaauccgaaaugggacggcuccuggccggcguugcggagaaccaccagcugcuccagcaagaacaguauagaacccccgccgagcuggcucuuaagaaauucgugaagcauuuucgcaauaagggcggggauuacgcccacacauucaaccggcuggaccuccaggcugaacugcaccuucuguuucagaaacaaagagagcucggaaauccuuucaccagccccgagcuggaacgccaggucgaugaccugcucaugacgcagcggucugcccugcagggcgaugcgauccuuaagaugcuggggcauuguggauuugagccugaacaauucaaagccgcuaagaacaccuuuuccgccgagagauucauuuggcucacaaaacugaauaaccuucgcauccaggaccagggcaaggaacgggcucugaccgccgaugagagaacaaaacuccuggacgagcccuauaagaaguccaaacugaccuacgcccaagugcgcaagcuccugucucuuccucagacggcuauuuuuaaagggcugcgguaugaccucgaacacgauaagaaagcggagaauagcacacugauggaaaugaagucuuaccauaacaucagacagacccuggagaagucuggacuuaaaacagaauggcaguccauugccacccaaccggagauccucgacgcuauuggcaccgccuucagcaucuacaagacagaugaggacaucucccacgaacugaaaacgugccgccugcccgagaauguucucaacgaacugcuuaagaauauuaacuucgauggcuuuauccagcugucucucaccgcccugcggaaaauucugccucuuauggagcagggguauagauacgacgaggcuuguacacagaucuauggaaaucaccauagcggcucccuccaacaggaaagcaagcaguuccugccccacauuccuaucgaugacgugcggaaccccgucguguuucgcacccugacacaggccagaaagguggucaacgcgaucauucggagauacgggucuccggcucgcguucauaucgagauggcccgggaacucggaaaauccaagagcgauagagaccgcauugagaaacaacagcagaagaauaaaaaggaaagagagaacgccguggcuaaguucaaagaggauuuuccugacuucgugggcgaaccccgggggaaggacauccugaaaaugcgccuuuaugagcagcaacacggaaagugccuguacucuggccaugauauugacaucaauagacucaacgaaaaaggcuaugucgagaucgaucacgcccugccuuuuagccggaccugggacgauucccagaauaacaaggugcugguucuugggucugaaaaucagaacaaacgcaaucaaacgcccgacgaguaccucgauggagcuaacaauagccagagauggcuggaguuccaggcccgggugcagacaugucacuuuuccuacggcaagaagcaacgcauucagcuggcgaaacucgacgaugaaaccgagaagggguuccuggaaagaaaccuuaaugacacccgguauaucgcccgcuuuaugugccaguucguccaggagaaccuguaccucacaggaaaaggcaagagacugguguuugcuagcaaugggggcaugaccgccacacugcggaaccuuuggggacucagaaaaguucgcgaagauaacgaccggcaucacgcucuggaugccauuguggucgcguguucuacggccuccaugcaacagaagaucaccaaggcuuuccagagacaugagagcauugaguauguggacacagaaaccggcgaggucaaauuccgcaucccccagccuugggacuuuuuccggcaagaagugaugauuagaguuuuuagcgaucagccgugcgaggaccugguggagaagcucuccgcccgccccgaagcucugcacgauaaugucacaccucuuuucgugagccgggcccccaacagaaaaauguccgggcagggacaccuggagaccaucaagucugccaaacgccucagcgaagaaaauuccaugguuaagaagccucugacgacccugaaacuuaaggacauccccgagauugugggcuacccgucucgggagccucaacuguaugcugcgcucaaaacaagacuggagacccaugaugacgaucccaucaaggccuuugcuaaaccuuucuacaagcccaacaagaauggggaacucggagcccugguccggagcgugcgcgugaaaggcguucagaacacaggggucauggugcacgacggcaagggaauugccgauaaugcuaccauggugagagucgacguguauacgaaagccggcaagaacuaccuuguuccuguguacgucuggcaaguggcgcaggggauccugcccaaucgggcuguuacauccggaaaaagcgaggccgauugggaccucauugaugaaucuuuugaguucaaguuuucccugagccgcggcgaccugguggaaaugaucucuaacaaagggagaaucuucggauauuacaauggccuugaccgggccaacggguccauuggcaucagagagcaugaucuggaaaagagcaagggaaaagacggcguccaccgcguggggguuaagaccgcuacagccuuuaauaaauaucauguggauccgcucggaaaggagauucaccgguguucuagcgagccuagacccacccugaaaaucaaguccaagaaauga

SEQ ID NO: 3827 - RNA, 3192 nt, Artificial Sequence
  Cas9 variant
auggagaaggacuacauccugggccucgauauugggaucggaagcgugggcuaugggcugauugacuacgauaccaaauccaucauugacgccggagucagacuuuuccccgaagccaacgccgauaauaaccugggccggcgcgcgaagagaggggcucggcgccucaaaagacggcgcauccacagacuggagcggguuaagucucuucugagcgaauauaaaaucauuuccggacucgccccuacaaauaaccagccguacaauauccgcgugaagggccugacggagcaacugaccaaggacgaacucgccguggcucugcuucauauugccaaaagacggggcauccacaacgucgauguggcugccgacaaggaggagacagcgucugauagccuguccaccaaagaccagauuaauaagaacgccaaauuucucgaaucucgcuauguuugcgagcugcagaaggaaagacuugagaaugaggggcaugugcggggagucgaaaaccgcuuccugacaaaggauaucgugagagaggcuaaaaagauuaucgacacccagaugcaauacuaucccgaaaucgaugagacauuuaaagaaaaguacauuagccucguugagacccggagagaguacuaugaaggcccugggaaaggaucccccuacggcugggacgccgacgugaagaaaugguaucagcugaugauggggcacuguacguacuucccugucgaguuucgcagcgugaaguaugcuuacaccgccgaucuguauaaugcgcucaacgaccugaauaaccuuacaaucgcccgggaugacaaucccaagcuggaauaccaugagaaauaccacauuaucgaaaacguguucaagcagaaaagaaacccuacccucaagcagauugcuaaagagaucggagucaaugauaucaacauuucuggcuaucgcguuacaaaguccggcaagccgcaauuuaccagcuucaaacuguuucacgaccuuaagaaaguggugaaggaucaugccauccuggacgauauugaccuccugaaucagaucgcugagauucugacgaucuaccaggauaaagacucuaucgucgccgaacucgggcagcuggaguaucuuauguccgaagccgacaagcaaagcauuucugagcugacaggauacaccggcacacacucccucagccugaagugcaugaacaugaucauugaugaacuuuggcauuccucuaugaaucagauggagguguucaccuaucugaacaugcggcccaaaaaguacgagcucaaaggguaucagagaaucccuaccgacaugauugaugacgcuauccugagccccguugugaagcgcuccuuuaaacaagcgauuggagucgugaaugccaucaucaagaaguacggccugccuaaagauauuaucauugaacucgcucgggagagcaacucugccgaaaaguccagauaccugcgcgccauccagaaaaagaaugagaaaacacgggagagaauugaagcuaucaucaaggaguaugggaacgaaaaugccaaaggacuuguucagaagauuaagcugcacgacgcgcaggagggcaaaugucucuacagccugaaggauaucccccuggaagaccuucuccgcaacccgaauaacuaugauauugaccacaucauuccucggucugugagcuucgaugacuccaugcauaauaaaguccuggugagacgggagcaaaacgcuaagaaaaacaaucagacgcccuaccaguaucugaccucuggcuacgccgauaucaaguauagcgucuuuaagcagcacgugcucaaccuggccgagaauaaagaccgcaugacaaagaaaaagagagaauaccuucuggaggaacggaacaucaauaaauacgacguucaaaaggaguucauuaacagaaaucucguggauacccgcuauacaacccgggaacugacgacacugcuuaagaccuacuucaccaucaacaaucucgacgucaaagugaagacaauuaacggguccuuuaccgauuuccugagaaaacgcuggggauuuaagaaaaauagagacgagggcuauaagcaucacgcugaggaugcccugaucauugcuaacgccgacuaccucuucaaggaacauaaacugcuuaaggagaucaaagauguuagcgaccuggcgggggaugaacgcaauucuaacgugaaggacgaggaucaguaugaagaggucuuuggaggcuacuucaaaaucgaggacauuaagaaauauaagaucaagaaauuuucccaccggguggauaagaaaccuaauagacagcucauuaacgacacaaucuacagcacgcgggugaaggacgauaaacgcuaccugauuaacacccugaagaaucuuuaugacaagucuaacggggaucucaaagaaagaaugcagaaggaccccgagucccugcugauguaccaccaugauccccaaacauucgaaaaacucaagaucguuaugagccaguaugagaaugagaaaaacccucuggccaaguacuuugaagagaccggccaguaucuuacaaaguacgcuaaacacgacaauggaccggccauucauaagaucaaauauuacggcaacaagcuggucgaacaccucgauaucaccaaaaauuaccacaacccccagaauaagguggugcaacugucccagaagucuuuccgguuugacgucuaucagacggauaaaggguacaaguucauuagcaucgcuuaucugacccuuaaaaacgagaagaauuacuaugccauuucccaagaaaaauacgaccagcucaagucugagaagaaaaucagcaacaaugcgguguuuauuggauccuucuauacaagcgauaucaucgagauuaacaaugaaaaguuccgcguuaucggcgugaacucugacaaaaacaaucugauugaggucgacagaaucgauauucggcagaaggaauuuaucgagcuggaagaggagaaacaggugaacuacaugaacuccgacagcuaccucaagaauaaucgcaucaaaguuaccauugggagaaagacaaccaacaucgaaaaguuccauacggauauucugggaaauauguauaaaucuaagcggccuaaagcuccccaacuuguguuuaagaaaggcuga

SEQ ID NO: 3828 - RNA, 3195 nt, Artificial Sequence
  Cas9 variant
augagcgagugcgugaccagacggauccugggcauugaccucgggaucgccuccuguggauggggcgucauugaaguuggggaggcuucuggaagcaucauugccuccggcgugcgcugcuucgaugcgccccugaucgacaagacaggggaaccuaaaucugcuacgagacggaccgcccgcggacagagacggaucauucgcagacggcgccaaagaaugaacgccgugcggcgccuucuggcugaguuuggcguccucacaggcagaagcccggaugcccugcaccaggcccuucugcggcucucccagucuguggcugggagccagguuacccccuggacacugcgcgcggccgcucaugaaagaaagcugaccaaugacgagcucgccgugguccugggacacaucgcucggcauagaggcuuccgcuccaacagcaaaaaugaugggggagccaacgcggccgacgagacaucuaagaugaaaaaggcuauggaaaccacgcgggagggccuugccagauaccacuccuuuggggcuaugauugccagcgauccuaaguucgccgaccgcaaacggaauagagauaaggacuauucucauaccgcuaaacgcuccgaucuggaagacgaggugcggacaaucuuuagaagccaaacccgcuucggaucucucguugcguccgagaagcugagccaggccuuugcugaugccgccuucuuucagcggccccuucaggacuccgaagacauggugggcucuuguccuuucgagcccggccagaaaagaacagcucgccgggccccuagcuuugaacuguucagauuucucucccggcuggcgaaccugaagcucaccgucgggcgcgcuccggagagacggcugacgcccgaugaaauugcccuugccgcuaagggauucggcgagaccaaaaagagcaucacauucaaaucucugagagaggcccucgaccuggauccuaaugcucgcuuuuccgggguggccaaggaaaaagagagcacacuugacguggcggcccggaccggaggcgcugccuacgggaccaagacacugaaagaugcucucggagacgcccccuggagaucucugagccgcaugccugaaaagcuggauagaauugcggagauccucuccuuccgggaagacaugaaggccauccgcaacggccuggaggaggucggccuugaugggcugguuguggacgcucucaugcaagccacggcuaauggagauuuuaaagacuucaccagagccgcccacauuucugcucuggcggcccggaacaucauucccggccuucgcgaagggcugguguauagcgacgcuugcacaagagucggauacgaucacgccgcccggccggcugugccucucucccagaucggcagccccguuacccgcaaggcccugucugaggcgcugaaacaggugagagcugucgcccgggaauaugggccuauugacuacuuucauaucgagcucgcccgcuccaucggcaagagcgcugaagagagaaagaaacugacagauggaauugaggcccggaauguggaaaaggagaaaagacgcaaggaagcggcugagcaccuuggccgggcccccucugacgaugagcugcucagauaugaacuggccaaagagcaaaacuucaaguguaucuacuccggggaccccauugauccugcuggaaucagcgccaaugacacccgcuaccagguugaucauauucugccguggucccgguuuggcgacgauucuuaugugaacaaaacgcuuugcacagcuagaagcaaucagaacaagcgcgggcggacccccuucgaaugguuugacgccgauaagaccgaggcggaauggauggaguacuccgccagagucgaggaccucaaagaagugaagggacgcaaaaagcggaacuauucuaucaaagacgcugccagcgucgaggauaaguucaaggcuagaaaucugacagacacccaaugggccacacggcugcucgccgaugaacugaaacgcauguuuccucccagagagugugaacgggugguuacggugcgcgcugacggcgggaacgauggccuuuccaucgucgaggagagacggguguucaccagaccuggagcgauuacaagcaagcugcgccgggccuggggccucgaagggcugaaaaagcaggacggaaaaagaguugaggaugaccgccaccacgcuguggaugcccugguccuugccgcuaccacagaaucucuccugaaucggcugaccguggaggugcagcagagagaacgcgagggccggcaagacgauaucuuucauugcucccagcccuggccgggguucagaguugacguccagcgcacgguguacggaagcgagaccaugccuggcauuuucgugucuagagccgaacggcgcagagcgcgggggaaggcucacgaugccacagucaaacagauccgcgacauugacggcgagagaaucguguuugaacggaagcccauugagaagcucaccgauaaagaccuggagagaaucccuguucccgaaccuuauggaaaggccgcugaucccaaaaagcugcgcgacgagcuuguggaaaaccuccgggccuggaucgcggcuggcaaaccgaaggauaagccucccagaucccccaaaggggacauuauccgcaagguccggauugagacaaaagauaagguggccguugaaaucaauggaggcaccguggacagaggggauauggcccgggucgacguguuccgcaaaaagaacaagaaaggaguuugggaguuuuacgugauuccuaucuauccgcaucaaaucgucgcuagcgcccugcccccuaauagagcugugauugccuacaaggcggagucugaauggacggccaucgauggcuguuucgaguuugcuuggagccugaaccccauguccuaccuugaacucgugaaaagcaauggggagcugauugaaggcuauuuccggucuauggaccgcacaaccggagccaucaaccuguccccuaugagcacaaauuccgagaccauuagaucuaucggcgucaagacccucagcuccuuucggaaauucacaguugaccgccuggggagaaaguuugagaucccccgggaagugcgcacguggagaggagaggcuugcaccuga

SEQ ID NO: 3829 - RNA, 3195 nt, Artificial Sequence
  Cas9 variant
augaagagaaccagccugcgggccuaccgccucggcguggaccugggggcuaacucccuuggaugguucgucguuuggcuggaugaccacggccagcccgaggggcucggaccuggcggggugagaaucuuuccggauggacggaauccccaaucuaaacagagcaacgccgcgggccgcagacuggcucgguccgcccgcagacggcgcgacagauaucuucagcggcgcggcaagcugauggggcuccuggugaaacauggacugaugccugccgaugaacccgcuagaaagcggcucgagugccuggacccuuacggccuucgcgccaaagcucuggaugaaguccucccccugcaccauguggggagagcccuuuuccaccugaaucagcggagaggacucuuugcgaaccgcgccauugagcaaggcgacaaggaugcuucugccaucaaggcugccgcggggcggcugcagacaagcaugcaggccuguggagcuagaacgcugggcgaauuucucaaucgccggcaucagcugagagccaccguucgcgcucgguccccugugggcggggacguccaagccagauaugaguuuuacccgacacgcgccaugguggaugcugaguucgaagcgauuugggccgcucaggcuccccaccacccuaccaugacagccgaggcucaugacaccauccgggaagccauuuucucucagagagcgaugaaacgccccagcaucggaaagugcucccuugauccugcuacaagccaggacgacguugauggcuuccggugugccuggucucacccccuggcccaaagauuucggaucuggcaggacgugcgcaaccucgcugucguggagaccgggccgacguccagcagacugggaaaagaggaucaggacaagguggcccgggcccuucugcaaaccgaucagcucucuuucgacgaaauuagaggccugcuggggcucccuuccgaugcccgcuuuaaucuggagagcgaccggagagaucaucuuaaaggagacgcgacaggcgccauccugucugcucgcagacacuucggccccgccuggcacgaucggucccucgaccgccagauugacaucgucgcucugcuugaaagcgcccuggaugaggcggccauuaucgcuucccucgggaccacacauucucuggacgaagccgcugcccagagagcccugagcgcucuccugccugauggauauugccggcuuggccugcgcgcgauuaagagaguucucccccugauggaggccgggcggaccuacgcugaggccgccuccgcugccggauaugaccacgcgcugcuucccggcgggaagcucagcccuacgggcuaccugccguacuauggacaauggcugcagaacgauguggugggcucugacgaugaacgcgacacaaaugagagacggugggggcgccuccccaacccuaccguccauaucggaaucggccagcugagacgggugguuaaugaacuuauuagauggcacgggcccccugcugagaucacaguggaacugacccgcgaucucaaacugucccccagaagacuggccgagcuugagcgcgaacaggccgagaaccaacggaagaaugacaaaagaaccagccuccugcgcaagcugggacucccggcuucuacacauaaccugcuuaaacugcggcucugggaugaacagggcgacgucgccagcgaguguccuuacacgggggaagcgauuggccuggagagacugguguccgaugacguugacaucgaucaccuuauucccuuuucuaucagcugggacgauuccgcugccaauaagguggucugcaugcgcuaugccaaccgggagaaaggaaacagaaccccuuucgaggcuuucggccaccggcaggggcgccccuacgacugggccgauaucgcugaaagagccgcgcggcucccucgcggaaagagauggcgguuuggccccggggccagagcucaguucgaggaacugggagacuuucaagcccgccugcucaaugagacaagcuggcuggcucggguggccaagcaguaucuugccgcugucacccauccgcaccggauucaugugcugccuggccgccucacagcgcugcugcgggccaccugggaacuuaacgaucuccugcccgggucugacgauagagcugccaaaucccgcaaggaccaccggcaccaugccaucgaugcucugguugccgcgcucacggaccaggcucugcuuagacgcauggccaaugcccacgaugacacaagacggaaaauugaggugcugcuccccuggccuaccuuccgcaucgaccuggaaaccagacugaaggcuaugcuugucagccauaaaccggaucacggccugcaggcccggcuccaugaggacacagcguacggaaccguggaacaccccgagacagaggauggcgcuaaccugguuuaucgcaagacguuuguggacauuucugaaaaggagaucgauagaauccgggacagacgccuccgggaucuggucagagcccacguggccggggaacgccaacagggaaaaacccuuaaggcugccgugcuguccuucgcucagcggagagacauugccggccauccuaaugggauccggcacguucgccucacaaaaagcauuaagcccgauuaccuggucccuaucagagacaaagcgggacggauuuacaaguccuauaacgccggcgagaaugcuuuuguggauauccugcaagccgaaucugggcgcuggauugcuagagccaccacaguguuccaggccaaccaggcuaaugagagccaugacgcgcccgccgcucagccuaucaugcgggucuuuaagggcgacaugcuucgcaucgaucacgccggagccgagaaauucgugaagauuguuagacugucccccucuaacaaucuccuguaccucguggaacaucaccaagcuggcgucuuucagacccggcacgacgauccggaggacagcuuccgcuggcuguuugccuccuucgauaaacuuagagaauggaacgcggagcuggugcggaucgacacgcucgggcagccuuggagacgcaagcggggacuggaaaccggcagcgaggaugcuacaagaauuggguggacccgccccaaaaaguggccuuga

SEQ ID NO: 3830 - RNA, 3198 nt, Artificial Sequence
  Cas9 variant
augaacaaggacaucaauuacgcccugggccucgauauugggaucaccagcgugggaugggcugucauuaaccuggaccuuaauagaaucgaggaucugggcguucggauuuucaacgccgcggaaaaucucaaagacggguccucucuggcccuuccccgcagacuggcucggggacgcagacggcuccugcgcagaaaggccuaucggguggagcgcgugagaaaacugauccucaagaacaauauccugacaaaagaggagcuugaaggccuguuuaagaacaaggaggucauugaugugugggaggcucggguuaaagggcucgacuacaagcugagccgcgaagagugggccaaaauccuuauuaauuucugcaagagacggggauuuaaauccaaccgcaagaaugaagcuaaggauaaagaggccggccagauccugucuagcauuuccuauaacaucgagaagaugaaagaaacgaauagcagaaccauuggcgaguacaucuauaacgaagugaagaauagcgaggacuccuacgcgccucuccggaacaaauucggggaauauaagaugugugucagcagagaugugauccgcgaggagauucacacacuguuugaaaaacaacgggagcugggaaacaauuucgccucugacgaaaucgaggauaaguacuuugaaauuuucaacucccagagaccguuuagcaauuucgaggaccucgagaagcugguuggcuuuugcaccuucgaacgcaaaaagcauaaacgggcucccaagcacuguaucucuuccgaggaauuuacacuuuacgaggggauuaacaaacugagcaucaucaaggauggagaaaagagaaaacucucugaggaggaacgcacccugguggucaaugaggccuucaacaagaaagaaauuaaguauacaacccuucggaaacugcucggccuguccgaggaggaacuguucagcacgcucaccuacuccaucgacaaggacauuucuaagacagagaauaccaaauuugugagccugaagggguaucaugaaaucaaaagagcuauugagaagggaguguccaaaaaggccuggcaggauaucgaaaacaaucgcaaccuucugaaugacaucgcguacguccucacacugggcaagaccgaugacgagauugagaaacagcuucggcugagaaacguuccugaagaacucuucgaaagccugcuggauaugucuuuuaauaaguucaacaaucucuccaucuaugcccuggagaaaauucuucccuuuaugaaggaaggcuaccaauauaacgaggcuugcgagaaagccggguacaacuucaaggcuaucuacgaaggagugcgcacgaaaaagcugccugugauugagaucgacgaaauugucaaucccgugguuaaccgggcccucgcccagacaagaaaggugaucaauagcgucaucgauaaauauggcucuccugugcggauuaacaucgagcuggcucgcgaccuggcgaagaauuuuaaagauagaaaacuuauugaaaaggagcagaaggagaaccgggccaaucucgacaagaucagagaaaaccugcgcgagcugauggauaaagaaccgaccguuguggagguccucaaguaccggcugugggagcagcaaagaggggaaugugcuuauacacagagccagauuccccuugagcgccuguucuccccuggauacugcgaaaucgaccacaucauucccuuuucuagaucuuucgacgauucccucagcaauaaaauccuggugcugggcucugagaaccagcggaaggggaaucgcaccccuuaugaauacuuuggagaggacuccgagagauggaacagcuucgaaauuugggucaaaggcucuuaucuuaauuacaagaagaaagccaaccuccugaagaaaaaguuuuccgaggaggaacaacgggauuggaaagcccgcaaucugcaggacaccaaguacaucuguagauauauuagcaacuucgugaacaaucggcucgaguucaaggaauccgagaacaaacagaagguuaucacagugaauggccgcgcuacggccuaccugagaucucggugggggcuuaacaaaguccgcgaagauggagacaagcaucacgcgcuggaugcugccgugguuggcgugaccacacaagggaugguccagaaaaucagcaaguauuccaaagcccacgagcucuacaccgugagaaagaaugacgaauuuguggauguugagacaggagaaugcgucgacguggaugaguauaaggagauucggaaagacauccugcccagaccguggcgcggcuucucugaggaacugaaacuucggcucagcgauaacccucuggaggaacugaagaagucccccauugagaccuacaaugaagaguuuaucaaagaaaacgugaagccuauuuucgucagcagagugcccuuucgcaagaucucugggaaacucuucaaggagacgaucuauuccgaacgggcuuuuaaagacggcuacuucguuagcaagaaaucucugguggaccuuaagagaggagaucuggacaauuuuuacaacuaugagugugauaagaaacucuacgacgccauuuccgagcgcaugaaggaguucaauuauaacggcaaaaaggcuuuugaaagccccuuccggaaaccuacaaagucugggaaggaaggaccggucgugagaagcguuaaaaucaaguccgccgugcccuuuaaagauggcauuccuaugaaugaggggcuggucgcgaaggaaggaauggugcgcaucgacauuuacgagaaagagggcaaguauuucguugugcccgucuaccgguaucagcuggccaaggggaucgugccuaaaagagcugccauugcuaagaaagaugaacuuaaguggcccaucauggaccagaccuacaacuucaaauuuagcaucuacaagaaugaucucauugaggugaaauaugacaagaagggcgucuacuucggauauuacgauggcuuugaccggaacucugccucccugaccaucgaaaaacaugauaacagcgagcgcuauagauccauugggcugaagguuggagugcucgaaaucaauaaauacgagguggacguccugggcaacuaucacaaggugaaacuugggggaaauuga

SEQ ID NO: 3831 - RNA, 3198 nt, Artificial Sequence
  Cas9 variant
augaacaaggacaucaauuacgcccugggccucgauauugggaucaccagcgugggaugggcugucauuaaccuggaccuuaauagaaucgaggaucugggcguucggauuuucaacgccgcggaaaaucccaaagacggguccucucucgcucugccucgcagacuugcccggggacgcagacggcugcuccgcagaaaggccuaucggguggagcgcgugagaaaacugaucgucaagaacaauauccugacaaaagaagaacucgaaggccuguuuaagaacaaggaggugauugauguuugggaggcucgggugaaagggcuugacuacaagcugagccgcgaagagugggccaaaauccucauuaauuucugcaagagacggggauuuaaauccaaccgcaagaaugaaacgaaggauaaagaggcuggccagauccugucuagcauuuccuauaacaucgagaagaugaaagaaaccaauucuagaacaauuggcgaguacaucuauaacgaagucaagaauagcgacgauuccuacgccccgcuucggaacaaauucggggaguauaagaugugugugagcagagacguucugcgcgaagagauccacacccucuuugagaaacaacgggaacugggaaacaauuucgcgucugaugagauugaagacaaguacuuugagaucuucaacucccagagacccuuuagcaauuucgaagaucuggagaagcucgugggcuuuugcacauucgagcgcaaaaagcauaaacgggccccuaagcacuguauuucuuccgaagaguuuacccuguacgaagggaucaacaaacuuagcauuaucaaggacggagagaagagaaaacugucugaagaggagcgcacacucgucgugaaugaggcuuucaacaagaaagagaucaaguauaccacgcugcggaaacuucugggccucuccgaagacgagcuguucagcacccugacauacuccauugauaaggacaucucuaagaccgagaauacaaaauuugugagccucaagggguaucaugaaauuaaaagagccaucgagaagggagucuccaaaaaggcuuggcaggauauugaaaacaaucgcaaccugcuuaaugacaucgccuacguucugacccucggcaagacggaugacgagaucgaaaaacagcugcggcuuagaaacgugcccgaggagcuguucgaaagccuccuggauaugucuuuuuccaaguucaauaaccugagcauuuaugcgcucgagaaaauccugccuuuuaugaaggaaggcuaccaauauaaugaggccugcgaaaaagcuggguacaacuucaaggccauuuacgagggagugcgcacaaagaaacuucccgucaucgagauugacgaaaucgugaacccuguugugaaucgggcucuggcccagaccagaaaggucauuaacucugugaucgauaaauauggcagcccgguucggaucaauauugagcucgcccgcgaccuggcuaagaacuuuaaagauagaaagcugaucgaaaaagagcagaaggaaaaucgggcgaaccuugacaagauuagagagaaucuccgcgagcugauggacaaagaacccacagccguggagguccugaaguaccggcucugggaacagcaaagaggggagugugcuuauacccagucccagaucgcccuggagcgccuuuucucuccuggauacugcgaaauugaucacaucauccccuuuagcagauccuucgacgauagccugucuaacaaaauucucgugcugggcuccgagaaucagcggaaggggaacaaaaucccuuaugaauacuuuggagaggacagcgaacgcuggaacucuuucgagauuugggucaagggcuccuaucugaauuacaagaaaaaggccaaucuucucaaaaagaaauuuaccgaggaagaacaaagagauuggaaggcucggaaccugcaggacacaaaguacaucugucgcuauauuagcaauuucgugaacaacagacuggaguucaaagaguccgaaaauaagcagaaaguuaucacggugaacggccgggccaccgcguaccuccgcucuagaugggggcugaauaagguccgggaggauggagacaaacaucacgcucuugaugccgccgugguuggcgugacaacccaagggaugguccagaagaucagcaaauauuccaaggcucacgagcuguacacagugcgcaagaacgacgaauuuguggauguugagaccggagaaugcgucgacguggaugaguauaaagaaauuagaaaggacauccucccccggccguggagaggcuucucugaggagcugaaacugcgccuuagcgacaauccucucgaggaacugaagaaacugcccauugaaacguacaacgaggaguuuaucaaggaaaaugugaagccuauuuucgucucccgggugcccuuuagaaaaaucagcgggaaacucuucaaggagacaaucuauucugaacgcgccuuuaaggauggcuacuucguuuccaaaaagagccugguggaccuuaagcggggagaucuggacaacuuuuacaauuaugagugugauaaaaagcucuacgacgcuauuucugaaagaaugaaagaguucaacuauaauggcaagaaagccuuugagucccccuuccgcaagccuaccaagagcgggaaagaaggaccggucgugcggucuguuaagaucaaaagcgcggcccccuuuaaggauggcauuccuaugaacgaggggcugguggcuaaagaaggaauggucagaaucgacauuuacgagaaggaaggcaaguauuucgugguucccguguaccgcuaucagcuggccaaagggaucgucccuaagcgggcugccauugcgggcaaauccgagcuuaaguggcccaucauggaucagaccuacaauuucaaauuuagcaucuucaagaacgaccucauugagaucaaauacgccaagaaggauggauauuuuggcuacuaugacggguucgauagacauacagcuucucuggugauugaaaaucacgacaacuccgaccgguaccgcggaaucggcgugaaaaccggggucguugaguuuaacaaguaugaaguggaugugcugggaaauuaccauaaagucaaccucggcgggaauuga

SEQ ID NO: 3832 - RNA, 3201 nt, Artificial Sequence
  Cas9 variant
augagcgagagagugguccggcgcauccugggcauugaccucgggaucgccuccugcggauggggcguuguggauauuucuggggcuggaggcgggaucauugccaccggagugagauguuucgacgcgccccugaucgauaagacaggcgaaccuaaaagcgcuacgcggcgcaccgccagaggccagcggcgcaucgucagacggcgcagacaacggaugaacggggugcgcagacuucugugcgaguuuggacuccugccggacccccggccugaugcccuuaaucaggcuaugcgcagaauuuccacagccucugcugccgcgcagguuacccccuggacacugcgggccgcugcccaccagagacuccugagcaacgaagaacuggcugugguccucggccauaucgcccgccaccggggguucagauccaaugcgaagaacgaagccggagcuaaugccgcugacgagaccucuaaaaugaagaaagccauggaggccacacgcgaaggccuggcuaaguaccaugcguuuggggauaugauugccaacgacccuaaguucgcuaaucggaaaagaaaccgcgauaaggacuauagccacaccgccaaacgguccgaucuugaggacgaagugagagccauccugcgcgcucaacuccgguuuggaagcgccgcggcuacggagacccuggcccagacauucgccgauguugcuuucuuccagagaccccuucaggacucugaggaccgcgugggcgauuguccuuuugaaccgggccaaaagcgggccgcuagacgggcccccuccuucgagcuguuucgcuuccucagcagacuggcgaaucugaaacucgccgucgggcggucuccugaaagacgccugaccgcugaggaaauugcccuugcugccaagggauuuggcgagacaaagaaaaccaucacguucaagucccugcgggaggcgcucgaccuggaucccaacgccagauucagcgggauuggaaaagacaaggaggcuucucuugaugugguggcccgcacaggcggggcugccuacggaaccaaaacacugaaggacgcccucggcgaugcuccuuggagaucccugagccggacccccgagacccuggaccgcaucgcggaaauccucuccuuuagagaggauauuacaucuauccggaauggccuggaagaccuugggcuggauagccucgucguugaggcccugaugcaggcugccgccaacggagacuucaaagaguuuacgcgcgcuggccauauuuccgccagagcggcucggaauaucauuccggggcuucgcgaaggacugguguauagcgaggccugcgccagagugggcuacgaccacgcugcccggcucucugucccucuggaucagguggggucccccguuacccgcaaggcgcugagcgaagcucucaaacaggugagagccgucgcccgggaguauggcccuaucgacuacuuccacaucgaacuggcuagaucugugggaaaaagcgccgaggagcgcaagcaacuuacagauggcauugaagcucggaacguugagaaagccaagagacgcaaacaggcggaagaacaucuggggcgggcccccuccgacgaugagcuccugagauaugaacuggcuaaggagcagaauuuuaaguguaucuacucuggagacgccauugaucccgcuggcguggccgccaacgacacccgcuaccaagucgaucacauccuuccuuggagccgguucggggacgauuccuaucucaacaaaacacugugcaccgcuagaagcaaucagaacaagcgcggacggacgccguuugaaugguucgaggcggacaaaacagauguggaauggauggaguacgucgccagaguggagaaucugcaggaaguuaagggccggaaaaagcgcaacuauucuauuaaggacgcugccgccaucgaggacaaauuuaaggcuagaaaucucaccgauacccagugggccacacggcugcuugcggacgaacugucccgcauguuucccccuagagagugugaacgggcuaucugcgggagagccgauggcggaaacgacggccucaccauuguggaggagcgccgggucuuuacaagacccggggccaucacgagcaaacugcgccgggcuuggggacuggaaggccuuaagaaacaagaugggaagagaguggaggacgaucgccaucacgccguugacgcgcucgugcuggcugccaccacagaaucucugcuccagcggcugaccgucgaggugcagagacgcgaaagagagggacggccugaugacauuuuccacugugccgagcccuggcgcggcuuuagagcugaugugcggcgcacaguuuacggguccgaaaccaugccgggcaucuucgucagcagagccgagcggagacgcgcucggggaaaggcccaugacgcgacgauuaaacagaucagagaaauugagggcgagcgccuuguguucgaacggaagccuguggagaaacugaccgauaaggaccucgaaaagauccccaucccuaagcccuaugggcaagucuccgacccuaaaagacugcgggaugagcugguggaaucucuucgcgccuggauugcugccggaaagcccaaggacagaccgccucucagccccaaaggcgauguuauccggaaggugcgcauucagacaaaugacaaagucuccguggagaucaacgggggaaccguugauagaggcgacauggcucggguggaugucuuucgcaagaaaaauaagaaggccgugugggaguacuauguugugcccauuuacccucaccagaucgucgcccugaacgacccgcccgauagagcugugaucgcguacgccgaagacaaagauuggaaggagauugacucuagcuaugaguuccuguggucccucuuugggcugagcuacguggagaucucuaaagcuaauggcgaaugcauugacggauauuuccggggccuucaucgcgggacaggagccgccuccgucuguaagcacaucagccugggcaaagaugcuaccguuucugggauuggacucaagacgcuggccuccuuuaagaaauucacaaucgacagacugggccggaaguuugagaucccuagagaggugcgcaccuggcggggcgaagcgugcacauga

SEQ ID NO: 3833 - RNA, 3201 nt, Artificial Sequence
  Cas9 variant
augagccaccuggugcucggccuggaccuugggcccaacuccaucggaugggcccuggucaaugaugacccugagcauccgguugaaucuaagcucguggaucugggcgugagagucuuccccgaggggguggacaacuuugauaccagcaaagaacuuucccggaaugaggaccgcagaguugcucggggaaugcgcagacagauucggcgcagagcccggcgcagacaacagcugaagcaggcgcucaucgauucuaaacuguggccuagcgaccccaacgaugaagugguccuguacaauacaaacccuuaugagcuccgggcucgcgcccugaaggagagacuugaaccccacgaggugggccggguucugcuccaucugaaucagcgcagaggguuccuuuccaaccggaaaaaggacagaggagauaaggaagugcaaggcaugcuggccgagauuaaugagaacgaacagcagugcaaagacggcggguuugauacgaucggagcuuggcucgccgacaagcaggcuaauauugaccacgccaaccgcgaggaaaaugaucauguccggaacagacaccuggcgcgcucucaauacguggacgaguucgaagccaucuggagcgugcaggcuaaacaccauccuaagcugcucaccgaggagcugaaagucggcaaacuugggaagcagacauauccgguuaagcccaucccucgguggcacgaacauagacagggacugagcccccucgaguccuuuggcauuuacgggcugaucuucuuucaacgcccuauguauuggcccaagucuguggugggacuuugugaacuggagccgaaagaacggagaugccagcgcuccgaucggagacagcaacgcuuccggcuccugcaggaggucaauaaccugaaguacguggacccugauacccaccucgagcagaaacuggacgauaagcagagacggcuucugcucgacaaacugagccacacaaaggaaaugaccuuugaucaaauucgcaaggcccuugacuuccuggagucuguuaaauuuaaccucgaaagaggcgagcgguccagacugaagggcgugcccaucgaugcucuguucgccgcgaaagacguccucgggcaggaaugguaugaccgcccugagcagcagaagacagagauuguggccguucugcuugauaaugaacgggacgaugacagaaucauugcucgcgccguggcugaguggggaaugaccgccaaagaagccgaggcuaugcugggcgucgaucuccccgcgggguacgccaaccugagcuguaaggcuaucgagaagcugcuuccccauauggaaagaggacuccuguacauggacgaugacgagucuaauuccgccaugcacgccgcuggcuaucugcggcgcgaucaacucagacggcgcaucuuugacgugcugccugauccggccagaacgcccaacugcccuauuggggacauccccaauccugucgugaaacggacccuuacagaaauucgcaagguugugaacgcgaucgucagagaguacggaaaacccgaugcuauucaucuggaacucgcccggagcgugcagaugggcaaggagaaacgcuccgaguauucuaagaugaucagagaccgggaagccgagagagacggcaucguugaaaagcugcgcgagagcggggugcgggucaccagagauaauauucugaaauaccagcuuugggaacagcaaaaccaggaguguaucuauuccggaaagccgauuagcuucgagaaacucuucggcgaagggggaggcguggagguggaccacauccugccucgcucucggucccuggaugacagccaggcuaauaagauuguuugccucagaacagccaacgcugggaaaggcgaucagacccccuacgaauggcuggccgacacgcaaccuaagcaguaugagcaggucugucaacgcgcgggaaugcuuaugcggucuggcagaaugcccuacgccaaguaccgccgguuuauccagagagaacuggagcucgauaaauucaucgcucggcagcuggccgacacaggguauauuaccaaggcuacaauggaguaccugcgcuaucuuuuugauaaagaccaugaugugcucggacugaagggccagcugaccgccgaacucagauaccacugggggcuggagaccauccuugaggaacugccugacagccccgcguggcacgaggccgauuccggaaaacuccggccgggcgaaaagaaucgcgcugaccauagacaccaugccauugacgcuguggucaucgcccugacaaaccggagacgccuggugcaacuuucugauauuguuaaaagagggggcgcccgggcucacggagagauccucgaagacccuuggcccaauuuccgcgagaacgugguccaggcgauuaagaagacgaaugugagccaccggguugaaagaaaaguggccggcaagcugcaugaggagacccuguaugggcccacacgcaccccuggagaauggguccuccggaaaccggugaucgcucuguccgccaacgagguugaaagaauccgcgaugccacaauuagacagaucguggucagcgcucuugccgacgcgggcauugauguggggcggggaaagaaacccgacgcuaagaagaugaaagaggcccugucuaagcucaaaaugccuuccggcgugcccauccgcaaggucagacugaccaaaccugaacagacgauucaacccguucgggccgggcgcccugaucaggcuuuugugaagcccggcagcacacaccaucugugcaucuucgaguuuaccgagaacggaaagaccaaaagagacgccguguucgucacaaugcuugaagcgaugaaucggcugaagagacgcgagccggugauccagcggacccacccugaaagacccgauucucgcuuuguuaugucccucagcgcucgggagaugcugcucgccaacuggaaagacggcgaaagacugcuuacauucaagacggccuccucuacccaggggcaaauuugguuugcugagcauacagaugcccggaaaagcgcugacuacaagcaguucguggccaaugcgaacacccuggacgccaagaaagucacaguggauccucucggacgcaucagaugggcuaaugacuga

SEQ ID NO: 3834 - RNA, 3204 nt, Artificial Sequence
  Cas9 variant
augggcaccagacuggggcucgacaucggaacaaacagcauuggcuggugccuguucaaucuugauggguccggacggcccaucggcauucgcgacaucggggugagaaucuuuucugauggacgggacccucgcagcggcgccucccuggcugucgagagacggguugcccgcgcgaugagacggcgcagagaucgguacauccgcagacggucugcucuccuggaagcccuuaucaacacgggccugaugccggccgacgugcaggagagcaaggcucucaccgggugugaucccuaugugcugcgcgcccaagcucuggacagagcccucgaugcgcaccuucuuggacggguccuguuccaucucaaucagagacgcggcuuuaaauccaaccggaaggccgaaagaaaagcuggggacgauaaggagggaggcaaaauugccgacggggcuaaggcccuggaucuugcgaugcacgaagccggagcucgcacauacggcgaguuccuggccggccgggacucuagacgcgugcggcucagagcugagggggacggauaugauuuuuacccugaacgccggcaucuggaggccgaauuugacgccaucugggaugcucaggcggccuauaaucccgcucugcucaccgacguugugagagaucgccugcggagaauuaucuucuuccagcggccucuuaaggcccccaaagucggcgggugcacauuuuucaacgaggagccucgccugccgaaggcccacccccucuuucaagaaagacggcuguacgaggaagugaaucagcuugagauuaccagagcuggagccccuagccgcaaacugacacucgaccagcgggauaagaucauuagaaaacugaaguccgcgaagaccgcuagcuucucuggccuggcccgccuccugaaacuugccgacggggaauccuuuagcagaguuacggagaaccggaccggacuggcuggcgaugacaucuucacaucuuucuccgauaagcgcuguuuuggcgacagaugggcccauuucgaccccggggugcaguggagcaucauugagaccgucacagaagaggaagauccugugcggcuccgcgacuggcugauggcuacccacggagugacggucgagcaagccgaagcgaucggcagaguucggcuucccgaggggcacggacgccugggcgagacagccucuagacucauucuggcucagcugaaauccgggagcaaggauggccauccgcucaccuauaaugaagccguggaggcugcccugggaaaaucccacucugacuuucggacaggcgaaauccuugagcagcugccuuacuacggggaaauucucagccgcgagauucccccuggaucccuggaucccgacgaugacgaugagaucagauggggcaagauuaccaaccccaccgugcauaucgggcugaaucagcuucggagacuccugaacgcgcugauuaaagcccacggacgcccugacgaaaucgucguggagcucgcucgggaacugaagcugagcgagaaggauaaagccgagcacaauagacgcauuggcgcuaacacacgggccgccgaagcuagaucuaagaaacugcucgaguccgggcaaccggacacgggcgcgaaucgcagccugcugaaacuuugggaagaucucaaccccaacaauccucuggaccggugcugucccuucugcggaagacauaucggccagauggcccuguuuucuggggagaccgaaaucgagcacauuaucccuuauagccgcucccucgacgauucugcugccaacaagguuauugcccaucggagcuguaauagagagaagggaaaccggacacccugggaggcuuggggccacaccgaacgcugggccaucauugcggaacagguguccagacugcauaagagcaaacaauggcgguucgcuccggacgccaucgagcgcuuuaaucaggaagggggauucauugccagacagcuuucugauacacaguaccugucccggauggcuagaaccuaucucagcucucuguacccugacacggccggcgucuaugugauccccgggcgcaugacagcgaugcugcggagacuuuggggccucaacgagcugcugccugaucacaauuacguugagaacccccacuccggagcuccuaagaaucgccucgaccaucggcaccaugccaucgaugccgcuguggucggcgugaccaccagagggcugcuuaacgaaauuagccgcgccgcuggacgggccgagagacaagaccuggaucgccucuuuaucgaccugcccaaaccgugggaaacauucagagaggaucugcacgaaucccuugcgcgggucgugggcucucacaaggccgaccaugggcgcaaaggaguuccugcuaagggcaaggaugccaccgcugccagacuccacaaugagacagccuaugggcugacgggccugaccagcgaguccggacuccccauugugguccaucgggugccccugcuuucucugaaaccugacgaccucagcaacccgauccgcauucccgaugcugcgcugcagagagcccugcgggaagcuacagacggcaaguccgggaaagauuuucaggaggcccuugcccaguucagcaagucugacccuguuuuuaaaggaaucagacacgugcgcguccgggaaacccugaaggugauccccauuagagaugcuuccggccaugccuucaaggcguacaaaggggacgcuaaugcccgcuacgauguguggcggaugccugacggaaaguggguuagcucuuggagagaucgggacggcaaagcccacuccggcaucauuacaauguucgcugcccaccaagcggggcagcccguccagcgcccucaucccgcugccaagagagugcucagccugcggcagaacgaucucguggccgucgagccgcaaggacagccucgcaaaaucaugagagugguuaaguuuucuagcggcgggcagauuaccuucgcugagcaccaggaagccggaccccugaaagcucgggacgccacguccccugacaucgaucccuuuaaguauuucuacagcucugcgggcgggcuucaaaaggcccgcgcuagacagauccggauugacgagcugggacgcaucuuugauccgggcccuagauga

SEQ ID NO: 3835 - RNA, 3207 nt, Artificial Sequence
  Cas9 variant
augaaguacgugcugggccucgacaucgggauugccagcugcggaugggcugucaucaaccaggagaaacacagaauugaagaucugggcguucggaucuucgacaaggccgagaaucccaaagaugggaagucccuugcgaccccucgcagagacgcucggucuacacgcagaacgcugcggcgcaaaaagcauagaaugcaacggauuaagauccuccuggugaaacacggacuucugagcaagaccgaaaucgaucaucucuaugaguccgccacagaaauugacgugugguaccugcgccugaacgcccucgagagacggcugaauccgaaagaguuugcucgcguccuuauccaccugucuaagagacggggcuucaaaagcaaccgcaaggaaaccacacucuccgagaaugggcagauucuggaaaacaucucugagaaucuucagauuauggagcagaagaacuauagaaccgugggagaaaugauccugaaagauaagcgguuugagaaucauaaaagaaacaaggacggcacauacauuggcaccguuacgcgccaacagcuccaggaagagauccagaugaucuucaaugcccaacggcuguauaaaaacaaucacgcuaccgaaaaguuugagagcuccuaccuggagauuugggccagccagagacccuaugcgucuaaagaucagaucgaaaagaugauuggguacuguacacucgagccuaaggaaaaacgcgugcccaaggccuccuggagcuuccaguacuuugucgcucugcaaaccaucaacaaucuucggcugauuucuaaagacagaaucgaggaacucuccuucgaggagaagaaacgcaucaugaaccuggcccuugaaaagagcauugugaaguauaucgauauucggaaacugcucucuguuccuaaggaguuucaguucaacucccugagcuacuccgcugacaucguggauacaaccgucgaaaauaaaaagugcauugagcugaaagaauaucacucuaucaacaagguguacaagcagaucuauggacaaaaugcccucaaccugcuucccaaagacuacgacacgauugcguauggccugacaaucuuuaaggaugacaaagauauucaggaguaccuccagaauaaguacgugaacgccaaagggaagccuaucagcaaucuggcuaacaagaccuaugacgauacauucauucagguccuucugacccucaauuuuuccaaaaugggacaucugagcuucaaggcccugaaaaacaucauuccguuccucgaggaaggccugucuuacgacaaggcuugugagaaagccggguauaauuuuaagggaaccuccuacacaaagaagacgaaguaucuucccguuaucccucaaaacaccaaucccguggugcacagagcccugagccagacacgcaaagucaucaacgcuauuaucaagaaauacggcucuccuaaugcgauucauaucgaaaccgcccgggagcucagcaagacauuccaggagagaaaagaaauugauuccauguaucaggacaacucuaagaagaacgagcacgcuaucugcaaacugaaggaacugggcaauaucaaccccagcgggauuaauaucgugaaauuuaaacuuuggaacgagcaagauggacgcuguauguacaccggcaaauacauugaaccgcacagacucuucgaggagggguauacggaaguugaccauauccugccuuacucccggagccuggaugacucuuauaauaacaaggugcucacacugggaaccgagaaucagcggaagggcaacaaaacccccuacgaauauaugcgcaauaacuccauuugggacgaguuugaaacaagaguccagagcaauaagaaaaucaacaagaaaaagcagcaaaaacuucugcuccagaauuucucucacgcccgggagcaggaguuuaucgaaagaaaccugaaugauacccgcuacgccacaauuuaucuguccagccuuauccagcaacaucucauuuucuccgagucuagccgggaaaagaaggugcacacgguuuccgggaucauuaccucucaucugagaagccgcuggggauuuaacaaagacagaaaggagggccacauccaccaugcucuggaugccgugaucgucgcggugacauccgaccacaugauucagcgggucaccaaauacuacaagcucaaagaacugaaccgcaauagacaggcuaagcggaugcaauucccugagcccugggagggcuuucgccuugaacuggaggccagaaucagccccaacacacagcaguaucucaaggggauucgguucaaaaauuacgccgaugugaaccugucugaaaucaagccuauuuuuguuucccgcaugccgaaaagaagcaucaccggagagcugcaucaggagacgauucggaaguuccuuggcuauaaugaaaaagggaaggugcucaccgcuacaaagaccaaacuggaggacauccccuucgaugccaacggagacuuuccuauguucggcaaggaaacagaucuguacaccuauaaugcuaucaaagagcgcuaccucucucacaagaaagacaaguccaagagcuuucaagaaccccuguauaaaccuacgaagucugggggcauuggaccccuuaucaaaagcauuaagaucauggauacaagaaccauugucaacccggugaaucagggcaaagggguuguguacaacuccaagaucgcccggacagacgucuucaagaaaggagagaaguacuaucugaucccuauuuacaccaucgaucucaugaaaaauacccugccccagaaggcgauuacagccggcaaaggguaugaggacuggacgaccaucgacccuagcuuuacauuccuguuuucucuuuuccccaacgaucucauucagaucgugccuuccaagaauaagaccaucaaagcuagaacaaccgugagcaagaaagaaguucugcugcccucccucacgggauacuuuaagggcguccacucugggacagccggcauuaccguggagacccaugacggaagcaucauugcuaacgugggcuccaaacaacugcuuucuuucgaaaaguaucaggucgaugugcuggggcacuacacaaaaaucaagaaggagaaacgcauuggaauggccaucuga

SEQ ID NO: 3836 - RNA, 3207 nt, Artificial Sequence
  Cas9 variant
augaacaaggccguggcuuacagacuggcccucgaccugggcagcaccucccuugggugggcgaucuuccggcugaaugaggcucgcgaacccacagccauuaucagagccggaguccggauuuucucugauggccgcaacgcuaauagcgagccucucgccguucacagacggguggcucgcgccaugagacggcgcagagaccggcugcuuaaacgcaagaaaagaaugcaugaucagcuggugcaacacggguucuuuccggcggaagucgccgagcggaaggaacucgagcgccugaaccccuaucagcugagagcuaaaggacuccaugaggcccugacgccuggcgaauuugcucgggcccuuuuucacaucaaucagagacgcggguucaaguccaaccggaagaccgacagaaaagauaaugacucuggagcgcugaagcaggccauuagcgagcuccgcaaacggauccaagauuccgacugcgcuacagccggcgaaugguuuuggaaggagagaaugcagcagaaacccgagggcgugcgcgggcaguggguucgggcuagauaccgcaagaccccuucuacaaccgaugaaggaaagaaacggaucggcuaugaccuguacguggauagagccauggucgagcaagaguucgacgcccuuugggcugcgcaggccgcucugcagcccgggcucuuuacagaagccgcccgcgcugaacugaaggauacccugcucuaucagcgggaccugagaccugugaaaccgggacgguguacgcuucugcccgccgaggagcgcgcgccucucgcucugcccagcacccaaagauuccggauucuucaggaaguuaacaaucugagacuccuggacgaggcccugcgcgaagugccucucaaccuggcccagcgggaugcugucguguccgcccuugagggcaagaaagaacugagcuuugcugccaucagaaagcuccugacacuuucugggaaauucaaucuggaggacgagaagcgcgcggaacucaagggaaacgccaccuccgugauucuggcuagaaaagaucuguuuggcgacgccugggcuggcuucgaugccgcgguccaagacgagaucguuuggcggcucgugagccaggaaucugagggggcccugauugcuuggcuucagcagcauacaggaguggauggcgucugcgccgaagcuaucgugaauacccgccugcccgacggguacggaagacucucccggaaggcccuggagcgcauuguuccggcccugcaaagagagguguguacguaugauaaagcuguccaggcggccggcuucgcucaccacagcgaccuuggguuugauuucgacuacgccgaagacgaggugcagcagguuggagaacauacaaucgccucuaccggcgaggugcaagcucaguacgccuuuaagcagcucccuuauuacggcaaagcgcugcagcggcacgucgcuuucggguccggagaugccaaggaccaugaggaaaagugcuauggcaaaaucgccaaccccacagugcacauugggcugaaucaaguccgcaccgugguuaacgcucucaucagacgguacggacacccuaccgagguggucguggaacuggcccgcgaucuuaagcagagcagagagcagaaacagcaaacacagcgggaacaggcggacaaccaaaagagaaaugaggauauucgcaaacggaucgcucccauucuggagacgucccccgaaagaguucgcgaccgggauaucaagaaguggauccucugggaggaacugaacaaaaaggacauugccgauagacauuguccuuauucuggcgagcgcaucagcgccaccaugcugcuuuccgaagcuguggagauugagcacauccucccguuuagccggacacuggacgauucucugaauaacagaaccgucgccaugcgccgggcuaauagaauuaaaggggaccggacacccugggaagcccgcgcggauuucgaggcccagggcuggagauacgaagcuauccuccagcgggccgagggaaugccuccccgcaagagauaucgguuugcugaagacggcuaccagagauggcuggggaaagaccgcaacuuccuugcccgggcccugaaugauaccuccuaccucagcagacuggcugcgaacuaucugcgccuugugugcccucaaggagugcggguuauccccggccagaugacggacaagcucagagggaaguuuggacucaauucuguccugggccuggaugggaaaaagaaccgcaaugaccaucggcaccaugccguggaugcuugugugauuggcgucacagaccagggacugaugcagagauucgccaacgccagcaaacaagcucgcgagaauggccuuaccagacuggugcaggauaugcuccugccgugguggccuuccuacuaugaccacguugagcgggccgugcgccacaucagagucucucaucggcccgaucacggguuugaaggagcgaugaugaagggcaccgcucaugggauucgcgaggacggaaucagagaagauggccggauuaaacagagaccuaaggccaaagggagcgccgaccacaagacaaucacccugauucccaucgaugagccucgccagcuugcucggcacggcguggacgccgagggaaagccccucccguacaaaggcuaugcguccgggagcaacuacugcaucgaaauuacaaagaauggaaaaggcaagugggaggggcaaguuaucucuacguucgacgcuuauagaauuaaagccgccgcugaugccgcugcccgcgcgggacaggugaucuccaccgucgaagccgacagcauugugcggaagucuggcugggagagacugcgcggggcucagucccaaaacggccagccucugguuaugcggcucgugaucggagauagcgucagaauggaaguggacggccgggaugaggugaugcgcgucguuaagauguccgggaaagagaugguguuugcccccgugagagaagcuaacgucgacaagcggaauaacaugcccgaugagcaggacccuuucacauacaccuacaaacgcgccgaucagcugagaaaggccaaagcucggcaagugacaaucucuccgauuggagaacuucgcgaccccggcuucaagggguga

SEQ ID NO: 3837 - RNA, 3207 nt, Artificial Sequence
  Cas9 variant
augcaguacgugcugggccucgacaucgggauugccagcugcggaugggcugucaucaaccaagagaaggaaagaauugaggaucugggcguucggaucuucgacaaagccgaaaaucccaaggaugggaaaucccuugcggcuccucgcagagacgcccggucuacccgcagaacacugcggcgcaagaaacacagaaugcuccggauuaagauccugcuugugaagcagggacugcucagcaaaaacgagcugaaucaucuguaugaauccacgaccgagguggaugucuggaaccuccgccuggacgcccuugagagaaagcugaauccgaaagaauuuacacgggugcucauccaccuggcuaagcgcagaggcuucaaaucuaaccggaaggagaccacacuuagcgaaaaugggcagauucuggaguccaucucugagaaccagcaaauuauggaacagcagaauuaccgcaccguuggagagaugauccucaaggauaaaaaguuugaaaaccauaaaagaaauaaggacggcacauauauuggcaccgugacgcggcagcaacugcaggaggaaauccagaugauuuucaccgcccagagacuguacaaaaacgauuaugcuacagaggaguuugaaaucagcuaccucgagaucugggccucccaacgccccuaugcgagcaaggaccagauugagaaaaugaucggguacuguacccuggaaccuaaggaaaagcggguccccaaagccucuugguccuuccaguacuuuguggcccuucaaacaauuaauaaccugagacucaucagcaaggaucgcauugaggagcugucuuucaaagaaaagaaacagaucaugaaucuugcucuggagaaguccaucguuaaguauauugacauccggaaacuccugagcauuccuaacgaauuucaguucaacucucuguccuacagcgcugauaccguggacacgacacucgagaauaagagaugcaucgaacugaaagaguauuacuccauuaacaaggucuauaaacagaucuacgagaagaaugcccuuaaccugcuccccaucgacuaugauaccauugcguacggacugacaaucuuuaaggacgauaaagacauucuugaauaccugcaaaauaaguaugugaacgccaaaggcaagccuaucaauaaccucgcuaaaaagaccuacgauuauaccuucauucaggcccugcugacacucaauuuuacgaagauggggcaccugucuuucaaagcucuuaagaacaucauuccguuccuggaggaaggacucagcuacgacaaagccugugagaaggccggcuauaauuuuaaagggaccuccuacacagagaagaccaaauaucugcccgugaucccucagaacacaaaucccgucguucaucgcgcucugagccagacccggaaggugaucaacgcgauuaucaagaaauacggaucuccuaaugccauucacaucgaaacggcuagagagcuuuccaagacauuccaagaacgcaaagagauugauagcauguaccaggacaacucuaagaaaaacgaacacgccauccauaagcucaaggagcugggcaauaucaaccccagcggcauuaauaucgugaaauuuaagcuguggaacgagcaggaugggcggugcauguauuccggaaaauacauugaaccgcacagacucuucgaggaaggcuauaccgaggucgaccauauccugccuuacucucgcagccuugaugacuccuauaauaacaagacccugacacucgggaccgaaaaucagcggaaaggaaacaagacacccuacgaguauaugggcaauacgagcauuuggaacgacuuugagaccagagugcacucuaauaagaaaaucaacaagaaaaagcaacagaaacugcugcuucagcacuucuccuacgcccgggaacaggaguuuaucgaacgcaaucucaacgauacaagauacgcuaccauuuaucugagcucucugauccaacagcaucucauuuucuccgagagcucccggaagaagaaaguucacacagugucugggaucauuaccagccaucugagaucccgcuggggauuuaauaaggaccggaaagaaggccacauccaucacgcccuugaugcggucaucguggcuguuacgucugaccacaugauucagagagugaccaaguacuauaaacugaaggagcucaaccgcaaccugcaagccaaaagaaugccuuuccccgagcccugggaaggcuuucggcuggagcuugaagcccgcaucagcccuaauacacagcaguaccucaagggguucagauuuaagaacuaugcugaugucaaucuguccgagauuaaaccgaucuucgugagccggaugcccaagcgcucuauuaccggagagcugcaucaggaaacaaucagaaaauucauuggcuacaacgagaaggggaaaguccucaccgccaucaagacgaagcuggaagacaucccuuuugaugcuaauggagacuuccccauguauggcaaagagacagaucuuuacaccuacaacgccauuaaggaacgguuucugucccacaaaaaggacaaacgcaagagcuuccaagagccucucuauaagcccacaaaaucugggggcaucggaccgcugauuaaguccaucaaaauuaucgauaccagaaccaucgugaauccuguuaaccagggcaaggggguggucuacaauagcaaaauugcgcggacagacguguuuaagaaggaugagaaauauuaccugauccccauuuauacgaucgaccuuaugaagaacauucucccucagaaagccaucaccgcuggaaagggcuacgaagacuggacaaccaucgaucccucuuucacauuucuguucagccuguuuccuaaugaccucauucagaucguucccuccaaaaacaagaccauuaaggcccgcacgacagugagcaaaaaggagguccugcuuccgucucugaccggguauuucaaaggagugcauuccggcaccgcugggaucacaguggaaacccacgauggcagcguuauugccaaugucggauccaagcaacuccugcugaucgagaaauaccagguggacauucuuggccacuacacaaagaucaaagaagagaagagaaucgggauggcgauuuga

SEQ ID NO: 3838 - RNA, 3207 nt, Artificial Sequence
  Cas9 variant
augcccaagagcgccaaaccucagcaggcuuacacccugggccucgacaucgggauugccuccgugggagcggcucugcuuggccaacagcacaucauugggcugcaugucagaacauucgaucgggccgagacggccaaggaaggagagccgcucaacaaaauccgcagagacgcucggcugacccgcagacggcuucagcgcagagcccaccggcugcuccgccugagacggcuguuuaagcgccauaaucucauucccgauacagacaccucuacauucaucagcggccaauccccuugggaacugagagcucaggggcuugaucggcagcugaccucugccgaguggacaaccguucucuaucacaucgugaaacaucgcggauuucacagcaacagaaaguccgaagugaagacggacgagaaagcgggccagaugcugucuggcgucaaucaaaaccaggcccuucugaagcagagcgggcuccggaccaugggagagcuggcugccagacacgaggcuuuccgcgaagccaaacggaauaagaaaggcgcguacaaccauacauuuuccagacacgaucuggaagacgagcuccaucugcuuuucagccgccagcgggagcuggggaaucccuaugccaccccugaacucgaggaugcugugcacacacugcuuaugcaaagacgccccgcccugucuggaaccaaccuccugaagaugguuggccacugcacgcuggaaccugacgaguuucgggcuccgaaggccuccuacacagccgaaagauucauuuggcucaccaaacugaauaaccuucgcgugagcgggucuggagagacacggccccugaaugaguccgaaagacaggcucuccugagcaagccuuuuucucaguccaaacuuaccuauaagcaaguccgcaaaauccuggagcuccccgauaacauucgguucgugggccugcauuaccacccugcgcaggacaauggcaagagccccgaaaacagaguguuuuucgaggccaaggcuuuucaugcccugcggaauguuuauaaaaaggccgggcucaaccuggaauggcagcgcgauucccagaacccggagaaacuugacaauaucaccuacgcucugacagucuucaaggaggacaaagaagccaagcaauggcucauugagaaaggaguggaagcgucugugaucgaggcuguccugaacgagagcuucuccgaauuuguuagacugagcauuaaggcccuucggaagaucaucccucacauggagauuggccauagauacgaugaagccgugaaacucgcuggguauucucaccacucccaucugccccagccuagcaagacgcccuacaucccccgcuucucuaaacagagcauugccaauccuguggucucccgggcucugaaccaggccagaaagcucgugaaugcgaucguucgcgaguauggaccgcccgacgccgugcacauugaacuggcuagagaucuuaacaaaccuuuugacgagcggcgcaagaucgagaaggaucaagaaaaauaccagaaggacaaagccagagauaucgagaccuuccaggaaaauuuuggcuucacacccaaggggcugcagcucaccaaauggcggcuguaucgcgagcaaucuggaaagugugcuuacagccugaagccucuugacauuaacagacucuuugaagauggcuaugucgagaucgaccaugcccugcccuacucccggagcuucaaugauggcaugaacaauaaagugcugacacucaccacggagaaccgcaauaaggggaaccagacaccguacgaauaucuggacggagcgucuaauuccgcccaguggagaaacuuuguugcuugggugaacagcaauaaaucuuaccgggccuccaagcagcgcaaccuucugagaaaagacuucgcugcccaagccgcuaccgaguuucgggaaagacaccucaccgauacacgcuauauugcgcgggaguucaagagaauggucgaaacccaccugaaacugaauaagccuaaccagcgcugcguggucgugagcggccagcuuacagccuaccuccgggcuagaugggggcugaucaagguucgcgagaauggagaccugcaucacgcccucgaugccgcuguggucgccgcguguucccaugcuauggugaaacggcuggccgacuauucuagacgcggcgagcuucaauacgcccgggggcaccauuuugaucccgaaacgggcgagauuaucgacaucaacgcucugagaaagcucgaugaccacuucccucagcccuggaccgauuuccggcgcgaacugcuggccuggcuuagcccugaccccgcgcagcagcucaaaaaucuggcuuauuacacagaugagagacugaagcaaguuaaaccgauucgggugucccgcgccccuaccagacggggacucggcgccgcucaccaggaaacaaucagaucugccaaguaccugggggagaaccgcagcaccgucaagacgccccuugagaaacugaagcucaaagacauucccaauaucgugggauaugaagauccucggaaccaucagcugauucaggcuaucucccaaagacugaccgagcacggcgacgacgggaagaaagccuuuaaggaaccgcuuuacaagcccggaaauaacaaaagcacagcgccugugguucgcucugucaagcuguucaccgugcagaaauccggcauucccgugagagggggcaucgccaauaacggaaauaugguccggguggauaucuuuacaaagaaagagcgcuauuucgcuguuccuguguacgucagcgacgccgcucggaacgagcuccccaacaaggccguggccagaggcaaggauggguggauugacaucgaugacucuuuuuccuuccuguuuagccucuauccuaaugauuggguuucuguggucgugaaaccccaugaagcuccgugcgagggauacuaugcgggccuggacauuagcaccggggccauccacauuugggcucaugaucgcaacagauccguuggaaagaauggccuuaugcggagcaucgggaucaaaacggcccacucuguggaaaaguaccacgucgaccugcucggcaaccuguaccgcguggugcaugagacaagaaaaccucugcgggccggaaaguga

SEQ ID NO: 3839 - RNA, 3207 nt, Artificial Sequence
  Cas9 variant
augcaguacgugcugggccucgacaucgggauugccagcugcggaugggcugucaucaaccaagagaaggaaagaauugaggaucugggcguucggaucuucgacaaagccgaaaaucccaaggaugggaaauccauggcgaccccucgcagagacgcucggucuacacgcagaacgcuucggcgcaagaaacacagaaugcagcggauuaagaucauccuggugaagcagggacuccugagcaaaaccgagcuugaucaucuguaugaauccgccacagagguggacgucuggaaccuccgccuggaugcccuggagagaaagcucaauccgaaagaauuuacccgggugcugauucaccuugcuaagcgcagaggcuucaaaucuaaccggaaggagacaacccugagcgaaaaugggcagauccucgaguccauuucugagaaccaacagaucaugggacagaagaauuaccgcacaguuggcgaaaugauucugcaggacaaaaaguuugagagccauaaaagaaacaaggauggcaccuauaucgggacggugacccggcaacagcuucaggacgaaauucagaugaucuucaaugcccaaagacuguacaaaaacaauuaugcuacagccgaguuugaaaacuccuaccucgagaucugggcgagccagcgccccuaugccucuaaggaucagauugagaaaaugaucggauacuguacccuggaacaaaaggagaagcgggcuccuaaagccuccuggagcuuccaguacuuugucgcucugcagacaauuaauaaccucagacugaucucuaaggaccgcauugaagaacuuuccuucgaagagaaaaagcagaucaugaaucuggcccucgagaaaagcaucgugaaguauauugauauccggaagcugcuuucuguucccaacgaauuucaauucaacucccugagcuacuccgcggacaccguggacauuacggucgagucuagaaaaugcaucgaacucaaggaguaucacagcauuaauaaaguguacaagcagaucuaugagaaaaacgcccugaaucugcucccuaaggauuacgacacaaucgcuuauggccugaccauuuuuaaggaugacaaagauauccuugaguaccugcagaacaaguacgugaaugccaaagggaagcccauuuccaacuucgcuaauaaaacauaugacgauaccuuuauccaggcccuccugaaccuuaauuucaccaagaugggacaucugagcuucaaggcccucaaaaacauuaucccuuuucuggaggaaggccugucuuacgacaaggcuugugagaaagcgggguauaauuucaagggaacauccuacacggagaaaaccaaguaucucccggucauuccccaaaacacaaauccuguugugcaccgcgcccugagccagacccggaaagugaucaacgcuaucauuaagaaguacggcucucccaaugccauccacauugaaacagccagagagcuuagcaaaaccuuucaggaacgcaaggagaucgauuccauguaucaggacaacucuaaaaagaacgaacaugcuauuugcaaacugaaggagcucggcaauaucaacccuagcgggaucaauauugucaaguucaaacuguggaacgaacaagauggacgguguauguacuccggcaaguacaucgagccccacagacuguuugaggaaggguauacggagguggaccauauucuuccguacagccgcucucucgacgauuccuauaauaacaaaacacugacccugggaaccgaaaaucagcggaagggcaacaaaacaccuuacgaguauauggggaauaccagcaucuggaacgacuucgaaacaagaguucagucuaauaagaagauuacgaaaaagaaacagcaaaagcuccugcuucagcacuuuuccuacgcccgggagcaggaguucaucgaacgcaaccugaaugauaccagauaugcgacaaucuaccucagcucccugauucaacagcaccugaucuuuucugagagcucccggaaaaagaaggugcauaccgucucuggaauuaucacaagccaccuuagaucccgcuggggcuucaacaaagaccggaaggaaggccauauucaccaugcucucgaugccgugaucguugccgugaccagcgaccacaugauccagagagucacgaaauacuauaagcugaaagagcugaaucgcaaccuccaggcuaagagaaugcccuuuccugaacccugggagggguuccggcuggagcuugaagcccgcauuucucccaacacccaacaguaccugaaaggauuuagauucaagaauuaugcugaugugaaccucuccgagaucaagccuauuuucgucagccggaugccgaaacgcucuaucacaggcgaacugcaccaggagaccauuagaaaguuuaucggguacaaugagaaaggaaaggugcugacagccauuaaaaccaaacuugaagacauccccuucgaugcgaacggcgacuuuccuauguaugggaaggagacggaucucuacacauauaaugccaucaaagaacgguuccugucccauaagaaagacaagcgcaagagcuuucaggagccccuguacaagccuaccaagucuggcggaauuggcccccucaucaaaagcauuaagaucauugauacaagaaccaucguuaacccggugaaucaagggaaaggagucguguacaacuccaagaucgcucggaccgacguuuucaaaaaggacgaaaaguauuaccugauuccuaucuauacaauugaucuuaugaaaaauauccugccccagaaggccauuacggcuggcaaaggguacgaggacuggaccacaaucgauccuagcuuuaccuuccucuuuucucuguuccccaacgaccugauccagauugugccuuccaagaauaaaacaaucaaggcccgcaccacggucagcaagaaagaggugcuucuccccucccugacaggauauuuuaagggcgugcacucugggaccgcgggcauuaccguugaaacacaugauggaagcgucaucgccaacgugggcuccaaacagcugcuccuguucgagaaguaccaaguggacguccuugggcacuauaccaaaauuaaggaagagaaaagaaucggaauggcuauuuga

SEQ ID NO: 3840 - RNA, 3210 nt, Artificial Sequence
  Cas9 variant
augaagaaacagccccaaagauacauccugggccucgaccuggggauugccagcgugggaugggcucuuauccuggucgauggcgccgagaacccuguugggcuccuggacugcggagugcggaccuucgaacgcgcggaggugccgaagacaggcgauucccuugcucuggccagacggcaggcccgcucugucagacggcucauucgcagacgggcucaccgccugcugagacuccggcgccugcuuaaaagagaagggauccugagcgccgcugacuuuaauuccgauggacuccccaaccugccuauugacgccuggcagcuucggguggcgggccuggagcgcaagcucacgaaucaggaaugggccgcuguucugcugcaucucgugaaacacagaggcuaucugucucaaagaaagagcgagacccagacagagaacaaggaacuugggagacugcucgccggagucgcugaaaauuccaaacugcuuucugagagcuccgagcaguaccgcacccccgccgagcuggcggugaagcucuuugccgaacagagcggccggcugagaaacaaagggggagauuauacacauaccuuuaaucgccuggaccuccaaaaggagcugcaccuucuguucgaacggcagugugcucucggcaacccuuuugccucugcugagcugcaguccaaaguugaugaacuucugaugacacagagaagcgcccuccaaggggaggccgugcugaagaugcugggaaagugcaccuucgagcccucugaauacaaagcugcgaagaauacguauuccgccgagcgcuuuaucuggcucaccaaacugaacaaucuucggauccuguacaacggcgaagacagagcucucgaugagggcgaacgcaagcagcugcuggacgagccuuauaaaaaggccaaacuuacauacaagcagguccggagcauucucaaucugccggagucugccguguucaaggggcugagauacggaaaagauuccgacggccucaaggcugaaaacggggcccugauggagaugaaagcguaucauaagauccgcaccgugcuugaaaaagcuggacugaagggcgagugggaaaaucggauuagaaaccccgagauccucgaccaaauugggacagccuuuagcgucuacaagaccgaugaggacaucaaagccgaacuggcugcccugcggcuuccugagaacguucucgaugcucugcuggccggacucaauuucgacaaguuuauucagcugucccuuaaagcgcugucuaacauccucccccugauggaacgcggcaucagauaugaugaggccuguaaggagguguacggcgaccaccgggcucuggccgaaagcaaaaaucagaugcuucucccucagauucccgcuaacgagaucagaaauccggugguccugcgcacgcugacacaagcccggaaggugauuaacgcgaucauuagacgcuauggguccccucagagaguucacaucgaaaccgcccgggagcucggaaagagcuucaaagaucgcaaggaaaucgagaaaagacaggaggaaaaucggaaggagcgcgaaagagcugccgagcauuuuaaagaacuguucccccgguucacaggcgagccuaagucuggggacauucuuaagcugcgccucuaccagcaacagcagggaaaaugccuguauuccggcauccccauugaucuggggagacuuaacgagaagggcuacguggaaaucgaccacgcucuccccuuuagccggaccugggaugacucuuucaauaacaaaguccuggugcugggaagcgagaaucagaagaaacgcaaccaaaccccuuacgaauaucucgacggcgccagagauucccagcgguggagagaguuucaggcccgcguucaggggugucgguucccguacgcuaagaaacaacggauucagacagcgaagcuggacucuaagacggaacagggauuucuugagcgcaaucugaacgauacccgguauaucgccagauuccucugcggcuuuaucgagaaaagccugcaucugcaaggggcuggaaagcgccggguguucgccuccaauggccagauuacagcccuucugagagggcucuggggccugaaaaagguccgcgaagacaacgaucggcaccacgcucucgacgccaucguggucgcguguagcaccgugucuaugcagcagaaaauuacaaaggcuaugcaaagacgggagacccuggaaacgaucaacacagagaccggagagguuaagacccgcauuccccagccuugggauuucuucagacaggaagugaugauccgggucuuuuccgacgcuccccgcgaggaacuugccgagaaacugaauagcagaccugaagcucuccaugauuucgugucuccccuguuuguuucccgggccccgaacagaaagaugacaggccaggggcaccuggagaccgugaaaagcgcgaagcgccuuuccgagaauauuucugucgugaaaaagccucugacagcucucaagcugaaagacaucgaaaacaucgugggauaccccgaucgggagccugcccucuauagagcccugcaagaacgccuucaggcuuacaaggacgaucccgccaaagccuucgccgagccuuucuauaagcccgcgaaagacggcgggcagggaagccugguuaaggccguccggauuaucgaaaauacgaagcauggccucaaagugagaaacgggauuaccgacacaaauggcgauauggugcgcgcugacgucuaccagaaggccgauaaaaagggaaaacggcaauacuuuaucgugccgguuuaugcuuggcaaguggagaagaacgagcugccuaccgucgacugcaaaggcuacgaaauugaugacacauaugaguucuguuuuucccuguacaaguaugauaucaucgaaauucagaaucccgacaacaugucuaaggagcuuagaguguacuauaucaauugcgauagcuccgacgggcgcuucuggcuggcccaccaugauaaaagcgccaaggaacagcaguuuagaauuucuacccagaaccagcccaucauuaaaaaguaccaaguugacccucucggaaaagagauccggcuguguaaggcugagaagcgcacggaacucaauggcaaaaagaaaaaguga

SEQ ID NO: 3841 - RNA, 3210 nt, Artificial Sequence
  Cas9 variant
augaacuacgacaucggccugagaauugggaucaccagcugcggaugguccauuaucaauaaggaucucgagcggauugaagaccugggcgugcgcgucuucgagaaagccgaaaaccccgaugggacagcuucugccgcgccuagacgggaggcucgcaagagcagacggaaacaccgcagaaagaaacaucggaucgaacgcaucaagagacuuauuguucagcacgaccugcucuccaagaaagagcuggauucucuuuaucugagcccguuuaauaucgacguguggaaccuccggguggaggcccuggaacgcaagcuggauaauagagaguucgcccggguccucauucaucuggugcaacgcagaggauuucagacgauccggaaauccguugaaauucaggaggagggcaaacuucuggaaaacgugucugagaaugaaagaaucaugaaggucaacggguacaagaccgugggagagauguucagcaagcacgaaaaauuuacacaucacaagcgcaauaaagacggcuccuauaccagcguugugacacggucucuccugcuuaaggagauuaaaaccaucuucaacucccagagaauccugggcaaugucuuuagcacacaaaagcucgagucugauuaccuguauauuugggggucccagcgccccacccugacguacgaacagcucaugagcauggugggaaacuguaucuaugagaaaaaggaaaagcgggcuccuaaaaccucuugggccuuccaguacuuuucccugcuucaaaagauuaauaaacugaaggugagcgacgauaacacacucagaaaacuguccaaggaggaacgcgacaucgucauugagcuugcuuucaagaaaaagaauguuucuuuuguggauauccggaaagcccugaagcucaacgacaacaccaaauucaaucaccugacauacagccauguggucgagaccaagaagguggaaaaagcgacguuuaucgagcugaagggcuaucaccucauuaaaaagcagcugaaagacagaaacguugaacuuacacaggagcugcagcccaaggauuacgacgccaucgcugccgcuuccaccuucuucaagaaugauauugaauuucgcgacuaucuccggaaccaauaccuggauagcaaugggaaaagaaagucuaacaucgccaauaaaguguucgaggacaaggucauugcggccguguuugagcuuaacuucuccaaaguuugccaucugagcuuuaagucucucuauaaacugaucccucaccuggaaaagggacucgauuacaaggaggcuauccugugugccggcuauaauuuccgcgacgaaaacaaacgggauaagaaacuuuuucugcccgugauucagcaggagacaaauccugucgugcacagagcucucacccaagcccggaaggucaucaacgccauuauccgcgaguacgggagcccgaauaccauuagauucgugguugcuaacgaccuggcgaaaacauacaagcagcggaaggaacuggaguccacgcuuaaaaagaauagagccgaaaacgagaaaaucaagaccaaacuccugucuaugggaauuaucaaccccacaggcauggauaucgugaaguauaagcugugguacgaacagagcggcauuugccucuauaccgggcgccagauggagcuguccagccuuuuuaaaccuggauacucuaucgucaaucauauuauccccuauaaccgguccuucgacgacacauaccacaauagagugcugacccucacggagacaaaguaugaaaaaggcaacaagauuccuuuugaguacuucggggcugaagagaccuguuggaaugaauacgagaaacgcguuagcaccucuaagaagauccaugauaaaaagagagagaaacugcugauccggaacuuugacauugaauaugagaaugaaaugaucuccaacaauguguucgauacacacuacauuggaagcuauuucgagaaguacaucgacgaacaucuucaauuuaaaaaguccaccaaaaagcagaaggucuucucuauucacggcaacaugguggcccaccuccauagccgcuggggguuuaauaaaaacuccagagagaucuaucugaaucacgccguggaugcugccaucguugcgguccugacagaccagcucauucggaacaucgcugauuacuaucgcagagacaauauucuggagcagaagggaucucuuaaauuccccgaaccguggaaguccuuuagcaucgagcuggaagcccggauuagcccucaagugcgcgaucucaucaaaaagcugaaccuggacucuuaccuugauguggacauccuccauauuaagcccgucuucaucuccaaaaagccuagacggaaagugaacggcgaggcccacaagagcacgauucgcucucugaucggcauuaaugagaucgggaaaaccguuacaugcauuaagaccagacuggaagauauccccuuugacgagaacggagacuuccccauguacggcaaggauacagacaaauauaccuacacggcuaucaaggaacgguaucucgaguuuaauaaagauaaggaaaaagccuucuccaccccucuguacaaacuuaagagaaacggggagccgggaaaucagauuaagagcgugaagaucauugacacacgcaacaucgucaauaaagugaaccagggcaaggggauugcuuauaauucuaacaucauccggguugauguguuuagcagagaccagaaauacuaugucgugcccauuuaccugcgcgauuucaucaagggcucccucccuaauaagauuaucaccgccgcgaaaggauuuaugcaauggcccgagacagacaacagcuacaccuuccuguucucuauuuuuccuaaugaucugaucaagguugugcccaaagaaggcaaguucaucaaagccaagaacgagaauaaagaaaacauuaaccuuacggagauccucggguauuuuaagggacuggacuccagcacaggcgcuuucacccuggaaucccacgaugggucucuccuggcccggggaauuggcacaaagaaucuucugcucaucgagaaauaccaggucgacgugcuggggagauauaacaaggugggcaaugaggaacgccaggauauuaaaauccagcaaaacuga

SEQ ID NO: 3842 - RNA, 3210 nt, Artificial Sequence
  Cas9 variant
augaacuacgacaucggccugagaauugggaucaccagcugcggaugguccauuaucaauaaggaucucgagcggauugaagaccugggcgugcgcgucuucgagaaagccgaaaaccccgaugggacagcuucugccgcgccuagacgggaggcucgcaagagcagacggaaacaccgcagaaagaaacaucggaucgaacgcaucaagagacuuauuguucagcacgaccugcucuccaagaaagagcuggauucucuuuaucugagcccguuuaauaucgacguguggaaccuccaaguggaggcccuggaacggaagcuggauaaucgcgaguucgccagaguccucauucaucuggugcagcggcgcggauuucagacgaucagaaaauccguugaaauucaggaggagggcaaacuucuggaaaacgugucugagaaugaacggaucaugaaggucaacggguacaagaccgugggagagauguucagcaagcacgaaaaauuuacacaucacaagagaaauaaagacggcuccuauaccagcguugugacacgcucucuccugcuuaaggagauuaaaaccaucuucaacucccaacggauccugggcaaugucuuuagcacacagaagcucgagucugauuaccuguauauuugggggucccagagacccacccugacguacgaacagcucaugagcauggugggaaacuguaucuaugagaaaaaggaaaagcgcgcuccuaaaaccucuugggccuuccaauacuuuucccugcuucagaagauuaauaaacugaaggugagcgacgauaacacacuccggaaacuguccaaggaggaaagagacaucgucauugagcuugcuuucaagaaaaagaauguuucuuuuguggauauccgcaaagcccugaagcucaacgacaacaccaaauucaaucaccugacauacagccauguggucgagaccaagaagguggaaaaagcgacguuuaucgagcugaagggcuaucaccucauuaaaaagcagcugaaagaccggaacguugaacuuacacaggagcugcaacccaaggauuacgacgccaucgcugccgcuuccaccuucuucaagaaugauauugaauuuagagacuaucuccgcaaccaguaccuggauagcaaugggaaacggaagucuaacaucgccaauaaaguguucgaggacaaggucauugcggccguguuugagcuuaacuucuccaaaguuugccaucugagcuuuaagucucucuauaaacugaucccucaccuggaaaagggacucgauuacaaggaggcuauccugugugccggcuauaauuucagagacgaaaacaaacgcgauaagaaacuuuuucugcccgugauucagcaagagacaaauccugucgugcaccgggcucucacccaggccagaaaggucaucaacgccauuauccgggaguacgggagcccgaauaccauucgcuucgugguugcuaacgaccuggcgaaaacauacaagcagagaaaggaacuggaguccacgcuuaaaaagaaucgggccgaaaacgagaaaaucaagaccaaacuccugucuaugggaauuaucaaccccacaggcauggauaucgugaaguauaagcugugguacgaacagagcggcauuugccucuauaccgggagacaaauggagcuguccagccuuuuuaaaccuggauacucuaucgucaaucauauuauccccuauaaccgcuccuucgacgacacauaccacaaucgggugcugacccucacggagacaaaguaugaaaaaggcaacaagauuccuuuugaguacuucggggcugaagagaccuguuggaaugaauacgagaaaagaguuagcaccucuaagaagauccaugauaaaaagcgcgagaaacugcugaucagaaacuuugacauugaauaugagaaugaaaugaucuccaacaauguguucgauacacacuacauuggaagcuauuucgagaaguacaucgacgaacaucuucaguuuaaaaaguccaccaaaaagcagaaggucuucucuauucacggcaacaugguggcccaccuccauagccgguggggguuuaauaaaaacucccgcgagaucuaucugaaucacgccguggaugcugccaucguugcgguccugacagaccagcucauuagaaacaucgcugauuacuaucggcgcgacaauauucuggagcaaaagggaucucuuaaauuccccgaaccguggaaguccuuuagcaucgagcuggaagccagaauuagcccucaggugcgggaucucaucaaaaagcugaaccuggacucuuaccuugauguggacauccuccauauuaagcccgucuucaucuccaaaaagccucgcagaaaagugaacggcgaggcccacaagagcacgauucggucucugaucggcauuaaugagaucgggaaaaccguuacaugcauuaagacccgccuggaagauauccccuuugacgagaacggagacuuccccauguacggcaaggauacagacaaauauaccuacacggcuaucaaggaaagauaucucgaguuuaauaaagauaaggaaaaagccuucuccaccccucuguacaaacuuaagcggaacggggagccgggaaaucagauuaagagcgugaagaucauugacacaagaaacaucgucaauaaagugaaccagggcaaggggauugcuuauaauucuaacaucauccgcguugauguguuuagccgggaccaaaaauacuaugucgugcccauuuaccugagagauuucaucaagggcucccucccuaauaagauuaucaccgccgcgaaaggauuuaugcaguggcccgagacagacaacagcuacaccuuccuguucucuauuuuuccuaaugaucugaucaagguugugcccaaagaaggcaaguucaucaaagccaagaacgagaauaaagaaaacauuaaccuuacggagauccucggguauuuuaagggacuggacuccagcacaggcgcuuucacccuggaaucccacgaugggucucuccuggcccgcggaauuggcacaaagaaucuucugcucaucgagaaauaccaggucgacgugcuggggcgguauaacaaggugggcaaugaggaaagacaggauauuaaaauccaacagaacuga

SEQ ID NO: 3843 - RNA, 3213 nt, Artificial Sequence
  Cas9 variant
auggccaccagacugggccucgacaucgggacaaacagcauuggauggugccuguacgauggcgacuccauccgggauauuggggugcgcaucuuccuugacggaagagagcccucuaagcugacggucagcggcuccgggaccccucucgcuguuaaacggcgcgaugccagaggagcgcggcgcagacgggaccgcuauauuggcagacggucugcuaugcugcgcgaacuuagaaagcacggccugcucccggccgaucccaaacaggccaaggugcuggagacacaagacccuuacgcucugcgggugcgcgcccucgaugaaaaacuggagccccaucagaucgggagagcucuuuuucaccugaaucagcggagaggauucaagagcaaccgcaaggccgaacgggcguccaaagccggcgaggacgggaagaucgcuaccgccacaaaacuccuggaugaggaaaugcagagacuuggagcucgcacccugggcgaguuucucgucaagcgggacucugaguucgauggggaggccggaaaaagagugcgcaugcgggcggacagcaaggccuaugacuuuuacccugauagacgccauguucuggacgaguuccgggcuauuuggaaugcccaaaagguguggcaccccgaacugcucacagagcaggcuuggaacgauaucuuuagagucauugaauaucagcgcgagcugaaaccucaggugguuggccauuguaccuucgccggcaucaauggggugccggccgacgaaaagcggcuucccaaagcucacccucuguuucaacagagacggcucuacgaggaggucaaccagcugaaggugguggcgcccggagaagccggccgcccucuuacgagagaugagcgggacgcucugauucucaaacugcaggauaagaaauccgucagcuucgaaacccuggggaagacacucaagcugaaagacggagagagauuuaauaaggaaucugagaaccgcaaagcccuugauggcgacgagguucgggccgcucuguccgggaagaaacucuucggaaccagaugguuucacuucagcgccgaagaacaauggaugaucauugaacgccugcuugaggaagaggauucugagacacugcucaccuggcugaagaucggcuauagacuggacgacgaagcggcucucgccguggccaaugcuaagcugcccgagggccaugggcgguucggacuuuccgccacgacagcucugcucaaagaacugaaggccgaugugugcaccuacgcggaggccgcuaaacgcgccggcuuucaccauagcgacuucagaacaggggaggucuuugaucagcugccguacuauggagaaauccuugcucgggagauugccccuggcaagcccgaauacggggacgagaacgaacgcagauucggcaaaaucaccaauccuaccgugcacauuggacucaaccagcugacaaagcugguuaaugcgaucauucggcuccacggcaagcccgauuauaucuuuguggagcuggcccgcgagcuuaaacugaacgaaaaggagaaaaucgcuuacaauagacaacucaaggaaaacacggacgccgcucgggaucgcggggccaaacugggaaccaugggcgucagagacacagggcggaacagacugauucuucgccucuggaccgagcugaaucccggagaugcccugaaccggagauguccuuucugcggcgaacagaucucucagcgcaugauucagaauggggagguggagaucgaacauauuaucccguauucccaauguuuugacgauggcaucggaaacaagguucucagccacgugcggugcaauagacagaagggcgaccagacacccugggagcgcugggggcaugauccugaccggugguccauuauccaggaacaagucgcucaucugcacagaucuaaacaguggcgcuucggacccgacgcgcgggauagauacgccgcugaggaagacagcuuucuuccucggcagcugauugauacccaguaucucacgcgcaucgccgccaaguaccuggcuugucuguaccccgagagaggcgagcggcacguguucgccguccacgggggaaugacagcgaugcuucgcagacucugggaccugaacuccauucugcucgaucauaauuggguggaaaaccugaauagcaacgcuccgaaaaaucggcuugaccacagacaucacgccaucgaugccgcuguugugggcauuaugaccccugggcugaucgccgagaucgcgaaggcugccgcccgcgcugaaaaacaaaaccucgaccggcuguuugaggagcugcccaugccuugggcccagcaccccaaugauagacgcuuccgggacgaacuuagagagaagauucucgcugccaccgucucucauaaagcggaucacggccgccagggaaagccugaacggggcagagacaucacagccgggaagcugcauaacgauaccgcuuauggauuuacaggccugacguccgacaccgggcuccccgugguugugcaccgcgucccgcugacaagccuuaccccuaaagacauugccgaucccgacagaauccccgauacaacccugcggggaucucucuggcaggcuacgcgcgaccugagcggcaaggaguucgaaaaagcccugcuugauuucuccagaacccaugcccaauuuaaggggauucggcgcgugagagugcgggagggccugacacucaucccuaucagaaaucacgcuggaaaaccguacaagggcuaucugggggacucuaacgcgcgcuacaacguuuggcagaugcccgauggacgguggguccaccaggugauuagcaccuucgaccuccaucaaccuggcuuuaucgagcagagaccccacccugccgcuaagaaagugcugucccuucgccagaaugaucugauugccaucgaacgggacggggcccucagacagauuaugcggguccaaaaguauggacagaacggccagaucuuccugaucgagcauaaugaagcuggcaacauggccgagcgcaauaaaaacacagaugaccccuuuaaguucuacgggccuggagcgagcgcucugagaaauaugaaagcccgccaggugcggauugacgaacuuggcagaaucuuugaucccgggccgcgguga

SEQ ID NO: 3844 - RNA, 3213 nt, Artificial Sequence
  Cas9 variant
auggccaaggacuucgaguacauccugggccucgaucugggggaaaccagcauuggaugguccguggucagacuuaacgagggcguucccgaacaccuggagcggcucggggugcgcaucugcucugacggaagagaugcucagagccaugaaccucuguccguggcccggcgcauugcgagaggccuucggcgcagacgggaccgcuauauccacagacggauucgccugacagauguccucgugaaauacgggcugaugccggaggacaucaaggagagaaagaagcugcaagcucucaaucccuaucggcugcgcucugaagcccuugauagaaaacuggagccuuacgaacucggacggguucuguuucauaucaaccagagacgcggcuucaagagcaauaugaagacggaccggaaagauuccgagucuggcgccaugaagcaggcuauucuuaaaaccagagccaagauggaggcuagcggggcccgcacacugggagaauuucucuauuuccugaacaaagacaagaccuccacacaggaguacgugcccguccggaugagaagccacucugaaaagaauaaaaccguguaugagauguacccugaucgcgcgauguacgaagacgagguucauaagaucuuugagcaacaggaacugucccccgaggcccagacagaaauuuucaacaccaucuuuuuccagcggccucucaaaccgguggagcugggcuuuugugaguucgaagauggggagagacgcgcuuauacggccagcgucguguuucaaaaguuccgggcccuucagcagauuaaucagaucuacgugcaagacgacuaugaaagacgcccccugaccaaagaggaaaaggauauucucaaacacuuucugcuugaggacuucucugcccuggauaagaacggacuccugacaugggcgaagguccggacccugcucaaacugcagaagaaaaaguucaaucuugaauccgagagacggaaaggccugaacgccgacguuacaagcuggaagcucucuaaugcugccugcuuugggcgcgagugguucuccuuuagcgaugcuaagaaagaagagaucguggcccugaucaccggagccgaaaaggaggaggaacuuauugcugagcugaaaacgaaguacggccucuccgacgaaagagcgaaaaacacagccaaugugucucugccugauggcgucgcuagccuguccgccaaggccaugaagaaacucauccccuuccuggaggaagggaugcuuuaugacgaugcugugaagcaggccggauacguuuuuagcuccucuuucaaaggcgugcugccugagaaguaugagaccuuuauugaacccgagagcggggaauguuucgacgagcucccguacuacggacaaguccugcggagauaugugcugggcgggguuccuucugaagagaacaaacuuuuucccgagaaguacuauggaaagaucaauaacccuacagugcacauuguccucaaccagcugcgcaaacugaucaauagccucguggcgaaguacggccauccccggaaaaucgucguggaaauggcuagagaucugaaacuuuccaaaaagcagaaagacgccauugccaaggagcaggcucugaacgaacgcgagaauaagagaaucggcgccgaacucgagcggcuggacauucgcaacaauuaugauaacagaaugaaauacaagcugugggaggaccuuucuaccgaucccaccaaacggagcugcccuuucugugggaagcaaaucucccagcaggacauuuuuagcccggaguucgaaaucgaacaccucauccccuuuucucgcuccuucauggauggaagaagcaauaaaguucugucuugccggcgcuguaacagagagaagggcaauaagacaccuuucgaggcuuuugggaacgacuccacgcgguggaaugccauuaugggacgcguggaaagccugcccgagaacaaaagauggaaguucgcguccgaugccaugucucgguuugaaagagacggcgaucuccuggcucgcaugaugaccgacacacaguauauggcccggaucgcuagacgcuaccuuugcugugccgcgaauccuaaccaagucuacgggauucccggccagcugaccgccaaacuccgggagcauuggggacugaauagcauccuguccgaucagaaggaaaaagacagaucugaucaccgccaccaugcuauugacgccuucgugguugcuugcacagaccggggcacccuucagaaguauagcacggagagacgcgauuacgccaagccggagaugccuuccgaaaaagcuccccacaucccuuuugcugacuuccggcucagcgauauuaagagaguguuugacgagaucaucgucucucauaaacccgaucgggggaacgcgcgcgccgcuauucugaagggaggcacaguggccaaacugcacgaagagaccuauuacgggaugggaggcgaaggguccaagaagggcaccuggaaacucauccaacggauuccugugagcgagaucaagaaagccucugaccuggauugucuuauugaccagaagggaacagcuaacccccugagaguucuccuggucggcgccuccgagagcgaacaggagcagaucaucgcgucuuauuucgcucgcagagggacccauaaagugcggacauacagagaacgcaauaaggaugugauucugccguuuaaagacaaggauggaaaacuuuaucgguacgccgucuacggcagcaacgccuaugcugagaucuacugcccugacagagggaagaaugccggaaaguggcaaguggaaauuauccccaacuauugcgcgcaccagaaaggcuucauucccaaguggcgccacacggaugcucaugccaaacucaucaugcggcuguacagaaaugacaugguugccuaugagaaggaggggaagaccgugaucgcucgcgucaaaaagaugggcggaaacggcgugauuguuuuucggaaucaccugaucgccaaagaagagggggacagacucuccuggcaggcuguggucagcggaaugcaaucugccaaccugcgcaagauuuacguggauguucuuggcagagugaucgacccuaaacggccgaugacacagaaugaaaccgaugggcaggacaacuga

SEQ ID NO: 3845 - RNA, 3213 nt, Artificial Sequence
  Cas9 variant
augagccacuucagacugaagcagcucaacuacauccugggccuugaccuggggauugccuccgugggaugggcugucguugagaucgauaccgaagagaaucccacacggcucauugacgugggcgugcgcacguuugaaagagccgaggucccuaaaaccggggauucucuggcggcugcccggcgccaagccagaagcgcucggcgccuuaucagacggcgcacacauagacugcuccgggcccgcagacugcugaagcgggaaggcauucuccacgcugacgaucugaacgccgagggacuugugaaagagcugccgaauacccccuggcagcuccgcguugacgggcuggauagaaaacuuaugccuaaagaaugggcggccgugcugcuccaucuggucaagcaccggggauaucugucccagagaaagaacgagucugaaggcgcugacaaagagcucggccgccugcuugccggggugcaugagaaucaccaggcucugcaaagcuccgaauaccggacacccgccgagcucgcgguuaagaaauuccaggcccagucuggacacaucagaaaccagcgcggcgauuauacccauacauuugaccggaaggaucugcaacaggaacuucaccagcuguucgcugcccagcaaaaauacgggaauccuuuugugagcgacggacucaagcagggcaucgagacccugcugaugcagcaaagacccgcucucuccggggaugccguccagaagaugcugggacgcugcacguucgaaaccgaggaguuuaaagccgcuaagcauacauauagcgcggaacgguucauuuggcuuaccaaacugaacaaucucagaauccaggagaacggcaaugaacgcugucugacagcccaggagcggggccaaauuaucgaccuuccuuacaagaaagcuaagcugaccuaugcccaggugagaaaagaacucucucugccggagaacgccuuuuucaaggggcugcgcuacggaaaggagaaugcugaaacggccgcgcucauggagaugaaggcuuaccacgccauucggaaggcccuggaaaaagcuggccuuaagacagaguggcaggggcuggccugcaaacccgaacuccuggacgcuaucggaaccguguuuucccuguauaagacagaugaggacauuagcaccagacuucagggccaacucucugaggaugucaucaacgcccugcuggcggggcucaauuucgacaaguuuauccagcugucccuuaaagcccugagcaagauucucccucugauggaacagggacagcgguacgaugaggcucacgccgcucuguauguucgcucuacaccccaaccucagagacuucucccccagaucaccgccgacgaaauuuguaacccgguggugcugcggacgcugucccaggcgagaaaagucaucaacgccauugugcgccgguacggcagcccugcuagaauccauaucgagaccggccgcgagguugggaaguccuucaaagauagacaagaaauucagaagcggcaggaggacaaucacaaggaacgcaaacaagccgcugagaaguuccucgaauauuuucccaacuucgugggacagccuaaagccaaggauauccugaaacuuagacuguaccagcaucagcacggccaaugccucuauucugggaagacacuggacauuugucggcugaaugagaagggauacgccgagaucgaucaugcgcuucccuuuagccgcaccugggacgacuccuucaacaauaaaguccucgugcuggcuggcgaaaaccagaauaaggggaaccagacacccuacgaguggcugggcggagccagcaauucuccuagauggcaggaauuuguugcucgggugggcuccagccgcuuccaccacucuaaaaagcaacggauucuccugcggcagcuugaugaggaaggguuuaaagagcgcaaccugaaugacaccagauaugucgcccgguuccucugcaaguuuaucgaggaaaacaugcugcugcuuggaagaggcaaacgccggguguucgccagcaaugggcagaucacguccuuucucagaucucgcuggggacugcggaaggucagagaggaaaacgaucgccaucacgcucuggacgccgugguuguggcguguagcacagucgcuauucagcaacggaucaccuacuucgugagacagcgcgagaugaauauuuuugauggcgaacucaucgacaaggagaccuccgagguuagccggccguauuucccccagccuugggauuucuuuagacaagaagugaugaugcgggucuucgggaaacccgacggcgauccuucuuuucccgaggccgacacaaaggaaacccugugcacacuucuggagacgcgccucuccagcagaccgcaggccgugcaugaguacgugaccccucuguucguuucucgggcucccacacgcaaaauguccggacagggccacaaggaaaccgucaaaagcgccaagcugcuucacgaggggaaguccgugcugagagugccucucacacagcugaaacccaaccuccuggaaaagauggucaaccgggauagagagccucaacuuuaugaagcgcugaaagagcgccucgcugccuacggaaaugaccccgccaaggcuuuugccaccgaguuccggaaaaagggcgggcagcuggugaaggcuguuagaguggaagauacgcagaaaucuggaguccugcuucauaagggcaccgggguggccgacaacgcgacaaugguucgcguggacgucuuugagaaaagcggcaaguauuaccuggugccgauuuacuccuggcagguugcccaaggaauccucccuaauaaagcugugauucagggcaaggaugaaaagaacugggacgagauggaugaaaccuauacauucaaauuuucuauguaccccaaugaccuggucgagaucaacaccgggaagcagagacucuucggauauuacaucggccuggauagagccacgggggcuauuagcauccgcgagcacgaccuugauaauuuuaaaggaaagaacggcauuuaucgggugggggugaaaacagccaucuccuucaagaaauaccagaccgacgaacugggcaaggucguugugcccuguagaccuaagaaacgccucccggugagauga

SEQ ID NO: 3846 - RNA, 3216 nt, Artificial Sequence
  Cas9 variant
augagacugggccucgacaucgggaccaacagcauuggaugguggcuguaccagacagaugacggcacgaucaccgaugugcuugacgggggaguccggauuuucuccgauggccgcgacccccaaucuaaggagagccuggccguugauagacggguggcucgcgcccagagacggcgcagagaccgguaucuccgcagaaaagcggcucugaugaagcggauggccggggccggacuuaugccuacagaucaggcucacgccaaaaagcuggaaucccucgacccguacgcucugcgcgccgagggccuggauugcgaacucccccugacccaucuuggcagagcgcuguuucaccucaaucagcggcgcggguucaaaucuaacagaaagacagaccggggagauaaugagagcggcaagaucaaagacgccaccgcuagacuggacugggccaugcgcgaugcuaaggcccggacauauggggaauuucuucauaccagacaacagaaagcggacgauccuaagcgcaugcccacggugcggaccagacugacagucgcccgccgggacaacgcugagaaagaggaagccggauacgauuucuauccugacagacgccaccucuccgaggaauuugaugcucugugggccgcccaggcugacuaccaugaggcgcugucugaugaccuccgggaucagauuaagaccaucaucuuccaccaaagaccccugaagacaccugaggugggccuuugucuguuuaccgacgaacgccggauuccgagcgcccacccccucaaucagagacggauccugcuugagacgguuaacgcucugcgcauuguggccagaggggaagccgcucggagacucacacuggaggaacgcgaccagaucguccaugcccuggauaauaaaaaccacaccaagacacucuccggaauggcgaugaaacugaaggcucuuggcaaagugauucggcugagaagcgaccagaccuucacccucgagacagccaaucgcgaugccaucgcuugcgaccugguuagagccucucuuucccauccugaucggaugggcgggguguggacgacccuggacgagggagcucaaugggaagucgugcagcgcauuagagccgugcagagcgauucugaguuugacgcgcucgucguuuggcuggaacaaaaccacggccuggauaaugcccacgcucaggccacagcuaacgcgccccucccugagggguauggacggaugggccugauggccacccgcagaauccuugccgcucugcaguccgacgugaugcccuacagcgaugccguggcugccuguggguggucucauuccggaggcccgacaggcgaaguccucgagaagcugccuuacuaugggaaaauccuggaccggcacgugauucccggaaccuacgaugagaauaacgaagacguuaagcgcuauggcagaaucacgaauccuacagugcauauugggcuuaaccagauccggcgccucgucaacagaauuaucugcauccacggaaagcccgacgagauugugguugaacuggcccgggaucugaaaaauagcgaggaccaaaagagagaaauccagaaaauuaucaagaaaaacaccgaugcugcgauuaagcgcggcgagaagcucaucaaugagcuggggcagaaagacaccggcgccaaccggcuugugcugagacucugggaagaucugggacaugacgucaugacacgcaauugucccuacuccggcaagcggaucucugcugggaugcuguucgauggaagcugcgacguggaucacauucuuccuuauuccagaacccucgacgauggcaucgccaacaaaacacugugucugaaggaggccaaucgccagaaaagcaacaauacgccgugggaagucuggggagagaccgagcaaugggacacaauugcugccaaccucaagaaucugcccgauaacaaggcguggcgguuugcuucugacgccaugcagagauucgaaggggagaaugacuuuuccgcccgcgcucuuaaagauacccaguaccugagccggaucgccagagcguaucucgacgcucuguacgauggcggggacggcaacucucacguguggguugugccuggacggcugacagaaaugcuucgcagacauuggggccucaaugggcuggaggcccugaccgauagcgacgaaaacacggucaaggccaaaaaccggauggaucaccgccaucacgcuauugacgccgcugugguugccgcgaccgauagaggacucauccagcggauuuccaagaucgccaaaagagacgagcaagcuggcgccgaggaaguggcucgcucugucagcccucccugggauggguuccgggacgacaucgccgcccagcuguccagaauuaucgugagccaccgcgcugaucauggacggauugacucucaggcgaagcagcaaggcgaggaugccacagcugggcagcuucacauggacaccgccuacggcgugguugaugccggaagagucgugucccgcaagccccugcucagccugucugaauccgacaucaaaaagauucgggauccggaccugcagagacaucuuacacgcgugaccaaaggccucgauaagaaagaguucgaacacgcucugagcgacuuugccaaugcgagaaagcugccugaucaauccgagaaccccuauuucgggaugcggcgcgucagacucaucgacgcucugcaggauucugcccgggugagcguucgcgacagagacggacauaucuacaaagccuauaaggcuggcuccaaucacugcuacgagguguggcggcuuccugaugggaagauuaaacccugggccaucucuacguuugaagcgcaccagacaggaaccgagagcaagccucaucccgcugccaaaagacugcuccgcgucuucaagcgggacaugguggccauugaaagagauggcgagacacugauguguuauguucagaaaauggacaucgcuaacgggcuguuucuugugccgcacaccgaaggcaaugccgaugcucgcaaccgggacaaggaugacuccuucaaguuuauucaaaugagcgccgucucucugaucagagcgaaaauccggcgcauucauguggaugagaugggaagacuccgggaccagggcccuccccgcuga

SEQ ID NO: 3847 - RNA, 3216 nt, Artificial Sequence
  Cas9 variant
augagauacaccaucggccuggacauugggaucgccagcgugggaugggcugucauuaacgaggauaagucccggaucgaagaccucggcguucgcguguucaaaaaggccgaggaacccgaugggaaaucucugaaucuugcgagacgggaggcucgcggaagcagacggcgcauuagacggcgcgccacaagaaugcagaaggugaaagaacugcucgucaaguauaaccugguguccgagaaggagcuugaaacgcuguacaucaucaccgagacaaccccugacguuuaugaacuccgggccaaaggccuggaucgccugcucucuagacaagaguuugcucgggugcugacaaauauugccaagcgcagaggguacaaaagcaaccggaagaucgacgaggaagauaaagaggucggaaaacuuuccaagggcaccauugaaaauaaaagaauccugcaggagaagggcuaucgcacaauuggggaaauguucuacaaagacgagaaguuugaguauaacaaacggaauaaggcuggagaauacaacucuaccgugcucagaagcaugcugaucgaugagguucacacgcuuuucgaaaugcagcgcaaauuuaaguccgaguucgccaaugaagaguuugagaaggaauacguggaggucaugaccuaucagaaaccguacauuacacccgaacugcucgagaagaugcugggcaaaugcaccuucgaaaagggggagccucgggcgcccaaaaacagcuauacauuugagagauucaugcugcuccaaaaggugaauaaccugaauaucuacaucaacggagaaaagguggagauuccucaggaaaagaagaaagagaucauugagcuugccuauaagcagucugaaaucaaauacacccagcugcgcaagaagcucgagcugcccauugaagcucgguuugccgaccuuaauuaucaaaucaaaagaacggaggaugaauccgaggaggcucuggucaagaaaaucgaagacaagaaauucguuaagcucgagggcuggcauaagauucgccuggcccugaaagaaaacaaggauaaauuugagaagaucgagaaaaacccugaacuccagaauauuaucgcggacgcccuggugcggaacaagacagacgagaccauuaaaaauuaccuugaaaagagcgauaucgacgaggaaaucauuaacgcuauccugaauauuaacuucacaaaguucgggcaccucucuuacaaagccaugaauaagaucauuccggagcuggaaaaaggacuuaccuaugauaaggcuugugagaacgugggcuacgaguuuaaaggcagaaagaaugaacugcaguauaagcugcccccugucaccgagcucgaagacgagauccugaacuccgugguucuccgcgccgugagccagacacggaaagucauuaaugccaucaucgauaaguacgggucucccacggcuauuuauaucgagaccgcgagagaacuguccaaaccuuacgacgagcggaugaagauugaaaaacgccaaaaggagaacgccgcuaauaacgaucagaucaaggaauauauuaaagagacauucggauuugaccccaagccguucgauaucgugaaaaugaaacuuuggagagagcagaauggcaaaugcgccuacagcuccaagccuauccccgccgaacggcuguacgaggaaaacuuuguucaaguggaccauauuaucccuuucucuagauguuuugaugacagcuaucagaacaagguccucgugcugaccgacgagaaucagaaaaagaaagaacgcacacccuucgaguacuuuggggaggauaaggaacgguggcaccaguucgaggaauuugucaaccugaccuauaaauucaauacgagaaagaaagagaaccuucucauuaagaauuuuaacgaagagaaguccaaagaguggauccaacgcaauauuaacgacacaaaguacaucagcaaauucauguauaauuacaucgcuaacaaucugaaguucgccgauucugaauccaaaagaaagguguauaacauuaauggacaggcgaccagcauccugcggcauuacuggggccucaagaaagaccgcgaggaaucugauaagcaccacgcucaggacgccguuauuaucgccugcgcuaccaacaaaaauauuaagaaagugagcgauuacuccagacggaagcugcuuuauaagaacaacgagaucaucgacgaggaaacaggggagauuaucgauaaaaaguacaauauugacaucucuauuaaagaacccuggccuaaguuucgcgaggaagucgaggccagaauggaggaugcugacaacaauggacagcuguaugcccucaucaacggcaauuucaccaacuacgaugacguggacauuacacauaucaaaccgaucuuuacgagccggaugcccgaacgcaagauuaccggcagagcgcacaaggauacaaugcggucccaaaaauucauccagcaggggcagaauuuuaccguugugaagaaaccucugaaggccauuagcaaacaagagaucgaaggaauuaucaacaaucccgacuucaagaaccuguaucuuucugauaagaaacucuacgacgauaucuaucagaagaugaaagaggcugacuuuaaggccgaaaaggcuuucgccaaugaguaccgcaaguacuccaaaaacggcaauagcccuauugucagaucuaucaagguggcguccgccggggcuacaggagugcagcugaagaacggcgccauugcugagaaugccaacaugguucgggucgauguguuugaaaaagacaacaagaauuaucuggugcccaucuacgucagcgauuucgccaaaaacgagcucccgaauaaggcuauuugugcgaacaaagacgaaaaggaguggaucgaaaugaccgagaaguauaaauuuaaguucucccuguacccuaaugaucuugugaaaaucaagcgcaaaaacgagaaggaauuuuaugccuacuauugcucuacgcauagagggaccggcaauauuaaccugcuccugguuaauggagaggcucggaaggacggcguggggaucaaaaacacagaaauuuucgagaaguaccaggucgaugugcugggaaauaucagcaaaguuaacaaggagaaaagagaaggcgugaaguga

SEQ ID NO: 3848 - RNA, 3216 nt, Artificial Sequence
  Cas9 variant
auggacuacagaaucggccuggauauugggaccaacagcaucggaugguccauuaucgagcucacaacggugcagucuaagcuggacggcaaauaucggcuuaaggccgucgggcugauugaugcuggaguucgcauguucgacagagccgaagugcccaaaaccggcgcgagccucgcucugccucggcgccuugccagauccucucggcgcagacugacacggcgcagcgccagaaagaaagcuauccggaaucuccuggugaaggaggauauccugaaccaaauugaacucgaccaccuguaccgcaccuccgagcuugucgauaucuggcagauuagaguggaagggcuggagcggcgccucggaagacaggagugggcccggcugcuuauccaucugggccagaagagaggcuaucgcucuacacggaaagcugaagagggggccgacaccgaaggcagagcgguucucagcuccauuaaggagaaucaagagacacugaaacaguaccgcaccgugggagaaaugugggccacggaugacaaguuuaaagggcgggucagaaacagcaccaaugaguucaucuuuaacgugucucgcgauaaucuggaagaggaaauucgguuccucuuucagcagcaaagagagcugggauccauguaugcuagcaagcugcuggaggaaucuuacauggagguuuggggccaccagcucccguucgccuccggggaaagcauccugaagaacgugggaacaugcucucuuuaugagaaagaaaagcgcgcugccaaagcgaccuacacauuucaguacuucauggcccuggacaagcucaauaacguccggauccugcccuccaugagaacccugagcgaggaggaacgcggccucgcucugaaagccauguuugagcgggauaaacuuccuaaaaaucccccuaaguucacguauucccaucugagaaaggcuauuaaacucgaagaggacgaaacauuucagaccaucucuuacgacguggagaagacacuggccaccaacgagagcgccguguucgucaaucuugcugcguauuaccaaauuaaaaagguuugugaugaacacaacgagaauuaugacuacguggauuauaacaccaucggccaugcccugacaguguacaaaacggacgaagauauuaacaaguaccucgcuuccaagaauaacaucgccaaacgggucuaugccaaugacuuuaucgauagcgugcugaagcacucuuacaccacauucgggcaccugucccucaaagcucugagccgcauuaucccccuuauggaggagggagaaguuuucgccaaggcgaaagagaaggcuggcuuuaaggaagagucuuaucuggaaauuaaaagcaagcuccugaccaacaucccugacgccauuaaaaauccgguggucaugagaucccugacacaggcccggaaggugaucaacgcuaucauuaaaagaaugggggagcagcccgccucuauccaaauugagcuugcucgcgaacucagcaaggauguuuccgagcggaagaaaaucaccaauggauucgccgaaaacagaagccgcaaucaguuugcgauuaagacgcuggaggaaaaccauaucacaaauauuagaggccaggacaucgugaaauucaagcuguggcaggagcaagggggacggugcgccuacucucucaaaccuaucaagcuggaggaacuuauuuccuuucugaaaaaggagcgcagauaugaacacaaccucgaugucgaccauaucauucccuacagcaagaccuucgacgauucuuauaccaauaaagugcuggucuuuuccgacgagaaccggaagaaaggcgaucagaucccugcugaauaccugggcauugggacaaagcgcugggagaaauacaaggaguucgugaucaccagcaaguuucccgccuccaaaaagaaaagacuucucaaggaacagcugguugagcgggaggaacuguucaugaaagagcgccaccucaaugacacaagauaugcuucucgguacuuuaugaacuuccugcgcgaaaaccuucugagaaaggagacggugcuccacgaaacccagugggucacagccguggcgggacggguuaccagccauaucagaaagcgccugggcuuugggaaagaucgggaggaaacacaccuucaucacgcccuugacgcuauuaucguggccuguaccgauaaguggaugauugacugcgucacgaauuauuacaaauccagagagggaggcucuaucaagcgcaaagagauucgguucccgagcccuuggaacggguucuggcaugaugugcaaaccaagcucgcucagcugccccagccugaagugaucaaugaguccaucagcaagggcaaccccgacgccguugauuauaugcuggucucuagaaugccccgcaaauccauuacaggagccgcucacaaggaaaccaucagcaaauggggcggguacgacgauaagggaaaagcgcuccuggugaagaaaguggcccuuucugagcugaaguuuaagaaugacgacuucccuauguauaacaaagaaacagauccgcuccuguacgaggcuauuaagaaucgguacgucgaguccggcagagacgugaaacgcgccuuugccacgccccuguauaagccuagcaaaucugggaagcggaacgaaguuaagagagugaaagucaucgcugagaagaaagccauggugcgggaaguuaauggaggcauugcggagaacgggggccuugugcgcagcgauaucuuccucaaggaaaagaaguacgucauggugcccguuuauaccuuugacacaaucaagcagcaacugccuaauaaauacguggucuccggaagaggcuaugagcaguggcccgagcugaccgcugaacacguguuccaguuuagcguguacccguaugagcucguccauguugggacaaacaagggagauaauucuuucuacuacuuugccucccugaacauuagcuccaaugugcuuaaauucucugaauguaaccggccuaccaaggacuauaucgagauuggccugaacagcaucauucuccuggagaaauacgaaaucgaugugcuggggcgcauuaccggacaguccaagaagggcaucagacaaucuuuuaaaaauaacaagagccagaugaaagaguga

SEQ ID NO: 3849 - RNA, 3219 nt, Artificial Sequence
  Cas9 variant
augagacugggccucgacaucgggaccaacagcgugggaugguggcuguacaagacagauggcgaggccgcuuccgcccggauugucgaaguuaucgacgggggagugcgcauuuucucugauggcagagaccccaaaagcaagacgucccuugcgguggaucggcgcgucgcuagagccgcccggcgcagacgggaccgcuaucugagacggcgcgcuucucucaugaaacugcuugccagaaccgggcugaugccugcugauccgguggaggccaagaaacucgaacggcuggaccccuacgagcugcgcagcacaggacucgaugacgcgcugccucuuacccacuuuggcagagcccuguuccaucucaaucagcggagaggcuuuaaguccaaccgcaagacagaucggggagacaaugaaaacggaaaaaucagagaggcuaccgcccgccuggaucuugagaugaugacaucuggcgcucggagcuauggggaguuccugcacaugagacgccaacgggccuccgaccccagacauguuccuagcgugcgcacccggcucucugucgcggccagaggaggccccgacgcuaaggccgaagcuggguacgauuuuuauccugaccgccaccaucuggaagaggaguuccacgcccugugggccgcucaggcgacgcaccaucaggcccucaccgaugaccugcgggaucuuguguuugagaaaauuuucuaccagagaccgcugaaggaacccaaaaucggacucugccuguuuacagcugaggaacggaucgccaaggcccacccucuuacccaacgcagaguucuguucgaaacaauuaaucagcuccgggugaccgcugacggcagauccacgcgcccccugacacuggaggagcgggauacccucguccaugcccuggacaacaagaaaccuacaaagagcaugaccucuaugaauaugacccuuaaagcgcuggcuaagcuccugaaacuuagagauggcgaacgcuuuacacuggagacgggggugagagaaaacaucuccugugaccccgugcgggccugcauggcccacccggcucgcuucggaccucaguggagcucucucgauugggaggcccagugggacgucauuuccagaguucggcaagugcagagcgaaggcgaguuuaucgagcugaccgacuggcugauucaggggcacggacucgaugcugaccaugccaaggcggugggcaaugccccgcugccugaaggguaugcucgccuuggauucuccgccacagagagaauccuggaucagcucaaagcugaagucuguaccuacucugacgccguggcgaagugcggcuggcaccauagcgaucaacggacaggcgccugucuggagguucugcccuacuauggggaagugcuugaccgccacgucauucccggaaccuacgaugcuacggacgaugagaucacaagauauggccggaucaccaacccuaccgugcauauugggcucaaucagcugcgcagacugguuaacaagaucauugaggugcacggaaaaccggaccagaucgucguggaacucgcccgggagcugaagcaauccgaaccccagaaaaaggaugcuaugaaaagacuucgcaauacaaccgccgacgccauucggagaagcgagcagcuggagcagcucggccaaccuaacacagggcacaaucgcaugcugcugcggcuuugggaagaucucggccccgcuaucggaccuagaugcugucccuacacgggcaagaccaucucugucacaaugguguucgacggguccugcgacguugaucauauucugccguuuagccgcacccuggacgauucuuucgcgaaccggacacucugucugaaggaggccaacagagaaaagagcgaccgcaccccuugggaggcuuggggaggcacggaucagugggacgauaucgccgccaaucuuaagaaccugcccgagaaaaagcggaaaagauuugggccugacgcuauggaaugguucgagggagaaaaugauuuucucgaccgggcccugguggauacccaguaucuggcgaagauuucccgcauguaccuugacacacucuucaccaagggcgggcacgucugggugguucccggcagaaugacagagaugcugcggcgccauuggggacugaacgcucuccugaaugauaaagacagaggcgccgugaaggccaaaaaccggaccgaccacagacaccaugcuaucgaugccgcggucguggcugccacggacuaucgccuuaugcagaagauuucucgggccgcugggcaaggagaaaaugccggccagagcgcugagcugaucgccagagauacagacgcgccuugggaacacuuucgcgccgauaucgcuucccagcucgagaaaauuaucgugagccaucgggccgaccacgggagaauugauguugagggacgcaagaccggccgggacucuacagcugggagacugcauaacgauaccgccuacggcgucaucgacgaucugaccguggccucccgcacaccccuuaugagccucaagccgucugacauugcuaucacggaaagagggaaaaauauucgggacccucagcugcaaaacgcgcuguacguggccaccaagggcaaagaggggaagauguucgaacaggcucucgucgauuuugccuccaaagagggacccuaucagggcauccgcagagugcggcugguugaaacacuucagaaggccgcucgcguggagaucgggaaaaccgagagcggacaaccccugaaggccuacaagggcgacuccaaucacugcuaugaacucuggaaacugccugaugggaagauugucccccaggugguuacaaccuacgaggcgcacgcuggcucugcccccagaccucaucccgccgcuaaacggauccugagaguguucaagaaagacauggucaaacuuacgaaggauggagaagagauugugggcuauguucagagcaugcacaucaaaaacgggcuguuuguggcccaacaucucgaggcgaaugcugacgcccgcaaccgggauaagacagacccuuucaaauuucugcagaugggagccggcacccucgucaagaccgggcugagacgcgugcuuguggaugaaauuggacggcugagagaccccggcccucccaaacucuga

SEQ ID NO: 3850 - RNA, 3225 nt, Artificial Sequence
  Cas9 variant
augcagaccaagaaccugcccuacacacucggccuggacaucgggauggccagcgugggagcugcccuucugcucccugaucaagagcggauucuggcgcuucacgucagaacguucgacaaagcugaaaccgccaaggagggcgaaucccugaauaaaauccgcagagauucucggcucacacgcagacggauucgcagacgggcccaucgccugguuagacuggcucggcucaugaagcgcguggggcugaucgccgacgcuaacccggaggccuuugcgcuucccggagugagcccuuggcaccugagagccgauggccucgaccggcugcuugaacccaaagagugggcugggguccuguaucaucucgugaagcaccgcggauuccaguccaauagaaagucugaggccaaagcugaugaaaaggccggccagaugcugagcggcguugggcggaaccaggcgcugcucaaagaggccggauacagaaccgugggcgaacuggcugcccgccaugaggacuuuaaggaggcuaaacggaauaaagggggauccuauucucacacauucgccagagccgaucuuaacgcugaacugaaucuccuguuugagcgccaacgggcgcuuggcagcagacuggccuccgcugacuuccaggaaaacguccgcgaucuccugauggcccggagaccuacccugagcggggccaaucuccugaagauggugggaaagugcacauuugagaagucugaagaccgcgcucccaaagccggcuaccgggcggagagauucguuuggcuuggcaagcugaacaaucucaaaauugugggguccggagaugcucgcccucugaccgacgccgagcaccggaucgucaucgaccuuccguuuacgcaggccaagcugaccuucaaacaggugagaaaggcucucgaacuggagacacaucaacgguuuaaccugcucagcuaucgccccgauccuaagggcaaagacaaggaucccgaagagucuaccuucuuugaagccaaauccuuccacacacugagaaaggcuuacgagggggccggacuuaaaaaggaguggcagcgggacgcgcuggauccugacagacucgaugcccuggcuuaugcccugaccuguuacaaggacgauacggaaagccgccaguggcuuguggcucagggcauugggacacccaucauugaggccguccucgcggaaucuuucgacaaauuuauccaucugucccaaaaggcccugaaagcuauucucccgcacauggaggccggacagcgguacgaugacgcugccaagagcgccggcuaugaccacucccagccugaugcuggcaccgggaaaagagcgacacugcccccucccgacaaggauaccauccgcaaucccguuguguacagagcccuuaaccaagcucggaagcuggugaaugccauugucgccgaauauggaccuccggcugccgugcauaucgagcucgcgcgcgaccugucuaaacccaucgaugagagacgggacauugaaaagggccagaaagaguuccaggcucugaaggaaaaacuugccgccgcuuuugaggagaccuuccaccgcaagccuagcgggcucgaucugcugaaguacagacucuuucgggaacagcuggaccaaugccccuauugucagaaagcccuuguuguggaucgccuguucgagccuggauacgcgcagaucgaccaugcucuccccuauucccggagcuuugaugacggcaugaacaacaaggucgugguucacguggccugcaaucaggauaaagggaacagaacaccguacgaguuccuggacggcgccggagacucugaacgcuggcaaagauuugucgcuugggugcagggcaauaaggccauucggcaggcuaaaagaaaccgccugcuucgggucaauuucgggacggaugaagccaaggaguuuuccaaaagaaaccucagcgacacccgcuacaucugucgggaguucaagagaacaauugaaacccaguuugcguggcauucugaugccgagggaaaugaacgcugcgugguucugagcggccaacugacaucccuccugcgggcuagaugggggcuuaucaaggugcgcgaggacggagaucugcaccacgcccucgacgucgcugugaucgccgccgcuucucggagccugguuaaaagaauggcggauuauucccggcgcaacgaacuggagauggugagaaaucgguacgucgacccugccaccggcgaggugguggauguugcugcccuucgccagauugaagaccauuuccccaagccuuggccccucuucagagaggaacugcuggcccggcucgcuccugagcccaaacugcagcuuacgugugucagcucuuaugaugaagggcugagagaguccauccgcccgauucgggugagcagagccccuacacgccggggccucggagcggcucaccaggagaccaucagaucucugcgcgacggcucccaaagcgccauuaagacaccccugcgggaucuuaaccugaaagaccucgaaaauaucgugggguuugagagagacaccgcccugaucgaugcuauucgcaccagacucgaagccuucggaggcgaggggaagaaggcguuugacgauaaacagcccccucugcggaagccguccaaagaccccgauaaggcuccuaucauucgcucugucaaacuucuggugacacaaaagagcggaauccccauuagaggcgggaucgccaacaauggcgccaugcuccgguccgacauuuucacgaaggcuggaaaauuuuacgccguuccuaucuauguggcugaugccguccgcggcgagcugccccauagagcgguggcccaggcuaagccugaacuggaguggcccaugauggacgaaucuuaccaguuccuuuuuagccugcacccgaacgauuggaugaccauccggcucaaaaaugagguuagagaaggguauuacgccggacuggaccgcgcuacaggcaacauuucccucuggcugcacgaucggaaccagaauguggggcagaagggacuucugaccggcaacgggaucaaaacagcccucgccgucgagaaguaccauguggaccugcugggcaaacuucacagaguucauaaggaggaacgccaaccuauucacaucaagcccggaaaacgguga

SEQ ID NO: 3851 - RNA, 3234 nt, Artificial Sequence
  Cas9 variant
augaaguacagcaucggccuggacauugggaucgccuccgugggaugggcugucauuaacgaggauaucgaaagaauugaggaccucggcguucggaucuucgauguggccgaacagcccaaaaccggggcgucucugagcacaccucgcagacuugcucgguccacgcgcaagagacugcggcgcagacggcaccgcguggagagaguccggaaauuuaugauccaaaagggacuccugacccaggugcagauggaacagcuuuaugacuggaaagauggcgaccuggauauuuggcucguucgcgugaaugcccuggagagaaagcugucugaccgggaguucgcccgcauccucguccauuuugcuaagaacagaggguuccaaagcaaucggaaauccgaacugcaggaggaagauaacggagccgugcuuucugcuguucaggagaauaagagacugauggaggaaaaaggcuaccagacaauuagcgagaugcuccuguaugacgaaaaguuugagggcaccaaacgcaacaaagggggagaauacacacacguggucgcccgguccgaucuuaagagagagauccaacugauuuucgagaagcagcgcgcguauggccaugccuuugcuaccauggaaaaugaggacaaguuccuccagaucuggagcucucagcggccguuugccacaaaagaugacauugcuaagaaaaucgggaacugcaccuucgaacccaaggagaaaagagccccuaaguccacguacaccuuugaacgcuuccgggcgcuggacaagcugaauagacuccgcauccugagcggaacaucucccgcccggucccuuacccaagaggagagagaucugauucucaacagccuguuuucuaaaaaggaagugaaauauaaggagcuucgcaaacugcucaagcugaaugacgaacagcgguucaacgagaucuucuacgauccuaaugaaaagauugagaaaaacgagaauagaacauuucugucccucgaaagccaguacaagauccggaaaauucugcaaaagaucgagggcaaaucccuuaacgacaccuaucgccccguggaucuggacacgaucgcuuacgcccucacagucuucaaggaugaccaggauauuagagacuaucugcagaaccaguacguugcuucuaaugggaagaaagaacuuaaccuggccaaucggaaguauaacgaugagcucaucgaggaacugcugcaccucagcuuuaccaaauucggacaucugucccuuaaggcccugagaaauauucucccuuuuauggagcaaggcaucccguaccaccaggcuugugaaaaagcgggcuaucaguucaacaagaaggugaaucgcgagaaacagaagcugcugcccccugugcccgccaaagacauugucaacccugugguuauccggagccuuucucaagugagaaaggucaucaaugggauuaucaaacgcuacggaucccccagcucuauuuacaucgaacucgcuagagagaugggccggggguauaaggagcgcaaagaccuggaaaagcaguacaacaagaauagacagaugaacgagggagccaaaaagcacauucuggaacuccggccggaguuuggcgauccucgcgggcaugacauccugaaauauaaacuuuggcaggaacaagauugcagaugugccuacagcuucaaguccauucccaucaagcagcuguuugagaucggauaugcugagguggaccacauuaucccuuacucucggagcuucgaugacuccaauaacaauaagguucucgugcuggccgcggaaaaccagaacaaacagaaucgcacacccuaugagugguuuggccaugaugaaaccaaguggcaagaguucaccagccuggucacaacgaugaaagugucuaagaaaaagaagucccuucuccugaaaaagaacuuugacgaagaacaggcugaggaguucagaagccggcaccugaaugauacccgcuacauuacaagauacaucaaaaccuucauugaggacaaccuccaguuucggaucgaagagggcaagaaaacauauguccacaccgugaauggggccuacacgucucugaugagaaagcgcuggggauucaacaagaaucggcaagagaacgcccuucaucacgcucuggaugccguuaucguggcugucucccuccccuuuaaacauaaggugagagccuauuucaaacgccgggaagaguacgcgcacaaucagcugaagagagaaggcgaguuuuucccugaaccguggcccggguuuauucaugagcuggagauccgcaugaugcaggacagcgaaaacauuaaacuugccauggagucccucaaucugaagacauaugaugaaucuuucaucaaagagcugaagccuauuuuuguuagccggaugcccaagagagcuaugaaaggacagauccacgaagagacccucaagcgcgugcggggcagaaccgacgacggguacauccggacagucaaaaaggugaaacuggaucaaauuccuuucgacaagaacggcgauuuucccauguucggaaaggagaccgacaugaaaacauaugaagccaucaagucccgcuaccuugagucuggcaaagauaagaaaaaggcuuuuaauacgccgcuguacaagccugccaaaaaccccgaaaaugcgccuauuaucagaagcauuaagaucgaggaaaaagccaaccgggugguuaugcucgacgagaagaccgcugccgauaacgcuuccaucguccgcacagagguguucagacacaaagaaaccgggaauuauuuccugacacccguguacgucgccgacgugcuggccaagaagguuccugaucggcuuauuaccacgaaaaagcccuauagcgaguggagaaaaaucaccgacgaauacgaguuucucuucucucuguauccgaacgaucugauucgcgugaagaugccuaaagagaaggaaacaaagacccauacaggagagaaacacgucuggcaggaaaauuuuauguacuucaagggcgugcauuccgggagcgcuggaguucggaugaucgaccacaugaacucuuuugaggaugaaauuggcgugagaaaacucgucguguucgagaaguaucagguugacccccuggggcgcaugaauaaagugcacggcgagaagcggcauggaaucuga

SEQ ID NO: 3852 - RNA, 3234 nt, Artificial Sequence
  Cas9 variant
augaaguacagcaucggccuggacauugggaucgccuccgugggaugggcugucauuaacgaggauaucgaaagaauugaggaccucggcguucggaucuucgauguggccgaacagcccaaaaccggggcgucucugagcacaccucgcagacuugcucgguccacgcgcaagagacugcggcgcagacggcaccgcguggagagaguccggaaauuuaugauccaaaagggacuccugacccaggugcagauggaacagcuuuaugacuggaaagauggcgaccuggauauuuggcucguucgcgugaaugcccuggagagaaagcugucugaccgggaguucgcccgcauccucguccauuuugcuaagaacagaggguuccaaagcaaucggaaauccgaacugcaggaggaagauaacggagccgugcuuucugcuguucaggagaauaagagacugauggaggaaaaaggcuaccagacaauuagcgagaugcuccuguaugacgaaaaguuugagggcaccaaacgcaacaaagggggagaauacacacacguggucgcccgguccgaucuuaagagagagauccaacugauuuucgagaagcagcgcgcguauggccaugccuuugcuaccauggaaaaugaggacaaguuccuccagaucuggagcucucagcggccguuugccacaaaagaugacauugcuaagaaaaucgggaacugcaccuucgaacccaaggagaaaagagccccuaaguccacguacaccuuugaacgcuuccgggcgcuggacaagcugaauagacuccgcauccugagcggaacaucucccgcccggucccuuacccaagaggagagagaucugauucucaacagccuguuuucuaaaaaggaagugaaauauaaggagcuucgcaaacugcucaagcugaaugacgaacagcgguucaacgagaucuucuacgauccuaaugaaaagauugagaaaaacgagaauagaacauuucugucccucgaaagccaguacaagauccggaaaauucugcaaaagaucgagggcaaaucccuuaacgacaccuaucgccccguggaucuggacacgaucgcuuacgcccucacagucuucaaggaugaccaggauauuagagacuaucugcagaaccaguacguugcuucuaaugggaagaaagaacuuaaccuggccaaucggaaguauaacgaugagcucaucgaggaacugcugcaccucagcuuuaccaaauucggacaucugucccuuaaggcccugagaaauauucucccuuuuauggagcaaggcaucccguaccaccaggcuugugaaaaagcgggcuaucaguucaacaagaaggugaaucgcgagaaacagaagcugcugcccccugugcccgccaaagacauugucaacccugugguuauccggagccuuucucaagugagaaaggucaucaaugggauuaucaaacgcuacggaucccccagcucuauuuacaucgaacucgcuagagagaugggccggggguauaaggagcgcaaagaccuggaaaagcaguacaacaagaauagacagaugaacgagggagccaaaaagcacauucuggaacuccggccggaguuuggcgauccucgcgggcaugacauccugaaauauaaacuuuggcaggaacaagauugcagaugugccuacagcuucaaguccauucccaucaagcagcuguuugagaucggauaugcugagguggaccacauuaucccuuacucucggagcuucgaugacuccaauaacaauaagguucucgugcuggccgcggaaaaccagaacaaacagaaucgcacacccuaugagugguuuggccaugaugaaaccaaguggcaagaguucaccagccuggucacaacgaugaaagugucuaagaaaaagaagucccuucuccugaaaaagaacuuugacgaagaacaggcugaggaguucagaagccggcaccugaaugauacccgcuacauuacaagauacaucaaaaccuucauugaggacaaccuccaguuucggauggaagagggcaagaaacaauauguccacacagugaauggggccuacaccucucugaugagaaagcgcuggggauucaacaagaaucggcaggagaacgaucuucaucacgcccuggacgcuguuaucguggccgucucccuccccuuuaaacauaaggugagcgcuuauuucaaaagacgcgaagaguacgcccacaaucagcugaagcgggaaggcgaguuuuucccugaaccguggcccggguuuauccaugagcuggagauuagaaugaugcaggauuccgaaaacaucaaacuugcgauggagucucucaaucugaagacguaugacgagagcuucauuaaagaacugaagccuaucuuuguuucccgcaugcccaagcgggccaugagaggacaaauucacgaagagacacucaaacgcgugcggggcagaaccgacgauggguacauccggaccgucaagaaagugaagcuggaccagaucccuuucgauaaaaacggcgacuuucccauguucggaaaggagacagauaugaagaccuaugaagcuauuaaaucucgcuaccuugagagcggcaaggacaaaaagaaagccuuuaauacaccgcuguacaagccugcuaagaaccccgaaaaugccccuaucauuagauccaucaaaauugaggaaaaggcgaaccgggugguuaugcucgaugagaaaacggccgcugacaacgccagcaucguccgcaccgagguguucagacacaaggaaacagggaauuauuuccugacccccguguacgucgcugaugugcuggccaaaaagguuccugaccggcuuaucacaaccaagaaacccuauucugaguggagaaagauuacggaugaauacgaguuucucuucucccuguauccgaacgaccugauccgcgugaaaaugccuaaggagaaaggaaccaagacacauaccggcgaaaagcacgucuggcaggagaauuuuauguacuucaaaggggugcauagcggaucugccggcguucggaugauugaucacaugaacuccuuugaagacgagaucggggugagaaagcucgucguguucgaaaaauaucagguugacccccugggccgcaugaauaaggugcacggagagaaacggcauggcauuuga

SEQ ID NO: 3853 - RNA, 3234 nt, Artificial Sequence
  Cas9 variant
augcagcaaaagccccagagauacauccugggccucgaccuggggauugccagcgugggaugggcuugcgucugggccgaugagaacgaacacccuaccggccuucuggacugugggguucggacauucgagcgcgcggaagugccgaaaacgggagauucccucgcucuggccagacggcaggcccgcucugugagacggcuuauccgcagacgggcucaucgccugcucagacugcggcgccugcucaagagagagggcguccugcuuagcgccgacuuuaaugaaaacgggcuggugcggggacuccccauugaugcuugggcccugcgcguugcgggccuugacagaaaacuguccaauaaggagugggccgcugugcuccugcaccuggucaaacaucggggcuaucucucucagagaaagaacgagacccaaagcaaggauaaagaacuggggcgccuucuggccggagugaauggcaaccgggaggcucuccagaauagauccgacgaauaccgcacagccgcggagcuggccguuaagaaauucgcugccgagaacaaugggucucuucggaacaagggaggcgauuauagccacaccuuugacagaaaagaucugcagcgcgaacuccaucugcuguucgagcggcagagagcucucgacaauccuuuuacauccagcgaaauggaggccgccguggaugaacugcuuaugaagcaacgcucugcucugcagggggaggcgguccucaagaugcugggacggugcaccuucgagcccuccgaauacaaagccgcuaagaacacauauagcgccgagagauuuguguggcuuaccaaacugaauaaccuccgcauccaguacaauggcgaagaacgggcccugucugaagcugagagacggcugcuccuggacgagccuuaucagaaggccaaacuuacguacaagcaagugcgcaccauucuggaacuccccgaguccgcggucuucaaaggccugagauacgggcacggagaagacggccugaaggcugagagcgggacacuuauggaaaugaaggccuaucacgccguucggaaagcucucaaggaugccggacuggagggcgagugggaaaacagaauccgcaacccugagcugcucgacgcuaucgggaccgccuuuucucuguacaaaacagaugaagacauucgggcgaaucuugccgcuuucagacuguccgagaacgugcucgaggcccugcuggcuggacuuaauuuugauaaguucgugcaucucagccugaaagcccuggcgaagauccucccgcugauggaacagggcaugcgcuaugacgaggccuguaaggaggcuuacggcgaucacuauggggccaaagagcaggaagaccauagacuucugcccccuuuugucgcugaugacauucggaaccccgugguuuuccgcacccucacgcaagccagaaagaucgugaaugagauuguccggcgcuacggauccccucugagagugcacaucgagacaggccgggaaguugggaaaucuuucagcgaucgcaaggagauugagaaaagacaggaagaaaaccggaaggagcgcgagagagccgcugcgcacuuuaaggaacuguuccccaauuuugccggagagccgaaagcucaggacauccuuaagcuccggcuguaugaacagcaacauggcaaaugccuguacuccgggaaggagaucgaccucagacgccugccugaaaaaggcuacguggagauugaucacgcccuucccuucagccggaccugggacgauucuuuuaacaauaagguccuggugcucggaaaggagaaccaggacaaaagaaaucgcacaccuuaugaauaccuggauggcaaggggaacuccggagccuggcgggcuuucgccgagagagucagcggcugucgcuuucccuaugcgaaaaagcagcggcugcuuacccagaaacucgacgaaaagaccgagcaaggguuccuggagagaaaucugaacgauacacgcuacguggcucgguuucucugccaguucaucgaagagaaaaugcaucuggaaggagccggcaagaagagaguuuuugccucuaaugggcagauuacggcccuucugcggggcuucuggggacucaaaaaggugcgcgaggaaaacgacagacaccaugcucuggaugcggucgugguugcuuguagcuccgugucuaugcagcagaaaaucacccggcacuuucgcuauagagaggagcuggaacacauugaccgggagacaggcgaagucauccauggguucccccaaccuugggaguucuuuagacaggaagugaugacccgcguguucagcgaugacccgguuuccgagcuugccgagaagcuggauagccggcccgaagccguccacgaguuugugacaccucucuucgugucuagagcuccccaucgcaaagucaccggacagggccaccuggaaacgauccgguccgccaagagacucgacgagaagauuagcgugguuaaacugccucuuacacaacugaagaccaaagacaucgaacgcauugugggguaccccaaccgggagccggcucucuaugaugcccuggcggccagacuggcugccuuuaaggacgauccugcuaaagccuucucugagcccuuuuacaagaccggaaaggacggcaaaugcgggguccuugugaaggccguucgcguggaaaauguccagaaauccggccugcucgugagaaaggaugagagcggaaaaaugcagggcguugcugacaacgcgacaauggugcgggucgauguguucgggaagaauggaaagaacuaccuggugccugucuaugccuggcaaguugaaaaaggcgagcuccccaaucgcgcugugguggccuacgccgacgaggaagauugggacgagauggaugacuccuuugaguucaaguuuucucuguauccuaacgaucuugucgaagugguuaccaaaaaggacaaauucuuuggguacuauagcggauucaauagagcuacaggcgccaucaacauuaaggaacacgaccuguccaaaucuaaggugaagaauggggucuacgagggcaucggagugaaaacggcgcagagcuuccagaaguaucagguugauacccucggcaaaacaauccggcuguguaagcccgagaaacgcaugggguuuaagaagaaauga

SEQ ID NO: 3854 - RNA, 3237 nt, Artificial Sequence
  Cas9 variant
augagauacgugcugggccucgacaucgggauugccagcugcggaugggcugucaucaaccaggagaaggaacggauugaggaucugggcguucgcaucuucgacaaagccgaaaaucccaaggaugggaaaucccuugcggcuccuagacgggacgcccgcucuaccagacggacacugcgcagaaagaaacaccggaugcaacgcauuaaggugcuccuggugaagcauggacuucugagcaaaacggagcucgaucaccuguaugaauccgccaccgaggucgacguguggaaccugagacucgaugcucuggagcggaaacuuuacccgaaggaauuugcccgcauccugauccaucucgcuaagagacggggcuucaaaucuaaucgcaaggagacaacccugagcgaaaacgggcagauucuugaguccaucucugagaaucagcagauuauggaaaagcaaaacuauagaacaguuggagagaugauccugaaagacaagaaauuugaaaaucacaagcggaacaaaaauggcaccuacgugggcacagucaccagacagcagcuccaggaugagauucaaaugaucuuccaugcccagcgccuguauaagaacgacuacgcgacggaagaguuugagagcuccuaucuggaaauuugggccagccagcggcccuacgcuucuaaagaucagaucgagaagaugaucggguacuguacccucgaaccuaaggagaaaagagcccccaaggcuuccuggagcuuccaauauuuuguggcccugcagacaauuaauaaccuucgccugaucucuaaagaccggauugaggagcucuccuucgaggaaaagaaacagaucaugaaucuggcgcuugaaaagagcauuguuaaguacaucgauaucagaaaacugcucucugugccuaacgaauuucaauucaauucccugagcuauuccgccgacaccgucgacacagcuguggagucucgcaagugcauugaacugaaagaguaccacagcaucaacaagguguauaaacagauuuacggagagaacgcccucaaucugcuucccaaguauuacgauaccaucgcuuacggccugacgauuuuuaaggacgauaaagacauccucgaauaucugcagaacaaguacgucaaugccaaagggaagccuaucuccaacuucgccaauaaaacauaugaugacaccuuuauucaggcgcuucugaaccucaauuucacaaagaugggacaccugagcuucaaggcucugaaaaacaucauuccguuucucgaggaaggccugucuuacgauaaggccugugagaaagcuggguauaauuucaagggaaccuccuacaccgagcaaacaaaauaucuucccguuaucccucagaacacgaaucccguggugcaucgggcccugagccagaccagaaaggucauuaacgccaucauuaaaaaguacggcucuccuaaugcuauccacaucgaaacagcccgcgagcucagcaagaccuuucaggaacggaaagagauugacuccauguaccaagauaacucuaagaaaaaugaacaugcgauccacaagcugaaagagcugggcaacauuaaccccagcgggaucaauauugugaaguucaaacuuuggaacgagcaggacggaagaugcauguauuccggcaaguacaucgaaccgcaccgccucuuugaggaaggguauacagagguugaucauauccugccuuacagccggucucuggacgacuccuauaauaacaagacccucacgcugggaacagaaaaucagagaaaaggcaacaagauucccuacgaguauauggggaauaccagcaucuggaacgauuucgagacccgggugcagucuaauaaaaagauuaacaagaaaaagcaacagaaacuucugcuccagcacuuuuccuacgcucgcgaacaggaguucaucgaaagaaaucugaacgacacacgguacgccaccauuuaucugagcucccuuauccaacagcaucucaucuuuucugagagcuccagaaagaaaaagguccacacagugucuggaauuaucacgagccaucugcgcucccgguggggcuucaauaaggauagaaaagaaggccacauucaccaugcccuggacgcuguuaucguggccgucaccagcgaucacaugauucagcgcgugacaaaguacuauaaacucaaggagcugaacagaaaucuucaagcuaaacggaugccuuuucccgagcccugggaaggguuccgccuggagcucgaagccagaaucucuccuaacacccagcaguaccugaagggacugcgguuuaaaaacuaugcggacgucaaucuuuccgagaucaagagcauuuucgugucucgcaugccgaagcauuccaucacaggcgagcuccaccaggaaaccauuagaaaauucaucggguacaacgagaagggaaaaguucugacggccauuaagaccaaacuggaagauauccccuuugacgcuaauggcgauuucccuauguaugggaaggagagcgaccucuacacauacaacgccauuaaggaacgguaucugucucacaaaaaggauaaacgcaagagcuuucaagagccccuuuacaaaccuaccaaguccggcggaaucggcccccugaucaagagcauuaaaaucauggacacaagaaccauugugaauccggucaaccaggggaagggagugguuuauaauucuaaaaucgcucggacggauguguucaagaaagaggaaaaguacuaucucauuccuaucuacacaaucgaccugaugaagaacauucugccccagaaagccaucaccgcgggcaagggguaugaggacuggacaaccauugauccuuccuuuaccuuccuuuuuagccucuuccccaaugaccugauccagauugucccuuccaaaaacaagacaaucaaagcccgcacgaccgugucuaagaaggaagugcugcuccccagccugacaggauacuuuaaaggcguucauuccgggaccgcuggcaucacagucgagacccacgauggaucugugauugccaaugugggcagcaagcaacuucugcucaucgaaaaauaccaggucgacgugcuggggaacuauacgaagauuaaagaggagaagagaaucggacugacaaccuacaaugauaacaaaaagauugcugccuguuga

SEQ ID NO: 3855 - RNA, 3237 nt, Artificial Sequence
  Cas9 variant
augaagcagcaaccccagagauacauccugggccucgaccuggggauugccagcgugggaugggcucuuauccuggucgaugaggaaggcaacccuauugggcuccuggacugcggaguucggaccuucgagcgcgccgaagugccgaaaacaggcgauucccuugcgcuggcuagacggcaggcccgcucugugagacggcucauccgcagacgggcccaccgccugcugagacuccggcgccugcuuaagagagaggggguccugagcgcugccgacuuuaauuccgauggacuccccaaccugccuauugacacguggcagcuucggguggcuggccuggaacgcaaacucaccaaucaagagugggccgcgguucugcugcaucucgugaagcacagaggcuaucugucucagcggaaaagcgagacacagaccgaaaacaaggagcuugggugucugcucgccuccgucgcuaaaaauucuaagcugcuuagcgaaaacgccaaucaguacagaacacccgcugagcuggccgugcgccucuucgcggagcaauccggacaucugcggaacaagggcggggauuauacccacacauuuaauagacuggaccuccagaaagaacugcaucuucuguucgagcagcagcgcaccuuuggaaacccuuucgccagcgcugaacuccaaucuaagguugauggccugcuuaugaugcagcgguccgcccugcagggggaggcugugcucaaaaugcugggaaagugcacguuugaacccagcgaguacaaggccgccaaacacaccuauucugcugagagauucaucuggcugacaaagcucaauaaccugcgcauccuugaaaauggcaccgagcgggcgcugaacgaagccgagagaaaacuccugcuggacgaaccuuacaagaaagcuaagcucacauauucccaagcccgcaaacuccuggauaugagccacgacgccaccuuuaagggccugcgguacgggaaggauucugagggacucaaugcugagaacggcgcccugauggaaaugaaagcguaccauaagauuagaacgguccuugacaaagcugggcugaagggagagugggaaaaccgcauccggaauccggagauucucgacaaaaucggcacagccuucucccuguauaagaccgaugaagacauucaggccgcucuggccgaucuuagacuccccgagaacgugcugaaugcucugcucgccgggcugaacuuugacaaguucauccagcuuagccugaaagcgcucuccaauauuaugccucugauggagcggggaauccgcuacgaugaagccuguaaggagguguauggcgaccacagagcucuggccgaaucuaaaaaccagaugcuucuucccccuauccccgcuaaugagauucggaacccggucguucugagaacacugacccaaacccgcaaggugaucaaugccauuauccggagauacggcagcccucagcgcgugcauauugagacagcgagagaacucgggaaauccuuuaaggaucggaaggagaucgaaaaacgccaggaggaaaacagaaaggagcgggagcgcgccgcugaacacuucaaagagcuguucccccacuuugccggagaaccuaagggcggggacauccuuaaacugagacucuaugagcagcaacagggaaagugccuguacagcucuauucccaucgaucugggccggcuuaaugaaaagggguaugucgagauugaccaugcucuccccuucucccgcacgugggaugacagcuuuaacaauaaagugcugguucugggcucugagaaccagaagaaaagaaaucagaccccuuacgaauaccucgacggagccagcaacucccaacgguggcgcgaguuccaggccagacugcagggcugucgguuuucuuaugcuaagaaacagagaauccaaacagcgaagcuggauagcaaaaccgaacagggguuccuggagcgcaaccucaaugacacacgguacauugccagauuucugugcggauucaucgaagagaaccugcaccuucagggcgaggggaagcgccggguguuugcuuccaauggacaaaucaccgcccugcucagaggccugugggggcucaagaaaguccgcgaagagaacgaucggcaucacgcccuggacgcuauugugguugccuguagcacggugucuaugcagcagaagaucacaaaagcgaugcagagacgcgaaacccuugagaccgucgauacagagaccggcgaagugaagacacggauuccgcaacccugggacuucuuuagacaggaggucaugaugcggguguucuccgauacgccucaugaggaacuggcugaaaaacucagcggacgccccgaggcccugcacgacuuuguuucuccucuguucguguccagagcccccaaucggaagaugaccggccaggggcaccuugagacagucaagagcgcuaaacgccuguccgaaaacaucucugugguuagaaagccgcucaccgcccugaaacucaaggauauugagaauaucgugggauauccugaccgggaacccgcgcuguaccaggcucuuagagagcgccugcaagccuauaaagaugacccugucaaggccuucgcugaacccuuuuacaagccugccaaaaacggcgggcagggaagccucgugaaggcugugcggguuaaagauguccagaagacaggcgugauggugagaaaagaccgcgggggcauugcccggggaaucgcggacaaugccaccauggucagaguggauguuuucggcaagaaggggaaaaacuaucuggugcccgucuacgcuuggcaaguggccaagggaauccugccgaaucgcgcuguuguggccuacgccgacgaggcugauugggacgagauggaugacuccuaugaauuuaaauucacgcuuuacccuaacgaucuggucgagauuaucucuaagaaaggccggauuuuuggguauuacagcggacucaauagagcgaccggcgccaucgacauuaaggaacaugaucuguccaaagagaaggcuaagaacgggauccaccagagcgugggcguuaaaacagugcucucuuuccagaaguaucaggucgacccccugggaaaagaaaucugccuuuguaagguggagaaacaucccgagcuuaauuccaagaagaaaaaguga

SEQ ID NO: 3856 - RNA, 3237 nt, Artificial Sequence
  Cas9 variant
augggcuaccugaucgggcucgacauuggaaucaccagcgugggcuaugccguccugcagacagauuucaaggggaaccccuacaaaauucuucugaugaauacgguuaucuuuccuguggcugaggccccgaagaccggagaaucccucgcggcucccgugagacaaaaacggucuagccgcagaacaaaccggcgcaccaaguucagaaaacugcggguccagaaacuuuuugugcgcuucggccugcucgaguccgccgacguugccacauuucugaaucagaaggugccucaccaggauauuuggcaacugagaaaagacgcucucaaccggaagcugucuaaucgcgaacuuuucgagauccuguauuucuucgucgggcauagaggauuuaaaagcaaccggcgcuccgaagugaccggcaagcagcccaaagauaaucagguugugcucacaucuauccacgacagaggcaacacccugaaugauuucgacagccuuggggagaugaugcaggagcugccugaauuuaagacgauuaagcauaacaaagccuaccggcccgauaauaccaucuauccucuccgcgcuuggauugagcacgaacuguccgccaucuucagcguccaacagaagaacaauagacagauuacagacaacuuuaucacccaguaccuggauauuuuccggucucaaagagacuucgaucagggaccggcggcccccucccgcuuuggcgggaauaugaucgagcggauggugggaccugacagccucgacgcucaugagaaaagagccgcuaagcugacaaacaccuucuuucgcuucaacuuucuuucuacgcugaauaaccucaaaauccagcugacacuuggcgccgaauuucacccccugaccacaccucaacgggagauugugcuccaggcggccacccugaagucccugaauuauaaacagaucagacacaagcuccagcugcccgauagcgcucgcuuuaaccuugucccguaccaaucuaaugaagacccuauuaagaccgaguccaaacauuaccuguucaagcggaaagcccucacacagaucgaagcuguuacggauaacccccagcugauugacaagaucgggaccauccuugccuauuuuaaaggagauaagacaagacaggagaagcugagcgcccucaaucugucccgcgcugagauuaaacaacugcucccuaucaaccagcccggcuucggcaaucugucucuuaagaccaugcacaaaauucugcccuaccucgaacaggggcaucuguaucacgaggcggcccagcuggcuggauacgacuuucaaaacaaucuuguggaucggcaguaucucagagacaaccugaagaauccuguggucaaccgcgccaucggcaaaacaauuaaggugguuaaugccaucaucaagaaauacggggauccggacgcuauucacaucgaacugacccgggagauuaagcauagccacgaagagagacagaaaaucgcccggcagaugaacacgaacauggaucaaaaugacaagguggcggagcaucuccgcgaaaacggcauucccgucaauggacagaacaucauuaaauccaagcuguucuaugagcagaaggggaucgaccuuuacagcggacaacagaucaaugaacaggaucuguacacagaggaccacuaucagguggaucauauuaucccuuacucuauuuccuuuaacgacagcuucaccaauaaaaccguuacaagaaccucuaacaaucaaaacaaggcuaaucggcucccccuggaauaucugagcgaggagaaacaggaugccuucagagcccgcgugauguccaacaucucuaauuaccggaagagacagaaccuucucaaagaaggcauuacagaggacaaucgccagcaauggaagacgagaaacaucaacgauaccggcuauaucaaucggcugcugagccaguaccuccgcaacaauguccaguuuacaaagaagucccacaacccuguguucaccgucaauggggcuacaaccgccuauauuagaaagcgguacggaaucauuaaaaaccgccaggcuacggaccugcaccaugccguggaugcgguuaucauuggcugcaucagcaauaccuuugugucuagacuugccaaguacuccgaagcucaagaggcccgguaucacaaacagcuguggcagaucacacaauaccgccaggagcauaaggaccucagcaccauugaauaucaggagcugaucaaacaguucccccugccguggccugauuuuagacacgaacuuauggcucggcucucuacagaccccgccaagaugauggcgcaccauaccugggagcacuacacggaugaagagauuucccaacugaagccugccuucgucauccgcagcgcuaaccauaaagugacaggguccgcccacgacgacaccauuuauucuaagaaacuguacgaucagagaggaguuggccuccugcggacaagccuucagaaucugaaguaugacuccaaaaaggaugggaucaagaacuacgagagacucaaagacggcucuaauagccugguguacgauucccugcuucgcgcucucaaggaacaugacggaaacgccaaaaaggccuuucccgauaaucagcugcugaucagcaccggcaaccaccaacagauuaucacccacgucaaaacagugaagaagauuacgcauccuaucgaggugaaucgggacaccgcuauugcgaucgggggaagaaugauucgcguugauaucuucaaacaggccaaggcucagaaacucaucggcauucccgucuaugugaacgacacagugaagccgacccugccuaaccgggccuguacaucugggaaaagauacuccgauugguaucaacuuacccgccaggaccaguuucugugcagccucgucucuaaugaucuggugcugguugaaacggccagcccccuuaaggugacaaacaauaucaccaacgaggaaguccagaccacacaacugcucuguuacuucuccucuuuuaauauugcuaacgcccagaucaauuuccacagcauuaacaaugacuccagcaucaaccccaucgugcugaauaaaguuaccuaucucacaaaguaccagcuggacuaucuuggaaacuacuuuccugugaagcaugagucucggaaaacguucaauagaaagcgcuga

SEQ ID NO: 3857 - RNA, 3237 nt, Artificial Sequence
  Cas9 variant
augcacaccagacuggcccucgacaucggcacaacgagcauuggguggauccuguacgagcuugugaacggacagcccgcuuccauucuggauggcgggacccggaucuucucugacggacgcgaagccaagacaggccauagccucgcggucgggagacggaccgcucgcggaaugagacggcgcagagaucgguaucugcgcagacgggccgcccuuaugaaacgccuggcugccauuggccucaugccugaguccccggaagcugccgcgcaacuggccacacuggaccccuacgagcucagagcucggggccuggaucacccucuucccccugaacaucuggggcgcgcccucuuucaccugaaucagagacggggauucaagucuaacagacgcaccgacaaaggcaauaacgaagggggaaugaucgcugaugccagcgcgcggcuugagcaggccaugauggcugccggcgcuagauccuauggggaauuucugcauaagcgccgggccgaggccacagcucccagagcgaccccugccguucgcacgcggaucaauccgcaccucaccggagaagacggcaaagagcagcccggcuacgauuucuauccugacagaaagcaccuggaggaugaauuucaucgccugugggaggcucaagcccggcacaaccccgaccucacacccgccaugggggaucugcuuuuccagaccauuuuucaucagagaccccugaaggcuccggccgugggacgcugccucuuccuggacgaaccucggcuucccaaagcgcacccucugacacagcaaagaacccucuacgagacggugaauaugcugcggaucgcuccucccggccagccuaagcgcagacugucucggguccagagagaccagauugugcacgcccucaacaaucgcaaaauccuggccagcccggggaagaacguucuuacacuggcugccauuggaaaacuccugaaacuucggcccggcgaggcuuuuucccuggauaccgccaauagagacgcgaucgccugugauccugugcgcaugagccucgcuuaugaggggagauucggaccccaauggucugcccuguccgucgagagccagugggaacugauucagcggcuccgcgacgaucaagacggcgcugcccugguggauuggaucauggacagauacggcuuugaucgggaccgcgcgagagccaucgcugaugccccucuucccgagggguucggacggcugggcgaaacagcuacccgcgccguucucgccgugcugauugggggaaccacagagcaggaaguccugacguacucugaggcuguggcggccugcggcugggaccauuccagacuugggaccggcgaggugcucgaccggcugccguauuacggacagguccuggaucgccacguucucccuggcacagggagacccgaagacgaugagaucacccgguuuggaagaauuacaaacccuaccgugcauaucggccugggacaggugaagcgccuugucaauaaggugauugacgcuuggggacggccccacgaaaugguuguggagcuggccagagaucucaagaugagcgaagaccaaaaacgcaaccuggccaaggucaaugcucagaaccagcgggccgcggagaugagaucugcuaaacugaucggcgaucuuaagaucgaggacaacgggcgcaaucggggcauucucagagugugggaagaguccgccgccgauguucugcaucgcuguugcccuuauacgggagcucagaucagcgccuccaugcuguucgacggcucuugugauauugaccacauccuccccuacagccggacacuggaugacggguucaacaauagagugauuugccuuaaauccgcgaaccgggaaaagcgcaaucugaccccgugggaggcuuggggaaacaccccuaagugggccgccaucgaggcuaaucucaaaaaccugccucccgccaaggcuuggagauuugcccccgacgcgaugcugcgguaugaaggcgagcgcgauuucacagccagagcucuugucgacacccaauaccucagccggcuggccagagaauaucuggagugucucuacgcugaagauaucgacccggggccccacucugggaaaaagccucgccggcccauuuggguggucacaggcaaacugacggagcuucugagacgccauugggggcucaauucccugcugccugaugcccaccggggcaccgccaaggcuaagaacagacuugaccaucgccaccacaugaucgaugcggccgugguuggagcuacagaccaugccaccgugcagcggauugccaauauggcuaaaggcaacgucgagaaugggcucgaagaucuggccggaacaauccugcccccuuggcccggccucagagacgaucugaaggcgcgccuugagagaaccauugugagccaccgggggaaccauggagcuaucgacccggccgcccgcaaacagggcagagauacgaccucugggcagcugcacaaugacacagcuuacggccucaccggagaaacacugaagggcguuccucugguggucaaccggaaacccauugacaugcuuaccccugccaugaucgauaagauccgcgacccccaucugagcagauggcucacggcggugacaaaggggaaagagggaaaggauuuuaaagcugccguggaagccuuccgggcucacccgggcccuuauagagggauucgccggguuagacugaucgagcccgucgaggugauucgcaucaaggaccggaacggaagaccuuacaaaggcuauaagggcgauuccaaucaaugcuacgaaguguggugucuccccgaccggacccugacacaccaugucgugucuaccuuugccgcucaccaggggcagaccggaaagccccauccugccgcgaaacgccuugccagacuguauaagggcgauaugguucggcucgaccgcagcaaauucggguccgugauugcuacagucgagaaguuugauagaaacggacagcuggaacuggugccgcacaaugagggcaacgccgaccaacgguaccgcaaagauaagagcgacucuguuuucaucagacuucgggcugccacguuuaucgccuccggggcucgcagagugauugucgacgaaaugggacggaucagagaucccggcccuggcaaacauuga

SEQ ID NO: 3858 - RNA, 3240 nt, Artificial Sequence
  Cas9 variant
augaaguacggcaucgggcuggacugcggaauuaacagcgugggcuauuguaucauggagcucaauuccgaugacgaacccaaaagaauuguccggcugaacucucgcaucuucaccgaggccgaaaauccuaaggaugggagcucccuugcugccccgagacgggaggcgcgcggacugagacggcgcauuagacggcacaaacaucgccucgaaagaauccgggcucugcuuguucgcgagaacaucgugacacaggccgagcuggacaauauguuuucuggcacgcucagcgauauuuacgaacugagaaccgccgcucuggacgcuccccucaacaauaucgaguucgcccgggugcugauuaaccuugcccaacgcagaggguuuaaguccaaucggaaaucugaaaagagcuccagcgauaaggagacaggaaaacugcucucugcgaucaagaaaaacaaggaguccauugaagccggcggcuauagaaccgucggggagaugcuguucaaagacgaacgcuacgcuaagcacaagcggaauaaaggagaggccuaucuuaacacagugagcagagauaugaucgaagcugagauucaugccguuuuugcgucucagcgcaauuucggcaugccuuuugccaacgagaagaucgaaaaugaguacaccgacaucgcucugucccagcggcccuucgaucucgggccuggagaaggccccgagaacugcaaaagcccuuaugccgggaagcagauuaaaaacaugaucggacaauguacauuuuucccggaagagaagagagcugugaaagccucuuacuccuuucagcuguucagccugcuccagggcauuaauaacaucacccuggucuccucugacggcaauacguuuccccuuagccaggagcaacgcaagacccugaaggauuacugcuucaaaacagccaacgugaccuaugcuuccauucggaagguucuccagaucccucaggaauacacauucaaaaauaucaccuauacggacgacgggauugaaaagagcgaaaagaagacaaaguuucagcaccugaaacccuaccaugagaugaagaaagugcuuggaucugcgauccaaacccugacaccugaggagcucgaugagauuggcgaaaucuucaccuuuuauaaggacgagaccauuaucaucaaacagcuggaagagacagagauugauaagucccuguacgaccuccugcuucagcugcccacguucgaaaaggccgggcacaucagcaccaaggcuuguaagaugauuaucccguuucucgaggaaggaaaaacauaugauaaggccugcgagugugccggccugaacuucaaagcucacaccaauaugcaaaagcagaugcuucugccugccaagucugacgaacucaacgaugucgugaaucccguggucagacgcgcgauuagccagacaaucaaaguugugaacgcuauuauccgggagauggggaccuccccuacguacaucaauauugagcuggccagagaacugucuaagagcaaaaaggagcgcgacgaaaucaacaaaaaguacaaacucaaucaggccgagaacgaacggcugaagaaugagauuaucgauaacuuuaagauuaaacccaacggacaagacaucaucaaacuuaaacuguggcaugagcaggaugacggcauuugccccuauacaggcgugagaaucaaguacgaaaaucucuucgacgauggguaugcugagauugaccacaucauuccuuacucccugagcuuugaugacucuuucaacaauaaaauccugaccaccgccacacagaaccggcagaagggaaaucgcaucccgcuugaauaucuccccgaguccgaaaaggauggcuuuagagucugggugaacagcaauauucggaaccauagaaaacgccaaaaucugcugaaggagcacuucaccgaggcugacaaaaaggaauuuaaaucucggaaccucaaugauacaagauaccugaacaaacuucugcucaauuauaucaacgacaaucugcuguucacggauuucuacaacgggaagaaaaagcacguuaccuccgugaacggagccgucacagcguacauucgcaaaagauggggcaucaauaagaaccgggaggacggggaucuucaucacgccguggacgcugccguuauugcuugugugacccagggcaucaucaaucgcauuacagccuauagcgcgagaaacgaagccccuuacgaucucaauaccgagacgggagagaucaaagaacgguuuccccugccuuaucccaacuucaagaaggagcuggacgcucgcaccacaauugaagacgagaaaagacucaagcggguccugauguccuuuucuaauuacagcuaugaugacguggaaaaagccaagccgugcuucgucucccgcaccccucauagaaaagugacaggcgcugcccacgaggagaccauccggucugggaagguugaaggauuuacggugagcaaaacagagcuuaccaagcugaagcucacaaacggcgaaauugagggguacuaugaacccgaguccgauacccugcuguacaaugcccuucuccagcgccugaacgaguucggaggcgacgcuaaagcggccuuugcugaugaguuccauaagccuaaagccgacgggacccccggcccugucgugaagaaaguuaagacaaucaagagaucuagcuccaaugugaaagcccggaacaagaauggacugggcgucgcugauaacgggagcaugauuagaaucgacguguuuuacguggaaaaugaaggauauuacuucguucccaucuaugucgccgauacggugaaagagaugccgaacgaagcguguccuuuuggcaaggacaaaaagaagauuaugaccgaugacgauuuccucuuuucucuguaccccaacgaccuuaucaaaauuacagcuaagaaagacaugaaguucucccuggccaauaaagagagcgggcuccccaagaacaaguaugccaaugaggugcuggucuacuauucugcugccgauaucagcaacgcguccauuagcgugaucaugcacgacaaugcuuacaaauuccgcggaugcggcaucaagucucugguuaaacuugaaaaguacaccguggauccucucgggaacgucuccaaagugaaucgggagaagagaauguauuuuaaguga

SEQ ID NO: 3859 - RNA, 3240 nt, Artificial Sequence
  Cas9 variant
augagacugggccucgacaucgggaccagcuccauuggaugguggcuguacgagacagauggcgccgggucugacgcucggaucacgggaguggucgauggcgggguucgcauuuucagcgacggaagagaucccaaguccggcgccucucuugcgguggaccggcgcgcugccagagccaugcggcgcagacgggaucgcuaucugagacggcgcgcuacccucaugaaagugcuggccgaaacaggccuuaugccugcugacccggccgaggcgaaggcccuggaagcucucgaucccuuugcccugagagcugccgggcuggacgagccucucccccugccucaccuuggacgggcgcuguuccaucucaaccagcgcagaggcuuuaaaagcaaucggaagaccgauagaggggacaacgaauccggaaaaaucaaggaugccacagcucgccuggacauggagaugauggccaauggcgcucggaccuacggggaguuccuucacaagagacgccaaaaagccacagacccccggcaugucccuucugugagaacccgccugagcauugccaaccggggaggcccggauggcaaggaagaggcuggguaugacuuuuaccccgauagacgccaccucgaagaggaguuccauaaacugugggcggcccagggagcucaccacccugaacugacggagacccuccgggaccugcuuuuugaaaagaucuucuuucagagaccccugaaagagccugaaguuggccucugccuguucuccgggcaucacggagugcccccgaaggauccucgccuucccaaggcccauccucugacacagcggagaguccucuaugagaccgugaaucaacugcggguuacagccgacggccgcgaggcuagaccccugacccgggaagagagagaucaggugauccacgcccucgacaacaaaaagcccacgaaaagccugucuuccaugguccuuaagcugccugcgcucgcuaaagugcugaaacuucgcgauggggaacgguuuacacuggagaccggagugagagacgccauugccugugauccgcuccgcgcuagccccgcccacccugacagauucggcccccgguggucuauccuggacgcugaugcccagugggaagucauuucccgcaucagacggguucagagcgacgcggagcaugccgcucugguggauuggcucacagaggcccacggccuggaccgcgcucaugccgaagcgaccgcccacgcuccucuucccgauggguacggaagacugggccucaccgccacaacgcggauucuguaucaacugaccgcugacguggucacauacgccgaugccgugaaggcuugcggguggcaucacucugacggacgcaccggcgaguguuuugauagacuuccguacuauggggaaguucucgagcggcacgugaucccuggcuccuaccaucccgacgaugacgauauuacacgcuucggaagaaucaccaauccuacgguccacaucggccugaaccagcugcggagacucgugaaucgcauuaucgaaacacaugggaagccccaccagauuguuguggagcuggcgcgggaccuuaagaaaagcgaggaacagaagagagccgacaucaaacgcauucgggauaccaccgaggcugccaagaaaagauccgaaaagcuggaggagcucgaaaucgaggacaacggacgcaaucggaugcugcugagacuuugggaagaucucaacccugacgaugccaugcgccgguucugccccuauacaggcaccagaaucucugcugccaugauuuuugacgggagcugugaugucgaccacauccugccguacucccggacacuggaugacagcuucccuaaucgcacgcucugccugagagaggcgaaccggcaaaagcgcaaucagacccccuggcaggcuuggggagauacaccccauuggcacgccauugccgcuaaccuuaaaaaccugccugaaaauaagagauggcgguuugccccggacgcgaugaccagauucgagggcgagaacggguuucucgaucgcgcucugaaagacacacaauaucuggcccggaucucuagauccuaccuugacacccucuucacgaagggcggacaugugugggucgugcccggccgcuuuaccgaaaugcugcggagacacugggggcugaauagccuccugucugaugccggacgcggcgcuguuaaagccaagaaccggacagaccauagacaccacgcuauugaugccgcggugaucgccgcuaccgacccugggcuucugaaucgcaucagcagagccgcuggacagggcgaggccgccgggcaguccgcugaacucauugcgcgggauacacccccucccugggagggcuuccgcgacgaucugagaguccggcuggaccgcaucauugugucucauagagccgaucacggacggaucgaccaugcugccagaaagcagggccgcgauagcaccgccgggcaacuucaccaggaaacggcuuauuccauuguugacgacauccauguggccagccggacagaucuccugucucugaaaccugcgcagcuccuggacgagcccggaagauccggccagguccgcgauccgcaacuucggaaggcucugagaguggccaccgggggaaaaacaggcaaggacuuugagaacgcccuccgguacuucgcuagcaaaccugggcccuaccaggccauucgcagagugcggaucaucaagccucugcaggcgcaggcucgcguucccgucccggcccaagauccuauuaaggccuaucagggcggaucuaaucaccuguuugaaaucuggagacuucccgacggcgagauugaagcucaggugaucaccuccuucgaggcccacacccuggaaggggagaaacggccucaucccgcugccaagcgccuccugagagugcacaaaggagauauggucgcgcucgagcgggacggccgcagagugguugggcaugugcagaagauggauauugccaacggacuguuuaucgucccccacaaugaagcuaacgccgacacacggaauaacgauaaaagcgacccuuucaaguggauccaaauuggcgcuagaccggccaucgccuccggcauucgccgggugucuguugaugagaucgggagacuucgcgacggaggcacgcggcccauuuga

SEQ ID NO: 3860 - RNA, 3240 nt, Artificial Sequence
  Cas9 variant
auggacgaggaagccaagauccagcugagcaaagaguccuacgaagaggaacucgagucucugcuugaaaagagcggcgaagaguucagagauguguuucugcaagcuaaaaaggucuaugacgccauucuccuguccgauauccuuucuaccaaaaagcagaacagcaaggcgaaacugucccucgggaugauugaacgguacgacucucacaagaaagaucuggaggagcugaagcaguucguuaaagcuaaucuccccgaaaagacagccaucuuuuucaaggacagcuccaaaaacggauaugccggcuacauugaugggaagacgacccaggaggacuuuuauaaauuccugaagaaagaacuuaauggaaucgcuggcagcgagcgcuuuauggaaaagguggaucaagagaacuuccugcucaaacagagaacaaccgccaauggggugaucccucaucagguccaccugacagagcuuaaggcuauuaucgaacggcagaagccguacuaucccuuucuggaggaagcccgcgacaaaaugauuagacuccugaccuuccggaucccuuacuacgugggaccccuggcgcaaggcgaggaaacaucuuccuuugccuggcucgagcgcaagaccccugagaaaguuacgcccuggaacgcuaccgaagugauugauuauagcgccucugcuaugaaguucauccagagaaugauuaauuacgacacauaucugccuaccgagaaaguccuuccgaagcauuccauccuguaccagaaguauacaaucuuuaacgaacucaccaaaguggccuacaaggaugagcggggcauuaaacaccaguucagcucuaaggaaaaacgcgagaucuucaaggagcuguuucaaaagcagagaaaaguuacggugaagaaacuucagcaauuccuguccgcgaauuauaacauugaagacgccgagauccucggggucgacaaggcuuuuaauagcuccuacgccacauaccaugauuuccuggaccuggcuaaacccaacaccgaacggguggccgagcuccuggagcagccugaaaugaaugccauguuugaggauauugugaagauccuuacaaucuucgaagaccgcgagaugauuagaacccagcugaagaaauaucagucuguccucggagauggcuuuuucaagaaacugguuaagaaacacuacaccggguggggacggcuuagcgaacgccugaucaacggcauuagagacaagaaaacaaauaagacgauccucgauuaucugauugacgaugacgauuuucccuacaaccggaacagaaauuucaugcaacugaucaacgacgacucccucagcuuuaaggaggagcuggcuaaugaacuugcgcuggccgggaaccagucucuccuggaggugguggaagcucugccuggaucccccgccaucaaaaagggcauuuggcagacccuuaaaaucgucgaggaacucauugagaucauuggcuauaauccgaagaacaucgugguugagauggcccgcgaaaaucagcggacaaacagaagcaaaccucgccugaaggcucuggaggaagcccucaagucuuucgauagcccccugcuuaaagagcaaccuguggacaaucaggcgcugcagaaggaucggcucuaccuguauuaccugcagaacgggaaagacauguacaccggagaagcucuugauauugacagacucuccgaguaugauaucgaccacaucauuccccgcucuuuuaucgucgauaauagcauugacaacaaggugcugguuuccagcaaagagaaucggcugaagauggaugacgugcccgaucaaaaggucgugaucagaaugcgccgguacugggaaaaacuccugagagccaaccuuauuucugagcgcaaguucgccuaucugacaaaacucgaacugaccccugaggacaaggcucgguucauccagagacagcuggucgagacgcggcagaucacaaaacauguggccgcuauucuugaccaauacuuuaaucagccggaagaguccaagaacaagggcauccgcauuaucacccucaaaagcucucugguuucccaguucagaaagaccuuugggauucacaaagugcgggaaaucaacaaucaucaccacgcccaugaugcguaucugaacggagucguggccaucgcucuccugaagaaauaccccaaacuugagccugaguucguuuauggcaauuacacaaaguuuaaccuggccaccgagaauaaggcuacagccaagaaagaguucuacagcaacauucucagauuuuucgaaaaggaggaauauuccuacgacgagaauggggaaaucuuuugggauaaagcgcgccacauuccccaaaucaagaaagugauuucuagccaucaggucaacaucgugaagaagguggagguucagacgggaggcuucuauaaagagaccgucaauccuaagggcaaacccgacaagcugauccagcggaaagccgggugggauguguccaaguacggaggcuuugggucuccgguggucgcuuaugccguggcuuucauuuacgaaaagggaaaagccagaaagaaagccaaggcuaucgagggcauuacaaucaugaaacaaagccuguuugaacaggacccuauuggguuccuuuccaacaagggcuauagcaauguuaccaaguucaucaaacucucuaaguacacacuguacgagcuggaaaacggacgcagacggaugguggcgucccacaaagaggcccagaaggcuaauagcuuuauucuccccgagaaacuggucacccuucuguucuaugcccagcauuacgaugaaaucgcccacaaggagucuuuugacuaugugaacgaucaccucuccgaguuccgcgaaauccuggaccaaguuauugauuuuagcaauagauacacgaucgcugccaagaacaccgagaaaauugcggaacuguucgagcagaaccaggaaucuacagugcagagccuuucccagagcuuuaucaaucugaugcaacucaacgcuaugggcgccccugccgacuucaaguuuuucgaugucauuaucccccggaaacgcuauccuucucugaccgagaucugggaauccacaauuaucuaccagagcauuaccgggcucagagagacgcggacacgcauggcuacccugugggacggagagcaauga

SEQ ID NO: 3861 - RNA, 3240 nt, Artificial Sequence
  Cas9 variant
auggacgaggaagccaagauccagcugagcaaagaguccuacgaagaggaacucgagucucugcuugaaaagagcggcgaagaguucagagauguguuucugcaagcuaaaaaggucuaugacgccauucuccuguccgauauccuuucuaccaaaaagcagaacagcaaggcgaaacugucccucgggaugauugaacgguacgacucucacaagaaagaucuggaggagcugaagcaguucguuaaagcuaaucuccccgaaaagacagccaucuuuuucaaggacagcuccaaaaacggauaugccggcuacauugaugggaagacgacccaggaggacuuuuauaaauuccugaagaaagaacuuaauggaaucgcuggcagcgagcgcuuuauggaaaagguggaucaagagaacuuccugcucaaacagagaacaaccgccaauggggugaucccucaucagguccaccugacagagcuuaaggcuauuaucgaacggcagaagccguacuaucccucucuggaggaagcccgcgacaaaaugauuagacuccugaccuuucggaucccuuacuacgugggaccccuggcgcaaggcgaggaaacauccagcuucgccuggcucgagcgcaagaccccugagaaaguuacgcccuggaacgcuaccgaagugauugauuauucugccuccgcuaugaaguuuauccagagaaugauuaauuacgacacauaucugccuaccgagaaaguccuuccgaagcauagcauccuguaccagaaguauacaaucuucaacgaacucaccaaaguggccuacaaggaugagcggggcauuaaacaccaguuuucuuccaaggaaaaacgcgagaucuucaaggagcuguuccaaaagcagagaaaaguuacggugaagaaacuucagcaauuucugagcgcgaauuauaacauugaagacgccgagauccucggggucgacaaggcuuucaauuccucuuacgccacauaccaugauuuucuggaccuggcuaaacccaacaccgaacggguggccgagcuccuggagcagccugaaaugaaugccauguucgaggauauugugaagauccuuacaaucuuugaagaccgcgagaugauuagaacccagcugaagaaauaucagagcguccucggagauggcuucuuuaagaaacugguuaagaaacacuacaccggguggggacggcuuuccgaacgccugaucaacggcauuagagacaagaaaacaaauaagacgauccucgauuaucugauugacgaugacgauuuccccuacaaccggaacagaaauuuuaugcaacugaucaacgacgacagccucucuuucaaggaggagcuggcuaaugaacuugcgcuggccgggaaccagucccuccuggaggugguggaagcucugcuuggaagcccugccaucaaaaagggcauuuggcagacccucaaaaucgucgaggaacugauugagaucauuggcuauaaucccaagaacaucgugguugagauggcccgcgaaaaucagcggacaaacagaucuaaaccgcgccugaaggcucucgaggaagcccuuaagagcuuugauuccccucugcugaaagagcaacccguggacaaucaggcgcuccagaaggaucggcuguaccuguauuaccuucagaacgggaaagacauguacaccggagaagcucucgauauugacagacugucugaguaugauaucgaccacaucauuccucgcagcuucaucgucgauaauuccauugacaacaaggugcugguuagcucuaaagagaaucggcucaagauggaugacgugcccgaucaaaaggucgugaucagaaugcgccgguacugggaaaaacugcuuagagccaaccugauuuccgagcgcaaguuugccuaucucacaaaacuggaacugacccccgaggacaaggcucgguucauccagagacagcuugucgagacgcggcagaucacaaaacauguggccgcuauucucgaccaauacuucaaucagccugaagagagcaagaacaagggcauccgcauuaucacccugaaaucuucccugguuagccaguuuagaaagaccuucgggauuaacaaagugcgggaaaucaauaaccaccaucacgcccacgaugcguaucucaauggagucguggccaucgcucugcuuaagaaauacccgaagcuggagcccgaauuuguuuauggcaacuacacaaaauucaaucucgccaccgagaacaaggcuacagccaagaaagaguuuuacuccaauauucugagauucuuugaaaaggaggaauauucuuacgacgagaacggggaaaucuucugggauaaagcgcgccauauuccucaaaucaagaaagugauuagcucccaccaggucaauaucgugaagaagguggagguucagacgggaggcuuuuauaaagagaccgucaaccccaagggcaaaccugacaagcugauccagcggaaagccgggugggaugugucuaaguacggaggcuucgggagccccguggucgcuuaugccguggcuuuuauuuacgaaaagggaaaagccagaaagaaagccaaggcuaucgagggcauuacaaucaugaaacaaucccuuuucgaacaggacccgauuggguuucucagcaauaagggcuauucuaacguuaccaaguucaucaaacuguccaaguacacacuguacgagcucgaaaauggacgcagacggaugguggcgagccauaaagaggcccagaaggcuaacucuuucauucugccugagaaacuugucacccugcucuaucacgcccagcauuacgaugaaaucgcccacaaggaguccuuugacuaugugaaugaucaccugagcgaguuccgcgagauccuggaccaaguuauugauuuuucuaacagauacacgaucgcugccaagaacaccgagaaaauugcggaacuuuucgagcagaaucaggaaagcacagugcagucccugagccaaucuuuuaucaaccucaugcagcugaaugcuaugggcgcccccgccgacuucaaguuuuucgaugucauuaucccucggaaacgcuaucccucccucaccgagaucugggaaagcacaauuaucuaccaguccauuaccgggcugagagagacgcggacacgcauggcuacccuuugggacggagagcaauga

SEQ ID NO: 3862 - RNA, 3243 nt, Artificial Sequence
  Cas9 variant
augaagaccagcuucgccuuugacaucggcacaaacuccauuggguggugcgugcuggcucucgauaaugccaaccugcccuacagaauccuugacgcgggaguccggauuuucucugauggccgcgagccuaaaagcgggacgucccuggcugaaggaagacggcucgcccgcggcaugucuagacggcgcgacagauauaagcggcgcagaaaagccguuauccggacccugauugaguacgggcuuaugccggaugaccccgcugcccgcagagcucugguggccgaaacaaaugauaaggcgccuggaaaaaucgccagcgacguguaugcucuccgggcccgcgcucuggaugacaagcugccccuccaccauaucggcagagcccuguuucacauuaaccagcggagaggcuucaaguccaaucgcaaaaccgauaagcgggacaacgaucaagggaaaaucgcgucuggaauuagcagacuucgcgacaagcuggccuccgagggcaugcggacacucggggaauaccugaaucauagacaccaggcuggaaacuggguccgcgugcggccuagcagaguucccggcaaagacgauaaggaggaggacggguauggauuuuacccugaacgcgcccuucugcaggaugaguucaaugcuaucuggaccgcccaggccgcucauuauccggacgugcucacagaagaacggagaacccaccuggagacgauuaucuuuuuccaacgcccccugaagccuguccaggugggcaaauguucuuuuaaccccggcgaggagcggcucccuagagcgcacccccuguuccaggaauuucggcuuuacaaggagguuaaugaacuggagcucguggaucgcaaccaggaccaucacaaacugucccuugaucaaagagacgcccugauugcucagcucaagacccagcgggaggccgccuacagcgcucugagaaaaacagcccgcgcgccgcuggggacccgguucaauaaggaaacagagucuagaaccaaaaugaagggagaugaagucgcugccgagcucuccgccaagacgcgcuuuggccaggcuuggaucagcaugccucuggaagagagauggaucauuguggacacacuucggcgcguggaggauccccuggaacucaccgccuggcuggagcaacauuaugggcuugacggagaacacaucgacgcuauucuggccgcgagacucccugagggcuacgggcggcugggagaaacagcccugaccgagauccucgucgagcugaaagcugccguuauuucugaagcugaggccgcgcgcagagccggcuaugaucacgcccuucugcagcggggcgccgggcucgaagcucugcccaaguaccaggaggugaucgcccgcagaaucccucccggaaccggcaacccggacgaucccuaugacguggagaaagggcggauuacaaauccuacgguccauaucggacugaaccaacuucagaaggugcucaacgcccugauucgcagauacggcaaacccgaacagaucgcuauugagcuggcgcgggaacucaagcugaaugaugagcagaagagagaaaagaacaucgagaucgcccgcaauacccgggcugccgagcaaagauccgccaaacuuguugaacugggggugccugacacaggcuauaaccgcguccuccugaaacugugggaggaacuuaaucuccgggcucccgagaacagagugugcauuuacuguggagaaccgaucaauauugagacccuguucagcuccgccguugauaucgaccacauucugccuuggucuaagacacucgaugacagccaggcgaaccgccuggugugccaugucgcuuguaaucggcagaaagccaacuacgcccccgcugaggugccucaguggcaaggcagauaugaugacauccuugcccgcgcgaauacccugccccucaacaagcgguggagauucgggcgggaugcuaugaagaaauuugccgacgaagagacguuccuggcccgccagcugacagacacccaguaccuuuccagacucgcucacgccuauauggcugcccuguacccugaugaggaacccgacgcgcagggaguccuggcccggaagaaucaugugcgcguuauuaccggcagaaugacagaaaugcuccggagacaaugggggcugaacagccuucuggcugaucacaaucagaaaaaccgcaacgaccaccggcaucacgccaucgaugcugccguggucggagugaccacaagagcccuccugcagcgcaucgcuacgguugcgggcgggcgggaggcccaggcucuggaggaaaccauuggcaagaucgagccgccuuggcccggauuuagagacgaacuucaagccgugauuaaacgcaucgucgugucucauaagcccgaucacggcacacucccuaagccggggcagggaggccagaccgccgggcaacugcacaaugacacagcuuauggacugaccggcgagacggauucccgggggacccccauugugguuagacgcaaaccuuucacaagccucaccgagaaggaccugcccucuaucagagaucggcagcuugcccaggcgcugggcagcgcuaucgccggacgcuccggcaaagaacuccaggccgcucuggagcaauuuagagaccgggaugacuacaagucuauucgccaugucagagugguggaaccucugaacgucauccccauucgggacgggacaggcagagccuauaaagcguacaagggagaugcuaauuaccgcuaugacgugugggagcuuccuaacgggaaauggaugcacgaaguugugagcauguucgaugcccaugaccgguccuggaccagcgccguccacauccaucaccccgcugccagacgcgugcugucucucaagcagaaugauaugguugcuuacgaccacccgcaggauggaccuacgauuggccggguggucaaguuuucccagagcgggcaaaugacauucgcuccccauaaagaggcgggcgcccugaaggcuagagacgccgauccugaggaccgguuucgcuauuucuacaaaucuggauccgcuaugaaggauaucggccucagacaggugcggguugacgaaaucgggcgcguguuugaccccggaccgagagauaaagaggcccggaacgcccgcaagaagaaaagcaccgacuga

SEQ ID NO: 3863 - RNA, 3243 nt, Artificial Sequence
  Cas9 variant
auggccaagagcuucgcuuuugacaugggcaccaacuccaucgggugggccgugcugggacucgauucugcgggcgaccccgauagcauugagggggcuggagucagaaucuucuccgacggccgggaaccuaaaucuggggccagccuggccgagggacgcagaauugcucggggcaugucccgcagacgggaacgcuacaaggccagacggaaagcucuuauccgcacacugggcgauuaugggcucaugccgcuggagagagccgcgcggcgcgcccuuguugcugaaacgaaugacagaucuuuuggacugguggcccaggauguguacgcucuccgggcccgcgcgcuggucgagaagcugcccccuuaucaccucggcagagcccuguuccaucuuaaccaacggagaggguuuaaaagcaaucgcaagaccgacggacgggauaacgagcugggcaugauugcuacagggaucgccgcucucgacgcccagcugaauggaagaacccuuggccaguaccugcacgaaaugcgcggcgccgauccccggcagagagggcaagugcgcguucggccucaucucgagaucaacgacaagggaagagaaauugcugcguauggcuucuacccccagcgcgccaugcuggagcgggaguuuaaugcuaucugggccgcccaggcuccucaccauccggaacugcucuccgaggaaagacgcgcccaccuguuccaggugaucuuuuaucaacggccccuuaaacagccugaucccgggagaugcagcuucaacccugcggagccccggcuggcuaaggcccacccgcucuuucagcgcuucagacuggucaaagaaauuaaugagcuucggauugugacaggaucuaacucccagggcguuccucugacccucgagcaaagagacauccugcugacacuccugcgcgacaagaaagccagcucuuuuaagacccuucuggcuaagauuaucaaagggcagcccgaagcccgguucaauaaggcuuccgauagcagagacaaaaugaagggagaugagcucgccgcgacgaugucugacaaaacccgcuucggccaggccugguuugcuaugccugaagccgagcaauggagaaucauugcuaagcugcgggauaucgacgauccccuugaacugaacgccuggcucgaguccgaguacggccuggcgcccgaacgcagagacgccguggcuaaugcccugcucccucagggguacggacggcugggcgagacagcucuuagaaccaugcuggauuaucucgaagccgccgucauuagcgaggcugaagcggccgcucaggccggguacgaccaugcccuggcuagacggggagccggccuggaucagcuuccgaaauaucaagaggugcucgggcgcagaaucccucccggcuccggagagcccaacgacccuuacgacauucggaugggccgcaucucuaaucccacagugcacaucgcgcugaaccagcugagacgggucguuaacgcucucauuagaaaguaugggaagccggccgaaaucgccauugagcuggcucgcgaucuuaaacugagcgaagaacagaagcgggaggugaaugccaccaucgcgaaaaacacgagagacgcugaacgccgggccgugagacucgccgaugagggaauugacaauacaggccauaaccgcgcucugcugcgguucugggaggagcuugccgcugauccucucgacagagucuguguguacugcgggggaggcaucggggccgcgucccuguuuaauggcagcguugauaucgaccacauucugcccuggucucgcacccucgaugacucccgggccaacagaauccuggugcacaauagcuguaaccggcuuaagcgcaauuucgcuccuuuugaaguccccgaguggagagagauuuaucaggauauccuggugcgggccgcuaaacucccugccaacaagucuuggcgcuucgcccccgacgcuauggauagauuugaaggagagaaggacuuccuggcgcggcaacugacagacacccaguaccuugccagaauggcucaugaauaccucgccgcccuguauccggaugaggaaccugacgaguggggcguuuuugcucgcgggaaucacgugcgggucgugcccggaagacugaccgagaugcuccgccgggccuggggccugaacgcgauucuuagcgaugacaaucgcaaaaaccgcaaugaucaucggcaccaugcuaucgacgccgucgugguuggggugacaacgagagauaugcugaacaagauuucccaggccgcuggacgcggcgccgacaugggggcggcugaugcccucagacgguucgaucccccuuggccgucuuuucaccaggccguccgcgcugccguggaaagaauccugguuagccaccgggcugaccauggcacccugcccggaacagacggccaaggguccaccgccggacagcuucacaacgauacagcguacggccucaccggggagacgcgcaaaggacuggccguggucgugagacggaagccuuaucugagccucgaacccagagacaucgagacaauucgcgacccucagcugcgggaucaucuugcuaccgaaaccuacggccuggccggggcugaguucacagccgcccucaaaagacugcagcaaaccgacaaguuuuaugcuggcauccgccgggugagaguuacagaggcgcugucugucauucccauccgggaugccacgggacacgcuuacaaggccuauaaaggcgacgccaauuuccgcuacgaugugugggaacuuccuaacgggaagugggugcccgaggucauuuccauguucgacgcucacgauagaggaugggugagccagguucaugccgcgaauccggcugcccggcgcgugcugucucucagacagaacgacauggucgccuaccaacacccugaacagggccugguguaugggcggguugugaaauuuggacaguccggccagaugaccuucgcugcccaucacgagggcgggagccucaagucccgcgaugcggacagagaugaccccuuuaaauacuucuauaagucugccggaacaaugaaggacaucggccugcggcaaauccgcgucgaugagauugggagagugcaggacccuggaccccaggaucgggacagcaaaagaguucgcaaguccgaucgguga

SEQ ID NO: 3864 - RNA, 3246 nt, Artificial Sequence
  Cas9 variant
auggccgcuuucaagcccaacccuaucaauuacauucugggccucgacaucgggauugccagcgugggaugggcgauggucgagaucgaugaagacgagaacccgauuugccugaucgaucuuggcguuagaguguuugaacgggcugaggugcccaaaaccggggacucccuggccauggcccgcagacucgcucggucuguccgcagacugacacggcgcagagcccaccggcuucugcgcgcuagacggcuccugaagcgcgaaggagugcugcaggccgcggauuucgacgagaauggccucaucaaaagccugccuaacacgcccuggcaacuuagagccgcugcccuggaucggaagcucaccccucuggagugguccgcuguucuucugcaucucauuaaacaccgcggguaucugucucagagaaagaaugaaggagagacagccgacaaggaacugggcgcgcuccugaaaggcguggccgauaacgcucaugcccuucagaccggggacuuucggacacccgcuaagcuggcccucaauaaauucgagaaggagagcggacacaucagaaaccagcgcggcgauuacucccauaccuuuucucggaaagaccugcaagccgaacuuaaucuccuguucgagaagcagaaggaauuugggaacccucacauuagcgauggacugaaagagggcaucgaaacacugcucaugacccagagaccggcucuguccggggacgcgguccagaagaugcuuggacacuguacguucgagcccaccgagccuaaagccgcuaagaauacauauaccgccgaacgcuuuguguggcugacaaaacucaacaaucugcggauucuugagcaaggcagcgaacagccccugaccgacacgcagagagccaagcucauggaugagccuuaccgcaaaucuaagcugacauaugcucaggcccggaagcugcucggccuggaagacaccgcguucuuuaaagggcuuagauacggaaaggauaacgcugaggccuccacacugauggagaugaaagccuaucaugcuaucagccgcgcccucgaaaaggagggccugaaagacaagaagucuccccugaaucuuuccccggaacuccaagaugagauugggaccgcuuucagccuguuuaaaaccgacgaagauaucacaggacggcugaaggacagaguucagccugagauccucgaggcccugcuuaaacacauuucuuucgauaaguucgugcagaucucccugaaagcgcuccgccggauugucccccugauggaacaaggcaagagauacaacgaggccugcgcugaaaucuacggggaccauuauggaaagaaaaacacggaggagaagauuuaccugccucccauccccgccgaugaaauccggaauccuguggugcuucgcgcucucagccaggccagaaaagucauuaacggcguugugcggagauauggcuccccggcgcgcauccacauugagaccgcccgggaaguggggaagucuuuuaaagacagaaaggagaucgaaaagcgccaggaggagaauagaaaagaccgggaaaaggcugccgcuaaauuccaggaguacuuucccaacuucgucggagaaccuaagagcaaagauauucugaagcugcgccucuaugagcaacagcacggcaaaugucuguacuccgggaaggaaaucaaucuuggaagacugaacgagaagggcuauguggagaucgaccaugcccuccccuuuagccggacaugggaugacucuuucaauaacaaaguucuggugcugggguccgaaaaucagaacaagggcaaucagaccccuuacgaguacuuuaacggaaaagauaauagccgcgaauggcaagaguucaaggccagagucgaaacaucucgguuuccccgcagcaaaaagcagcggauucuucuccagaaguucgacgaggauggcuuuaaagagagaaaccugaaugacacccgcuaugugaacagauuccugugccaguuuguugcugaucggaugagacucacggggaagggcaaaaagcgcguguucgcguccaacggacaaaucacaaaucugcuucggggguucuggggacugagaaaaguccgcgccgaaaacgaccggcaccaugcucucgaugccguggucguggccuguucuaccguugcuaugcagcagaagauuaccagauuugugcgcuacaaggagaugaaugccuucgacggcaaaacaaucgauaaggaaaccggggagguccugcaccagaaaacacauuuuccgcaaccuugggaguucuuugcgcaggaagugaugauucggguuuucggcaagcccgacggaaaaccugaguuugaagaggcugacacgcccgaaaagcugagaacccuucucgccgagaagcugagcucccgcccugaggccgugcacgaauaugucacaccccuguucgugagccgggcuccgaacagaaaaaugucuggccaggggcacauggagaccgugaaguccgccaaacggcucgaugaaggaguuagcguccugcgcgugccucuuacacaacugaagcucaaagaccuggagaagauggugaauagagaacgggagcccaaacuguacgaggcgcuuaaggcucgccuggaagcccauaaggaugaccccgccaaggcuuuugccgagccuuucuauaaauacgauaaagcuggcaacagaacccagcaggucaaggccgugcggguugaacaggugcagaaaacgggggucugggugagaaaucacaacggaaucgcggacaaugccaccaugguucgcguggaugucuuugagaagggcgacaaguauuaccucgugccgauuuacucuuggcaaguugcuaaagggauccugcccgaucgggccguggucgcuuaugccgacgaagaggauuggacagugaucgacgaguccuucagauuuaaguucgugcucuacagcaacgaucugauuaaaguccagcuuaagaaagacuccuuccugggcuauuuuucuggacucgaccgcgccaccggcgcuaucagccugcgggaacaugaucuggagaaguccaaggggaaagacggaaugcacagaauuggcguuaagacagcgcuuucuuuccagaaauaccaaaucgaugaaauggggaaggagauucgcccuugccggcugaaaaagagacccccugugcgcuga

SEQ ID NO: 3865 - RNA, 3246 nt, Artificial Sequence
  Cas9 variant
auggccgcuuucaagcccaacccuaucaauuacauucugggccucgacaucgggauugccagcgugggaugggcgauggucgagaucgaugaagacgagaacccgauuugccugaucgaucuuggcguuagaguguuugaacgggcugaggugcccaaaaccggggacucccuggccgccgcucgcagacucgcccggucuguccgcagacugacacggcgcagagcucaccggcuucugcgcgccagacggcuccugaagcgcgaaggagugcugcaggcggccgauuucgacgagaauggccucaucaaaagccugccuaacacgcccuggcaacuuagauccgcugcccuggaucggaagcucaccccucuggaguggucugcuguucuucugcaucucauuaaacaccgcggguaucugagccagagaaagaaugaaggagagacagccgacaaggaacugggcgcgcuccugaaaggcguggccgauaacgcucaugcccuucagaccggggacuuucggacacccgcugagcuggcccucaauaaguucgagaaagaauccggacacaucagaaaccgccggggcgauuacucucauaccuuuagcagaaaggaccugcaggccgagcuugaucuccuguucgaaaaacaaaaggaguuugggaauccucacauuuccgacgaccugaaggaaggaaucgagacacugcucaugacccagcgcccggcucugagcggcgaugcgguccagaaaaugcuugggcacuguacguucgagcccaccgaaccuaaggccgcuaaaaacacauauaccgccgagcgguuuguguggcugacaaagcucaauaaccugcgcauucuugaacagggaucugagagaccccugaccgacacggaacgggccacacucauggaugagccuuacagaaaauccaagcugaccuaugcucaagcccgcaaacugcucgagcuggacgauacagcguucuuuaagggccuucgguacggcaaggacaaugcugaagccagcacccugauggagaugaaagccuaucaugcuaucucuagagcccucgaaaaggaggggcugaaagauaagaaaagcccccugaaccuuagcccggaacuccaggacgagauuggaaccgcuuucucucuguuuaagacagaugaggacaucacgggccgccugaaggaucggguucagccugaaauccucgaggugcugcuuaaacacauuuccuucgacaaguucguccagaucagccugaaagcccucagacggauugugccccugauggaacaagggaagcgcuacgacgaggcgugcgccgagaucuacggagaucaugacggcaaaaagaauaccgaagagaagauuuaucugccucccauccccgcugaugaaaucagaaacccugugguccuucgggcccucucccaggcuagaaaaguuauuaacgccguggugcgccgguacgggucuccggcgagaauccacauugagacagcccgcgaagucggaaagagcuuuaaagacagaaaggagaucgagaaacggcaggaagagaaucgcaaggauagagaaaaggcugccgcuaaauuccgggaguauuuucccaacuucgugggcgaaccuaaguccaaagacauucugaagcugcgccucuacgagcaacagcacggcaaaugucuguauagcgggaaggagaucaaucuuggaagacugaacgaaaaaggcuacguugagaucgaucaugcccuccccuuuucucggaccugggacgauuccuucaauaacaaggugcugguccuggggagcgaaaaucagaacaagggaaaucagacaccuuaugaguacuuuaacggcaaagacaauucucgcgaauggcaagaguucaaggccagaguggagaccagccgguuuccccgcuccaaaaagcagcggauucuucuccagaaauucgaugaagagggguuuaaggaaagaaaccugaaugacacgagauacguuaaccgcuuccugugccaguuuguggcugaucacaugcuccugacaggcaagggaaaacggagagucuucgcgucuaauggccaaaucaccaaccuucugcgcggguucuggggacuccggaaggugagagccgagaacaaucgccaucacgcucuggacgccgucgugguugccuguagcaccguggcuaugcagcagaaaauuacacgguuugucagauauaaggagaugaacgccuucgacggcaaaaccaucgauaaggaaacaggggaggugcugcaucagaagacgcacuuuccgcaaccuugggaguucuuugcgcaggaaguuaugauucgcguguucggaaaacccgacggcaagccugaauuugaggaggcugauacccccgaaaaacuucggacacuccuggccgagaagcuguccagcagaccugaagccguccacgaguacgugacaccccucuucgugucucgggcuccgaaucgcaaaauguccgggcagggccauauggaaaccguuaagagcgccaagagacuggacgagggagucucugugcuucgggugccucugacccagcucaaacugaaggaucuggagaaaauggucaaccgcgaaagagagcccaaacuuuaugaagcgcugaaagcucggcucgaggcccacaaggacgaucccgccaaggcuuuugccgaaccuuucuacaaguaugacaaggcuggcaauagaacgcaacaggugaaagccguucgcguggagcagguccaaaagaccgggguguggguucggaaccauaauggaaucgcggauaacgccacaauggugagagucgacguguuugagaaagcuggcaaguacuaucugguuccgauuuacuccuggcaaguggccaaagggauccuccccgaucgcgcugucguggccuacgccgacgaagagggauggaccgugaucgaugaauccuuccgguuuaaguucguccuguauuccaaugaccuuauuaagguucagcugaaaaaggacucuuuccucggcuacuuuagcgggcuggauagagcuacaggcgcgaucucccugcgcgagcacgaccuugagaaaucuaagggaaaagauggcaugcaccggauuggggugaagaccgcccugagcuuccagaaguaucagaucgacgaaaugggaaaagagauuagacucugccgccugaagaaaagaccucccgugcgguga

SEQ ID NO: 3866 - RNA, 3246 nt, Artificial Sequence
  Cas9 variant
augaccgccuucaagcccaacccuaucaauuacauucugggccucgacaucgggauugcuagcgugggaugggccauggucgagaucgaugaagaggaaaacccgauuagacugaucgaccuuggcguucggguguuugagcgcgcggaagugcccaaaacaggggauucccuggcugccgccagacggcucgcucgcucugucagacggcugacgcgcagacgggcccaccgccuucugagagcucggcgccuccugaagagagagggagugcugcaggccgcggacuucgaugagaauggccucaucaaaagccugccuaacacccccuggcaacuucgggccgcugcccuggaccgcaagcucacaccucuggaaugguccgcuguucuucugcaucucauuaaacacagaggguaucugucucagcggaagaaugagggagaaaccgccgauaaggagcugggcgcgcuccugaaaggcguggccgacaacgcucaugcccuucagacaggggauuuuagaacccccgcugagcuggccgucaauaaguucgaaaaagagagcggacacauccgcaaccagcggggcgacuacucccauacauuuucuagaaaggaucuccaagccgaacuggugcuucuguucgagaaacagaaggaauuugggaauccucacauuagcgacggacucaaggagggcaucgagacccugcugauggcucagcgcccggcgcucuccggggaugccguucagaaaaugcugggauauugcacguucgaacccaccgagccuaaggcugccaaaaacacauacaccgccgaacgguuuauuuggcuuacaaagcugaauaaccucagaauccuggagcaaggcagcgaacgcccccuuaccgacacggagcgggcuacacugauugacaugccuuauaaaaauaagcucaccuacgccaaagcgagagagcugcugggccucgaugacacagcuuucuuuaaggggcugcgcuauggaaaggauaacgccgaaucugccacccuuauggagaugaaggcuuaccacgccauccggagagcucuggaaaaagagggccucaaagacaagaaaagcccccugucccugucuccggaacuucaggaugagaucgggaccgccuucucccucuuuaagacagacgaggauauuacgggacgccugaagggcugucugcagccugaaauccucgacgcgcugcuuaaacauauuaauuucgauaaguucgugcagaucagccugaaagcccuccggagaauugucccccugauggagcaagggaagcgguacgacgaggcuugcgccgaaaccuauggagaucacuacggcgagaaaaacucugaagagaugcuguaucuuccucccauccccgcugacgaaauccgcaacccuguggugcucagagcccugucccaggcgcggaaggucauuaauggcguugugagacgcuacgggagcccggcccggauccauauugagacagcuagagaagugggaaaguccuuuaaagaccgcaaggagaucgagaaaagacaggaagagaaccggaaggaucgcgaaaaagccgcugccaaguucagagaguauuuucccaauuucgucggcgaaccuaagucuaaagacauucugaagcuccggcuguacgagcaacagcacgggaaaugucuuuauagcggaaaggccaucgauauccgcagacugaacggcaaaggguacguggagauugaccacgcucuccccuuuucccggaccugggaugacagcuucaauaacaagguucuggugcugggcucugaaaaucagaacaaaggaaaucgcacaccuuacgaguaucuuaacggcaaggauaauuccagagaauggcucgaguuuaaggcgcgggucgaaaccagccgcuucccccauucuaaaaagcagagagugcugcugcaaaaauuugacgagaagggguucaaagagcggaaccucaaugauacgagauacguuaaccgcuuucugugccaguucguggccgaccacaugcagcuuacaggaaagggcaagcggagagucuuugcuagcaaugggcagaucaccaaccugcuccgcggauucuggggccugcauaaagugcgggccgaaaacgauagacaccaugcccuggacgcugucgugguugccuguuccaccguggcgaugcaacagaagauuacaugcuucguccgcuauaaagagaugaaugcuuuugaugggaagaccguggacaaagaaacaggcgagguucuucaccagaagacgcacuucccgcagccuugggaguuuuucgcccaagaagugaugauccgggucuuuggaaagcccgacggcaaaccugaguucgaagaggccgauacccccgaaaagcucagagcucugcuggccgagaaacucucuagccgcccugaggcggugcaugaauacgugacaccccuguuuguuucccgggcuccgaacagaaagaugagcggggcccacaaagacacccuucggucugccaagcgcuucgucaagcauaaugagaaaauuuccgugaagagaguguggcugacagaaaucaaacucgcugaucuggagaacauggucaauuauaagaacggacgggaaauugagcuguacgaggcccuuaaagcucgccugggcgccuaugggggaaaugcgaagcaggccuuugacccuaaagauaaccccuucuacaagaagggcgggcagcucgugaaagcuguuagaguggaaaagacccaggagagcggcguccugcucaauaaaaagaacgccuacacgaucgcugacaauggagauauggugcggguugacguguuuuguaaagucgauaagaagggcaaaaaccaauauuucaucgugcccauuuacgccuggcagguugccgaaaauauccugccugacauugauugcaagggguauagaaucgacgauucuuacaccuuuuguuucucccuucacaaauaugaccugauugcuuuccagaaggacgagaaaagcaagguggaauuugcguacuauaucaacugcgauuccucuaauggacgcuucuaccucgccuggcacgacaagggcagcaaagagcaacaguuucggaucuccacacagaaccugguccugaugcagaaguaccaaauugaugagcuugggaaagaaaucagaccgugucgccugaagaaacggcccccugugagauga

SEQ ID NO: 3867 - RNA, 3246 nt, Artificial Sequence
  Cas9 variant
auggccgcuuucaagcccaacccuaucaauuacauucugggccucgacaucgggauugccagcgugggaugggcgauggucgagaucgaugaagacgagaacccgauuugccugaucgaucuuggcguuagaguguuugaacgggcugaggugcccaaaaccggggacucccuggccgccgcucgcagacucgcccggucuguccgcagacugacacggcgcagagcucaccggcuucugcgcgccagacggcuccugaagcgcgaaggagugcugcaggcggccgauuucgacgagaauggccucaucaaaagccugccuaacacgcccuggcaacuuagauccgcugcccuggaucggaagcucaccccucuggaguggucugcuguucuucugcaucucauuaaacaccgcggguaucugagccagagaaagaaugaaggagagacagccgacaaggaacugggcgcgcuccugaaaggcguggccaacaaugcucaugcccuucagaccggggauuuucggacacccgcugagcuggcccucaacaaguucgagaaagaauccggacacaucagaaaucagcgcggcgacuacucucauaccuuuagccggaaggaucugcaagccgagcuuauucuccuguucgaaaaacagaaggaguuugggaacccucacgucuccggaggccugaaggaagggaucgagacacugcucaugacccagagaccggcucugagcggagacgcggugcagaaaaugcuuggccacuguacguucgagcccgccgaaccuaaggcugccaaaaauaccuauacagccgagcgcuuuauuuggcugaccaagcucaacaaucugcggauccuugaacaaggcucugagagaccccugacagauaccgaacgcgcuacgcucauggacgagccuuaccggaaauccaagcugacauaugcccaggcgagaaaacugcucgggcuggaggacaccgcuuucuuuaagggacuucgcuacggcaaggauaacgccgaagccagcacacugauggagaugaaggcuuaucaugccauuucucgggcucucgaaaaggaggggcugaaagacaagaaaagcccccugaaucuuuccccggaacuccaggaugagaucggaaccgccuucucucuguuuaagaccgacgaggauaucacaggcagacugaaggaccgcauucagccugaaauccucgaggcgcugcuuaaacacauuuccuucgauaaguucguucaaaucagccugaaagcccuccggagaauugugccccugauggaacaggggaagcgguacgacgaggcuugcgccgagaucuacggagaucauuauggcaaaaagaacacggaagagaagaucuaccugccucccauucccgcugacgaaauccgcaacccugucgugcuuagagcccucucccaggcgcggaaagugauuaauggcgucguuagacgcuaugggucuccggcccggauccacauugagaccgcuagagaagugggaaagagcuuuaaagaucgcaaggagaucgagaaaagacaagaagagaaccggaaggaccgcgaaaaggccgcugccaaauucagagaguacuuucccaauuucgugggcgaaccuaaguccaaagacauccugaagcugcggcucuaugagcagcagcacgggaaaugucuguacagcggaaaggagauuaaccuuggccgccugaaugaaaaaggguaugucgagaucgaucaugcccuccccuuuucuagaacaugggacgauuccuucaacaauaaggugcugguucugggcagcgaaaaccagaauaagggaaaccaaaccccuuacgaguacuuuaauggcaaagacaacucucgggaauggcaggaguucaaggcucgcguggagacaagcagauuuccccgguccaaaaagcagcgcauucuucuccagaaauucgaugaagacggguuuaaggagagaaaucugaacgauacccgguaugucaauagauuccugugccaauuuguggcggaccgcaugcggcucacgggaaagggcaaaaagagaguuuucgccucuaacgggcagaucacaaaccugcuucgcggauucuggggccugcggaaagugagagcugaaaaugaucgccaccaugcccucgacgccgucguggucgcuuguagcaccguggccaugcagcagaagauuacccgguuuguuagauacaaagagaugaacgcguucgaugggaagacaaucgacaaggagaccggcgaagugcugcaccagaaaacacauuuuccgcagccuugggaguucuuugcucaggaagucaugauucgcguguucggaaagcccgauggcaaaccugaguuugaagaggccgacacgcccgagaagcugcggacccuucucgccgaaaaacuguccagcagaccugaggcuguucacgaauaugugacaccccuguucgucucucgggccccgaaucgcaagauguccgggcagggacacauggagaccgugaaaagcgcgaaaagacucgacgaaggcgugucuguucugcgggucccucuuacacaacugaagcucaaagaucuggagaagauggugaaccgcgagagagaacccaaacuguacgaggcucuuaaggcccggcuggaagcccauaaagacgaucccgcuaaggccuuugcugagccuuucuauaaguacgacaaagccgggaauagaacccaacaggugaaggcgguccgcguggaacaaguucagaaaacgggaguguggguccggaaccacaauggcaucgccgauaacgcuaccauggugagaguugacguguuugagaaggccgggaaauauuaccucgucccgaucuacuccuggcaaguggcuaagggcauucugcccgaucgcgccguuguggccuaugcugacgaggaaggauggacagucaucgaugagagcuuccgguuuaaguucgugcucuacuccaaugaccugauuaaagugcagcuuaagaaagauucuuuccugggcuauuuuagcgggcucgacagagcgaccggagccaucucccugcgcgaacaugaucuggagaagucuaaaggcaaggacgggaugcaccggauuggagucaagacagcucuuagcuuccagaaauaccagaucgacgagaugggcaaggaaaucagacugugccgccucaaaaagagaccucccguucgguga

SEQ ID NO: 3868 - RNA, 3246 nt, Artificial Sequence
  Cas9 variant
augcugaagagagugcucggcaucgacgucgggauuagcuccaucggaugggcccugcuugaguuccagggcgauauugacaacaaagaucugcccucugggaagauccucgcuagcggaguuagaguguuuacccaagccgaaaauccuaaaaacggcgagucccuggcgaagccgcgcagagacgcucggcuugcccgcagacggacacgcagacgggcccagcgccugacggauauuaaagaccucuucuuuaaguacaagcuggugaccgggaucucuagaaauaaaaucaacagcauuuauaagacagaagagaauaaaaaggaucccuggacccugcggaaagaagcucucuaccgcaagcuggacggagaggaguucgccagaguccuuacacacaucgcuaagcaucggggcuuuaaauccaugcgcaagucugaagaggaaggcagcgauaccaaagccaaggagacacagagagugcugaccgagauugggaaaaacaaggacacgcucaaaaccggaaucuggcagacagcgggcgaaaugauugccucccggccuaagggggaugcuagacgcaauaagaccgacagcuauaaaaacucuaucucccgggagcugcuucaagaugaaacaaagauuaucuucgagaaacagagaggaaugaauagccaguuuaccucugccgaccuggaaaaggaguacuccgacaucgcuuuccaccaggcccccauucaaagcaugcucaaaaugguuggcgggugcacguuugagaaggaugaagagggaaagcgccugaaacgggcgccuaagaacucuuauuccgccgaaguguucacagcucugaccaaaaucaauaaccucguccugaagacaaaaaccgccaauauuaacgacagauuucuuaccacagaggaacgcaagaaggcucuggagcucugucauagcaaugccaaagugacguucaagcagcugcggggcgagcuuggccugcccgaagauuggaucuuuaacaccguugacuacgccaaaaagccuaaaaagacagcugugaaggagaccgaaccggaguccgcgugcuucuuccagaugagaggguauaacgaaauucgcaaaucugucggaaaggaucucuggacagagaucagcaugaaaaaggagauccucaauuccauugugaccacgcuggccacagagaaaagcgacgaagcuaucaaggcccagcugaaaaagucugaagugcccgaugagauugccgagaagguccugggccuuaacuuucggggguuccugcaccucuccaucaaagcucuggacaagauuaucccuuuuaugauggccggagauaaauacaccgacgcgugugauaaggcuggcuacaaagaacaaaucagcgggauuaagaagaucuuccuuagaaaacugaaugacgaggaaaacgagcagauuaccaaucccguugccaagcgcgccaucacacaguuucggaaagugauuaacgcuaucauuagagaauauggaaaguucgaccaaaugaauaucgagcucgcccgggaucuggcuaaaucuuacgacgaucgcaagaagaucaaagagggccaggaagacuuuagagccgagaaggaucgggcggcccagagaugcaaagacaacggccuggauccuaauagcaaggacaaccucuccaaauaucgccugugggaacagcaagauaauggguucuguauuuacugcggaaagcccaucgagcuucagcggcuggcugaacagggcuauugugagguggaccauauucucccguacucuagaagccuggaugacucccagcacaacaagguccuggcccacauccaugauaaucaacagaaaaagaaccagauuccuuuugagcacuucgggggagacggccccaaaugggaagaguuuguggggcgccuuaauagccaguucaagaaccucccuaaaucuaagcugaacagacugguuaaacggaaguuugacgaaaaggauauggagggcuucaaagaacgcaauaucaacgacaccagauauaucucccgguucauuaagaauuuuguggagaaccaucucgaguucgcugaaagcgcccaaaaacagaaggucuuugugcgcucuggaucccugacagcguuccuuagacaccaguggggccugaucaaaaagcgggaugagagcgaccgccaccaugcccucgaugcucugguuacggccugcgcuacccaggccauggugaaguccacagccauuaccgcucagaaaauggaaucuuacaauuggaucaacaaggagaaacccagaaugccccugccuuggcuuaauuuucgggacgauguccaaaagagccucgacgcgguguucgucucccgcgccccgagacacaaaguugggggagcugcccauaaggagacaauucggucuaucagaaaguguggcgaagagaaccugaucauugagaaaacgccccugguggauaucgccaccaagagcgggauuaaacucaaggacaucgaaaaacuguacaagaaggaacagaaucgcaaacuuuaugagacccugaaggagcggcucgaacaaaacggaaaugauccugugaaggcuuuuggcaaccccgacgauccugucagaaugcccacaaaugaccugaccaagacagggccgauuaucaaauccaucaagcugauuaccaacaagaaaagcggccuuaaugugcgcgccggaaucgcggacaacggcgagauugcucggcucgauguuuacgaaagaaaggggaaauucuaucugaucccuaacuacguggccgacuuugccaauaaggagcugcccaaaaaggcuauuaaagccaacacgccugaaacagaguggcccaucauugaucgcaauuauaacuucaaguuuucucucuucaaggacgaucugaucuccaucaaacagaaacuugacagcccugaggaauuuuacuauuacaaaggacccgaugucucuaccgcguccauuacaguggagagcguggaccggaagagacugugggaagagaaaaagaagggcaaaaucgaaaauguuuuccacacccgcauugggaccaagacacucaaaucuuuccggaaguuuaaccuggauauccugggaacgaaagcuccggucgagauuaagaaggagaccugggugggcgugauccggaaaaauggggucgccaacaauacaggcaacaaggccauguga

SEQ ID NO: 3869 - RNA, 3249 nt, Artificial Sequence
  Cas9 variant
auggccgcuuucaagcccaacccuaugaauuacauccugggccucgacauugggaucgccagcgugggaugggcgauggucgagauugauaaagaagagaacccgaucagacugauugaccuuggcguucggguguuugaacgcgcugaggugcccaagaccggggauucccuggccauggccagacggcucgcucgcucugucagacggcugacacgcagacgggcccaccgccuucugagagcucggcgccuccugaaaagagaaggagugcugcaggacgccgauuucgacgagaauggccucguuaagagccugccuaacacgcccuggcaacuucgggcggccgcucuggaucgcaaacuuaccugccuggagugguccgccgugcuucugcaucucaucaagcacagaggguaucugucucagcggaagaaugaaggagagacagcugacaaagaacugggcgcccuccugaagggcgucgcggauaacgcccaugcucuccagaccggggacuuuagaaccccugccgagcuggcucucaauaaauucgagaaggaaagcggacacauccgcaaccagcggggcgauuacucccauacauuuucuagaaaagaccugcaagccgagcuuaaucugcuuuucgaaaagcagaaggaguuuagcaacccccacguguccgauagccugaaagaagggauugagacacugcucauggcccagcgcccugcucugucuggagacgcgguucagaagaugcuuggccacuguaccuucgagccggccgaacccaaagcugccaagaauacguauaccgccgagcgguuuaucuggcugacaaaacucaacaaucugcgcauucuugaacaaggguccgagagaccucugaccgacacagaacgggcuacccucauggaugagcccuacagaaagagcaaacugacguaugcccaggcgcgcaagcugcucggacuggaggacacagcuuucuuuaagggccuucgguacggcaaagauaacgccgaagccccuacccugauggagaugaaggcuuaucaugccaucucuagagcucucgaaaaagaggggcugaaggacaaaaagagcccccugaaucuuuccacagaacuccaggaugagauuggaaccgccuucucucuguuuaagaccgacaaagauaucacaggccgccugaaggaccgggugcagccggagauucucgaagcgcugcuuaaacacaucuccuucgauaaguucguccaaaucagccugaaagcccucagacggauugugccucugauggagcaggggaagcgcuacgacgaggcuugcgccgagaucuacggagaucauuauuguaagaaaaacgcugaggaaaagauuuaccugcccccuauccccgccgacgagauuagaaaccccgugguccuucgggcgcucucccaggccagaaaaguuaucaauugcguggugcgccgguauggcucuccugcuagaauccacauugaaacggcccgcgaggucggaaagagcuuuaaagacagaaaggaaaucgagaagcggcaagaggaaaaccgcaaagauagagagaaggcugccgccaaauuccgggaauacuuuccgaauuucgugggggagcccaaguccaaagacauucugaagcugcgccucuaugaacagcagcacggcaaaugucuguacagcggcaaggagaucaaccuuguuagacugaaugagaagggguauguggaaauugaucaugcucucccuuuuucucggaccugggacgauuccuucaacaauaaaguccuggugcugggaagcgagaaccagaauaagggcaaccaaacacccuacgaauacuuuaaugggaaagacaacucucgcgaguggcaggaguucaaggcgagaguugaaaccagccgguuuccucgcuccaaaaagcagagaauccuucuccagaaguucgaugaggaaggauuuaaagagcggaaucugaacgacacaagauaugugaaucgcuuccugugccaauuugucgccgaucacauccuccugaccggcaaggggaaacggagaguguucgcuucuaacggccagauuacgaaccuucugcgcggauucuggggccuccggaaggucagagccgaaaaugaccgccaucacgcccuggaugcugugguuguggccuguagcacagucgcgaugcagcagaaaaucacccgguuugugagauacaaggagaugaacgcuuucgacgggaagaccauugauaaagagacaggagaaguucugcaucaaaaggcccacuuuccccagccgugggaguucuuugcccaggaagugaugauccgcgucuucggcaaaccugacgggaagcccgaguuugaagaggcugacaccccugagaaacuucggacacuccuggccgaaaagcuguccagcagacccgaggcggugcacgaauaugugacgccucucuucguuucucgggcucccaaucgcaagauguccggacagggccauauggagaccgucaaaagcgccaagagacuggaugaagggauuucugugcuucgggugccgcugacacaacucaaacugaagggccuggagaaaauggucaaccgcgagagagaaccuaagcucuacgacgcccugaaagcucagcucgagacccacaaggauaaucccgccaaggcuuuugccgaacccuucuauaaauacgacaaggcgggaaaccggacacagcaagugaaagccguuagaaucgaacaggugcagaagaccggcgucugggugcgcaaucauaacgggauugcugauaaugccacgaugguucggguggacgucuuugaaaaaggaggcaaguauuaccuggugccuaucuacuccuggcagguugcuaaggggauccucccggauagagccguggucgccuucaaagacgaggaggauuggaccgugauggacgauagcuuugaguuccgcuucgugcuguaugcuaacgaccuuauuaagcugacagcgaaaaagaaugaauuucucggauacuucgucucccugaaccgggccaccggcgcuaucgauauuagaacacacgacaccgacucuacgaaagggaagaauggcaucuuucaaagcguuggagugaagacagcccuguccuuccagaaaaaccagauugaugaacuuggcaaggagauccgccccugccggcugaaaaagagaccucccgugcgcuga

SEQ ID NO: 3870 - RNA, 3249 nt, Artificial Sequence
  Cas9 variant
auggccgcuuucaagcccaacccuaucaauuacauucugggccucgacaucgggauugccagcgugggaugggcgauggucgagaucgaugaagaggaaaacccgauuagacugaucgaccuuggcguucggguguuugagcgcgcugaagugcccaaaaccggggauucccuggccauggccagacggcucgcucgcucugucagacggcugacacgcagacgggcccaccgccuucugagagcucggcgccuccugaagagagagggagugcugcaggccgcggacuucgaugagaauggccucaucaaaagccugccuaacacgcccuggcaacuucgggccgcugcccuggaccgcaagcucaccccucuggaaugguccgcuguucuucugcaucucauuaaacacagaggguaucugucucagcggaagaaugagggagaaacagccgauaaggagcugggcgcgcuccugaaaggcguggccaacaaugcucaugcccuucagaccggggacuuuagaacacccgcugagcuggcccucaacaaguucgaaaaagagagcggacacauccgcaaucagcggggcgauuacucccauaccuuuucuagaaaggaccugcaagccgaacuuauucuccuguucgagaaacagaaggaauuugggaacccucacgucagcggaggccugaaggaggggaucgagacacugcucaugacccagcgcccggcucuguccggagaugcggugcagaaaaugcuuggccacugcacguucgaacccgccgagccuaaggcugccaaaaauaccuauacagccgaacgguuuauuuggcugaccaagcucaacaaucugagaauccuugagcaaggcagcgaacgcccccugacagacaccgagcgggcuacgcucauggaugagccuuacagaaaaucuaagcugacauaugcccaggcgcgcaaacugcucgggcuggaagacaccgcuuucuuuaagggacuucgguacggcaaggacaacgccgaggccuccacacugauggaaaugaaggcuuaucaugccauuagcagagcucucgagaaggaagggcugaaagauaagaaaucuccccugaaucuuuccagcgagcuccaggacgagaucggaaccgccuucucucuguuuaagaccgaugaagacaucacaggccgccugaaggaucggguucagccggagauucucgaagcgcugcuuaaacacaucuccuucgacaaguucgugcaaauuagccugaaagcccucagacggaucgucccucugauggagcaggggaagcgcuacgaugaggcuugugccgaaauuuacggagaccauuauggcaaaaagaacacggaggaaaagaucuaccugcccccuauccccgcugaugagauuagaaaccccguggugcuucgggcccucucccaggcgagaaaagucaucaauggcguugugcgccgguaugggucuccugcccgcauucacaucgaaaccgcuagagaggugggaaagagcuuuaaagacagaaaggagauugaaaaacggcaagaggaaaaccgcaaggauagagagaaggccgcugccaaauuccgggaauacuuuccgaauuucgucggcgagcccaaguccaaagacauccugaagcugcgccucuaugagcagcagcacgggaaaugccuguacagcggaaaggaaaucaaccuugugagacugaaugagaaaggcuauguugaaauugaccaugcccucccuuuuucucggacaugggaugacuccuucaacaauaaggugcugguccuggggagcgagaaccagaauaagggcaaccaaacccccuacgaauacuuuaauggaaaagauaacucucgcgaguggcaggaguucaaggcuagaguggaaacaagccgguuuccucgcuccaaaaagcagagaauccuucuccagaaauucgacgaggauggcuuuaaggaauguaaucugaacgacacccgguauguuaauagauuccugugccaauuuguggcggaucacauucuccugacggggaagggaaaacgccgggucuucgccucuaacggccagaucacaaaccuucugagaggguucuggggacuccgcaaggugcgggcugagaaugacagacaucacgcccuggaugccgucgugguugcuuguagcaccguggccaugcagcagaaaauuacccgcuuuguccgguacaaggagaugaacgcguucgacggcaaaacaaucgauaaggaaaccgggaaggugcugcaucagaaaacacacuuuccccagccgugggaguucuuugcucaggaaguuaugauuagaguguucggcaagccugacggaaaacccgaguuugaagaggccgauacgccugagaaacuucgcacccuccuggccgaaaaacuguccagccggcccgaggcuguccacgaauaugugacaccucucuucgugucuagagcccccaaucggaagauguccggccaggggcauauggagaccguuaagagcgcgaaacgccuggacgaaggagucucugugcuuagagugccgcugacacaacucaagcugaaagaccuggagaagauggucaaccgggagcgcgaaccuaaacuuuacgaggcucugaaggccagacucgaagcccacaaagaugaccccgcuaaggccuuugcugagcccuucuauaaguacgauaaagccggcaaucggacccaacaggugaaggcgguuagaguggaacaaguccagaaaacggggguguggguucgcaaccauaauggaaucgccgacaacgcuaccauggugcgggucgauguguuugagaagggcgacaaauauuaccugguuccuaucuacuccuggcaaguggccaaggggauucucccggauagagcugucgugcagggcaaggacgaggaagauuggcagcugaucgacgauagcuucaauuuuaaauucucccuucaccccaacgaccugguggaggucauuacaaagaaagcccgcauguucggauauuuugccucuugccaccggggcaccgggaauaucaacauuagaauccaugaucucgaccacaagaucggaaagaauggcauucuggaagggaucggaguuaaaacagcucugagcuuccagaaguaccagauugacgagcuuggcaaagagauccgcccuugucggcugaagaaaagacccccugugcgcuga

SEQ ID NO: 3871 - RNA, 3249 nt, Artificial Sequence
  Cas9 variant
auggccgcuuucaagcccaacccuaucaauuacauucugggccucgacaucgggauugccagcgugggaugggcgauggucgagaucgaugaagacgagaacccgauuugccugaucgaucuuggcguuagaguguuugaacgggcugaggugcccaaaaccggggacucccuggccauggcccgcagacucgcucggucuguccgcagacugacacggcgcagagcccaccggcuucugcgcgcuagacggcuccugaagcgcgaaggagugcugcaggccgcggauuucgacgagaauggccucaucaaaagccugccuaacacgcccuggcaacuuagagccgcugcccuggaucggaagcucaccccucuggagugguccgcuguucuucugcaucucauuaaacaccgcggguaucugucucagagaaagaaugaaggagagacagccgacaaggaacugggcgcgcuccugaaaggcguggccgauaacgcucaugcccuucagaccggggacuuucggacacccgcugagcuggcccucaauaaguucgagaaagaaagcggacacaucagaaaccagcgcggcgauuacucccauaccuuuucucggaaggaccugcaagccgagcuuauucuccuguucgaaaaacagaaggaguuugggaauccucacgucagcggaggccugaaggaagggaucgagacacugcucaugacccagagaccggcucuguccggagaugcggugcagaaaaugcuuggccacuguacguucgagcccgccgaaccuaaggcugccaaaaacaccuauacagccgagcgcuuuauuuggcugaccaagcucaauaaccugcggauccuugaacaaggcagcgagagaccccugacagacaccgaacgcgcuacgcucauggacgagccuuaccggaaaucuaagcugacauaugcccaggcgagaaaacugcucgggcuggaggauaccgcuuucuuuaagggacuucgcuacggcaaggacaaugccgaagccuccacacugauggagaugaaggcuuaucaugccauuagccgggcucucgaaaaagaggggcugaaagauaagaaaucuccccugaaccuuuccccggaacuccaggacgagaucggaaccgccuucagccuguuuaagaccgaugaggacaucacaggcagacugaaggaucgcauucagccugaaauccucgaggcgcugcuuaaacacauuucuuucgacaaguucguucaaaucucccugaaagcccuccggagaauugugccccugauggaacaggggaagcgguacgaugaggcuugcgccgagaucuacggagaccauuauggcaaaaagaauacggaagagaagaucuaccugccucccauucccgcugaugaaauccgcaacccugucgugcuuagagcccucagccaggcgcggaaagugauuaacggcgucguuagacgcuauggguccccggcccggauccacauugagaccgcuagagaagugggaaagucuuuuaaagaccgcaaggagaucgagaaaagacaagaagagaaucggaaggaccgcgaaaaggccgcugccaaauucagagaguacuuucccaacuucgugggcgaaccuaagagcaaagauauccugaagcugcggcucuaugagcagcagcacgggaaaugucuguacuccggaaaggagauuaaucuuggccgccugaacgaaaaaggguaugucgagaucgaccaugcccuccccuuuagcagaacaugggaugacucuuucaauaacaaggugcugguucugggcuccgaaaaucagaacaagggaaaucaaaccccuuacgaguacuuuaacggcaaagauaauagccgggaauggcaggaguucaaggcucgcguggagacaucuagauuuccccggagcaaaaagcagcgcauucuucuccagaaauucgacgaagauggguuuaaggagagaaaccugaaugacacccgguaugucaacagauuccugugccaauuuguggcggaucgcaugcggcucacgggaaagggcaaaaagagaguuuucgccuccaaugggcagaucacaaaccugcuucgcggauucuggggccugcggaaagugagagcugaaaacgaccgccaccaugcccucgaugccgucguggucgcuuguucuaccguggccaugcagcagaagauuacccgguuuguuagauacaaagagaugaaugcguucgacgggaagacaaucgauaaggagaccggcgaagugcugcaccagaaaacacauuuuccgcagccuugggaguucuuugcucaggaagucaugauucgcguguucggaaagcccgacggcaaaccugaguuugaagaggccgacacgcccgagaagcugcggacccuucucgccgaaaaacugagcuccagaccugaggcuguucacgaauaugugacaccccuguucgucagccgggccccgaaccgcaagaugucugggcagggacacauggagaccgugaaguccgcgaaaagacucgaugaaggcgugagcguucugcgggucccucuuacacaacugaagcucaaagaccuggagaagauggugaaucgcgagagagaacccaaacuguacgaggcucuuaaggcccggcuggaagcccauaaagaugaccccgcuaaggccuuugcugagccuuucuauaaguacgauaaagccgggaacagaacccaacaggugaaggcgguccgcguggaacaaguucagaaaacgggaguguggguccggaaucacaacggcaucgccgacaaugcuaccauggugagaguugauguguuugagaagggggacaaauauuaccucgucccgaucuacucuuggcaaguggccaagggcauucugcccgaucgcgcuguugugcagggaaaggacgaggaagauuggcagcucaucgacgauuccuucaacuuuaaauucagccugcauccuaaugaccuugucgaggugauuacaaagaaagcccggauguucggcuauuuugccuccugccacagagggaccggaaacaucaauauucgcauccacgaccuggaucauaagaucggcaaaaacgggauucucgaaggaaucggcgugaagacagcucugucuuuccagaaguaccagauugacgagcugggggaggaaauccggcccuguagacuuaaaaagcgcccucccgucagauga

SEQ ID NO: 3872 - RNA, 3249 nt, Artificial Sequence; identical to SEQ ID NO: 3710
  Cas9 variant

SEQ ID NO: 3873 - RNA, 3249 nt, Artificial Sequence
  Cas9 variant
auggccgcuuucaagcccaacccuaucaauuacauucugggccucgacaucgggauugccagcgugggaugggcgauggucgagaucgaugaagacgagaacccgauuugccugaucgaucuuggcguuagaguguuugaacgggcugaggugcccaaaaccggggacucccuggccgccgcucgcagacucgcccggucuguccgcagacugacacggcgcagagcucaccggcuucugcgcgccagacggcuccugaagcgcgaaggagugcugcaggcggccgauuucgacgagaauggccucaucaaaagccugccuaacacgcccuggcaacuuagagcugccgcucuggaucggaagcucaccccucuggagugguccgccguucuucugcaucucauuaaacaccgcggguaucugucucagagaaagaaugaaggagagacagcggacaaggaacugggcgcccuccugaaaggcguggcugauaacgcccaugcucugcagaccggggacuuucggacacccgccgagcuggcccucaauaaguucgagaaagaaagcggacacaucagaaaccagcgcggcgauuacucccauaccuuuucucggaaggaccugcaagcugagcuuauucuucucuucgaaaaacagaaggaguuugggaauccucacgucagcggaggccugaaggaagggaucgagacacugcucaugacccagagaccggcgcuguccggagaugccgugcagaaaaugcuuggccacuguacguucgagcccgcugaaccuaaggccgccaaaaacaccuauacagcugagcgcuuuauuuggcugaccaagcucaauaaccugcggauccuugaacaaggcagcgagagaccccugacagacaccgaacgcgccacgcucauggacgagccuuaccggaaaucuaagcugacauaugcgcaggcuagaaaacugcucgggcuggaggauaccgccuucuuuaagggacuucgcuacggcaaggacaaugccgaggcuuccacacugauggaaaugaaagccuaucaugcuauuagccgggcccucgaaaaggaggggcugaaagauaagaaaucuccccugaaccuuuccccggaacuccaggacgagaucggaaccgcguucagccuguuuaagaccgaugaggacaucacaggcagacugaaggaucgcguucagccugaaauucucgaggcccugcuuaaacacaucucuuucgacaaguucgugcaaauuucccugaaagcucuccggagaaucgucccccugauggaacaggggaagcgguacgaugaggccugcgcugagauuuacggagaccauuauggcaaaaagaauacggaagagaagaucuaccugccucccauccccgccgaugaaauucgcaacccuguggugcuuagagcgcucagccaggcccggaaagucaucaacggcguugugagacgcuauggguccccggcucggauucacaucgagaccgccagagaagugggaaagucuuuuaaagaccgcaaggagauugagaaaagacaagaagagaaucggaaggaccgcgaaaaggcugccgccaaauucagagaguacuuucccaacuucgucggcgaaccuaagagcaaagauauccugaagcugcggcucuaugagcagcagcacgggaaaugucuguacuccggaaaggagaucaaucuuggccgccugaacgaaaaaggguauguggagauugaccaugcucuccccuuuagcagaacaugggaugacucuuucaauaacaagguucuggugcugggcuccgaaaaucagaacaagggaaaucaaaccccuuacgaguacuuuaacggcaaagauaauagccgggaauggcaggaguucaaggcgcgcgucgagacaucuagauuuccccggagcaaaaagcagcgcauccuucuccagaaauucgacgaagauggguuuaaggagagaaaccugaaugacacccgguaugugaacagauuccugugccaauuuguugccgaucgcaugcggcucacgggaaagggcaaaaagagaguguucgcuuccaaugggcagauuacaaaccugcuucgcggauucuggggccugcggaaagucagagccgaaaacgaccgccaccaugcccucgaugcuguggucguggccuguucuaccguugcgaugcagcagaagaucacccgguuugugagauacaaagagaugaaugcuuucgacgggaagacaauugauaaggagaccggcgaaguccugcaccagaaaacacauuuuccgcaaccuugggaguucuuugcccaggaagugaugauccgcguuuucggaaagcccgacggcaaaccugaguuugaagaggccgacacgcccgagaagcugcggacccuucucgcugaaaaacugagcuccagaccugaggccgugcacgaauaugucacaccccuguucgugagccgggcgccgaaccgcaagaugucugggcagggacacauggagaccgugaaguccgcuaaaagacucgaugaaggcguuagcguccugcgggugccucuuacacaacugaagcucaaagaccuggagaagauggugaaucgcgagagagaacccaaacuguacgaggcccuuaaggcccggcuggaagcucauaaagaugaccccgccaaggcuuuugccgagccuuucuauaaguacgauaaagcggggaacagaacccagcaggucaaggccgugcgcguugaacaagugcagaaaacgggagucugggugcggaaucacaacggcauugcugacaaugccaccaugguuagaguggaugucuuugagaagggggacaaauauuaccucgugccgaucuacucuuggcagguugcuaagggcauccugcccgaucgcgccgugguccagggaaaggacgaggaagauuggcaacucauugacgauuccuucaacuuuaaauucagccugcauccuaaugaccuuguggaggugaucacaaagaaagcccggauguucggcuauuuugcuuccugccacagagggaccggaaacauuaauauccgcauucacgaccuggaucauaagaucggcaaaaacgggauccucgaaggaauuggcgucaagacagcgcugucuuuccagaaguaccagaucgacgagcuggggaaagagauucggcccuguagacuuaagaaacgcccucccguuagauga

SEQ ID NO: 3874 - RNA, 3249 nt, Artificial Sequence
  Cas9 variant
auggccgcuuucaagcccaacccuaucaauuacauucugggccucgacaucgggauugccagcgugggaugggcgauggucgagaucgaugaagaggaaaacccgauuagacugaucgaccuuggcguucggguguuugagcgcgcugaagugcccaaaaccggggauucccuggccauggccagacggcucgcucgcucugucagacggcugacacgcagacgggcccaccgccuucugagaacgcggcgccuccugaagagagagggagugcugcaggcugccaauuucgacgagaacggccucaucaaaagccugccuaauacccuuuggcaacugcgggcggccgcucucgaucgcaagcugacaccccuugaaugguccgccguucugcuccaucugauuaaacacagaggguaucugucucagcggaagaacgagggagaaaccgcugacaaggagcucggcgcccugcuuaaaggcguggcggggaaugcccaugcucugcagacaggagauuuuagaaccccugccgagcucgcucugaacaaguucgaaaaagagagcggccacauccgcaaucagcggggagacuacucccauacauuuucuagaaaggaucuucaagccgaacugaaccuccuguucgagaaacagaaggaauuuggaaauccccacauuagcgacggccugaaggaggggaucgagacccuccugaugacgcagcgcccugcccuuuccggagaugcuguccagaaaaugcugggccacugcaccuucgaaccgacagagcccaaggcggccaaaaacaccuauacaaccgaacgguuuauuuggcucacgaagcugaauaaccuuagaauccuggagcaaggcagcgaacgcccucucacagacaccgagcgggcuacacugauggaugagcccuacagaaaaucuaagcugaccuaugcccaggcccgcaaacuccuggaacuugacgacauugcuuucuuuaaggggcugcgguacggaaaggauaaugccgaggcguccacccucauggaaaugaaggcuuaucaugccaucagcagagcccuggagaaggaaggccugaaagacaagaaaucuccucuuaaccucucccccgagcugcaggaugagaucgggacagcuuucagccuguuuaagacggacgaagauauuaccggacgccucaaggaccggauccagccggagauucuggaagcccuucugaaacacaucaacuucgauaaguucgugcaaauuucucucaaagcucugagacggaucguuccucugauggagcagggcaagcgcuacgacgaggccugugcggaaaucuacggggaucauuauggaaagaaaaauacagaggaaaagauugaccuucccccuauccccgccgaugagauucacaaccccgugguccucagagcucugucccaggcccggaaagugaucaauggcguggucagacgcuacggcagcccugcucggauucacaucgaaaccgccagagagguugggaaguccuuuaaagaccgcaaggagaucgaaaaacgccaagaggaaaaccggaaggaccgcgagaaggcggccgcuaaauucagagaauauuuuccgaauuucgugggagagcccaagucuaaagauauucugaagcuccggcuguacgagcagcagcauggcaaaugccuuuauagcgggaaggaaaucaaccugggacgccucaaugagaaaggcuacguggaaauugaccacgcccugccuuuuuccagaacaugggaugacagcuucaacaauaagguccuggugcuugggucugagaaccagaauaagggcaaccaaacccccuaugaauacuuuaauggaaaagauaacucccgggaguggcaggaguucaaggcucgcguugaaacgagcagauuuccucggucuaaaaagcagcgcauccuccugcagaaauucgacgaggauggcuuuaaggaaagaaaucugaacgacacacgguacgugaacagauuccucugucaauuugucgccgaucgcaugcggcugaccgggaagggaaagaaaagaguguucgccagcaauggccagauuaccaaccuucugcgcggguucuggggacuccggaaaguuagagcugagaaugaccgccaucacgcgcuggaugccguggucguggcuugcuccacagucgccaugcagcagaagaucacccgguuugugagauauaaagagaugaacgccuucgacggcaagacaauugauaaggaaacgggggagguucugcaucagaaaacccacuuuccccaaccgugggaguucuuugcucaggaagugaugauccgcgucuucggcaagccugacggaaaacccgaauuugaggaggccgacacaccugaaaaacuucggacccuccugacagagaaacugucuagcagacccgaagcggugcacgaguacguuaccccucucuucgugucccgggcucccaaucgcaagaugagcggccaggggcauauggaaacggucaagucugccaaaagacuggaugagggaaucuccgugcuucgggugccgcugacccaacucaagcugaaagaccuggagaagaugguuaaccgcgaaagagagccuaaacuuuaugaagcccugaaggcucggcucgaggcccacaaagaugaccccgcgaaggcuuuugccgaacccuucuacaaguaugauaaagccggcaauagaacacagcaggucaaggcuaugcgcguggagcaagugcagaaaaccggggucugggugcggaaccauaauggaauugccgacaacgcuacaaugguuagaguggaugucuuugagaagggcgacaaauacuaucuggugccuaucuacagcuggcagguugccaaggggauucucccggaucgcgcggugguccagggcaaggacgaagaggauuggcaacugaucgacgauucuuucaauuuuaaauucucccuucaccccaacgaccugguggaaguuauuaccaagaaagcccggauguucggauacuuugcuagcugucacagaggcacggggaauaucaacauccgcauucaugaccucgaucacaagaucgggaaaaauggcauucuggaggggaucggagugaagacagcccuguccuuccagaaguaucagauugacgagcuuggcaaagaaauccggccuugcagacugaagaaaagacccccugucagauga

SEQ ID NO: 3875 - RNA, 3249 nt, Artificial Sequence
  Cas9 variant
auggccgcuuucaagcccaacccuaucaauuacauucugggccucgacaucgggauugccagcgugggaugggcgauggucgagaucgaugaagacgagaacccgauuugccugaucgaucuuggcguuagaguguuugaacgggcugaggugcccaaaaccggggacucccuggccauggcccgcagacucgcucggucuguccgcagacugacacggcgcagagcccaccggcuucugcgcgcuagacggcuccugaagcgcgaaggagugcugcaggccgcggauuucgacgagaauggccucaucaaaagccugccuaacacgcccuggcaacuuagagccgcugcccuggaucggaagcucaccccucuggagugguccgcuguucuucugcaucucauuaaacaccgcggguaucugucucagagaaagaaugaaggagagacagccgacaaggaacugggcgcgcuccugaaaggcguggccgauaacgcucaugcccuucagaccggggacuuucggacacccgcugagcuggcccucaauaaguucgagaaagaaagcggacacaucagaaaccagcgcggcgauuacucccauaccuuuucucggaaggaccugcaagccgagcuuaaucuccuguucgaaaaacagaaggaguuugggaacccucacauuagcgauggacugaaggaaggcaucgagacacugcucaugacccagagaccggcucuguccggggacgcgguccagaaaaugcuuggacacuguacguucgagcccgccgaaccuaaggcugccaaaaauaccuauacagccgagcgcuuuauuuggcugaccaagcucaacaaucugcggauccuugaacaaggcagcgagagaccccugacagacaccgaacgcacgacacucauugaugagccuuaccggaaaucuaagcugaccuaugcucaggccagaaaacugcucgagcuggacaacacagcguucuuuaagggccuucgcuacgggaaggauaaugcugaagccuccacccugauggagaugaaagccuaucaugcuaucagccgggcccucgaaaaggagggacugaaagacaagaaaucuccccugaaccuuuccccggaacuccaggaugagaucggcaccgcuuucagccuguuuaagacagacgaggauauuacggggagacugaaggaccgcgugcagccugaaauccucgaggcccugcuuaaacacauuucuuucgauaaguucguucaaaucucccugaaagcgcuccggagaauugugccccugauggaacagggaaagcgguacgacgaggccugcgcugagaucuacggcgaucauuaugggaaaaagaacaccgaagagaagaucgaccugccucccauucccgccgacgaaauccgcaauccugucgugcuuagagcucucagccaggcccggaaagugauuaacggagucguuagacgcuacggcuccccggcgcggauccacauugagacagccagagaagugggcaagucuuuuaaagaucgcaaggagaucgagaaaagacaagaagagaaucggaaggaccgcgaaaaggcugccaccaaauucagagaguauuuucccaacuucgugggggaaccuaagagcaaagauauccugaagcugcggcucuacgagcagcagcacggaaaaugucuguauuccggcaaggagauuaaucuugggcgccugaacgaaaaaggauacgucgagaucgaccaugcucuccccuuuagcagaacaugggaugacucuuucaauaacaaggugcugguucugggcuccgaaaaucagaacaaggggaaucaaaccccuuaugaguacuuuaacggcaaagauaauagccgggaauggcaggaguucaaggcccgcguggagacgucuagauuuccccggagcaaaaagcagcgcauucuucuccagaaauucgacgaagagggauuuaaggaaagaaaccugaaugauacacgguacgucaacagauuccugugccaauuuguggccgaccacaugcuccugaccggcaaggggaaacgccggguuuucgcuuccaacggacagaucaccaaucuucugagaggcuucugggggcuccgcaaggugcgggcggagaacgauagacaucacgcccuggacgcugucguggucgccuguucuacaguggccaugcagcagaaaauuacccgcuuuguucgguauaaggagaugaaugcuuucgauggaaaaacaaucgacaaggaaacgggcgaggugcugcaucaaaagacccacuuuccgcagccuugggaguucuuugcccaggaagucaugauuagaguguucgggaaacccgacggcaagccugaauuugaggaggcggauacacccgaaaaacuucgcacccuccuggcugagaagcugagcucccggccugaagccguucacgaguacgugacaccccucuucgucagcagagccccgaaccggaaaaugucuggacagggccauauggaaaccgugaaguccgcuaagcgccuggacgagggggugagcguucuuagagucccucugacgcaacucaaacugaaggaucuggagaaaauggugaaucgggaacgcgagcccaaacuuuaugaagcccugaaagcgagacucgaggcucacaaggacgaucccgccaaagccuuugcugaaccuuucuacaaguaugacaaggccggaaaccggacccaacaggugaaagcugucagaguggagcagguucagaagacaggcguguggguccgcaaucauaacgggaucgccgauaaugcgaccauggugcggguugacguguuugagaaaggagauaaguacuaucuggucccgaucuacucuuggcaaguggccaaaggcauucuccccgacagagcuguugugcaggggaaggaugaagaggacuggcagcugaucgaugacuccuucaacuuuaaguucagccuucacccuaaugaccuggucgaagugauuacaaagaaggcccgcauguucggcuacuuugcuuccugccaccggggaaccggcaacaucaauauuagaauccaugaucucgaccacaaaaucgggaagaacggcauucuggagggaaucggggugaaaacggcccugucuuuccagaaguaucagauugaugagcuuggaaaggaaauccgccccugucggcugaaaaagagaccucccguccgcuga

SEQ ID NO: 3876 - RNA, 3249 nt, Artificial Sequence
  Cas9 variant
auggccgcuuucaagcccaacccuaugaauuacauccugggccucgacauugggaucgccagcgugggaugggcgauugucgagaucgaugaagaggaaaacccgauuagacugaucgaccuuggcguucggguguuugagcgcgcugaagugcccaaaaccggggauucccuggccgccgcuagacggcucgcccgcucugucagacggcugacacgcagacgggcucaccgccuucugagagcccggcgccuccugaagagagagggagugcugcaggcggccgacuucgaugagaauggccucaucaaaagccugccuaacacgcccuggcaacuucgggcugccgcucuggaccgcaagcucaccccucuggaaugguccgccguucuucugcaucucauuaaacacagaggguaucugucucagcggaagaaugagggagaaacagcggauaaggagcugggcgcccuccugaaaggcguggcugacaacacccaugcccuucagacaggggauuuuagaacccccgcugagcuggcccucaauaaguucgaaaaagagagcggacacauccgcaaccagcggggcgacuacucccauacauuuaauagaaaggaucugcaagccgaacuuaaccuccuguucgagaaacagaaggaauuugggaauccucacgucucugacggacugaaggagggcauugagacccugcucaugacgcagcgcccggcucugagcggggaugcggugcagaaaaugcuuggacacugcaccuucgaacccacagagccuaaggccgcuaaaaacaccuauacagccgaacgguuuguuuggcugaccaagcucaauaaccugagaauccuugagcaaggcuccgaacgcccccugacggacacagagcgggccacccucauggacgagccuuacagaaaaagcaagcugacauaugcucaggcccgcaaacugcucgaucuggacgauaccgcguucuuuaagggccuucgguacgggaaggacaaugcugaagccucuacccugauggagaugaaagccuaucaugcuauuuccagagcccucgaaaaggagggacugaaagauaagaaaagcccccugaaccuuucuccggaacuccaggacgagaucggcacagcuuucucccuguuuaagacggaugaggacauuaccgggcgccugaaggaucgggugcagccugaaauccucgaggcccugcuuaaacacaucagcuucgacaaguucguccaaauuucucugaaagcgcucagacggaucgugccccugauggaacagggaaaccgcuacgaugaggccuguacagagauuuacggcgaccauuaugggaagaaaaauaccgaagagaagaucuaccugccucccauucccgcugacgaaaucagaaacccugugguccuucgggcccucucccaggcuagaaagguuaucaauggaguggugcgccgguauggcagcccggcccgcauucacaucgagacagcgagagaagucggcaaauccuuuaaggauagaaaagagauugagaagcggcaagaagagaaccgcaaagacagagaaaagucugccgcuaaguuccgggaguacuuucccaauuucgugggggaaccuaaaagcaaggauauccugaaacugcgccucuaugagcagcagcacggaaagugccuguacuccggcaaagagauuaaccuugggagacugaaugaaaagggauauguugagaucgaccaugcccuccccuuuagccggaccugggaugacucuuucaacaauaaagugcuggcucugggcuccgaaaaccagaauaaggggaaccaaacgccuuacgaguacuuuaauggcaaggauaacagccgcgaauggcaggaguucaaagccagagucgagacaucucgguuuccccgcagcaagaaacagagaauccuucuccagaaguucgacgaagauggauuuaaagagcggaaucugaacgacaccagauauauuaaccgcuuccugugucaauuuguggccgaucacaugcuccugaccggcaaggggaagcggagaguuuucgcuuccaauggacagaucacaaaccuucugcgcggcuucugggggcuccggaaagugagagcggaaaaugaccgccaucacgcccuggaugcugucguggucgccugcucuaccauugccaugcagcagaagaucacacgguuugugagauacaaagagaugaacgcuuucgacggaaagacgauugacaaagagaccggcgaaguucugcaucaaaaggcccacuuuccgcagccuugggaguucuuugcgcaggaagugaugauccgcgucuucgggaagcccgauggcaaaccugaguuugaagaggcugacacacccgagaaacuucggacccuccuggccgaaaaacugagcuccagaccugaggccgugcacaaguauguuacaccccucuucauuagccgggcuccgaaucgcaaaaugucuggacagggccauauggaaaccgugaaguccgccaagagacuggaugaggggaucagcguccuucgggugccucugacgcaacucaaacugaaggaccuggaaaagauggugaaccgcgagagagagcccaaacuuuacgaagcgcugaaagcucggcucgaggcccacaaggaugaccccgccaaggcuuuugccgaaccuuucuauaaguacgauaaggcuggaaauagaacccagcagguuaaagccguccgcguggagcaagugcagaagacaggcgucugggugcauaaccacaaugggaucgcggacaacgccaccauuguucggguggaugucuuugaaaaaggaggcaaguauuaccuggugccgaucuacucuuggcagguugcuaaagggauucuccccgacagagccgugguccagggcaaggaugaggaggacuggacagugauggaugacuccuucgaauuuaaguucguucuguaugcuaaugaccuuaucaaacugaccgccaagaaaaacgaguuccucggauacuuugugagccugaaucgcgccacgggcgcuauugauauccggacacacgacaccgauuccacaaaggggaaaaacggaaucuuccaaucugucggcgugaagaccgcgcugagcuuucagaaguaucagauugacgaacuugggaaagagaucagaccuugucgccugaagaaacggcccccugugagauga

SEQ ID NO: 3877 - RNA, 3249 nt, Artificial Sequence
  Cas9 variant
auggccgcuuucaagcccaacagcaucaauuacauucugggccucgacaucgggauugccuccgugggaugggcgauggucgagaucgauaaagaagagaacccuauuagacugaucgaccuuggcguucggguguuugaacgcgcugaggugccgaagaccggggauucucuggccgccgcuagacggcucgcccgcagcgucagacggcugacacgcagacgggcucaccgccuucugagaacgcggcgccuccugaaaagagaaggagugcugcaggccgcgaauuucgacaagaacggccucaucaaaucccugcccaauacccuuuggcaacugcgggccgcugcccucgaucgcaagcugacaccucuugaguggucugcuguucugcuccaucugauuaagcacagaggguaucugagccagcggaaaaacgagggagaaaccgccgacaaggagcucggcgcgcugcuuaaaggcguggccgggaaugcucaugcccugcagacaggagauuuuagaacccccgcugaacucgcccugaacaaguucgagaaagaguccggccacauccgcaaucagagaggggacuacucucauacauuuagcagaaaggaucuucaagccgaacugaaccuccuguucgagaagcagaaagaauuuggaaauccucacauuuccggcgggcugaaggagggaaucgaaacccuccugaugacgcagcgccccgcucuuagcggcgacgcgguccagaaaaugcugggccacugcaccuucgagccuacagagccgaaggccgcuaaaaacaccuauacaaccgaacgguuuauuuggcucacgaagcugaauaaccuuagaauccuggagcaagggucugaacgcccccucacagauaccgagcgggccacacugauggacgaaccuuacagaaaauccaagcugaccuaugcccaggcucgcaagcuccugagccuugaggauaccgccuucuuuaaaggacugcgguacggcaaggacaaugcggaggcuucuacacucauggaaaugaaagccuaucauacgauuuccagagcccuggagaaggaagggcugaaagacaaaaagagcccccuuaaccucucuccugagcugcaggaugaaaucggaaccgcuuucucccuguuuaaaacagacgaggauaucaccggccgccucaaggaccggauucagcccgagauccuggaagcccuucugaaacacauuagcuucgauaaguucgugcaaaucucccucaaagcucugagacggauuguuccgcugauggagcaggggaagcgcuacgacgaagccugugcggagaucuacggagaucauuauggcaagaaaaacacagaggaaaagaucuaccuuccucccauuccugccgacgagaucagaaaucccgugguccuccgggcucugucucaggccagaaaagugauuaacggcgugguccgccgguaugggagccccgcuagaauccacauugaaaccgcccgcgagguuggaaaguccuuuaaagauagaaaggaaaucgagaagcggcaagaggaaaaucgcaaagacagagagaaggcggccgcuaaauuccgggaauacuuuccuaacuucgugggcgagcccaagagcaaagauauccugaagcuccgccuguaugaacagcagcacgggaaaugccuuuacucuggaaaggagauuaaucuggugagacucaacgagaagggcuaugucgaaaucgaccaugcccugcccuuuucccggacgugggacgauagcuucaauaacaaagugcugguucuugggucugagaaucagaacaagggcaaucaaacaccuuacgaauacuuuaacggaaaagacaauagccgcgaguggcaggaguucaaggcuagaguggaaaccucccgguuuccccgcucuaaaaagcagcggauucuccugcagaaguucgaugaggacggcuuuaaagaacggaaccugaaugauaccagauaugucaaccgcuuccucugucaauuuguggccgaccacauccugcuuacagggaagggaaaacggagaguuuucgccagcaacggccagauuaccaaucugcuccgcggguucuggggacugcggaaggugagagcugagaacgaucgccaucacgcgcuggacgccgucguggucgcuugcuccacaguggccaugcagcagaaaaucacgcgguuuguuagauacaaggaaaugaaugccuucgauggcaagaccauugacaaagagacaggggaggugcuucaucaaaagacccacuuuccucagcccugggaguucuuugcucaggaagucaugauccgcguguucggcaaaccggauggaaagccugaauuugaggaagccgacacacucgagaaacugcggacccugcucgcggagaagcugagcucuagacccgaagcuguucacgaguaugugacgccucuuuucgucucccgggcccccaaccgcaagaugagcggccaggggcauauggaaaccgugaaaucugccaagagacuggaugagggaguguccguucuccgggucccucugacacaacugaaacuuaaggaccuggaaaagauggugaaucgcgagagagagcccaagcucuacgaagcucugaaagcccggcucgaggcgcacaaggacgauccggcuaaggccuuugccgaaccuuucuauaaauacgacaaggcuggcaacagaacccaacaggugaaagccguccgcguggagcagguucagaagacagggguguggguccggaaucauaacggaaucgcugauaaugccaccauggugagaguugacguguuugaaaaaggcgauaaguauuaccugguccccauuuacagcuggcaaguggcgaaggggauccuucccgaccgcgccguugugcagggcaaagaugaggaggacuggcagcugauugaugacuccuucaacuuuaaguucucucuccacccuaaugaucuggucgaagugaucacgaaaaaggcucggauguucggauauuuugccagcugucacagaggcacagggaacauuaauauccgcauccaugaccuggaucacaaaauuggaaagaacggcauccuugaggggauuggagugaagaccgcucuguccuuccagaaauaccagaucgacgaacucggcaaggagauucggccgugcagacugaaaaagcgcccgccugucagauga

SEQ ID NO: 3878 - RNA, 3249 nt, Artificial Sequence
  Cas9 variant
auggccgcuuucaagcccaacccuaucaauuacauucugggccucgacaucgggauugccagcgugggaugggcgauggucgagaucgaugaagaggaaaacccgauuagacugaucgaccuuggcguucggguguuugagcgcgcugaagugcccaaaaccggggauucccuggccauggucagacggcucgcccgcucugugagacggcugacacgcagacgggcucaccgccuucugagagcccggcgccuccugaagagagagggaguucugcaggcugccgacuucgaugagaauggccucaucaaaagccugccuaacacgcccuggcaacuucgggcggccgcucuggaccgcaagcucaccccucuggaaugguccgccgugcuucugcaucucauuaaacacagaggguaucugucucagcggaagaaugagggagaaacagcugauaaggagcugggcgcccuccugaaaggcgucgcggacaacgcccaugcucugcagaccggggauuuuagaacacccgccgagcuggcucucaauaaguucgaaaaagagagcggacacauccgcaaccagcggggcgacuacucccauaccuuuucuagaaaggaucugcaagccgaacuuauucuucucuucgagaaacagaaggaauuugggaauccucacaucagcggaggccugaaggaggggauugagacacugcucaugacccagcgcccggcccuguccggagacgcugugcagaaaaugcuuggccacugcacguucgaacccgcggagccuaaggccgcuaaaaacaccuauacagccgaacgguuuaucuggcugaccaagcucaauaaccugcgcauucuugagcaaggcagcgaaagaccccugacagauaccgagcgggccacgcucauggacgagccuuacagaaaaucuaagcugacauaugcucaggcccgcaaacugcucgggcuggaagacaccgcguucuuuaagggacuucgguacggcaaggauaaugcugaggccuccacacugauggaaaugaaagccuaucaugcuaucagcagagcccucgagaaggaagggcugaaagacaagaaaucuccccugaaccuuuccccggagcuccaggaugagaucggaaccgcuuucagccuguuuaagaccgacgaagauauuacaggccgccugaaggaccggauccagccugagauucucgaagcccugcuuaaacacaucucuuucgauaaguucguucaaauuucccugaaagcgcucagacggaucgugccccugauggagcaggggaagcgcuacgacgaggccugugcugaaaucuacggagaucauuauggcaaaaagaauacggaggaaaagauuuaccugccucccauccccgccgacgagauuagaaacccugucgugcuucgggcucucagccaggccagaaaagugaucaacggcgucguucgccgguauggguccccggcgcgcauucacaucgaaaccgccagagaggugggaaagucuuuuaaagauagaaaggagaucgaaaaacggcaagaggaaaaucgcaaggacagagagaaggcugccgcuaaauuccgggaauacuuucccaacuucgugggcgagccuaagagcaaagacauucugaagcugcgccucuaugagcagcagcacgggaaaugccuguacuccggaaaggaaaucaaucuuggcagacugaacgagaaaggguaugucgaaauugaucaugcccuccccuuuagccggacaugggacgauucuuucaauaacaaggugcugguucugggcuccgagaaucagaacaagggaaaucaaaccccuuacgaauacuuuaacggcaaagacaauagccgcgaguggcaggaguucaaggccagaguggaaacaucucgguuuccccgcagcaaaaagcagagaauccuucuccagaaauucgaugaggacggguuuaaggaacggaaccugaaugauaccagauaugucaaccgcuuccugugucaauuuguggcugaccggaugagacucacgggaaagggcaaaaagcgcguuuucgcguccaaugggcagauuacaaaccugcuucggggauucuggggccugagaaaagugcgcgccgagaacgaucggcaccaugcucucgacgccgucguggucgccugcucuaccguggcuaugcagcagaagaucaccagauuuguucgcuacaaagagaugaaugccuucgaugggaagacaauugacaaggaaaccggcgaggugcugcaccagaaaacacauuuuccgcagccuugggaguucuuugcgcaggaagucaugauccggguguucggaaagcccgauggcaaaccugaauuugaggaggcugacacgcccgaaaagcugagaacccuucucgccgagaaacugagcucccggccugaagccguucacgaguaugugacaccccuguucgucagccgcgcuccgaacagaaagaugucugggcagggacacauggaaaccgugaaguccgccaaacggcucgacgagggcgugagcguucugcgcgucccucuuacacaacugaagcucaaagaucuggagaagauggugaauagagaacgggagcccaaacuguacgaagcgcuuaaggcuagacuggaggcccauaaagacgaucccgccaaggcuuuugccgaaccuuucuauaaguacgacaaagcugggaaccgcacccaacaggugaaggccguccggguggagcaaguucagaaaacgggagugugggucagaaaucacaacggcaucgcggauaaugccaccauggugcgcguugacguguuugagaagggggauaaauauuaccucgucccgauuuacucuuggcaaguggcuaagggcauccugcccgaccgggccguugugcagggaaaggaugaagaggacuggcagcucauugaugacuccuucaacuuuaaauucagccugcauccuaaugaucuugucgaagugaucacaaagaaagcuagaauguucggcuauuuugccuccugucaccgcgggaccggaaacauuaauauccggauccacgaccuggaccauaagauuggcaaaaacgggauccucgagggaauuggcgugaagacagcccugucuuuccagaaguaccagaucgaugagcuggggaaagaaauuagacccugccgccuuaagaaaagaccucccguccgguga

SEQ ID NO: 3879 - RNA, 3249 nt, Artificial Sequence
  Cas9 variant
augagagugcugggccucgacgccgggaucgcuagccugggaugggcccuuauugagaucgaagaguccaaccggggcgaacugucucaggggaccauuaucggagcgggcacauggauguucgaugcucccgaggaaaagacgcaagccggggccaaacucaagagcgagcagcgcagaaccuuucggggacagcgcagagucguucggcgcagacggcagcgcaugaaugaggugagacggauucugcacucccauggccuucugccuucuagcgaccgcgaugcucucaaacaaccgggccuggaccccuggagaauccgggccgaagcucuggaucgccuccuggggccuguggagcuugccgucgcgcugggacacaucgccagacaucggggcuucaaguccaacucuaaaggggcuaagacaaaugaccccgccgaugacaccagcaagaugaaaagagcugugaacgaaacacgcgagaagcucgcccgguuuggauccgcggccaaaaugcugguugaggaugagagcuucgugcuuagacagaccccuacaaagaauggcgcuucugaaauuguccgccgguuuagaaaccgcgaaggggacuacucccggagccugcucagagaugaccuggccgcugagaugcgcgcccuguucaccgcccaggcucgguuucagucugcgaucgccacggcugaucuccaaaccgccuucacaaaagccgcuuucuuccagagaccccugcaggacuccgaaaagcuggugggaccuugcccguuugagguugacgagaagcgcgcccccaaacggggcuauagcuucgaacuguuuagauuccucucucggcugaaucacgugacccuucgcgauggcaagcaggagagaacacugacccgggacgaacucgcgcuggcugccgccgauuucggggcugccgcuaaagucuccuuuacggcccugagaaagaaacucaagcugccugagacaaccguguucgugggagucaaagcggacgaagagagcaaacuugauguuguggcccgcuccggcaaggcugccgaggggacagcucggcugagaucugugauugucgacgcccucggagaacuggcguggggcgcccuucuguguagccccgagaagcucgauaagaucgcugaagugauuuccuuucgcagcgacaucgggagaauuucugagggacuggcccaagcuggcugcaacgccccucugguugaugcccucaccgcugcggccuccgacggccgguucgaucccuuuaccggggcuggacauaucagcucuaaagccgcccgcaauauccugagcggccuuagacaggggaugacauacgacaaggcuuguugcgccgcggacuaugaucacacggcuucccgggaacgcggagccuucgacgugggcgggcacggcagagaggcccugaaacggauucuccaggaggaacgcaucucuagagagcuggucggaagcccgaccgcucggaaggcccugauugaauccaucaagcaagugaaagcgauuguugagcgcuacggcgugccugauagaauccaugucgagcuugcucgggacgugggaaagagcaucgaagagagagaagagauuacacgcgggaucgaaaaacggaacagacagaaggauaaacuccgcggccuguuugagaaggaggucgggcggcccccucaggacggagccagaggcaaggaggaacugcuccgcuucgaacuguggucugagcagauggggcggugucuuuauaccgaugacuacauuucccccagccaacugguggccacagaugacgcuguucagguggaucacauccuccccuggucuagauuugccgacgauuccuaugcuaauaaaacccugugcauggccaaggcgaaccaggacaaaaagggccgcacgccuuacgaaugguucaaagccgagaagacagacaccgagugggaugcuuuuauuguccggguggaagcccuggcugacaugaagggauucaaaaagagaaauuacaaacuucggaacgccgaggaagccgcugcgaaguuucgcaauagaaaccucaacgauacccggugggccugucgccugcuggcugaggcccucaaacagcuguauccgaagggcgaaaaagacaaggaugggaaggagagacggagaguuuucagccgccccggagcccuuacagaccggcugagacgcgcuuggggccuccaauggaugaaaaaguccaccaaaggggaucggaucccugacgauagacaucacgcccuggacgcgaucgugauugcugccacaacggagucucugcuucagcgcgccacccgggaaguccaggagaucgaagauaagggacuccacuacgaccuggugaaaaaugugacacccccuuggcccggcuucagagagcaggcuguugaggccgucgaaaagguguuuguggcgcgcgcugagagacggcgcgccagagggaaggcccaugaugcuaccauucggcacaucgccguccgcgaaggcgagcaaagaguguaugaacggagaaaaguugcugagcugaagcucgccgaccuggaccgcgugaaagaugcggagcggaacgccagacuuauugaaaagcugcgcaauuggaucgaggcuggaagcccgaaagacgauccuccccucuccccuaagggcgaccccauuuucaagguccggcuggugacaaaaucuaagguuaacaucgcccuggauaccgggaauccuaaaagacccggaacgguggaccggggcgaaauggcucgcgucgauguguuuagaaaggccagcaaaaaggggaaguacgaguauuaccuuguuccgaucuauccucaugacauugccaccaugaaaacaccucccauccgggcugugcaggcguacaagcccgaagaugaguggccggagauggacuccagcuacgaauuuugcuggucucucguccccaugaccuaucuucaggugauuuccagcaaaggagagaucuuugaaggcuacuaucgcgggaugaacagaucugugggcgccauucagcuguccgcucacagcaauucuagcgaugucguucaaggaaucggcgcccggacacucaccgaguucaagaaauuuaacguggaccgcuucgggagaaagcaugaaguggagcgggagcugcgcacguggagaggagaaacauggcggggcaaagccuacaucuga

SEQ ID NO: 3880 - RNA, 3255 nt, Artificial Sequence
  Cas9 variant
augaagaacacccuguacggcaucgggcucgacauuggaguggccagcgucggcugggcuguuguggggcugaauggaacaggcgagcccguggggcuucacagacugggaguccggaucuucgauaaagccgaacagccuaagacgggcgagucccucgcggcuccgcgcagaauggcccggggcaugcgcagacggcugcgcagaaaagcccuucggcgcgcugacguguaugcccugcucgaaagaucugggcugagcacccgggaggcucuggcccauauguuugaagcgggaggccucgaggauauuuacgcccugcgcacaagagcucuugacgagcccguugggaaggccgaguucucccggauccugcuccaccuggcucaacgcagaggauuuaaaucuaaccggagaaccgccagcgauggcgaagacgggcgccuucuggcggccgugaaugaaaaccggagacgcauggcucagggaggcuggcggacagucggcgagaugcucuauagacaugaggccuucgcucugcacaagcgcaauaaggccgaugaauaccuguccaccguggggcgggacaugguugccgaggaggcuucucuccuguuucagagacagcgcgaacuuggaugcgcgugggccacaccugaacugcaagcugaguaucucagcauucugcuucggcagagauccuucgaugagggccccgggggaaacagcccuuacggcgggaaucagguggaaaagauggucggacgcuguaccuuugagcccgacgaaccucgggccgccaaggcugccuauucuuucgaguacuuuucccugcuccagaaaaucaaccauaucagacugguggaaaauggcgagacgcggccgcugacccaacagcagcgccagcaacuccugagccuugcgcacaagacacccgaugugucucuggcucggauuagaaaagagcucgcccugccugaaaccguccaguucaacggcguuagaugccgcgccaaugagacacuugaagaguccgaaaagaaggagaaauuugcuugucugcccgccuaccacaagaugcggaaagcucucgacgggguggugaagggaagaaucagcucucuguccauuagccagcgcgaugccgcggccaccgcucugucccucuauaaaaacgaggacacgcugagagccaaacuuacagaagcuggcuuccaagccccugagaucgacgcgcuggccgggcucaccggauuuucuaaauucggccaucugagccugaaggcuugccggaaacuuauuccccaccucgaacaggggcugacauacgaucaggccuguuccgcugccggcuaugacuucaagggacauggcgccggggagcgcgcuuuuacccugccggcggccgcuccugagauggaacagaucaccagccccgucgugagacgggccguugcccaaacaauuaagguggucaauggaaucauccgcgagauggaugcuucuccugccugggugagaauugaacucgcgcgggagcuguccaaaacguucggcgaacgccaggagauggacagaagcaugcgggagaacgcugcccagaaugaacgccuuaugcaggagcugagagauaccuuucaccuccugucucccacagggcaagaccugguuaaguaccggcuuuggaaagaacaggauggagugugcgccuauagccucagacgccuggacgucgagcggcuguucgaacccggcuacguggaugucgaccacaucgugccuuauucccucucuuuugaugacagacgcagcaacaagguucuggugcuuuccagcgagaaccggcagaaggggaauagacugccgcuccaguaccugcaaggcaaacgccgggaggacuucauugucuggaccaacucuuccgugagagauuaccgcaagcggcagaaucugcuuagagaaaaacucagcggagacgaggcugaaggcuuucggcagcgcaaccugcaggauacacaacauauggccagauuccuguauaauuacaucucugaccaccucgcguuugcucaguccgaggcccuggggaagaaacggguuuucgccgugagcggagcugucaccucccaucuucgcaagagauggggccugucuaaggugcgggccgauggggaccuccaccaugcucuggaugccgcggugauugccuguacgacagacggaaugaucagacgcaucagcggcuauuacgggcacauugaaggcgaguaucugcaggaugcugacggagccggcucccaacacgcucggaccaaagagagauuucccgccccuuggccccgcuuccgggaugaacuuaucguuagacucucugagcagccuggggaacaucugcuggacauuaaccccgaguuuuacugcgaguauggaaccgaacacauccgcccggucuucgugagccggaugccuagacgcaaggugacaggccccgggcauaaagagaccauuaagggagccgcugcggccgaugaaggccuccugacagucagaaaagcucuuacggagcugaagcucgacaaggacggggaaaucaaagauuacuacaugccuuccagcgacacccugcuguaugaggcccuuaaggcccagcugcggcgcuucggcggagauucuaaaaaggcuuuugccgagcccuucuacaaaccuaaggcggacggcacacccgggccgcucgugagaaaaguuaagaccacagaaaaggcuacccugacggugccuguccacggaggcgccgccuccaaugauaccauggugcggguugacguguuucucguccccggggauggauauuacugggugcccguuuauacagcugacacccugaaaccugagcuuccgaaccgcgccgugguccagggcaagcccuacagcgaauggaaagagaugagagaagaggauuucaucuuuucucuguauccuaaugaccucguguacguggagcacaaguccggccugaaauucacacugcaaaacgcggauagcacccuugaaaagacgcggacacagaccucugcuuuugucuacuucguugggggaagcauuuccacagccagcaucaccauuagaacccaugacaaugccuauggcauccccucucugggggugaagacacucaaaacguuucacaaguaccagguggauguccugggaaacguguucccuguucauaaagagacccgccagaaguuucgguga

SEQ ID NO: 3881 - RNA, 3255 nt, Artificial Sequence
  Cas9 variant
augaagaacacccuguacggcaucgggcucgacauuggaguggccagcgucggcugggcuguuguggggcugaauggaacaggcgagcccguggggcuucacagacugggaguccggaucuucgauaaagccgaacagccuaagacgggcgagucccucgcggcuccgcgcagaauggcccggggcaugcgcagacggcugcgcagaaaagcccuucggcgcgcugacguguaugcccugcucgaaagaucugggcugagcacccgggaggcucuggcccaaauguuugaagcgggaggccucgaggauauuuacgcccugcgcacaagagcucuugacgagcccguugggaaggccgaguucucccggauccugcuccaucuggcucagcgcagaggauuuaaaucuaaccggagaaccgccagcgauggcgaagacgggcgccuucuggcggccgugaaugaaaaccggagacgcauggcucagggaggcuggcggacagucggcgagaugcucuauagacacgaggccuucgcucugcauaagcgcaauaaggccgaugacuaccuguccaccguggggcgggauaugguugccgaagaggcuucucuccuguuucagagacaacgcgaacuuggaugcgcgugggccacaccugagcugcaggcugaauaucucagcauucugcuucggcagagauccuucgacgagggccccgggggagauagcccuuacggcgggaaccagguggagaaaauggucggacgcuguaccuuugaacccgacgagccucgggccgccaaggcugccuauucuuucgaauacuuuucccugcuccaaaagaucaaucacaucagacuggcggagaacggcgaaacgcggccgcugacccagccccagcgccagcaacuccugagccuugcucauaagacaccugauaugucucuggcccggauuagaaaagagcucgcccugcccgagaccgugcaguucaauggcgugagaugccgcgcuaacgaaacacuugaggaauccgagaagaaggaaaaauuugccugucugccugcuuaccacaagaugcggaaagcccucgggggagucguuaagggcagaaucagcucucuguccauuagccagcgcgacgcggccgcuaccgcccugucccucuauaaaaaugaggacacgcugagagcuaaacuuacagaggccggguuccaagcgcccgaaaucgaugcccuggcuggacucaccggcuuuucuaaauucgggcaccugagccugaaggccugccggaaacuuauuccgcaucucgagcagggccugacauacgaccaggcuuguuccgccgccggauaugauuucaagggccacggggcuggagaacgcgcguuuacccugccugccgcugcccccgagauggagcagaucaccagcccuguggugagacgggccgucgcucaaacaauuaaggugguuaacggcaucauccgcgaaauggacgccucucccgcgugggugagaauugagcucgcucgggaacuguccaaaacguucggggagcgccaggaaauggauagaagcaugcgggagaaugccgccaagaacgagcgccuuaugcaggaacugagagacaccuuucaucuccugucucccacaggacaggaucuggucaaauaccggcuuuggaaggagcaagacggcgugugcgcuuauagccuccagagacuggauguugaacagcuguucgagccuggguacguggacgucgaucacaucgugccguauucccucucuuuugacgaccgccggagcaauaagguccuggugcuuuccagcgaaaacagacagaaaggcaaccgccugccccuccaauaccugcagggaaagcggagagaggauuucauuguuuggaccaauucuuccgugcacgacuaccgcaaacggcagaaccugcuuagagagaagcucagcgaugacgaagccgagggcuuucgccagcggaaucugcaagauacacagcauauggcgagauuccuguauaacuacaucucugaccaccucgcuuuugcccaguccgaagcccuggggaaaaagcgggucuucgcugugagcggagccguuaccucccaucuucgcaagagauggggccugucuaaagugcgggcugauggggaccuccaccaugcccuggaugcggccgucguggcuuguacgacagacggaaugauucgcagaaucagcggcuauuacgggcacaucgagggcgaauauuuucaagaugccgacggagcuggcucccagcacgcccggaccaaggagagauucccugcccccuggccucgcuuucgggaugagcugauugugagacuuucugaacagcccggggagccgcuccuggacaucaauccugcuuucuacugcgaauauggaaccgagcauauucgccccguuuucgucagccggaugccuagacgcaaagugacaggccccucccacaaggagaccgugaaaggggcggccgcugccgacgaaggacugcucacaguccggaaggcccugacggagcuuaagcuggauaaagacggcgaaaucaaggauuacuacaugccuagcucugacacccuccuguaugaggcucugaaagcccagcuuagacgcuuugggggcgauggaaagaaagcguucgcugaacccuuuuacaagccgaaagccgacggcacaccugggccccuggugagaaagguuaagaccacagagaaagccacccucacggugcccguccauggaggcgcugccuccaacgauaccauggugcggauugacguuuucuuuaugccuggggauggauauuacugggugccgcuguaugucgcggacacacucaagcccgagcugccuaaucgcgcugugguugcccacaaacccuacagcgaauggcaagagaugagagaagaggauuucguguuuucucuuuauccuaacgaccuggucuacguggaacacaaguccgagcucaaauucaccgugcagaaugccgauagcacacuggagaagacccggacgcaggcuucugccuuugucuacuucguuagcggcggcaucuccgggggaacaaucaccgugcgcacacaugacaacagcuauggcauucccucucuggggcuuaagacccugaaaucccucuguaaguaccagguggacguccugggaaauguguuuccuguucacaaagaaaccagacaaaaguuccgguga

SEQ ID NO: 3882 - RNA, 3255 nt, Artificial Sequence
  Cas9 variant
augaagaacacccuguacggcaucgggcucgacauuggaguggccagcgucggcugggcuguuguggggcugaauggaacaggcgagcccguggggcuucacagacugggaguccggaucuucgauaaagccgaacagccuaagacgggcgagucccucgcggcuccgcgcagaauggcccggggcaugcgcagacggcugcgcagaaaagcccuucggcgcgcugacguguaugcccugcucgaaagaucugggcugagcacccgggaggaacuggcucaaauguuugaggccggaggccucgaggauauuuacgcgcugcgcacaagagcccuugacgaacccguugggaaggcugaguucucccggauccugcuccaucuggcccagcgcagaggauuuaaaucuaaccggagaaccgcuagcgauggcgaagacgggcgccuucuggccgcggugaaugagaaccggagacgcauggcccagggaggcuggcggacagucggcgagaugcucuauagacacgaggcuuucgcccugcauaagcgcaauaaggcugaugacuaccuguccaccguggggcgggauaugguugccgaagaagccucuauucucuuugagagacagcgcgcuaugggaugcagcugggcggccccugaacugcaagcugaguaucuuuccauccugcuccggcagcgcagcuucgacgagggccccgggggaaacucuccuuacggcgggaaucagguggagaaaauggucggaagauguacauuugaacccgaugaaccucgggccgccaaggcugccuauuccuucgaguacuuuagccugcuucagaaacugaaccacaucagacucgcggaaaauggcgagacccggccgcugacgcaaccccagcgccagcagcugcucucucuggcucauaagaccccugacauuucccuugccagaauccggaaagagcuggcccuccccgaaacagugcaauucaacggcgugagaugccgcgcuaaugagacccuggaagagagcgaaaagaaggagaaauuugccugucuuccugcuuaccacaagaugcggaaagcccuggauggggucguuaagggaagaauuucuucccucagcaucucccagcgcgacgcggccgcuacagcccugucucuguauaaaaacgaggacacccucagagcuaagcugacggaagccggcuuccaggcgcccgagauugaugcccuugcugggcugacaggauuuagcaaauucggccaccucucccugaaggccugccggaagcugaucccgcaucuugaacaagggcucaccuacgaccaggcuuguacagccgccggcuaugauuucaaaggacacggcgcuggggagcgcgcguuuacccugccugccgcugcccccgagauggaacagauuaccagcccuguggugagacgggccgucgcucagacaaucaaggugguuaauggaaucauucgcgagauggacgccucucccgcgugggugagaaucgaacuggcucgggagcucuccaaaacguucggcgaacgccaagagauggauagaagcaugcgggagaacgccgcccagaaugaacgccugaugcaggagcuuagagacaccuuucaucugcucucucccacagggcaggaucuggucaaguaccggcuguggaaagaacaagacggagugugcgcuuauagccuuagacgccucgauguugagcggcuguucgaaccuggcuacguggacgucgaucacauugugccguauucccugucuuuugacgacagacgcagcaacaagguccucgugcuguccagcgagaaccggcagaaggggaauagacuuccccugcaguaccuccagggcaaacgccgggaggauuucaucguuuggaccaacucuuccgugcacgacuacagaaagcgccaaaaucugcugcgggaaaaacuuagcggagaugaggccgaaggcuuuagacagcggaaccuccaggacacacagcauauggcgcgcuuccuguauaauuacauuucugaucaccuggcuuuugcccaauccgaggcccucgggaagaaaagagucuucgcugugagcggagccguuaccucccaucugcggaagcgcuggggccuuucuaaggugagagcugacggggaucugcaccaugcccucgacgcggccgucguggcuuguacgacagauggaaugauccggagaaucagcggcuauuacgggcacauugaaggcgaguaucugcaggacgccgauggagcuggcucccagcacgcccgcaccaaagagcgguuuccugcccccuggccuagauuccgcgacgaacugaucgugcggcuuucugagcaacccgcugaaccgcuccuggauauuaacccugaguuuuacugcgaguaugggaccgaacauaucagacccguuuucgucagccgcaugccucggagaaaggugacaggacccggccacaaagagaccauuaagggggcggccgcugccgacgaaggacugcucacagugcgcaaagcccugacggagcuuaagcuggacaaggauggcgaaaucaaagacuacuacaugccuuccagcgauacccuccuguaugaggcucugaaggcccagcuuagacgguucgggggcgacggcaaaaaggcguuugcugagcccuucuacaaaccgaaggccgauggaacaccugggccccugguccgcaaagugaagaccacagaaaaggccacccucacgguucccgugcauggaggcgcugccucuaaugacaccauggucagaguggauguuuuucuggugccuggggacggauauuacugggucccgguguauacagcggauacccucaaacccgagcugccuaaccgggcuguugugcagggcaagcccuacuccgaauggaaagagaugcgcgaagaggacuucaucuuuagccuuuauccuaaugaucuggucuacguggagcacaagucuggccucaaauucacacugcagaacgccgacuccacccuggaaaagacgagaacacaaaccagcgccuuugcuuacuucgugucugggagcauuuccacagccagcaucaccauucggacccacgauaaugcuuauggaauccccucucuuggcgucaagacacugaaaacguuucauaaguaccagguugacgugcucgggaacguguucccuguccacaaagagaccagacagaaguuucgcuga

SEQ ID NO: 3883 - RNA, 3255 nt, Artificial Sequence
  Cas9 variant
augagacugggccucgacaucgggaccaacagcauuggaugguggcuguacggcacagaagggggacggaucacggagguggucgauggcgggguucgcauuuucuccgacggaagagauccccagucuaaggccagccuugcuguggaccggcgcgccgcgagaucccaacggcgcagacgggaucgcuaucugagacggaaagcugcccucaugaagcgcauggcccaggugggccugaugccugcugacccggccgaggcuaaaguccuugaagugcugaaucccuacgagcucagagccucuggccuggaugggccucugccccucacccacuuuggacgggcgcuguuccaucuuaaccagcgcagaggcuuuaagagcaaucggaaaacagacagaggggauaacgaauccggaaagaucaaggacgccaccgcucgccuggaucaggccaugauggcuaaaggcgcccggacauauggggaguuccuccacaugagacgcgcggccgcucuggacccuaagucuguucccagcgugcggaccagacuuacagucgcccgccgggaugacgcugagaaagaagaggccggauacgacuuuuauccugauagaaagcaucuguccgaagaguucgacaaacucugggccgcucaagcgcgccacgccccggaugugcugaccgaggaccugcgggaugaaauugcuacgaucaucuuucaucagagaccccucaagaccccugagguuggccugugccuuuucacaggccagcacggggugcccgaacgcgacaagcggauuccuagcgcccacccccugaaucagagacggauccucauggagaccgucaacaaucugaaaguggccgcucaaggagaaccgucucgcccucuuacaagagaggagcgggaucagauugugcaugcccuggacaacaagaaacacaccaagucccucagcggcaugacgaugaaacugaaggcgcuggggaaagucaucaagcucagacccgaacagggauuuacacuggagaccgcuaaucgcgaugccauugccugugacccuguucgggcuucucuuucccaucccgauagauucggcgcccgcuggagcacacuggaaucugcugggcagugggacguggugcaaagaauccgggccguccaguccgacgcggagcacgccgaucucgugggauggcugauggacguucacggccuugaucgcgaccaugcugaagagaccgccaacgcuccccugccugagggcuacgggagacucggacugaccgccacaacgcggauucuggcggcccucgaagcugaugugcugaauuauagcgccgcugucgccgccugcggcuggcaccauuccgacgggcgcaccggagaggugcuugaaucucugccguacuacggcgagauccucgaaagacacguuauccccgggacaggcgauccuaacgacgaugacgugaagcgguauggacgcauuaccaaucccacaguccauaucggccugaaccagcugagacggcuugugaaucgcauuaucaccgucuacgggagaccugaugagauugugguugagcucgcucgggaccugaaacugagcgaagaucaaaagaaagacgugcagagagacaucaagaaaaacacggaggcggccauccgccggggaaagaagcucgaagagaugggcguccccaacacaggggcuaauagaauggugcugcgccuuugggaggaucugggagacgauguuaugacccggaacuguccguauaccggcaaaagaauuuccgccgggaugcucuuugacggcagcugcgauguggaccacauccugccuuacucucgcacacuggaugacuccuucgccaaucggacccuuugucucaaggaagcuaacagacagaaaacagauaagacgcccugggaggccuggggagaaaccgagcagugggaagcgauugcugccaaucugaaaaaccugccugccaauaaggcuuggcgcuuugcccccgacgcgauggagcgguucgagggcgaaaaggauuucagcgcuagagcccucgccgacacacaauaucugucucggaucgcucgcgccuaccuugaugcucuguaugacggggacgauggaaaaagccacgucuggguggugccuggcagacucaccgagaugcugcggcgccauugggggcugaacggaguugccgcgcuuacagacuccgauaagcagaccgucaaagccaagaauagaacggaccaccggcaucacgcuauugaugccgcugugguggccgccaccgacagaggccucaucaaacgcaucgcugauauggcgaagcgggacgaauuuaacggggccgaggaagucgcuagaucuauucccccgccuugggagggcuuccgcgaugacgugagcgcccagguuacacggaucauugugucccacagagccgaucauggacgcaucgaccccgcugccagaaagagcggccgggacucuaccuccgggcagcugcacaaugauacagcguacggaauuggccgcgacgggaccgucgugagcagaaaaccccuggcuucucucuccccuaacgauaucguugugacgaagcggggagccaauauucgcgacgucgaucugcaaaaacaucuugccagagugacacacggccuggacgggaaggcuuuugaggccgcgcuccuggcuuucgccgccagcccgauccugcccgauaacaccgacaauccuuacuuuggccuucggcgcguuagacucgaagagacacugcaggaauccgcucggguggaggucgccgaucaggaaggaagacccuauaaggcuuacaagggcgacucuaaccauugcuaugagaucuggugucugccugaugggaaaauuaagccccagguggugaccaccuacgaggcccaccaaagcggagcggaaaagaaaccucaccccgccgcuaagcgccucaugcggaucuucaaaagagacauggucaugcuggagcgcgauggcgaaacaauuaucggguauguucagaagaugaaacagaacggauccauuuuuguggccccgcauacggaggcuaaugccgacgcccgggacagagauccuaaggacgauuucaaacuuauccagcugggcgcuggcucucucgugaaagcgaaggcccggcgcgucaucguggacgagauggggagacugcgggaucccggaccuccccuguga

SEQ ID NO: 3884 - RNA, 3258 nt, Artificial Sequence
  Cas9 variant
auggacaagggcaccaacagcaucgggugggccgcucugagacucgaugagcagggagaacccgugggcauuaucgaggccgggguccggauuuacgcggacggacgcgaaccuaaauccggcacaucucuggcugaggggagacggaucgcccgcggaaugagcagacggcgcgauagauauaagcggcgcagacggacgguucuuaauacccugacagaguucggccucaugccggccaccaaagcugcccgcaaggcucugguggccgagacaaacgacagacgguuuggcgagguggcguccaaugucuacgcccuucgcgcuagagcccuggaugaaaaacucccccuguaucaacuggggcgggcucucuuccaccugaaccagagacgcggauuuaagucuaaucggaagaccgacaaaagagauaacgaccagggcaagauugccagcgcgaucucccgccuugggcggaaacuggaugaggccggagcuagaacacucggcgaguuccugcauaagcagcacgccgcugggaaaugggugcgcguucggccuucuagagugcccggagaagacgauaaggaggaagacggcuacggcuuuuauccugagcgcagcuuccuugaacgggaguuugccgccaucugggaagcucaagcggccuucuaccccgagcugcucaccgaggaaagacgcgaucaucugcacugggucauguuuuuccagcggccucugaagagaccgacgguggggaaaugcuccuuucaucccgacgaggaccggcucccuaaggcucacccccuguuccaggaauuucgccuuauuaaagagcugaaugaacucgagguugugcacagaggagaucggagagagaagcugaccccugaccagcgcgaucggcuuuucaaccaacugagaacacagcgcagcucugccuucaccgcccucagaaaaacaaucaaggcucccaccggcacgcgguuuaauaaagaauccgacgcccgcgauaagcugaagggggacgaggucgcggcugaaaugagccauaaagauagauucggacaggccuggauuggcaugccgcuggccgagcggugggcugugguggccaugcuccuggacacagaagauccucuugaggucaaggcuuggcuggaggaacgcuauggguuugccgcggacagaaucgaugccauugcugccgcuaaacuccccaccggauacggccggcugggcgagacagcccuucgcgacaugcuggacgaacucagaaacgggaccguuaaggaugacgcgggacgggauguggugcugaccgagcgccaggccauggacaauaucuggggcgauaacccugcucugcaaagagccgucacagacgcucgggagcucccucccuaccaggaagugcuggggagacgcauucccccgggaacgggcaaacccgccgauccuuaugacguucagaaggggcggcuuaccaaucccacagugcacaucggccugaaccaacucaagagaaucgucaaugugcugaugcgccggcauggaagaccugagcagauugcccuggaacuugcucgcgaucucaaacugaacgaggaacagaaggcggagaaaaaccgggagaucgccagaaauaccaaggcugccgaagcccgcggcaaaaagcuggaggaacucgggcacgcuaacaauggauacaaccggguucugcuuaagcugugggaggaccucaaucugaaacagcccgaaaacagagaguguauuuauugcggcaaggccaucgggauuggaacacugcuuucuaaucaaguggauaucgaccacauccucccgugguccaaaacccuggaugacagccaggcgaaccggauugucugucauguggagugcaaucgccagaagggcaaccacgcuccugccgaagucccccaguggcaugacagauacgaugacauccuggcccgggcugagcgccucccuagaaauaaagccuggcgguucgggagagaagcgaugaagaaguuuaaagaugacgagucuuuccuggcucgccaacuuacggauacacaguaucugucccggcucgcccacgaauaccugggcgcccuguaucccgacgaggagccugaugaauggggaggccccgcuagacgcaaccaugugcggguuauuccggggagaaugaccgagaugcuucgccggcaguggggacucaaugccaucauuagcgaccacaaccagaagaauagaaacgaucaccgccaucacgcuaucgacgccaucguggucggcgugaccacaagacggcugcugcaacgcauugcgaccguugccgggggaagagaagcucucgcccuggaggagacaaucggcaaaauugaaccucccuggcccggguuuuacgaugacgugaaggcugccaucgaucggauugucgugucccauaaaccugaccacggcucucuuccgaagcccggaaaaccuggccgcacggccgggcagcugcacaacgacaccgcuuacggauucacaggcgaggcgagaaauggggugcccaucaugguucaucgggucccuuuugccagccucaccgaaaaggauauucccuccaucagagaccgccagcuggcugaugcccuguaugccgcuaucagcggaauuucuggcaaggccgagcuugcggcugcccucgcccgguucuccgaaagcgggccuuacaaaggcaucagacacgugcgcguggucgagcccgugucuguuauugcuaucaaggaccaggccggaaaagcguauaagggcuacaaaggggaugcuaacuaucgguacgacgugugggagcugccgaauggaaaguggacacaugaagucgugagcauguuuaacgcccacagaccugauuggcaauccgagauucggucuaagaaucccgccgcucgcaaaguucugagccuccaucagaacgacaugguggccuaugaacacccucaggauggcuacaccaucgggagagucgugaaguucuccgcuggaggccaaauggcccuggcgggcaaucgggaagggggagcccuuaaaagccgcgacgcugaucccgaagacagauuucgguacuucuauaagucuggcggggccaugcgcgacguucagcugagacaggugcgggucgaugagacgggacgcguguucgacccgggcccucaggauagagagucccggaacgcuagaaaacaaaaugacgccggguga

SEQ ID NO: 3885 - RNA, 3264 nt, Artificial Sequence
  Cas9 variant
augagauacaagaucggccuggacauugggaucaccagcgugggaugggccgucaugaaccucgauauuccccggaucgaggaccugggcguucgcauuuucgauagagcugaaaauccucagacaggggagucccuugcccugccgcggcgccucgcgagaucugcucggcgcagacugcggcgcagaaaacaccggcuugaacgcaucagacggcuggugauccgcgagggcauucucacgaaggaggaacuggacaaacuguuugaggaaaagcaugagaucgauguguggcaacucagagucgaagcccuggaccggaaacuuaacaaugaugagcuggccagagugcuccugcaccuugcuaagcgccggggauucaagagcaacagaaaauccgagcgcucuaauaaggaaaacagcaccaugcugaaacauauugaggaaaaucgggccauccucuccucuuauagaacaguuggggagaugauugugaaggaccccaaauuugcucugcacaagcgcaacaagggagaaaauuacaccaacacaaucgcccgggaugaccuggagagagagauucgccucaucuucagcaaacagcgggaauuuggcaauauguccugcaccgaggaguucgaaaacgaauauaucacaauuugggcgagccagagaccugucgccucuaaggaugacaucgagaaaaaggugggcuuuuguaccuucgagcccaaagaaaagcgcgcuccuaaagccacguacaccuuucaguccuucauugcuugggagcauaucaauaagcugcggcuuauuagccccucuggggccagaggacugacagaugaggaacggcgccuccuguaugaacaagcguuucagaagaacaaaaucaccuaccacgacaucagaacacuucugcaccucccugacgauaccuauuucaagggcauuguuuacgacagaggggaguccagaaaacagaaugagaacauccgcuuucuggaacuggaugccuaccaucagauucggaaggcuguggacaaagucuauggaaagggcaagucuagcuccuuccucccgaucgauuucgacacguuuggguacgcccugacacuuuucaaagaugacgcugauauucacagcuaucugagaaacgaguacgaacaaaauggaaagcgcaugcccaaccucgccaauaaaguguaugacaacgagcugaucgaggaacuucugaaucucuccuuuaccaaguucggccaucugucucugaaagcccucagaagcauccugccuuacauggagcagggcgaaguguauuccagcgcuugcgagcgggcgggguacacauuuaccggacccaagaagaaacagaagaccaugcuucugccuaacauucccccgaucgccaauccugucguuaugcgcgcucucacacaggccagaaaaguggugaacgccauuaucaagaaauacggcucucccgucuccauucacaucgaacuggcucgggaucugagccaaacguucgacgagcgcagaaagaccaagaaagagcaggacgaaaaucggaagaaaaacgagacagccauucgccagcuuauggaauaugggcucacccugaauccuacaggacacgauaucgugaaguuuaaacuguggucugagcaaaacggcagaugugcguacagccuccagcccaucgaaauugagcggcugcuugagcccggguauguugaaguggaccaugucaucccuuacucccgcucucuggaugacagcuauaccaauaaggugcucguucugacgagagagaaccgggaaaaaggaaaucggauuccggcugaguaccugggcgugggcacagaacgcuggcagcaguucgagaccuuuguccuuaccaacaagcaauucuccaagaaaaagcgggauagacuccugcgccugcacuaugacgagaacgaagagacagaauuuaaaaaucggaaccucaaugauaccagauacaucagccgcuucuuugccaacuucauucgggagcaucugaaguucgccgagucugacgauaaacagaagguguacacagucaaugggagagugacggcucaccuucgcucccggugggaauuuaacaagaauagagaggaaagcgaccugcaucacgccguugaugcugugaucgucgccugcaccacacccucugacaucgcgaaagugaccgccuucuaucagcggcgcgagcagaacaaggaacucgcuaaaaagaaagagccucacuuuccccaaccuuggccccauuucgccgaugagcugagagcucggcuguccaagcacccgaaggaaagcauuaaagcccuuaaucucggaaacuacgacgaccagaagcuggagucccugcagccuguuuuugugucucgcaugcccaaaagaagcgucacaggcgcggcccaucaggaaacccuccggagauauguggggaucgaugagcgcuccggaaagauucaaacggugguuaaaaccaagcugucugaaaucaaacuugacgcuagcggccacuucccuauguacgggaaagaguccgauccccggacauaugaggccauuagacagcgccugcucgaacacaauaacgacccuaagaaggcuuuucaggagccccuguacaagccgaaaaagaauggcgaaccuggacccgucauccggaccgugaaaaucauugauacaaagaaccaggugaucccccugaaugacggcaagaccgucgccuauaacagcaacauugugagaguugauguguucgagaaagacgggaaguacuacugugucccuguguauacgauggauaucaugaaaggcauucuuccgaauaaggccaucgaacccaacaaaccuuacucugaguggaaggagaugacagaagacuauaccuuucgcuucucccucuaccccaaugaucugauccggauugagcugccuagagaaaagacaguuaaaaccgcugcgggagaggagaucaacgugaaggacgucuuuguguauuacaaaaccauugauagcgccaaugggggacucgaacugaucucucaugaccaccgcuucucccuuagaggcguugggagccggacacugaagcgcuuugagaaauaucaaguggacguccucggcaacauuuacaaggugagaggagaaaagcgggugggccuggcuucuagcgcccauuccaaacccgggaagacgauccgcccucugcagagcaccagagauuga

SEQ ID NO: 3886 - RNA, 3264 nt, Artificial Sequence
  Cas9 variant
augcugagaaugaaguacgccaucggccucgacauugggaucgcuagcgugggauaugccguccuggcgcuugaucacgaggaaaaccccuggggcauuauccggcuggggucccgcauuuucgacguugcugagaauccuaaagauggagccucucucgcccugccgagacgggaagcucgcagcgugagacggcgccuuagacggcaucaccaucgccuggagagaaucaagaaccuccugaucaauaccgaauuuauuacaaaagacgagcugcuccaccuguacgauggcaaccuuuccgacguguaugagcugcgggucaaggcccucgauuacucugugacgaaugcugaacugacccgcauccuucugcaucucgcccagagacggggguucaaaagcaaccgcaaguccgacgcgaaugauaaggaggccggacaacugcuggaagcuguuucugccaacgcuaaaagaaugcaggagaaucacuaucggacagugggcgagauguuuuacaaggacgaucucuucagcaaauauaagagaaacaaaggcgggaccuaccugacaaccguccaccgcgacaugauugccgcggaagcccggacaauccuugagaagcaguuugcucugggaaauaacauuugcacccaggauuucaucgacaaguaccucuccauucugcuuagccaaagacaguuugacgaaggccccggggagccuucucccuaugccggaaaucagaucgcuaacaugaucggcaaauguacguucgaaccuaaugaguaccgcgccgccaaggcuuccuauagcuuugagcgguucaaccugcuccagaaagugaaccaucugagacugcuccuggaagggaagucuauugcgcuugauaaugagcaacgcaaaaagaucauugcccuggcucacgacaaagccgaucuccgguacucccauaucagaaaggcccugggacuugacgaaaagguucuguuuaacaccauuacauauaaugaugacgugagcgucaucgagaaaaagaccaaauucaacuuucuccaggcuuaccaccagaucaagaaagugcuggccgaagauaugcagaagcugacaaccgagcaacucgacaauauuggccagauccugucuacguauaaguccgauaacaaacgcacagaggaacuuagcgcgcugggccucgagaagaaaauuaucgacgcucugcuggggauuaauggacuuuccaaguucgcccaccucucucugaaagcccugcggaagaucaaccccuaccucgaagagggcaagaucuacaaugaggcuugcaccgccgcuggguaugauuucaaagcccaugcgaacacacagaagaccgagcugcuuccugccuacaaagaggaaauggacgacauuaccagcccgguggcuagacgcgccaucgcucaauccauuaaggucaucaaugccauuauccgggagcagaaaggaagcccccuguauauuaacaucgaacucgcgagagagauggccaagggcuuugaugagcggacacagaucgacaaggcuaauaaagaaaaccaggccaagaaugagcgcauuauggaaagaauccggacggaguuccacaaagcuaacccuaccgggauggaucugauuaagcugaaacuuugggaagaacaagacggaagaucucccuacucccagaaggccaucagcauuaaccgccucuuugagccuggcuauguugauaucgaccauaucgugcccuacucuauuagcuucgaugacuccuuuaaaaauaaggugcuggucuucucugaugaaaaccgggacaagggcaauagacugccgaucgccuaucuccagagcaaauuuggggcuaaggcggccgagaacuucaugauuugggugcaguccaauaucaaagauuacaagaaacgccaaaagcugcuuaagagagaaauuacagaggaagacaucaacaaauuuaaggagcggaaucugcaggauaccaaaacaaucagccgcuuccucuacaacuauauuaaugacuaccugcuguuugcuccuucugacaccggaaagaaaaagagaguuacggccgugaacggcacaaucaccgccuaucuucggaagcgcugggggauuaauaaaaucagagcuaacggagauaagcaccaugccgucgacgcggugguuauugcuuguaccacagauaaaaugaucaaggaccucuccagcuucucucgguaccacgagcuggaauauacccacacagauacggaguccuuucuggugaauagccucaccggcgaaauccugaaacgcuuccccuacccuugggaggacuucagacccgaacuuauggcccggcuguccgauaaccccgccgacgcucuccgcaagcugaaucugaucuuuuaucaugggauugaucuuucuacaauuaagccuaucuucgucagcagaaugccgcggcacaaagugaccggcgccgcgcauaaggcuacaauuaaauccgccagaugccucgacaacggaaucgucauuuguaagaccucucugcagaaccugaaacucgauaaggagggcgagaucgccaauuacuacgcucccgaaagcgacacgauccuguauaacgcccuuaaagagcgccugcgguccuacgauaauaagccugcuaaggccuuugcggaacccuucuauaaaccuaaggccgacgggacccccggaccgcucgugaaaaagguuaaaguguacgagaagucuacacugaacgucgcugugcagcaaaauaccgccguugcugacaacgauucuauggugagagucgacguguuucacgugaagggcaauggguauuaccugguuccuauuuauaucgccgauacacuuaaaaaggagcugcccaacaaagccauugucgcuuacaagccuuacgcggacuggcccgugauggaugacuccaauuucaucuuuagccucuauccuaacgaucugauuaaauucgaacacaagaauagcgugaaguuugccaaagucaacaaggaguccacccucaaugacuucuacagcacgaaaucugaaaucguguauuuuaagggaugcaacaucaauacaggcgcuauuaccaucauuaaccaugagaacacauacguugugagcucccugggggucaaaacccuucccagccuggaaaaguaucaggccgaugugcucggcaauuacaccaagguuaaaaaggaggugcgcaaaccguuccgguga

SEQ ID NO: 3887 - RNA, 3264 nt, Artificial Sequence
  Cas9 variant
augagauacaagaucggccuggacauugggaucaccagcgugggaugggccgucauuaaccucgauaucccccggauugaggaccugggcguucgcaucuucgauagagcugaaaauccucagacaggggagucccuugcccugccgcggcgccucgcgagaucugcucggcgcagacugcggcgcagaaaacaccggcuugaacgcaucagacggcugauuauccgcgagggcauucucacgaaggaagaacuggacaaacuguuugaggaaaagcaugagaucgauguguggcaacucagaguggaagcccuggaccggaaacuuaacaaugaugagcuggccagaguccuccugcaccuugcuaagcgccggggauucaagagcaacagaaaauccgagcgcucuaauaaggaaaacagcaccaugcugaaacauauugaggaaaaucgggccauccucuccucuuauagaacagugggggagaugauuguuaaggaccccaaauuugcucugcacaagcgcaacaagggagaaaauuacaccaacacaaucgcccgggaugaccuggagagagagauccgccucauuuucagcaaacagcgggaauuuggcaauauguccugcaccgaggaguucgagaacgaauauaucgcgauuugggccagccagagaccuguggcuucuaaggaugacaucgagaaaaaggucggcuuuuguacauucgagcccaaagaaaagcgcgccccuaaagcuaccuacacguuucaguccuucauugccugggagcauaucaauaagcugcggcuuaucagccccucugggaccagaggacugacagaugaggaacggcgccuccuguaugaacaagcguuucagaagaacaaaauuaccuaccacgacaucagaacacuucugcaccucccugacgauaccuauuucaagggcauuguguacgacagaggggaguccagaaaacagaaugagaacauccgcuuucuggaacuggaugccuaccaucagauucggaaggcuguugacaaaguguauggaaagggcaagucuagcuccuuccucccgaucgauuucgacacguuuggguacgcccugacacuuuucaaagaugacgcugauaucagaagcuaucugcgcaacgaguacgaacaaaauggaaagagaaugcccaaccucgccaauaaagucuaugacaacgagcugauugaggaacuucugaaucucuccuuuaccaaguucggccaccugucucugaaagcccuccggagcauccugccuuacauggagcagggcgaaguguauuccagcgcuugcgagcgcgcgggguacacauuuaccggacccaagaagaaacagaagaccaugcuucugccuaacauucccccgaucgccaauccuguggucaugagagcucucacacaggcccggaaaguugugaacgccauuaucaagaaauacggcucucccguguccauucauaucgaacuggcucgcgaucugagccaaacguucgacgagagacggaagaccaagaaagagcaggacgaaaaucgcaagaaaaacgagacagccaucagacagcuuauggaauaugggcucacccugaauccuacaggacacgauauugucaaguuuaaacuguggucugagcaaaacggccggugugcguacagccuccagcccaucgaaauugagcgccugcuugagcccggguauaccgaaguggaccacguuaucccuuacuccagaucucuggaugacagcuauacgaauaaggugcucguccugacaaaagagaaccgggaaaagggaaaucggauuccggcugaguaccugggcgugggcaccgaacgcuggcagcaguucgagaccuuuguucuuacaaacaagcaauucuccaaaaagaaacgggauagacuccugcgccugcauuaugacgagaacgaagagaccgaauuuaagaaucggaaccucaaugauacaagauacaucagccgcuucuuugccaacuucauccgggagcaccugaaauucgccgagucugacgauaagcagaagguguacacggucaaugggagagugaccgcucaucuucgcucccggugggaauuuaacaaaaauagagaggaaagcgaccugcaccaugccgucgaugcugugauuguugccugcacaacccccucugacaucgcgaaggugacagccuucuaucagcggcgcgagcagaacaaagaacucgcuaagaaaaccgagccucacuuuccccaaccuuggccccacuucgccgaugagcugagagcucggcuguccaagcauccgaaggaaagcauuaaagcccuuaaucucggaaacuacgacgaccagaagcuggagucccugcagccugucuuugugucucgcaugcccaaaagaagcguuacgggcgcggcccaccaggaaacccuccggagauauguggggaucgaugagcgcuccggaaagauucaaacagucgugaaaaccaagcugucugaaaucaaacuugacgcuagcggccauuucccuauguacgggaaagaguccgauccccggacauaugaggccaucagacagcgccugcucgaacacaauaacgacccuaagaaggcuuuucaggagccccuguacaagccgaaaaagaauggcgaaccuggacccgugauucggaccguuaaaaucauugauacgaagaaccaggucaucccccugaaugacggcaagacaguggccuauaacagcaacauugugagagucgauguguucgagaaagacgggaaguacuacuguguuccuguguauaccauggauaucaugaaaggaauccuuccgaauaaggccauugaacccaacaaaccuuacucugaguggaaggagaugacagaagacuauaccuuucgcuucucccucuaccccaaugaucugauccggauugagcugccuagagaaaagaucauuaaaaccgcuggcggggaggagaucaagauuaaagaccucuuugcguauuacaagacaauccacagcggaacggccggccuggaacuugucucucaugauugcuccuucagccugucuggggugggcagccgcacccucaaaagauuugagaaguaucaaguugacgugcugggaaacaucuacaagguccggggcgaaaaacgcguggggcuggcuuccagcgcccacucuaagacaggagagaccauuagaccccuucaguccacacgggacuga

SEQ ID NO: 3888 - RNA, 3264 nt, Artificial Sequence
  Cas9 variant
augagauacaagaucggccuggacauugggaucaccagcgugggaugggccgucauuaaccucgaucugccccggaucgaggaccuuggcguucgcauuuucgauagagcugaaaauccucagacaggggagucccuggcccucccgcggcgccuggcgagaucugcucggcgcagacuucggcgcagacggcaccgccuggaaagaauccggcgccuccugacgagagagaacgugcugacccaagaggaacucgacaaacuguuugagaagaaacaugaaaucgauguguggcagcuucgggucgaggcccuggacagaaagcucaauaacgaugaacuggcccgcgugcuucugcaccucgcuaaacggagaggauucaagagcaaucgcaaguccgagcggucuaacaaagagaauagcacaaugcugaagcauauugaagagaacagauccauccugaccggcuaucgcacaguuggggaaaugauugugcgggaccccaaauuuguccuccacaagagaaauaaaggagagaacuacaccaauacaaucgcccgcgaugaccuggaacgggagauucagcuuaucuucgcuagacagcgcgaguuuggcaacaugauuugcaccgaagccuucgagaaugaauauaucgcgaucuggucuagccaacggccuguggccuccaaggaugacauugagaagaaaguuggcuuuuguacguucgaacccaaggagaaaagagcuccuaaggccaccuacacauuucagagcuucaucgcuugggagcauauuaacaaacugcggcucgugucucccuccgggacccgcgaacugacagaugaggaaagacggcuucuguaugagcaggccuuucagaagaauaaacucaccuaccacgacaucagaacgcugcugcaccucccugacgauacauauuucaagggaauugucuacgacuggggcgaaccgcugaagcaaaacgagaacauccgcuuucuugagcuggaugcguaccaucagauccggaaaaccguggacaagguguaugggagaggaaaaucuagcuccuuccuccccauugauuucgacacauuuggcuacgcccugacccuuuucaaggaugacgcucacauccgcagcuaucugagaaaugaauacgagcagaacgggaaacggauugccaaucucgcuaacaaggucuaugauaaugaacugaucgaggagcugcucaaccugucuuuuaccaaguucggacaucuuucccugaaagcccuccgcaauauucugccuuacauggaacagggcgagguuuauagcuccgccugcgaaagagcuggcuacacauuuacggggcccaccaagaaacaaaagacagugcugcuuccuaccauucccccgaucgcgaacccuguggucaugcgggcccucacacaggcucgcaaagugguuaaugccaucaucaagaaguacggaucucccgugagcauucacaucgagcuggccagagaccugucccagaccuucgaugaacggaaaaagacgaaaaaggagcaagacgagaaccgcaaaagaaaugaaacagcuauucggcagcucaucgaguauggccugacccgcaacccuaccgggcacgacauugucaaguuuaagcuguggagcgaacagaauggaagaugugccuacucucugcagcccaucgagaucaaacggcuccuggaacccggcuauguggagguugaucaugugauuccuuacuccagaagccuggacgauucuuauacaaacaagguccuugugcucaccaaagagaaucgcgaaaaggggaaccggaucccggcggaguaccugggagucggcacagaaagauggcaacaguucgagacguuugugcugaccaacaaacaguucagcaagaaaaagcgcgaccggcuccugagacuucacuaugaugaaaaugaggaggcugaauggaagaaccgcucccugaaugacacacgguacauuucuagauuuuucgccaacuuuauccgcgagcaucucaaauucgccgauagcgacgauaagcagaaaguuuacaccgugaauggcggggucacagcucaccuucgguccagaugggacuucaacaagaaucgggaagagagcgaucugcaucacgccguggacgcugccauuguugcgugcaccacgcuuucugauaucgcccgcgugaccgcuuuuuaucaaagacgggagcaggccaaagaacucgcuaagaagacagagccccacuucccucagcccuggccucauuuugccgacgaacugcgcgcgagacuguccaaaaaccccaaggagagcaucaaagcccucaaucugggaaacuacgacaaugaaaaacuugagucucugcagccggucuucgugucccggaugccuaagagaagcgugaccggcgcugcccaccaagagacacuccgccgguauauugggaucgaugaaagauccggaaagauucagaccguugucaagacgaaacugucugagaucaagcuggacgcuagcggccauuuucccauguacgggaaagaauccgauccucgcacauaugaggccauucggcuuagacuccuggaacacaacaaugacccccgcaaggccuuccaggagccucuguacaaacccaagaagaacggcgagcucggaccgaucauccggaccgugaaaauuaucgauacaaagaaucaggugauuccucugaacgacggcaaaaccgucgcuuauaacucuaauaucgugagaguugauguguuugaaaaggacgggaaauacuacuguguccccguguauaccauggauauuaugaagaaaguucuucccaacaaggcgaucgagccuaauaagccguacagcgaauggaaagagaugacagaagacuauacguuccgcuuuucccuguaccccaacgaucucaucagaauugagcugccucgggagaagaccgugaaaacaaccgccggacacgaaaucaauauuaaggacgucuucguguauuacaaaacaaucgauagcgcuaccggcgggcuggagcuuauuucucaugacaacuccuuuagccugcgcggaaucggcucuagaacgcucaagcgguucgaaaaguaucaaguugacgugcuggggaauauuuacaaaguccgcggcgagaagagagugggacucgccuccagcgcccaccccgagacacgggaaaccaucagaccucugcagucuacccgcgauuga

SEQ ID NO: 3889 - RNA, 3264 nt, Artificial Sequence
  Cas9 variant
augaagaaacuggugcucggccuggacaucggggucgccagcguuggauggggcauuaucgaugcugagaacggggacgugguggauaccggagucagacuuuucuccucucgggacgccagcgaaaaugagucccgcagaacaucucggcagagccgcagacugucccggcgcaagaaacacagacgggaacgcauuaagcaacuccugcuugcgcaugauauggacaucugcgauauugugaacgagaaucccuacgaacugagaguuaaaggccucaacgagaagcuggaggugucugaaaucuaugucgcucugacgcaccucgccaagcggcgcggggugagcuaccuggacgauguuguggaggaaggaggcaccaucaaauccgagcaucuuaauaagaacauggaggaaauuaaaagcggcaagaugccuugugagauccagcuggaaagauuugagaaauaugggcagguccggggaaugauugaaaucaaucaggacacagaggagucuuccuuccucgugaacauuuuucgcaccagcgauuacaucaaggaagccaagacaauucuggcuacccaacagaaauuccacaagcagaucacaaaugaguuuaucgacgaauauauucauaucauggccucuaaaagagauuacuucauuggcccggggaacgagaagucccggaccgacuauggaguguacagaacgaauggcgacaccugggauaaccuuuuugaaauccugauugggaaaugcagcgucuuccccgaggagacacgcgcugcccggucuuccuacguugcgcaggaauuuaaucuccugaacgaccugaauaaccucaagaucagcaaccuggaguccggaaaacuuucugccagccaaaagcacgauaucguggaaaaggugaaaaauuccaagaaauucggcaccaaggaccugcucaaauauauugcuagcgucugugagugcaagaucgaagauauuggcggguguagaguggacaagaaccgcaaaccuaucaugcacacauuugagaauuaccggaagguucauaacgcccugaaugaggcuggaguggaucuuagacugucugaaaccgacuaugaugagcucaugaaaauuaugacgcugaacuccgaaacacuggagaucaagaaacagugcaaggagaagcucccccagcugaccgaagacuaccuuaaugucugucuggugcucaacaaaaagggcgccuucagcggguggcacgcgcugucucuuaaagccaugaagcugaugaugccugagcucuauggaacaagcaaaaaucagaugcaaaucauucauaccaugcagcugggcaaggcuuaccugaagccccucaaccagcaaaaauaucuuaauuccgaagccauccuugaggaaauuuacaacccuaucgcugcccgcucuauucggcagaccaucaagguuacaaaugccauucugaaaaaguacgggcaccucgauagcgugaucaucgagaugccgagagacuaucagacguccgaggacgaacgcaaaaugauugagaagaugcagaaagaaaacgagaaggaaaagaaagcugcgcugaagcgggccagagaggaguaccccuuuccugaugaggcuuuccgcaaucacaaagaacuggccaccaagcugcggcucugguaucaacaggaccaguucugcgucuacagcggaagaaaaaucucuguggucgaucuggugcggaaccccaaccaguuugaaauugaccauaucauuccucaauccguuagccuggaugacucucucaauaacaaggugcuguguuucuccgaggaaaaucagaagaaaggccagcagacacccuuuuauuaccacaagggcaaaagcgggaacuggaccuaugagcaauacaaacuuuucgucgagaaacuguuugauaagaagaaaaucuccaauaagaaacgcgaacuccugcuguucgaggaagacaucaacaagugggaugugagacggggauuuauugccagaaaucuuguugacacacgcuacgcuucucgggugauccucaacagcuaucagcaguacuucggcaaucaugagauggggaccaaagucaagguggugagaggaaaguuuacgucccagcugcgcaaaaaguggagaauuuucaaagaucggaacgagucucacagccaucacgccaucgacgcgcugauuguugcugccacagccaaucuccgccuguggaagaaaaacacccuuggcgucuccgaugaagggaagguguaugacaaagagaccggcgaaauccugccguuugagaagcucacagaaagcgaguacaaugagaugaugaacaaggaaccuuaucugaauuucaaaaccaagcugcaaaacaucgagacaaaagugaaguacucuuauagagucuccaaaaaggugaaccggaagauuagcgacgcuacgaucuacucuacccgcgaaagagauggaauugacuacaucguuggcaaaauuaagaauaucuaugaugugaaaacauacaaggaccaguuucuuaaacgguauaagaagaacaaagagcaguuccucauguaccaacacgauccccagaccuucgccauccuggaaaauauuauggcuacauaucaggacgccgagaacccuuuucuggcguacaagaaagaguauggggucauccgcaaguacuccaaaaagggaggcgggagccccgugaccucucucaaguucauugauaaaguucugggacagaagaucgaccuuacggccaaaaaucaagcugcccugcccaagaacaaaaaggugguccuccagagcauuaccccuuacagagcugauguguauuacgacgaaaucgauaagcgguaucaucugauuggcguuaaauacucccuguuuagcuucucuaagcagggguaugugaucaauccgaucgccuaccagaaacuucucgagaaggaacaaauucacuccgagaugaaauuuugcuucagccuguaucgcgaagacaucauugaguuuggcgaggaucccgacucccugacaagauaccgguucuggucuaagaacgaaagcggaaagaauaagaucgaggucaagccuauugaaaaacccaacuuugagaagcagaccgugcucacaaucaccaaaaagaucaaaauucugaauaaguaccagacggacgugcuuggcaacuccuucaaggcgcaggaggaaaaagauccuagaaauaucgaguga

SEQ ID NO: 3890 - RNA, 3264 nt, Artificial Sequence
  Cas9 variant
augagauacaagaucggccuggacauugggaucaccagcgugggaugggccgucaugaaccucgauauuccccggaucgaggaccugggcguucgcauuuucgauagagcugaaaauccucagacaggggagucccuugcccugccgcggcgccucgcgagaucugcucggcgcagacugcggcgcagaaaacaccggcuugaacgcaucagacggcuggugauccgcgagggcauucucacgaaggaagaacuggacaaacuguuugaggaaaagcaugagaucgauguguggcaacucagagucgaagcccuggaccggaaacuuaacaaugaugagcuggccagagugcuccugcaccuugcuaagcgccggggauucaagagcaacagaaaauccgagcgcucuaauaaggaaaacagcaccaugcugaaacauauugaggaaaaucgggccauccucuccucuuauagaacaguuggggagaugauugugaaggaccccaaauuugcucugcacaagcgcaacaagggagaaaauuacaccaacacaaucgcccgggaugaccuggagagagagauucgccucaucuucagcaaacagcgggaauuuggcaauauguccugcaccgaggaguucgagaacgaauauaucacaauuugggcgagccagagaccugucgccucuaaggaugacaucgagaaaaaggugggcuuuuguaccuucgagcccaaagaaaagcgcgcuccuaaagccacguacaccuuucaguccuucauugcuugggagcauaucaauaagcugcggcuuauuagccccucuggggccagaggacugacagaugaggaacggcgccuccuguaugaacaagcguuucagaagaacaaaaucaccuaccacgacaucagaacacuucugcaccucccugacgauaccuauuucaagggcauuguuuacgacagaggggaguccagaaaacagaaugagaacauccgcuuucuggaacuggaugccuaccaucagauucggaaggcuguggacaaagucuauggaaagggcaagucuagcuccuuccucccgaucgauuucgacacguuuggguacgcccugacacuuuucaaagaugacgcugauauucacagcuaucugagaaacgaguacgaacaaaauggaaagcgcaugcccaaccucgccaauaaaguguaugacaacgagcugaucgaggaacuucugaaucucuccuuuaccaaguucggccaucugucucugaaagcccucagaagcauccugccuuacauggagcagggcgaaguguauuccagcgcuugcgagcgggcgggguacacauuuaccggacccaagaagaaacagaagaccaugcuucugccuaacauucccccgaucgccaauccugucguuaugcgcgcucucacacaggccagaaaaguggugaacgccauuaucaagaaauacggcucucccgucuccauucacaucgaacuggcucgggaucugagccaaacguucgacgagcgcagaaagaccaagaaagagcaggacgaaaaucggaagaaaaacgagacagccauucgccagcuuauggaauaugggcucacccugaauccuacaggacacgauaucgugaaguuuaaacuguggucugagcaaaacggcagaugugcguacagccuccagcccaucgaaauugagcggcugcuugagcccggguauguugaaguggaccaugucaucccuuacucccgcucucuggaugacagcuauaccaauaaggugcucguucugacgagagagaaccgggaaaaaggaaaucggauuccggcugaguaccugggcgugggcacagaacgcuggcagcaguucgagaccuuuguccuuaccaacaagcaauucuccaagaaaaagcgggauagacuccugcgccugcacuaugacgagaacgaagagacagaauuuaaaaaucggaaccucaaugauaccagauacaucagccgcuucuuugccaacuucauucgggagcaucugaaguucgccgagucugacgauaaacagaagguguacacagucaaugggagagugacggcucaccuucgcucccggugggaauuuaacaagaauagagaggaaagcgaccugcaucacgccguugaugcugccaucguggcgugcaccacacccucugacaucgccaaagucaccgcuuucuaucagcggcgcgagcagaacaaggaacucgccaaaaagacagagccucacuuuccccaaccuuggccccauuucgcugaugagcugagagcccggcuguccaaacacccgaaggaaagcauuaaggcgcuuaaucucggaaacuacgacgaccagaaacuggagucccugcagccuguguuuguuucucgcaugcccaagagaagcgugaccggcgccgcucaucaggaaacgcuccggagauaugucgggaucgaugagcgcuccggaaaaauucaaaccguggugaagacaaaacugucugaaaucaaacuugacgccagcggccacuucccuauguacgggaaggaguccgauccccggaccuaugaggcuauuagacagcgccugcucgaacacaauaacgacccuaagaaggccuuucaggagccccuguacaaaccgaagaaaaauggcgaaccuggacccguuauccggacagucaagaucauugauaccaaaaaccaggugaucccccugaaugacggcaagacgguggccuauaacagcaacauugucagaguggauguuuucgagaaggacgggaaauacuacugugugccugucuauacaauggauaucaugaagggcauucuuccgaauaaagcuaucgaacccaacaagccuuacucugaguggaaagagaugaccgaagacuauacauuucgcuucucccucuaccccaaugaucugauccggauugagcugccuagagaaaagaccgugaagaccgcggccggagaggagaucaacguuaaagacguguuugucuauuacaagacaauugauagcgcuaaugggggacucgaacugaucucucaugaccaccgcuucucccuuagaggcguggggagccggacgcugaaacgcuuugagaaguaucaaguugacgugcucggcaacauuuacaaagucagaggagaaaagcgggugggccuggccucuagcgcccauuccaagaccggggagacagugcgcccccugcagagcaccagagauuga

SEQ ID NO: 3891 - RNA, 3264 nt, Artificial Sequence
  Cas9 variant
augagauacaagaucggccuggacauugggaucaccagcgugggaugggccgucaugaaccucgauauuccccggaucgaggaccugggcguucgcauuuucgauagagcugaaaauccucagacaggggagucccuugcccugccgcggcgccucgcgagaucugcucggcgcagacugcggcgcagaaaacaccggcuugaacgcaucagacggcuggugauccgcgagggcauucucacgaaggaagaacuggacaaacuguuugaggaaaagcaugagaucgauguguggcaacucagagucgaagcccuggaccggaaacuuaacaaugaugagcuggccagagugcuccugcaccuugcuaagcgccggggauucaagagcaacagaaaauccgagcgcucuaauaaggaaaacagcaccaugcugaaacauauugaggaaaaucgggccauccucuccucuuauagaacaguuggggagaugauugugaaggaccccaaauuugcucugcacaagcgcaacaagggagaaaauuacaccaacacaaucgcccgggaugaccuggagagagagauucgccucaucuucagcaaacagcgggaauuuggcaauauguccugcaccgaggaguucgagaacgaauauaucacaauuugggcgagccagagaccugucgccucuaaggaugacaucgagaaaaaggugggcuuuuguaccuucgagcccaaagaaaagcgcgcuccuaaagccacguacaccuuucaguccuucauugcuugggagcauaucaauaagcugcggcuuauuagccccucuggggccagaggacugacagaugaggaacggcgccuccuguaugaacaagcguuucagaagaacaaaaucaccuaccacgacaucagaacacuucugcaccucccugacgauaccuauuucaagggcauuguuuacgacagaggggaguccagaaaacagaaugagaacauccgcuuucuggaacuggaugccuaccaucagauucggaaggcuguggacaaagucuauggaaagggcaagucuagcuccuuccucccgaucgauuucgacacguuuggguacgcccugacacuuuucaaagaugacgcugauauucacagcuaucugagaaacgaguacgaacaaaauggaaagcgcaugcccaaccucgccaauaaaguguaugacaacgagcugaucgaggaacuucugaaucucuccuuuaccaaguucggccaucugucucugaaagcccucagaagcauccugccuuacauggagcagggcgaaguguauuccagcgcuugcgagcgggcgggguacacauuuaccggacccaagaagaaacagaagaccaugcuucugccuaacauucccccgaucgccaauccugucguuaugcgcgcucucacacaggccagaaaaguggugaacgccauuaucaagaaauacggcucucccgucuccauucacaucgaacuggcucgggaucugagccaaacguucgacgagcgcagaaagaccaagaaagagcaggacgaaaaucggaagaaaaacgagacagccauucgccagcuuauggaauaugggcucacccugaauccuacaggacacgauaucgugaaguuuaaacuguggucugagcaaaacggcagaugugcguacagccuccagcccaucgaaauugagcggcugcuugagcccggguauguugaaguggaccaugucaucccuuacucccgcucucuggaugacagcuauaccaauaaggugcucguucugacgagagagaaccgggaaaaaggaaaucggauuccggcugaguaccugggcgugggcacagaacgcuggcagcaguucgagaccuuuguccuuaccaacaagcaauucuccaagaaaaagcgggauagacuccugcgccugcacuaugacgagaacgaagagacagaauuuaaaaaucggaaccucaaugauaccagauacaucagccgcuucuuugccaacuucauucgggagcaucugaaguucgccgagucugacgauaaacagaagguguacacagucaaugggagagugacggcucaccuucgcucccggugggaauuuaacaagaauagagaggaaagcgaccugcaucacgccguugaugcugugaucgucgccugcaccacacccucugacaucgcgaaagugaccgccuucuaucagcggcgcgagcagaacaaggaacucgcuaaaaagacagagccucacuuuccccaaccuuggccccauuucgccgaugagcugagagcucggcuguccaaacacccgaaggaaagcauuaaggcccuuaaucucggaaacuacgacgaccagaaacuggagucccugcagccuguuuuugugucucgcaugcccaagagaagcgucaccggcgcggcccaucaggaaacgcuccggagauauguggggaucgaugagcgcuccggaaaaauucaaaccgugguuaagacaaaacugucugaaaucaaacuugacgcuagcggccacuucccuauguacgggaaggaguccgauccccggaccuaugaggccauuagacagcgccugcucgaacacaauaacgacccuaagaaggcuuuucaggagccccuguacaaaccgaagaaaaauggcgaaccuggacccgucauccggacagugaagaucauugauaccaaaaaccaggugaucccccugaaugacggcaagacggucgccuauaacagcaacauugugagaguugauguguucgagaaggacgggaaauacuacugugucccuguguauacaauggauaucaugaagggcauucuuccgaauaaagccaucgaacccaacaagccuuacucugaguggaaagagaugaccgaagacuauacauuucgcuucucccucuaccccaaugaucugauccggauugagcugccuagagaaaagaccguuaagaccgcugcgggagaggagaucaacgugaaagacgucuuuguguauuacaagacaauugauagcgccaaugggggacucgaacugaucucucaugaccaccgcuucucccuuagaggcguugggagccggacgcugaaacgcuuugagaaguaucaaguggacguccucggcaacauuuacaaagugagaggagaaaagcgggugggccuggcuucuagcgcccauuccaagcccgggaaaaccauccgcccucugcagagcacaagagauuga

SEQ ID NO: 3892 - RNA, 3264 nt, Artificial Sequence
  Cas9 variant
augagauacaagaucggccuggacauugggaucaccagcgugggaugggccgucauuaaccucgauaucccccggauugaggaccugggcguucgcaucuucgauagagcugaaaauccucagacaggggagucccuugcccugccgcggcgccucgcgagaucugcucggcgcagacugcggcgcagaaaacaccggcuugaacgcaucagacggcugauuauccgcgagggcauucucacgaaggaggaacuggacaaacuguuugaggaaaagcaugagaucgauguguggcaacucagaguggaagcccuggaccggaaacuuaacaaugaugagcuggccagaguccuccugcaccuugcuaagcgccggggauucaagagcaacagaaaauccgagcgcucuaauaaggaaaacagcaccaugcugaaacauauugaggaaaaucgggccauccucuccggguauagaacagugggagagaugauuguuaaggaccccaaauuugcucugcacaagcgcaacaagggcgaaaauuacaccaacacaaucgcccgggaugaccuggagcaugagaucagacucauuuucucuaaacagcgcgaauuuggcaauaugagcugcaccgagaaguucgaaaacgaguauaucacaauuugggcgucccagcggccuguggccagcaaagaugacaucgaaaagaaagucggguuuuguaccuucgagcccaaggagaaaagagcuccuaaggccacguacaccuuucagucuuucauugcuugggaacacaucaauaagcugcgccuuaucuuucccuccggagcccggggccugacagaugaggaaagacggcuccuguaugagcaagcguuccagaaaaacaagauuaccuaccacgacauccgcacacuucugcaucucccugacgauaccuauuuuaaagggauuguguacgacagaggagaaagccggaagcagaaugagaacaucagauuccuggagcuggaugccuaccaccagauucgcaaagcuguugacaagguguauggcaaggggaaaucuuccagcuuccucccgaucgauuuugacacguucggauacgcccugacacuuuuuaaggaugacgcugauauccauucuuaucugcggaacgaauacgagcaaaauggcaaaagaaugcccaaccucgccaauaaggucuaugacaacgaacugauugaggagcuucugaaucucuccuucaccaaauuuggccaccugagccugaaggcccuccgcuccauccugccuuacauggaacagggggagguguauucuagcgcuugcgaaagagcgggauacacauucaccggccccaagaaaaagcagaaaaccaugcuucugccuaacauucccccgaucgccaauccuguggucaugcgggcucucacacaggcccgcaagguugugaacgccauuaucaaaaaguacgggucccccgugagcauucacaucgagcuggcuagagaucugucucaaacguuugacgaacggcgcaagaccaaaaaggagcaggacgagaaucggaaaaagaacgaaacagccaucagacagcuuauggaguauggacucacccugaauccuacaggccaugauauugucaaauucaagcugugguccgaacaaaacgggcgcugugcguacagccuccagcccaucgagauugaaagacugcuugagcccggauauguggagguugaccacgugaucccuuacucucggagccuggaugacuccuauaccaauaaaguccucgugcugacgcgcgaaaacagagagaagggcaaucggauuccggcugaauaccugggcguugggacagagagauggcagcaguuugaaaccuucgugcuuaccaacaagcaauuuucuaaaaagaaacgcgaucggcuccugagacugcauuaugacgagaacgaggaaacagaguucaagaaucgcaaccucaaugauacccgguacaucagcagauuuuucgccaacuucauccgcgaacaccugaaauuugccgaguccgacgauaagcagaaggucuacacagugaauggacgggucacgagccaucuuagaucucgcugggacuucaacaaaaaucgggaggaauccgaucugcaccacgcuguggacgccgcuauuguugccugcaccacacccagcgauaucgcgaaggugaccgccuuuuaucagagacgggagcagaacaaagaacucgcuaagaaaacagagccucauuucccccaaccuuggccccacuuugccgacgaacugcgcgcuagacugucuaagcauccgaaggaguccauuaaagcccuuaaucucggcaacuacgacgaucagaagcuggagagccugcagccugucuucgugucccggaugcccaaacgcucuguuaccggggcggcccaccaggaaacgcucagacgguauaucggaauugacgagagaagcggcaagauccaaaccguggucaaaacaaagcuguccgaaaucaaacuugaugcuucugggcacuuuccuauguacggcaaagagagcgacccccgcaccuaugaagccauucggcagagacugcucgagcauaauaacgauccuaagaaggcuuuccaggagccccuguacaagccgaaaaagaauggagaaccuggccccaucauucgcacagugaaaaucauugacaccaagaaccaggugaucccccugaaugaugggaagacgguugccuauaacuccaacaucguccggguggacguguuugagaaagauggaaaguacuacugugucccuguguauacaauggacauuaugaaaggcauccuuccgaauaaggccauugaacccaacaaaccuuacagcgaguggaaggaaaugaccgaggauuauacauucagauuuucucucuaccccaaugaccugauccgcauugagcugccucgggaaaagaccguuaaaaccacaacgggggaggaaaucaacgugaaggaugucuucguguauuacaaaaccauugacuccgcuacaggaggccucgagcugaucagccacgacaauagauuuucucuucgcgggguuggcuccagaacccugaagcgguucgagaaauaucaaguggauguccucggaaacaucuacaaggugcgcggcgaaaagagaguugggcuggcgagcucugcccauagcaaaacaggagagaccauucggccccugcaguccacgcgcgacuga

SEQ ID NO: 3893 - RNA, 3264 nt, Artificial Sequence
  Cas9 variant
augagauacaagaucggccuggacauugggaucaccagcgugggaugggccgucauuaaccucgauaucccccggauugaggaccugggcguucgcaucuucgauagagcugaaaauccucagacaggggagucccuugcccugccgcggcgccucgcgagaucugcucggcgcagacugcggcgcagaaaacaccggcuugaacgcaucagacggcugcucauucgcgagggagugcugacgaaggaagaacuggacaaacucuuugaggaaaagcaugagaucgauguguggcaacugagagucgaagcccuugaccggaaacugaacaaugaugagcucgugagaguucugcuucaccuggccaagcgccggggcuucaagagcaacagacaguccgagcgcucuaauaaagaaaacagcaccaugcucaagcauauugaggaaaaucgggcuauccuguccggguauagaacagugggagagaugauugucaaagaccccaaguuugcccugcacaaacgcaacaagggcgaaaauuacaccaacacaaucgcucgggaugaccucgagagagagauucgccugaucuucucuaagcagcgggaauuuggcaauaugagcugcaccgaggaguucgagaacgaauauaucgccauuugggcgucccagagaccuguggccagcaaagaugacaucgagaagaaaguuggguuuuguacauucgagcccaaggaaaaacgcgcuccuaaggccaccuacacguuucaaucuuucauugcuugggagcauaucaauaaacuucggcugauuucccccagcggaaccagaggccucacagaugaggaacggcgccugcuuuaugaacaggccuuucagaagaacaagaucaccuaccacgacaucagaacacugcuccaucugccugacgauaccuauuucaaagggauuguguacgacuggggagagucucugaagcagaaugagaacauccgguuucucgaacuggaugcguaccaccaaauuagaaaagccaucgacaaggucuauggcaaagggaaguccagcucuuuccuuccgauugauuucgacacguuuggauacgcucugacacucuucaaggaugacgccgauauccgcuccuaucugcggaacgaguacgaacagaauggcaaaagaaucgcuaaccuugccaauaagguguaugacaacgagcugauugaggaacuccugaaucugagcuuuaccaaauucggccaccucucccugaaggcccuucgcaacauccugcccuacauggagcagggggaaguguauucuagcgcuugcgagaaagcgggauacacauuuaccggcccuaagaagaaacagaagaccguccuccugcccacaauuccucccaucguuaauccgguggugaugagagcccugacgcaagcucggaaagucgugaacgccauuaucaagaaauacggguccccuguuagcauucauaucgaacuugcccgcgaucucucucagaccuucgacgagagacggaagacaaagcgcgagcaggacgaaaauagaaaacggaacgagaccgcuauccgccaacugauggaauauggacugacacucaaucccaccggccuggauauugugaaguuuaaacuuugguccgagcagaacgggagaugugccuacagccugcagccuaucgaaauugagcggcuccuggagcccggauaugucgaaguggaccacguuauccccuacucucgcagccuggaugacuccuauacgaauaaggugcuuguccucacaaaagagaacagagaaaagggcaaucggauuccugcggaguaccugggcguggggaccgaaagauggcagcaauucgagaccuuuguccugacaaacaaacaguucucuaagaagaaacgcgaucggcuccugagacuucacuaugacgagaacgaagagauggaauuuaagagccgcaaucugaacgauacccgguacaucuccagauucuuugcuaauuucauccgcgagcaucucaaauucgccgagagcgacgauaagcagaaaguguacacaguuaacggacgggugacgucucaccugagaucccgcugggacuuuaauaagaaccgggaagagagcgaucugcaucacgccgucgacgcugccauuguggcuugcaccacaccgucugauaucgccaagguuaccgcguucuaucagagacgggaacaaaauaaagagcuugccaagaaaacagaaccccaguuuccucagcccuggccucauuucgcugacgagcuccgcgccagacuguccaagcaccccaaagagagcauuaaggcucugaaccucggcaauuacgacgaucagaagcuggaaucccuucaaccgguguuugucucucggaugccuaaacgcagcgugaccggggccgcgcaccaggagacgcugagacgguauaucggaauugacgaaagauccggcaagauccagaccgugguuaaaacaaagcucucugagaucaaacuggaugccagcgggcauuuccccauguacggcaaggaauccgacccucgcaccuaugaggcuauucggcagagacugcuugagcacaacaaugaucccaagaaagccuuucaagaaccucucuacaagcccaaaaagaacggagagccgggcccuaucauucgcacagucaaaaucauugacaccaagaaucaggugaucccccugaacgaugggaaaacgguggcuuauaauagcaacaucguccggauugacguguucgaaaaggauggaaaguacuacuguguucccguguauacaauggacaucaugaaaggcguccugccuaacaaggccauugagccgaauaaacccuacucugaauggaaggagaugaccgaggauuauacauuuagauucucccucuacccuaacgaccugauccgcauugaacuuccccgggagaaaaccgugaagaccgccgcuggggaagagaucaauauuaaggauauguuuguuuauuacaaaacaaucgacagcgcgaacggaggccuggagcucaucucucaugacaauuccuucagccugagaggggugggcucucgcacgcugaagagauuugaaaaauaucaggucgaugugcuuggaaacauuuacaagguucggggcgagaaacgcguggggcuggccagcuccgcucacagcaagaccggagaaacaaucagaccucuccaaucuacccgggacuga

SEQ ID NO: 3894 - RNA, 3267 nt, Artificial Sequence
  Cas9 variant
augcccaaggaguucgacccucugaaaccggccaaguacagacucgcucuggauaucggcagcaaauccauuggguuugccaucauuuuccuuaaggaagacgugaacaaacugcucaagcccuaugcgaucguccggucuggaguucgcauuuuuggcgaugggagaaccccugcugcccccggacagcugggcagcucccuugccgcugagcggcgcgugaagagaucuauccggcgccaauacgccagaaaacggaagcgccugcagagacuccugcggaaucugaaagaacucggguucuuuccugacgauagcaagcugugcaaauccuucgaggaccuuaaccccuaugaacugcgccacaagggacucacaaaggagcugaaaccucaugaguuuggcagacuucugaugcacauggcuaagaaucggggcuuccagucuaaccgcaaaguggaucuccuggccgacaauaucgauagccaggcgaaggccgaaacguccgcuaugaaaagcgccauugcuacccugcaaucuagacucaacggggaguuugaaacacugggagccuaccuuuaugagcgguucaagaaaggcgagaccaucaaguccagcaagacacagaaagggcagaaggcggaauacgaguuuucuauuuccagacgcauggucaaacaggaguucgaccggcugugggccgcucaagagcaguuuaauccggaacucuucaacgagcaggccaagaauacccugaaagauacaaucuucuuucagagaaaccuucugccccaaaaggugggaaaguguaccuuccucccugagcaugaacgcgcuagcaaagcccugcccucuucccaguauuuucggauuaucagcgagcugaauaagauuuccuucacggacgccgaaggccucauccugccuaucucucuugagcagagaaacaaacugcucaagagccugcgcauuaaacaaaaacuuuccuuugaucggaucagaaccgaacugaaucucgacagcacaguucugauuaaccuggagcacgcuucuaaggacuccaucgagggggauaagaccggauaccuccugagcaagaaagaauacuucggccccgcguggcgcgaccuuucucuggagacacaggaugccauugugaccgcucuccugacgcaugaaaaugaggccgaacugguccagaaacuuguggacgauuuuaacaucgcccacgacguugcuaaggcccucgcgaacgcucggcuggagagccaguauaugagacuguccaaggaggccaucgaacgccucauuccggagcuggaaaagggcguggauucucaagacggguacaaagucccugugaaguaucacgaggccacagaggcugccggauucggccaucacagcgcccuucaggaaaauugggcugauuuucccacccuggaccucaaacagcugcauuccgaugacaacgacaaguacacaguggcggagcugccucuucccuauuacgggaaagucaucacccggcagguugccuucggaaccggcgaugugaaugaccccguggaaaagagauuugggaaaauugcuaacccuacaguccacaucugccucaaucaagugcggguucugcuggaugagauuaucgccaaguauggauacccguacgaagugaacaucgagcucgcucgcgagcugaagcagaaucacgaacagagacagcggagcauuaaacaacaggccgcgaacaagaaagagaaugaagagaucagacgcgaaauuaagcaggccuauaaagucgagaaggcucggaucauuacggacucugagaucuccagagccgauauugaaaaguggcgccuuuggagacggagcaaaucuaagcuguguguguacuccggcaaaaagaucugcgagaccaugauccucaacaaugaaguugagguggaccauauucugccccgcagcagaacaggcgauaacuccuaucagaauaaaguccuggugcuuaacaaggcuaaucggaucaagucuaaccgcaccccuugggaagccaaagaacucuucgaggcccaaggguggagcuacgaagacauucugaacagaaugcgggcucuggauaagcaccagcucuuucgcuucgcggagaauagcauggacaucugggauaaaaacuauagaucuuucgaagcccgggcucugaaugacacacgcuacauuagcagagucgugaaggauuaucuuaaaguugugugucauaaggaccggaucgucguguccaacggagcccacaccgcccugaucagacgcgaguuuggccucaaugaccugcuggggaagaaaggagagaagaaccgggaugaccauagacaccacgcuauugaugccugcguuaucggcgcgcuugaccgcagcaugcuccggaaacugcagauugcuauggaaguggccgagaagcaaaauucugccagaaacuucgucgggcugcaggaacccugguuuaauuucuccacacaggugcgccggagcaucggccagauuuacgugucucauaaaccuaaccacaauuacgagggagaaaucuuugaggcuuccaucuauggccucagacugauuagcgauaagcgcacggagaaauacguugggaucaagcggaaccccgaaaccggaaagaccgacaaaccgaagaaaucugucguggugauuagcgauccuaagacacaaaauagauauggccuucggcauaaauuccacuccgaggggcugcccaagaaguacuauggacucuccucuuccagcgucuuuugucuggaaaucuaccgcgacgagaaaggcaacuggcaggccuauaccauuccuagauacgaagcguaccggaucgugaagcgcagagggguuaaugcucuguaugauaacaaacgguccaacuucgagggcagaccccuugugaugcgccugaugcgggacgauugcaucgccuuugagaagaauggagucaaagaaguguaccgcauucagaagaucaacggccucaagaaaaauauuacacugacgagacacuucgacgccaacguugaugaccgguauagacgcaugcucaaggcucagaaagccgagaaggcuggggaagacuuugauucugaggaccugugugaugaccuuguguucagcuccuuuggagccucuagccuguacuccaauaaagcgcggaaggucaccaucucuccuaugggcgugcucagagaucccggguucaagggauga

SEQ ID NO: 3895 - RNA, 3267 nt, Artificial Sequence
  Cas9 variant
augaagaaacuggugcucggccuggacaucggggucgccagcguuggauggggcauuaucgaugcugagaacggggacgugcuugaugccggagugagacuguucuccucucgggacgcgagcgaaaaugagucccgcagaaccucucggcgccagagcagacggcucucccgcagaaagaaacaccggcgcgaaagaauuaagcaacugcuucuggcucaugauauggacgucugcgauaucgugaacgagaaucccuaccagcuccggguuaaaggccugaacgaaaagcuggagauuucugagaucuauguggcccucacacaccuggccaagcgcagaggggucagcuaccuugacgaugugguugaagagggaggcgcuaucaaauccgaacaucugaauaagaacauggaggagauuaaaagcggcaagaugccuugugaaauccagcucgagcgguuugaaaaauauggacaggugcgcgggaugauugagaucaaucaagacacggaagagucuuccuuccuggucaacauuuuuagaaccagcgauuacaucaaggaggccaagacaauucuugcuacccagcagaaauuccacaagcagaucacaaaugaauuuaucgacgaguauauuaacaucauggccucuaaacgggauuacuucauuggcccggggaaugaaaaguccagaaccgacuauggaguguaccgcacaaacggcgacaccugggauaaucuguuugagauccucauugggaaaugcagcguguuccccgaagagacgcgggcggccagaucuuccuacgucgcucaagaguuuaaccugcugaaugaccucaacaaccugaagaucagcucccuugaaucuggaaaacugagcaccucccagaagcaugauaucguugagaaggugaaaaauagcaagaaauucggcacaaaggaccuccugaaauauauugccucugugugugaaugcaagaucgagaacauugauggcugucgcaaggacaaaaaucggaagccuaucaugcacaccuuugaaaacuacagaaaaguccacaaugcucuuaacgaggccgggguggaucugcgccucuccgaggcggacuaugaugaacugaugaagauuaugacacugaauagcgagacccucgaaaucaaaaagcagugcaaggagaaacugccccaucuuacggaggacuaccugaacguuugucucgugcugaauaagaaaggagccuucucuggcuggcacgcucuuagccugaaggccaugaaacucaugaugccugaacuguaugggacauccaagaaccagaugcaaaucauucauaccaugcagcugggaaaggcuuacaucaaaccccucaaucagcaaaaguaucugaacucugaggccauucuugaagagaucuacaauccuauugccgcucggagcaucagacagacaauuaaagucaccaacgcgauccugaagaaauacggcccgcucgauuccgugaucauugaaaugccccgcgacuaucagaccagcgaggacgagcggaagaugaucgaaaagaugcagaaggagaaugaaaaggagaaaaaggccgcucugaaaagagcccgcgaagaguacccuuuucccgaugaggccuuccggaaccacaaggaacuggcuacaaaacuuagacucugguaucaacaggaccaguucugcguuuacucugggcggaagauuuccguggucgaucuggugcgcaacccuaaucaguuugagaucgaccacauuaucccccaaagcgucucucuggaugacucccucaacaauaaggugcuguguuucagcgaagagaaccagaaaaagggacagcagacgccguuuuauuaccauaaaggcaaguccggcaauuggaccuaugaacaauacaaacuuuucguugagaagcuguuugauaagaaaaagaucucuaacaaaaagagagagcuccugcuguucgaagaggacauuaauaaaugggaugugcggagaggguuuaucgcccgcaaccuugucgacacacgguacgcgagcagagugauucucaauuccuaucagcaguacuucggaaaccacgaaaugggcaccaagguuaaggugguccgcgggaaauuuacaucucagcugagaaagaaauggaagaucuucaaagaucggaaugagagccauucccaccaugcuauugacgcccugaucguggccgcuaccgccaaccuccgccuguggaagaaaaauaaacuuggaaucagcgaugagggcaagguguaugacaaagaaacgggggagauucugccuuuugaaaagcucacagcuucugaguacaacgaaaugaugaauaaagagcccuaucugaacuucaagaccaaacugcaaaacaucgagaccaagguuaaguacuccuauaaagucagcaagaaagugaauagaaagauuucuaacgacacaaucuacuccacccgggaacgcgauggcauugacuacaucgugggaaaaaucaagaauauuuaugaugucaagacauacaaagaccaguuucuuaagagauauaaaaagaacaaagagcaguuccucauguaccaacacgauccucagacguucgccauccuggaaagcauuauggcgaccuaucccgacgccgagaaucccuuucuggcuuacaagaaggaacacggcgugauccggaaauaugccaagaacaaagcuggggccccuguuacaucucucaaguucauugauggagcgcugggccagaaaaucgacgugaccuacaagaauaaggccgcccuuccgaaaaacaagaaagucgugcugcagagcauuaagcccuaccgcgcugauguuuauuacgacgaggggaauaaaagauaucaucucaucggagugaaguacucccuguuuagcuucucuaaacaaggcuaugucaucaacccuauugcuuaccagaagcugcuugagaaggaacagauccacuccgagaugaaauuuugcuucagccucuaucgggaagauauuaucgaguccggggaagaccccgauucucugacacgcuacagauuuuggagcaagaaugaguccggcaaaaacaagauugaggugaaaccuaucgaaaagcccaauuucgaggaccggaagguuaucaccauuacgaaaaagaucaaaauucugaacaaguaccagaccgacgugcucggaaauucuuuuaaagcccaagaagagaaggauccgagaagcaucgaguga

SEQ ID NO: 3896 - RNA, 3267 nt, Artificial Sequence
  Cas9 variant
augaacuacaagaugggccuggacaucgggauugccagcgugggaugggcugucaucaaucucgaucugaaaagaauugaggaccuuggcguucggaucuucgauaaggccgaacacccccagaacggggagucccuggcgcucccucgcagaauugcucggucugcccgcagacggcugcgcagacggaaacaucgccuugaaagaauccggcgccugcucgugagcgagaaugugcugaccaaggaagagaugaaccugcucuuuaaacaaaagaagcagaucgacgucuggcagcugagaguggaugcccuugagcggaaacugaauaacgacgaacucgcucgcguucugcuucaccuggccaagagacggggauucaaauccaauagaaagucugagcgcaacagcaaagaauccucugaguuucucaagaauauugaggaaaaccagagcauccuggcucaauaucgguccgugggcgagaugauugucaaggauagcaaauucgccuaccauaagagaaauaaacuggacucuuauuccaacaugaucgcgcgcgaugaccucgaacgggagauuaagcugaucuuugaaaaacagagagaguucaauaacccggugugcacagagcgccuugaagagaaguaccugaauauuuggagcucucagcggcccuuugccuccaaagaagauaucgagaagaagguuggguucuguacguuugaaccuaaagagaagagagcucccaaagccaccuauacauuccagagcuuuaucgugugggagcacauuaacaagcuccgccuggucucuccugacgaaacccgggcucuuacagagaucgaaagaaaccugcucuacaaacaagccuucuccaagaauaagaugaccuauuacgauauucgcaaacugcugaaccucagcgacgacauccauuuuaagggacugcuuuacgaucccaaauccucucugaagcagauugagaauauccgguuccucgaacuggacagcuaucacaaaaucagaaagugcauugagaacguguacggcaaggauggcauccggauguucaaugagacagacauugauaccuuuggguaugcgcuuacgaucuucaaagacgaugaagacauuguggccuaccugcagaacgaguauaucaccaagaauggaaaacgcgucuccaaccucgcuaauaagguuuacgauaaaagccugaucgacgaacugcucaaccugucuuuuuccaaguucgcccaccuuagcaugaaggcuauuagaaauauccugccuuauauggagcagggcgagauuuacucuaaagccugugaacucgccggguacaacuuuacaggaccgaagaaaaaggagaaagcucugcugcuucccgugaucccuaauauugcgaaccccguggucaugcgggcccucacccaaagcagaaaggugguuaaugcuaucauuaaaaaguauggcuccccugugucuauccauaucgaacuggcccgcgaucugagccacuccuucgacgagcggaagaaaauucagaaggaccagacagaaaacagaaagaagaacgagaccgccaucaaacaacucauugaguacgaacugacgaagaaucccacagggcuugauaucgucaaguuuaaacuguggagcgagcagcagggacgcugcauguauucucucaagccgauugaacuggagagacugcuugaaccuggcuacguggagguugaccauauccuccccuauucccggagccuggaugacucuuacgcuaacaaagugcugguccucaccaaggagaaucgcgaaaaaggcaaccacacaccuguggaguaucuggggcuuggauccgaaagauggaagaaguucgagaaauuuguccuggccaauaagcaguucagcaaaaagaaaaagcaaaaccuccugcggcugcgcuacgaagagaccgaggaaaaggaguuuaaagaaagaaaucuuaacgauacccgguacaucuccaaguucuuugcgaauuucauuaaagagcaccucaaguucgcugacggcgaugggggacagaaaguguauacaaucaacggcaagauuacggcccaucugcgcucuagaugggacuuuaauaaaaaccgggaggaaagcgaucugcaccaugccguugacgcugugaucgucgccugugcuacccaggggaugauuaagaagaucacagaguucuacaaagcccgcgaacagaauaaggaguccgcgaaaaagaaagaacccaucuuuccccaaccuuggccgcacuucgccgaugagcucaaggcuagacugucuaaguuuccccaggagagcauugaagccuucgcucuuggaaacuaugaccggaaaaagcuggagucccucagaccuguguuuguuagccgcaugcccaaacggucugugaccggcgccgcgcaucaggaaacacugagacgcugcgucggcaucgaugagcaguccgggaagauucaaaccgccgugaaaacgaagcugagcgacaucaaacuugacaaagauggacacuucccuauguaccagaaggaaucugacccccggacauaugaggcuauuagacagcgccuccuggagcacaauaacgauccgaaaaaggccuuucaggaaccucuguacaaacccaagaagaacggcgagccugggcccgugauccggaccguuaaaaucauugacaccaagaauaaagucgugcaucucgauggauccaagacaguggcuuauaacagcaauaucgucagaaccgacguguucgaaaaagauggcaaguacuacuguguuccuguguauacaauggacauuaugaaggggacgcugcccaacaaagccaucgaggccaauaagccguacucugaauggaaagagaugaccgaggaauauacauuucaauucagccuuuuuccuaacgaucugguccgcauugugcucccccgggagaagaccaucaaaacauccaccaaugaagagauuaucaucaaggacauuuucgcuuacuauaaaacgaucgauagcgcgaccggcggacuggagcugauuucucacgacagaaacuucucccuucggggcguugggagcaagacacugaagcgcuuugaaaaauaccagguggauguccucggaaauauccauaaggugaaaggcgagaagagaguugggcuggccgcucccaccaaccagaaaaagggaaagacaguggacucccuccaaucugucagcgacuga

SEQ ID NO: 3897 - RNA, 3270 nt, Artificial Sequence
  Cas9 variant
augaccgccuucaagcccaacccucugaauuacauccucggccuggacauugggaucgcuagcgugggaugggccauggucgagauugaugacaaagaaaacccgguuagacuuaucgaucugggcgugcggguguuugagcgcgcggaaaugcccaagacaggggacucccucgcugccgccagacggcuggcucgcucugucagacggcuuacgcgcagacgggcccaccgccugcucagagcucggcgccugcugaaacaugagggagugcucaagccugaagauuucgacgagaauggccugguuaaaccccuuccuuauauucccaagcagccuagaaacaccccguggcaacugcgggccgcggcccucgaucgcaagcugacaccccuugagugggcugccgugcugcuccaccuggucaaacauagaggguaccugagccagcggaagaaugaaggagagaccgacgauaaagaacucggcgcucugcuuaagggcguggccgacaacacacacgcgcugcaggccgggaauuuuagaaccccugcugagcucgcccugaacaaauucgagaaggaauccggacauauccgcaaucagcggggcgauuauucucacacauuuagcagaaaggaccuucaagcugagcugguucuccuguucgaaaaacagaaggaguuugggaaccccuacguguccgaugaccugaaaaauggaaucgaaaaccuccugaugacccagcgcccugcccuuucuggcgacgccauucagaagaugcuggggcacugcacguucgagcccgcugagccgaaagcggccaagaauaccuauacagcugaacgguuuaucuggcucaccaaacugaacaaucuucgcauucugaaccaaggaaacgagcgcccucucacagaugccgaacggaccacgcugauggacgagcccuacaaaaagagcaaacugacauaugcccaggcuagaaagcuccuggaucuugacgauaccgccuucuuuaaaggccugcgcuacggcaaggacaaugcggaauccgcuacacucauggagaugaaagccuaccaugccaucagccgggcucuggagaaggaagggcugaaggauaaaaagucuccucuuucccucagccccgagcugcaggacgaaauuggaaccgccuucucucuguuuaaaaccgaugaggaaaucacaggcagacucaaggggugucugcagcccgagauucuugacgcucugcucaaacacaucuccuucgauaaguucguccaaaucagccugaaggcccugcgccggauugugccucuuauggagcagggaaaaagauaugacgaagcgugcgccgagaucuacggcgaccaucacgggcggcgcaacucugaagagacgcucuaucugccgcccauuccugcugaugagaucagaaaucccgugguccugcgggcccucucccaggcuagaaagguuauuaacggagugggccgccgguacggcagcccugccagaauccacaucgaaaccgcgcgcgagguggggaaauccuuuaaggacagaaaagaaauugagaagcggcaagaagagaaucgcaaggauagagagaaagccgcugccgaguuccaggaauauuuucccaacuucgucggagaaccgaagucuaaagacauccugaaacuucggcuguaccgccagcagaauuguaagugccucuauagcggcaaggagauuaaccuggggagacugaaugaaaaaggauacguggagaucgaucaugcccuuccuuuuucccggacaugggacgauagcuucaacaauaagguucucgugcugggcucugagaaccaaaauaaggggaaccgcacccccuacgaauaucugaauggcaaagacaacuccagagaguggcaggaauuuaaggcucgggucgagacaagccgcuucccucacucuaaaaagcagcggauucuccugcagaaauuugaugaagagggauucaaggagagaaaccuuaaugacaccagauacgugaaccgcuuucuguguaaguucguugccgaucauaugcaacucacgggcaaagggaagcggagaguguuugcuagcaauggacagaucacaaaccugcugcgcggcuucugggggcuucggaaagucagagcggaaaaugaccgccaccaugcccucgaugcuguggucguggccugcuccaccguugccaugcagcagcggaucaccagauucgugcgcuauaaggagaugaacgcuuuugacggaaaaacagucgacaaggaaaccggcgaggugcugcaccaaaagacacacuucccccagccuugggaguuuuucgcccaggaaguuaugauucggguguuugggaaacccgauggcaagccggagcuggaagaggcggacacgccugaaaaacucagagcucugcuugccgagaagcugucuagccggcccgaggccguccaugaauacguggcuccccucuucgugucccgcgccccuaauagaaaaaugagcggacagggccacauggagaccaucaagucuccgaagcggcuggaugaagggauuuccguuguccgcgugccccugacacaacuuaaacugaaggaccucgagaaaauggugaacagagaacgggagccuaagcuguaugaggcgcucaaagcuagacuggaagcccauaaggaugaccccgccaaggcuuuugccgagccuuucuacaagcaggauaaggcuggaaaucgcacccagcaagucaaagccgugcggaucgaacagguucagaagacaggcgugugggucagaaaccagaaugggauugcggacaacgccaccauggugcgcguugauguguuugagaaaggaggcaaguauuaccuuguccccaucuacagcuggcaaguggcuaaagggauucugccugacaaggccaucaucgcuuucaaggaugaagaggaguggcagcucauugacgauucuuuuaauuucaaauuuccccugcacccgaacgaccugguugaagugaucacgaagaaagcccggauuuucggcuauuucgccuccugucacagaggaaccggcaauaucaacauucgcauccaugaccuugauaacaaggucgggaaaaauggaauccuggagggcauuggggugaagacagcucucagcuuucagaaguaccagaucgacgaacugggaaaagagauucggccuugcagacucaagaaaagacccccugugagauga

SEQ ID NO: 3898 - RNA, 3270 nt, Artificial Sequence
  Cas9 variant
augaacgugagauacaagaucggccuggacauugggaucaccagcgucggaugggccguugugaaucucgauauuccccggaucgaggaccugggcgugcgcauuuucgauagagcugaaaacccucagacaggggagucccuugcccugccgcggcgccucgcgagaucugcucggcgcagacugcggcgcagaaaacaccggcuugaacgcaucagacggcugcucauccgcgagggcauucugaugaaggaagaacuggacaaacucuuugaggaaagacaugagaucgaugucuggcaacugcggguggaagcccuugacagaaagcugaauagcgaugagcucgcccgcguucugcuucaccuggcuaaacggagaggauucaaguccaaccgcaagucugagcauaauagccgggaaaacuccacgaugcucaaacacauugaggaaaauagagccauccugucuagcuaucgcaccguggcugagaugauugucaaggaccccaaauuugcccugcauaagcggaacaaaggggaacacuacacaaauaccaucgcgagagaugaccucgagcgcgagauucagcugaucuucacaaagcagcgggaauuuggaaacaugaauugcaccaaggaguucgaaaacgaguauaucgccauuugggcuucccagagaccuuuugccagcaaagaugacaucgaaaagaaagugggcuucuguacauuugagcccaaggagaaacgcgcuccuaaggccaccuacacguuccaaucuuuuauugcgugggaacacaucaauaaacuucggcugguuucccccgccggcaccagagggcucacagaugaggaacggcgccugcuuuaugagcaggcuuuccagaagaacaagauuaccuaccaugacaucagaacacugcuccggcugccugacgauaccuauuuuaaaggaguggucuacgacagaaauaugccgcugaagcagaacgaaacgauccgcuuccucgagcuggaugccuaccaccaaauucggaaagugaucgacaaggcuuauggcaaagggaagucuagcuccuuccuucccauugauuuugacacauucggauacgcccugacccucuuuaaggaugacgccgaugugagaagcuaucugcagaacgaguacgaacagaauggcaaaccuaugcccaaccuugcuaauaagacauaugacaacgagcugaucgaggagcuccugaaucugucuuucaccaaauuugggcaucucucccugaaggcgcuucacaacauucugccuuacauggagcagggagaagucuauagcuccgccugcgagcgcgcuggcuacaaauucaccggccccagaaagaagcagaaaacaaugcuccugccgaauaucccuucuaucgccaaccccguugugaugcgggcccugacgcaagcucgcaagguggucaaugccauuaucaaaaaguacgggagcccuguguccauucacaucgaacuugcgagagaucucagccagaccuuugacgagcggcgcaaaacaaagagagaacaagacgagaaccggaagaaaaaugagaccgcuauucgccagcugauggaauauggacugacacucaaccccaccggccaugauaucguuaaguucaaacuguggucugagcagaaugggagaugugccuacucccuucagcccauugaaaucgagcggcugcucgaaccuggauauacggagguggaccacgucaucccguacagccgcucucuggaugacagcuauacaaacaaggugcugguucuuaccaaagagaauagagaaaagggcaaccggacccccgccgaguaccucggggugggaacagaaagauggcaucaauuugagaccuucguccugacaaacaaacaguuuuccaagaagaaacgcgaucggcugcucagacugcacuaugacgaaaaugaggagacggaguucaagaaccgcaaucuuaacgauacccgguacauuucuagauuuuucgcuaauuucauccgcgaacaucugaaauuugccgaaagcgacgauaagcagaaaguguacacagucaacggccggauuaccgcucaccucagaucccgcugggaguucaauaagaaccgggaggaaagcgaccugcaccaugccguggaugcggccaucguugcuugcacaaccccuucugacauugccaagaucacggcuuuuuaucagagacgggagcaaaauaaagaacuggccaagaaaaccgagccccacuucccucagcccuggccgcauuuugcggaugaacuucgcgccagacucuccaagcacccuaaagagagcaucaaggcucugaaccugggcaauuacgacaacgagaagcucgaaucucugcaccccguguucgucucccggaugccuaaacgcagcgugacaggggccgcucaucaggagacccuuagacgguauguuggaauugacgaaagauccggcaagauccagacaguggucaaaaccaagcugucugagauuaaacucgaugccagcgggcacuuucccauguacggaaaggaauccgacccucgcacguaugaggccauccggcaaagacugcuggagcauaauaacgaucccaagaaggcuuuccaggaaccgcuuuacaaaccuaaaaagaauggcgagcccgggcccauuauccgcacagugaaaaucauugacaccaagaaccaggugguuccucucaacgauggcaaaacagucgcguauaauucuaacaucgugcggguggacgucuuugaaaaggauggaaaguacuacugugugccgguuuauaccauggacauuaugaaaggcgugcugcccaauaaggccaucgagccuaacaaacccuacagcgaauggaaggagaugaccgaggauuauacauuccaguuuucccuguacccuaaugaccucauuagaaucgaacugccccgcgagaaagcuauccggacgagcaccggggaagagauuaagaucaaggauuucuuugccuauuacaaaacaauucacucuggaaccggcgggauggagcuuaucucccaugaccgcagcuucucucuguccggagucggcagcagaacacucaagagauucgaaaaauaucaaguggauguucuggggaacauuuacaaggugcggggcgagaaacgcgucggacuggccucuagcgcucacuccaagaccggcaagacggugagaccucuucagagcacacgggacuga

SEQ ID NO: 3899 - RNA, 3273 nt, Artificial Sequence
  Cas9 variant
augagauggcggcugggccucgacaugggggccggaagccugggcuggugcgcuguggggcuugaugaccagggauaccccgauuccauccuggccgcgggcucucacauuuucggggacggacgcgcuccuagcagaggcgaucagcagggcaccccgcucggggucgagcggcgcgccgccaaggcuaugagacggcgcagagaccgguuucugggacgccaggccaaacuucuggcuagacucacacuggccggccuguuccccgcggauccuguucgggccaaggcucucgaacugcuugaccccuaugugcugcgcgccagagcucucgaugaggcccugccuccccaucagcuugggcgggcguuuuuccaccugaaccaacgcagaggauuuaaauccaaucggaagacggacagaggcguggaugacgaagccgggaaaaucgcuauuggaaucgaucgccuccgggccgcuauugccgccgcugaggcgagaaccaugggcgaauuucugcauaagcgccggcagucugccccugacgucaaccagaucccgagcgugagaacacgccugcggcccgagaccggcgaggaagcuaagggggacggauacgauuuuuauccuggcagagagcucguugaagaggaguucgacgccaucugggaugcccaggcuccccaccauccuucccugcuuacacccgacaaucgcgcccugcuccacgaagcgauuuucuaccaacggccgcugaaagcuccuaagaucgggaaauguacccuucugaacaaugagcccagacucccuaaggcccacccccuguuccagcgccggagacugcucgaagaggugaacgcccugcggauuguccgccccggagaaguggcuacaaaacuuaccugcgagcagagagaucugcucaugcugaagcugaaggacaaagccaagguuucuuuugagacgcugcggagcaaagugcucaagcuggaaccugaggcuagauucaauaaagaaggcgagaaccgcaccgaacuggucggggaugaggugugugcccagauguccgcgaagacacgguuuggaaaagccugggcucauuucaccgacgagaagagaugggccauccucagccgccugauugaagaggaagaugaggaaagacuugacacauggcugcggaccgagcacggccucgaugcugagcaagcccgcgcgguggccggcgcuagacugccggccggguucggacgguuuggcgaaacggcuacacgcagacugaucgccgcccuucaggcugaggucauuguuuauucugaagcggugguggccgcugggcucggacaucacuccgacaugcggaccggcgagguccuggccgagcugcccuacuaugggaugacacucgaacgccaccuucuuccuggcaccggagacaaggccgaucccgaggaacugagaaucggccggcucaccaauccuacagugcauaucgcucugaaccgccugagacggauuguuaauagacuuaucaaaacguacgggcgccccgagcagauugccaucgaacucggacgggagcugaagcugaccgacgaggauaaacaaagacucagccgccagaacaaucggaacagagcggacgcugaagcccgcucuaagaaacuggccgagcuuggccaggcugauaauggggccaaccgggcgagacugaagcucugggaggaacugaaccgcgaaaaugcucuggaccggagaugcauuuacuccggacagcaaaucagcaucgccaugcuuuucucugaugccguggaggucgaccacauucucccguuugaugcuacacuggacgauuccaacaauaaccggauccugugucuccgcgaguggaauagacggaagcgcaaacagagcccuuaugaagccuggggccauaccgacuacuggcccgauauugcugccagagcggcccggcugccuaaggagaaaagauggcgcuucgaacccgacgcuaugcagcgguuuuccgccgaggacagauucaucgcucgccaccuuguggauacacaguauaugucucggcuggccagagaauaccucgaggcccuguauccugagaagggggaaggcagcggacauguuugggugucccccggccgccugaccgagcuuauucggagaaaacucgggcugaacgaacugcucccggaccacaauuuugcuggagucaagaaccgccuggaucacagacaucacacgaucgacgcguucguggucgccgugacagaucggagccuucugcaaggcaucucucgcgcuuccgcccucgagggggaggaaggaagagagcggguuauugugccugaacccugggacggcuuucgcgaggcccugagaaccacccugaauacaaucaccgucuggcaucggcaggaucacgggacagcuagcaaggccggccuugcgcagggaagagaccagacggcuggcaaacugcacaacgauaccgccuacgggcucacaggacgccaagacaccaagggcaaugaucuggugguuucucggaaaccccucaugagccugaagccugccgacauugaaccggugcccgaugucgcuccuaucacaaaaggggugagagaccgcgaccuucggaaggcccuggcgcauuucacccaggcuacggagggaaagggcuuucuccaggcccuggagagauucacccggcuggggccccuucacuuucgcggcauuagacgggugcgccugauccagccucucgccguuauucccaucaaaggaccuggcgggguccccuauaagggauaccugggcggggaaaacuucagaugcgaugugugggagaugccggacggagcuuggaaaccugaagugacauccauguuccaagcccaucagcccggcuggaccucugcuauccgggccgcguguccuacagcccgcaagguccucagccugcacaaaagagauaugauugcuaucgagcgggaagagggcgugcgcacccuuaugguuguggcccagauuugguccaaugggcaagucacgcugguggagccccaugaagcuggagaccucaacaagagaaauaaaagcgaggaugacccguuuggcuacuucaugccuacagccgggggacugaagcggcugaaggccagacagguucgcguggaugaacuuggccggguccaggaccccggguuuccugcuagaaaagcgcgccggagaacccgccccaagcaaguggauuga

SEQ ID NO: 3900 - RNA, 3273 nt, Artificial Sequence
  Cas9 variant
auggacuggagacugggccucgaucugggggccaacagccuuggaugggcugcccugcggcucgaccgcgcgggcgaucccaucgggauucuggcuaugggauccagaaucuucucugacggccgggauccuaagagcggggccucccuugccguggaccgcagagcugcccgggcuaugcgcagacggcgcgauagauuuaaacagcggcaagccgcgcugcucaaguaccugauucgcgacggacuguucccggccgaucaggcugacagacagcggcucgccgaugaggaccccuaugcucugcgcgccagagcgcuugaugaagaacugucucucuuugaaaucggccgggcccuguuccaccuuaaucagagacgcggcuuucaaagcaaccggaaagcugacagagggcaggacgaugaggccggaaagauugcugucggcguugaccgccugaaucagcagauggaggagcaaggggcccggacccucggagaguuccugcaucagagacgccgggccgcuacagaugcgaaccacaucccuuccgugagaacgcgccugcggcccgaaaccggcgagggggccaaaggagacggcuacgauuuuuauccuucuagagcucucaucgccgaagaguucgaggaaauuugggccgcucaggcuccccauuacccugacacacugacccagcaagugcacgaucgccuuuaugagaucauuuuucaucagcggccgcugagagcgccccaggucggccaaugcacacucguggcuggggaaacccggcugccuaaggcccacccccuuuuccagaagcgcagacugcucgaggaaaucaaugcccugaugauuguucggccuggagagaucgcucagagacugacacccgaggaacgcgacacccucuaccugaaacuuaaggauaaacggacggugagcuuugccacccugagaaagacacucaaacuggacuccgcugcccgcuucaacaaggagagcgaaaauagaaccgagcuuaagggcgaugaagucgcggccgagcugggggcuaaaacacggcucggaacccgcuggcagcaccugucuggcgaccaacagugggaggugguucauagacugauggcccucgaaucccaggcugacgaggccgcguuucgggauuggauuagccagacguaugaccugcuuccggaacaagccgcugccgugcugggggcucgccucccucagggacacggcagauucggccccacagccaccacaacccugaucgauucucugcuucaugaccggaccgaggaugggcgcgucgugguguacuccgaagccguccagagaagcggacucggccaccacucugaccugcggcaugaucgcgacgaugaggacguuacagagcugccuuacuaugggguggcucucgaaagacacaucaugcccggaacggcggagcccaccgauccugaagagaugcggauuggcagacugacaaacccgaccgugcauaucgggcuuaaucagcugcgccacgucgugaaccggcucauuagagccuacggacccccuaaggagaucgcuauugaacuggcccgcgagcugaaacuuuccgaagacgagaagaaaaagcggaauagcgaaaacagagauaaucgccucgccgcugagggccgguccaaaaagcuggaggaaaucagacaacgcgacacaggcgccaaccgggcgcugcucaagcugugggaggaacuuaaucccgggaacguucuggacagacgguguaucuauaccggagagcagauuucuaucgauaugcuguucagcgaccgcguggaagucgaucauauucucccuuuugcucagacgcuggacgauuccaacggcaauaaacuucucugccugagagaggccaaccgggagaagcgcagacggagccccuacgaagccugggggcacacagacagauggccggauaucgcugagcgcgccucucggcugccuaaacccaagagauggcgcuucgaaccugacgcgaugcagcgguuugcuaccgaggauggauuccucgccagacaccugguggacacccaauaucuuggccgccuggcccgggaauaccucuccuggcuguaucccgggagaggcgagggaagcggccauguuugggugucuccugggcgccugacagagauggucagacggaaacuuggacucaaugaucugcugcccgaccacaacuuuggcgggggagcugaucagccgaagaaucgccucgaccauagacaccacgccauugacgcucugguggucgccaucguggaucggggcaugcuucaggcgaucgcccgcgcuagcgggcaagacggcuccgaaggaagagagcggauucauaucccugcccccugggauggcuucagagacgaucugcgcguugcugugaacgggauuaucgucucucaccggcccgaccauggaaccguggccaaggccggccucgcuagagggcgcgaucagacagcgggacggcugcacaaugacacggccuacggccugaccggggaaacagaugcuaaaggcaacagcauuguugugagacggaucccucuuuccgccauuaagaaaccggccgacaucgcucgcgucagagauccccugcuccggaaugcccuggcggaguuuaccaagggacucgacggcaaagccuucgaggcccgcaucgggagauuucaugaacugggaccucuucuguaccggggcauucgcagagugcgggugguugagacacucaccgucauccccauucgcgacgccgaagggagagcuuauaagggauacaagggcgauagcaacuaucgguacgacgugugggagaugccugauggcaaauggagaugucagguggucucuauguucgacgcccaccaguccacggaacaagcgcgcccccacccugcugcccggaagauccugagccugcagagaaaugauauucuugccaucgagcgcaccgagggggaccgggaacuggugagaguugugaaauuuucugagaagcaguucgcugucgcucccccgcaugaaggaggcucccucaaaacacgcgaugggaacgccgacgauccuuuucgguaucuguaccccagcccuaauacccucaagggauggagagcccgccaggugcggaucgacgagcugggcagaguucuugaucccggguucccggcgcgcaaguccgugcggagaacacgcccuagagccgcucccgucgacuga

SEQ ID NO: 3901 - RNA, 3276 nt, Artificial Sequence
  Cas9 variant
auguacagcaaccuccucuucuccuuugacaucggcaccaauucuauuggguggugcguguucgcccuggaugaggcuggagaacccuauagaaucgucgaccuuggcgcccggauuuacgcggaugggcgcgacccucagagcaagacaucccuggcuguugccagacgggaggcccgcgcuaugucuagacggcgcgauagauaucuccggcgcagaaaagccacgcugcggaccaugaucgaauacggacuuaugccgggcgacaaggcugggcaagaggccgugcugcgcgaaacaggagauagagagggcggcgacgagagcuuuaaccccuaugcgcuccgggcccgcgcucuguccgaaaaacugccucccgccuacauugggagagugcuguuccaccugggacagcggagaggcuuuaagucuaaucgcaaaaccgaucggaaggacaacgauaaggggaaaaucgcucuuggaaucgacgagcugacagccgcgaugcauagaagcggcuccccuacccucggggccuggcuggcuaugcgccgggccgaaggacacagcgucagacuucgcgcuggcucugagguguucgaugccgagggcuaugccuuuuaccccgaacggucccugcucgaggacgaguucagacagauuugggacgcucaggcgguucaucacccugauauccugacaccggaacgccgggcccaucuguuuagagugauguucuaccaacgcccccucaagaaaccucuggucgggcgguguagcuuuaaucccgcugaauuuagacuuucucgggcccacccucuguuccaggaguuccgccucuauaaggagauuaacgaccuggaagugguucuucccgaucagucccacagaaaacugacccucgacgagcggaaugcccugguggcuaagcugaagacgagcagaaaagccucuuucuccgcgcuccgcaagacccugaaacuuacaccggaucuggucuuuaacaaggaaagcgaggcucggaaagaacuccugggagacgagaucuacuccgugcuugccgaugccaagauguucggcgcuagauggggaggguuuucucgcgccagacagugggagauuaucacccggcugaaagaagaggaagacccugcuagccucuccagcuggcugaagucugaguucggccuggaugacgaacgcgugacagccauugcgaaugccucccuccccgauggguauggaagacugggcgagaccgcucuugccagcaugcuggaggaacucaagacggcugucaucccugagucugaagccgcgcggcugugcggcuacgaccauagcaaccuggccaaagagcaagacgaggggcuugauacacuccccgaauaucaggagauccuggaacgccacauucccccuggaaccggcgacccggaugacaucuacgaucugagaaaggggcggauuacaaaucccaccguucauaucggacucaaccagcugcgcagaguggugaaugcucuuauucaccgguuuggccgcccucagagaaucgucguggagcuggcccgggaccuccaacuguccgaaaaacagaaggaugacguuaacagacgcaucgcuaaaaauacccgggaggccgaggggagaucucagaagcugauugaaaugggccaacuugauacaggauauaaccgccuccugcugaagcucugggaggaacugaaccuugacaaacccgaggaucggguguguaucuacagcggcaagccuauugggaucgccaugcuguucuccggagaagucgacguggaucacauucuccccuggagcaaaacgcuggacgacucucaggcuaauaagcugcuuugccucaaauccgcgaacagacagaagcgcaaucggaccccgagcgauguuccugaguggagagaccgcuacgaugaggugcuggcccgggcugccagacugccccggaacaagcgcuggagauuugccgcugacgccaugcagcaauucgaagcggagggcggguuucucgcucggcagcugacagauacccaguaucuuucucgcauggcccuggaauaccucuccgcccuguauccuagcgaggaagcugacaaauccggagagcugagacagcggaagagaguccaugugguccccggccgccuuacagagcuccugcggagaaauugggggcugaacacccuccugccugaucacaaucuuggcgaaauggcccaagagaaaaaccgccgggaccauagacaccaugcgaucgaugcugccgugaucggaacgacaucucgcagccugcuccagcggauguccggcgccgcugccagacuggacgauguugcuuucgacgaucuggugcgcaccgucgugaaggacaaucccccguggccuggguuuagagaggaacuucuggccgcgauuggacggguuaccgugucucacaaacccgaccacggcacagucagccgcgccgcuuacgcccaggggaagggacagaccgcuggcaagcuccauaacgauacagccuaugggcugacgggccucguggacgccaaaggaagcccccuggugguuagacggaagccuuucauggcucuugaggucaaagauaucgcguccauucgcgacaccgaacugcaaucugcccucuacggcgcuaucgggucccugacagagaagaaagcccugcaggaagcccuuauuagauuucgggauacccacccgcaguucaagggaaucagacgcgugcgggugcuggagacacucagcgucauucccaucguggacagagauggcaaggcuuauaaaggguacaagggagacgccaauuaccgcuaugaaguuugggagacccuggauggcaaauggcauacggagguggucucuauguucgacgcgcaccagccuggguggcaaucccccuuucacaagcagaacccugcugcccggagagugcucaaacugcagcaaaaugauaugguugccuacgaacaucccgcugacggcuauaccaucgcccggguggucaaguucagcaacgacaaacgcauuuacuuugcgucucacagagagagcggaucccuuaaggcucgggaugccgacaagggcgauccuuucagcuauuuugccaaagcuaauaacgggcugcgcgacaucaaguguagacaggugcggauugaugccgcuggacgcaucuucgaccccggcccgcaggauagagaaacacggcaggccaacaaagggguuuga

SEQ ID NO: 3902 - RNA, 3279 nt, Artificial Sequence
  Cas9 variant
auggccuacaccaugggcaucgacguggggauugcuagcugcggaugggccaucgucgaucuggagagacagcggauuaucgacauuggcguucgcacauucgaaaaggcggagaaccccaaaaauggggaagcucucgccgugccuagacgggaggcccgcuccucuagacggcgccugagacggaagaaacaccgcaucgaaagacuuaaguauauguuugugcggaacggacuggcugucgauauccaacaucucgagcagacgcugcgcagccagaaugagauugacguguggcagcuuagaguugauggccuggaccggaugcucacccaaaaagaauggcugcgcgugcugauccaccucgcccagagacggggguuccaguccaacagaaagacagauggaucuagcgaggacggccagguccuggugaauguuaccgaaaacgaucgccuuauggaggagaaggacuaccggacaguggcugaaaugauggucaaagaugagaaguuuuccgaccauaaaagaaauaagaacggcaauuaucacgggguggugucucgcgccagccugcucgucgaaauucauacccuguucgagucccaacggcagcaccacaacuuucuugcgagcaaagauuucgaacuggaguacaucaauauuuggucuucccagagaccgguugccacaaaggaccagaucgagaagaugauuggaaccuguacguuucuccccaaagaaaagcgcgcuccuaaagccagcuggcauuuccaauauuuuaugcugcugcagaccaucaaccacauccggauuacaaaugcucagggcaccagaccccucaacaaggaggaaaucgagcaaguggugaauauggcccugacaaaaucuaaggucuccuaccaugacauucgcaaagugcuugaucugagcgaagaguaucaguucguugggcucgacuacggaaaggaggaugaaaagaaaaagguggagucuaaagaaaccaucauuaagcuggacgauuaccacaaacuuaacaagaucuuuaacgaggucgaacuggcgaagggcgagacgugggaggccguggacuaugauacaguugcuuacgcccucaccuucuuuaaagacgaugaagacauccgggauuaucugcagaauaaguacaaagacuccaagaacagacuggugaaaaaugucgcuaacaaggaguauacaaaugaacucauugagaaggugagcacccuguccuuccgcaaagucgggcaccuuucucugaaggcccuccggaaaaucauuccuuuccuggagcagggaaugaccuacgacaaggccugccaagcugcgggcuuuaacuuccagggcaucagcaaaaagaagagauccgugguucuucccgugauugaucagaucagcaauccugucgugaaccgggcccugacacagacgcgcaaaguuaucaaugcucucauuaagaaauaugggucuccggaaaccauccauauugagacagccagagaacuguccaagcgguuugacgagagaaagaacaucaccaaggauuacaaagaaaaucgcgacaagaacgagcgggccaagaaacaccugagcgagcucggaauuaucaaucccacaggccuggauauugugaaguacaaacuuuggugugaacaacaggggagaugcauguauucuaaccagccuaucagcuucgagcgccugagagaauccggauacaccgaggucgaccauaucauucccuauucucggagcaugaaugauuccuacaacaaccgcgugcucgugaugacgagagaaaaucgggaaaagagcaaccagacaccuuaugaguacaugggcaaugacacccaacgcugggaugaguuugagcagagaguuaccacaaacccccagaucaaaaaggaaaagcggcagaaucugcugcuuaaaggguucaccaaccgcagagagcucgaaaugcuggagcggaaucugaacgacacacgccacauuacgaaguaucucucucauuuuaucuccaccaaucuggaguucagcccgucugauaaaaagaaaaaggucgugaacacauccggaagaauuaccagccaccuucgguccagauggggccuggaaaagaaucgcgagcaaaacgaccuccaccaugcuauggaugccguggucaucgcggugacaucugacagcuuuauccagcagguuaccaauuacuacaaacggaaggaaagacgcgagcugaacggcgacgauaaauucccucugcccuggaaguuuuuccgggaggaagugauugcuagacuuuccccuaaucccaaagagcaaaucgaagcccuccccaaccacuuuuauucugaggacgaacuggccgaucugcagccuauuuucgucagccgcaugccgaagcgguccaucacgggggaggcucaucaggcccaguucagacgcgugguuggaaagaccaaagagggcaagaacauuacagcuaaaaagaccgcccucguggacaucagcuacgauaaaaauggggacuuuaacauguauggacgggaaacagaucccgcgaccuacgaggccaucaaggaaagauaucuggaguucggcgggaaugcuaaaaaggccuuuucuacggaccuucacaagccuaaaaaggauggcacaaaaggaccccugauuaaguccguccggaucauggaaaacaaaacccucgugcacccuguuaauaagggcaaggggguggucuacaacagcucuauugugcgcacagacguguuccaaagaaaagagaaguauuaccugcugcccgucuacguuaccgaugugaccaaaggaaaacuuccgaauaaagugaucgcugccaagaagggcuaugacgauuggauugaggucgacgacuccuuuacauuccucuacagccuguauccuaacgaucugaucuuuauccggcagaaucccaaaaagaaaauuucucucaagaaacgcaucgaaagccauuccauuagcgacucuaaggaggugcaggaaauccugacguacuauaaggggguugauuccagcaccgcggccauugaguucaucacacacgacggauccuacuaugcuaaaggcguggggguccagaaccuugauuguuuugaaaaguaccaaguggacauucugggcaauuacucuaaaguuaagggagagaaaagacucgagcuggaaaccagcgauaacaaucauaagggcaaggacgugaacuccaucaaaucuacaagccgguga

SEQ ID NO: 3903 - RNA, 3279 nt, Artificial Sequence
  Cas9 variant
augaaguacagcaucggccuggacauugggaucgccuccgugggauggucugucauuaacaaagauaaggagagaaucgaagacaugggcguucggauuuuccagaaagcugagaaucccaaggaugggagcucccucgccucuagccgcagagaaaaacggggaucccgcagacggaaccgcagaaagaagcaccggcuggaccgcaucaaaaauauccuuugcgagucuggccuggugaagaaaaacgaaauugagaagaucuauaaaaaugcguaccucaagagcccuugggagcugagagcuaagucccuugaagccaaaauuagcaacaaggagaucgcccaaauucugcuccauaucgcuaaacggcgcggguuuaagucuuucagaaaaaccgaucggaaugccgacgauacaggaaagcugcuguccggcauucaggaaaacaaaaagaucauggaggagaagggcuaucucacgaucggggacaugguggcuaaagauccgaaguuuaauacccacguccgcaacaaagccggaagcuaccuguucucuuuuuccagaaaacuucuggaagacgaggugcggaaaauucaggcgaagcagaaggaacucggcaauacacauuucaccgaugacguucuggagaaauauaucgaaguguuuaacagccaaagaaauuucgaugaggggcccucuaagccuucccccuacuauagcgagauuggacagaucgccaaaaugauuggcaacuguacauuugaauccucugagaagcgcaccgcuaaaaauacauggagcggggaacgguucgucuuucuucagaagcugaacaacuucagaaucgugggacucuccggcaagcgcccucugaccgaggaagaacgggacaucguugagaaagaaguguaccugaagaaagaggucagauacgaaaagcuccgcaaaauucuguaucuuaaggaggaggagcgguuuggcgaccugaauuacagcaaggaugagaaacaggacaagaaaacggaaaagaccaaauucaucucucucauugggaacuauacaaucaagaaacugaaucuuuccgagaagcucaagagcgaaauugaggaggauaaaucuaagcuggacaaaaucaucgaaauucugaccuucaacaagagcgauaaaacaaucgaguccaaucugaagaagcucgaacugucuagagaggacauugaaauccuucugagcgaggaguuuuccggaacccucaaccugagccuuaaagccauuaagaaaauccugcccuaccucgaaaagggccugucuuauaaugaggcuugcgaaaaagccgauuacgacuauaagaacaaugggauuaaguucaaacgcggagagcugcucccugugguggauaaggaccugaucgcgaacccggucguucuucgggccaucucccaaacgagaaaaguggugaaugcuauuauccgcaaguacggcacaccccacaccauucaugucgaaguggcccgggaucuggcuaaaagcuacgacgacagacagacaaucauuaaggagaacaagaaacgggagcucgaaaaugagaagaccaaaaaguuuaucucugaagaguucgggaucaaaaacguuaagggaaaacugcugcuuaaguaucgccucuaccaggaacaggagggcagaugugccuauucccggaaggagcugagccuguccgaagugauucucgaugagucuaugaccgacaucgaucacauuaucccuuacagcagauccauggacgauucuuauagcaauaaaguccuggugcuuuccggcgaaaaccgcaagaaaagcaaccugcuccccaaggaguacuuugaccggcaagggagagauugggacacauucguucugaaugugaaagccaugaagauucacccucgcaagaaaucuaaccugcuuaaggagaaauuuacgagagaagauaauaaggacuggaaaucccgggcucucaacgauacccgcuauaucagcagauucgucgcgaauuaccuggagaacgcccuggaauaccgggacgauucucccaagaagcgcguguuuaugaucccgggacagcucacagcucagcugagagcccgguggcgccuuaauaaagucagagagaacggcgaccugcaucacgcccucgacgcugccgugguugcggugaccgaucaaaaggcuauuaauaacaucuccaauauuagccgguauaaagaacugaagaacugcaaagacgucaucccuucuauugaguaccaugccgaugaggaaacaggggagguguauuucgaagagguuaaggacacccgcuuucccaugccuuggagcggauucgaucuggaacuucagaagagacucgaguccgagaauccccgggaagaguuuuacaaccugcugagcgacaaaagauaucucggcugguucaauuacgaagagggguucaucgaaaagcugcgccccguguuugucucucggaugccuaacagaggcgugaaaggacaggcccaccaggagacgauccgcuccagcaagaaaauuuccaaccaaaucgcugugucuaagaagccgcuuaauagcauuaaacugaaggaucucgagaaaaugcagggccgggacacagauagaaagcuguaugaagcccugaaaaaccgccuugaggaauacgacgauaagcccgagaaggcuuucgccgagccuuuuuacaagcccaccaauuccgggaagcggggaccucucguuagaggcaucaaagucgaagagaagcagaacguggggguguaugucaauggaggccaggcgucuaacgggagcauggugcgcauugacguuuuccggaaaaauggcaaguuuuacaccgugcccaucuauguccaccaaacacugcugaaagaacucccgaacagagccauuaauggaaagccuuacaaggauugggaccugaucgacggcuccuucgaguuucuuuauucuuucuaccccaacgaucugaucgaaauugaguuugggaaaagcaaguccaucaaaaaugacaacaagcucaccaaaacagagauuccugaagugaaucugagcgagguucugggauauuaccggggcauggauacgucuaccggggcugccacaaucgacacccaggauggaaagauucagaugcgcaucggcaucaagacagugaaaaacauuaagaaauaccaggucgacgugcuugggaauguuuauaaggugaaaagagaaaagcggcaaaccuucuga

SEQ ID NO: 3904 - RNA, 3285 nt, Artificial Sequence
  Cas9 variant
augaaaagcacccuggccaucgcuuccauuucuagccucggcugggugaucgagcugggggaaaacagaauuaugcggcuuggacuggacaucggcuccacaucuauugggugguggaucuacgagacgaccgauggacagaucacaagcgucauugacggcgggguucgcaucuucuccgauggaagagaccccaaaucuaagggcagccucgccguggaucggcgcguggcgagagcucaacggcgcagacgggaccgcuaucugagacggaaagccgcccuuaugaagcgcauggcugaagucggccugaugccuuccgauccgaaacaggccaagcagcucgaggcucuggaccccuacgaacugagagcccgggggcucgaugagacccuggagcuuacagaacugggacgcgcgcucuuucaccugaaucagagacggggcuucaagagcaacagaaaaaccgacgccggggauaaugagucuggaaagauuaucgacgcuacagcccgccuugauugggcuaugcgggaccauagagcccgcaccuauggcgaauuucugcacaugcggagacaaaaagcggacacgccucgcaccacacccgccgugcggaccagacucacaauugcugcccgcgauggggcugagaaggaggaauccggauacgacuucuauccugaucggcagcaucugagagacgaguuugaugcccugugggaagcccaggcugaguaccacggcguucucaccgaagaccugcgcgaugagaucggcacgauuaucuuccaucagcggccccuuaaaacaccuaagguggggaagugccuguuuaccaacgaggaaagagucgcgagcgcccacccgcucaaucaacggcgcauccugguggagacaguuaacgcucuuagaguggcccagcugggagaagucgcccgggcucucacccuggaggaaagagacaccauucugcacgcccucgauaauaaagcgcauacaaagucucuguccggcaugagcaucaaacuuaaggcucuggggaaagugauuaagcuccgcucuggacaguauuucacgcuggagaccgccaaccgggacgccaucgcuugugaucccgugagagccucccuuagcaaaccugaccgcauuggcuccuacuggucuacacuggaccacaaugcucagugggaggucguuaacagaauccgggccgugcaaagcgaugcggaccaucgcgaacucguggccuggcuggucucccagcacagacuggcugccgagcacgcugaaggggccgcguacgcuccccucccugauggauauagccggcugggcaucaccgccacaaagcgcauucuugccgcucuggaggccaaugugauccccuacucuaaggccguugaauccugcggcuggcaucacagcgacgagagaaccggggaggugcucgaucggcugccguauuacggagaaauucuggaccgccaugucaucccuggcacguaugaugacucugaugacgauauuacaagauuugggcggaucaccaaccccaccgugcacaucggacuuaaucagcuccgcagacugguuaaccggauuaucgaggugcauggcaaaccugacgaaauugucguggagcuggcuagagaucucaagcugagccaagaccagaaagcggacgucgagcgcacaaucaagaaaaauacccaggccgcuauucggagaggggaaaaacuugaggaaaugggcgugcccaacacaggaggcaaccgcaugguucugcggcucugggaggaucugaaugacgaugacgugaugaagagauucugucccuacacggggcagcgcaucuccgccggaaugcuguuugauggcucuugcgacgucgaucacauucuuccuuucagccggacccucgacgauggguuuacaaacaagacccugugucugaaggaagccaauagaaagaagcgcaacuaugcuccgcacgaggccgcggagaaaggacuccuggaccgggaugcuauggacuccguggccaaguaccuucccgauaauaaggccuggagauucgcuccugacgccaucgaacgguucgagggcgaacgcgacuuuacagcgagagcucugaaagauacccaauaccucagccggcuggcccgcacguaucuggacgcccuuuacgaugggggcgacgauaagucucauguuugggugguccccggaagacucaccgagaugcugcggagacacuggggccugaacgggcucgaagcucuggccgacuccgaugagaaaacagugaagcgcaaaaaucggaccgaccauagacaccacgcuaucgaugccgcggugguugccgcuacagaccgcagccuuauucagaagaucucuaagauugccgcuuccgaugagcaggccggagccgaagacacccugaaaagcacgccucccccgugggacuccuuccgggaugacaucgcugcgcagcuccaaaacauuacagucucucauagagccgaucacggccgcaccgacagccuggcuaaggggcggggagaggauacaaccuccggcgcccugcaugaagccaccgcucuugggaucaucgacgagacacacgugacggugcgcauuccuaucgaaucucucaaaagcggccaucugauugagggauccagaaauggcuauaucagagaucccuaccugcgggaccagcucacccuggccacaaagaacgggagcgauaaagacuuuaccacaguccuucagaaguucuuugaucgcucuaaaagauauggaggcacccggcgcgugagaauuaucaagacgcugcaggacacagcgcggaucuccguuccucacaaugcucccauuaaggccuacaaagggggaagcaaccacgccuucgagaucuggagacucccuaauggcaagauugaaucucaagugaucaccaccugggagcaucacaaccugacagaacccaaacgcccgcauccugcugccaagcggauuaucagacugcacaaaaccgauauggucgcgaucgagcgcgacgggaagacagugauuugcuuuguucagaagacggaccccuccaauggcgcuuuccuugugccccauuuugaggccaacgccgauggacggaaaagaaagaacgaaccugucgagugguaucagaugagcgcuaauucucugaucaaagccgaccuccggcgcgugggcguugaugaaauggggagagugcgggacccgggacccccucccauucgcuga

SEQ ID NO: 3905 - RNA, 3285 nt, Artificial Sequence
  Cas9 variant
augaaguacagagugggcuucgaccuggggaccaacagccucggaugggccgucguucggcugaaugcuuccggcgagcccgaucgcaucgaaguggccgggucuagaauuuuuagcgacggacgggagccuaaauccggcgcgucucuugcuggggcccgcagagaugcccgggcuaugcgcagacggcgcgacagauucaagcagcggcaagccgcucugaucaaauaucucacacaggccggauuuuucccggcggaugaaagcgagcgcaaggcccuguccgcucuugaccccuacgaacugagagcccgggcucucgaugaggcccugccucuggcgcaccucggccgcgcccuguuucaucuuaaccagagacggggcuucaaaucuaauagaaagacggaccgcgggaagaacgaugacaccggaaaaauucggaucggcguggcuagacuguaugagcagaugcgcgaugccgacgcucggacacucggggaauuucugcacaagagacgcgccgccgcuagcgaucccaaugcgauuccucauguccggaccagaaucgugacacuugccgcugaggacggaaaagccuccgacguuuacgauuucuaucccgaccgccaaacccuggaagaggaguuugaagccaucugggaggcucagacaagccaccauccugaagcccucaccgaggaacggagagcgcaguucuacgagauuaucuuucaccagcgcccgcugaagcaacccaaaauuggcuucugcacgcugcucccucccgagaagcggcugccuaaggcucacccccuuuuucagagacggcgccugcucgaagaggugaacgcccugagaaucguccuuccggggaaagaaacccgggcccuggagaaggcugaaagagaugcccuccugucuaaacugaaucagcgcaagaaagcugccuaugagucccuccggaaggcgcugaaacuugacccugaugccagauucaacaaggagagcgacaaucgcgaagauaugauuggagacgagaucgcugccgaaauggcucauaagucuagauucggcaaaguguggcugggcauguccgccgaggcgcaggcccaaguuauugaacggcuccgcgggcuggagagcgaugcugacgccgaugacuuugaggcuuggcuuagagacgaucacggacuggcccaggaacaggccaaggcugugacagcggccaaccuccccgagggcuacgggcgguucggagaaaccgcuacacgcaaacugaucgccgcccuggagcaagaggucaucguguacucugaagcugugcagagagccggccucgggcaucacuccgaccugcgggauggacaggucuggaccgacaagaaaggcaauccugcgcuucccuauuacggcgcuguucuggagcgccacauugugcccgggacggccgauccuaacgaaacagacgaugcccucagaaucggacggcugaccaauccgacagugcauauuggccugaaccagcuucgcagagucgugaaugcucucaugcggagauaugggcaaccccaggagaucgccauugaacuggcgcgcgagcugaagcucagcgacgaucggaagaaagagaucaacaccagaaaccgcgaaaaucggaaggcugccgagaaaagaucccagaagcugcgcaacaucggacaggccgacaaaggcgggaaucgggcccuucugaagcucugggaggaacugaacccugaaaauguucuggauagacgcuguguguacaccggccgggucauuucuaucgacaugcuuuuuagcggagcugcugagguggaucacauucuccccuucuccguuagccuggacgacucuaacggcaauagaauccugugccuccgggaggugaaccgcauuaagagacaacggacaccuugggaagcccgcgaugaccugagagcgcauuuugggcccgaugccggaugggaggcuaucgccgcucgggccgccagacuuccgcgcgaaaaacgguggagauucgagccugacgcugcgaaucgcuuugaugcccagggcggguuccuggcucggcaccucacggacacccagcaucuguccagacuggcccgcagcuaucuuucugcccucuaccccgaaacaggagagggcagcgggcacgucuggguguccccuggccggcugaccgagaugcugagacgcgcuuggucucucaaccaccaucugcccgaucacaauaucgccggagcggcuaaccagccuaagaauagaaaagaccaucggcaccacgccauugaugccaucgucguggcucuugccgaccgcgcgaugcugaacagaauugcucgggaaagcggcaaggaggggcaugaagccgccggacgccucguugcuuccauccccgagccgugggagggcuuuagcgaugaaguggggagagccguccgggcuauuacagugucucacagaccugaccauggaaccgccuccaaagcgggccgcgccaaggauaaggacgcuacggccgggcggcugcacaaugagacagcuuauggccugaccggagaaaaagacgccagaggccuugauaucguugugacccgcaagccccucagcgccuucaaaaagucugcugaccuggaugcgauucgggacgaugaccugaaacaaaagcucaaagccugggcugccgggaaggagggaggcgccuuugaacaggcuaugagauccuucggggaucccgagcggggaccucgcagccauccgggccugagacggauccgcgucacagagccccuuuccgugaucccuauuagagaccgggaugggcgccccuacaaggccuacaaaggcgacucuaacuauagauuugauaucugggaacugaagaccggaaaauggaaggacgaggugguuagcauguucgaagcgcaccggccuaacuggacaucccccauucgcgcuggcaauccuacggccagaaaaguccucucugugcggcagaacgacgugaucgccauugagagagaaaaugggcccgagcugaugcgcgucgugaaguucagcgcuggaucccuggcccuugcgccgccucaggaggccggcagccugaaggcucgggaugccgacaaaaacgaucccuuuaaguacguuuaugggucuccuuccagccuccaaagauggaaagcucgccaggugcggaucgacgaacugggaagagucuucgaucccggcuuugccgugcgcucucggagauccagcgaguga

SEQ ID NO: 3906 - RNA, 3291 nt, Artificial Sequence
  Cas9 variant
augaagaacaucuucagcuuugacauuggcaccaauuccaucgggugggccgugcuggcucucgauggaaacggcgaccccgucagaauugccgaugcggggguucggaucuucucugacggacgcgauccuaaaagcaaggcuucccuggccgaggccagacggauggcucgcgccaugucuagacggcgcgacagaacacuucggcgcaaaagagcuacgcugcggacccucgccgaaauuggccugaugccggauacaagcuccgcgcgccaggcccaacuuagagagaccucugaccccaagagcggguccggacagcugacacggaauccuuacgcucuccgcgcccuggcucuggaagagaaacucccccuguuucacaucggcagagcccuuuaucaucugggccagcggagaggguuccagagcaaccgcaagaccgaucggaaggacaaugauaaaggaaagaucgcgcucggcauugaagaacugcacgccgcuaugagacaagacggggcccagacauacggacaguggcuugcucgccggcaugcccugggccaggccgugagacuccgcucuggggcucuggaucuggagggagaaggcuaugcguuuuacccugagcggaaacuccuggaagacgaguuccacagaaucugggaggcccaagcucgccauuaucccgacauucuuaccccugaacggagagaucaccuguuuacggugauguucuuucagcgcccgcucaagaaacccaaggucggcaagugcuccuucaacaaucaggaggaacggcugagcaaagcccacccucuuuuucaggaguucagacuguacaaggaagugaacgagcucgagaucguugaacccgaccugacccauaaaaagcugacacucgaucaacggaaugcccuggugaaaaagcugcaggucucucgcgaggcuuccuuugccgcgcugagaaaagugcucaagcugcggccugaccagagacuuaacaaggaaagcgagucucgcaccaaacugaaggggaaugaaguuuaugcugugcucuccgauaaaacacgguucggacccagauggggcaccuucagccaagccgagcagugggccauuaucgagcgccugaaggaagaggaagacccggggagacuguuugcuuggcuccgguccgccuucggaauugagggcgaacaggcugccgauaucgcgaacguccaucugccugaggggcacggacgccuuggcaaaacggcccuggaggcuaugcucgaggagcugaaggccgaagugaucacagaggcugaggccgcgaagagauguggcuacgaccacgcccggcuugggggaggcucugaugaaggggagcccgaacuuccucccuaccaggagauucuccaacaccgcauucccccuggaaccaauaacccggacgaucccuaugacauugaaaaaggcagauuuacaaauccuaccgugcauaucgcucugaaccagcugcggcacgucaugaacacccucauucgcagauacgggaagcccgcccagaucgcuguugagcuggcccgggaccuuaaacugagcgagcgccagaaggaagaggugaauagaacaaucgcccggaacacgagagaugcugaacgccggggcaaaacccucgaggaaaauagaaucccuaacacaggauauaaucgcacccugcugcggcuuugggaggagcucaaccccggcaagguggaagacagaugcuguaucuacacagggaagccgauuuccaucagcaugcuguucucuggagaggucgauauugaccauauccugccuuggucccgcacccucgaugacagccacggcaauaaacugcuuugccugcgggaagcgaacagagugaagcgcaaucgggcccccgcugauguuacggaguggagagacaacuaugaugaaauccucucucgggccgcccgccugccucaaaauaaaagagaccgguuugcucccgaugccauggagcgcuucgagaaggcugggggauuucuggcgagacagcuuacagacacccaguaccucagccggauggcccuggaauaucuggccugucucuucccugcugaggaaauggauggcuuuggggagcugagacgccaucgguacauuaacgugugccccggcagacuuaccgagaugcugcgccggaauuggggacucaacuccauccugucugacagccagcugggcgaaacagcccaagagaaaaauagaaaggaccaccgccaccaugcgauugaugcuaucgucauuggggugaccggacggucccuucucaacagaaucagcuacgccgccggccgccuggaagcucagcagcuggagacacucguuaaggaagccgcugccacgaacaaaccgugggacggguucagagaggauguggcgaaggucgugggaggcauuaucgucucucacaaaccugaccaugggaccgccggccggaaggcuaaagaucccgcccgccagcaaacagcuggaagacugcacaaugacaccgccuauggccuuacaggggagaccgaugcccggggaaacacgaucgugguucgcagaaagcccuuucugucccucaccagcaaagacauuccuucuauccgggaugaagcucugagagcggugcuggagcagcaccuucgcggcauuccggacgggaaggccuuccaggcugcccuggaugccuuucggaagcaaaaaggauuccaucacuaccauggcaucagacacguccgccucacagaaccccuguccgugauugggaucaaggaccgggauggcaaaguuuauaagggauacaaaggcgacgcuaaucagagauaugacgugugggagacccucgaugggaaguggcaugccgaagucgugagcauguucgacgcgcaccagccuggauggcagucccgguuucacgcugagaaccccacagcccgcagagugcugcggcuucaacaggaugacaugguugcccugaaugcuccugauggcgggcgccuccuggucagaguggugaaguuccggcagaacggacagaucaccuuugccggccauaaugagucuggcaaccugaaagcgcgcgacgcugccagcaaugaacaagaucccuucaaguacauuuccagaauggccucuagccuuaaagacugugggugccggcagguccgcaucgaugcuacgggacagguguuugacccuggcccccaggauagagccucccggcugcaaaagcagagcaaaagauga

SEQ ID NO: 3907 - RNA, 3294 nt, Artificial Sequence
  Cas9 variant
augaagaaacagccccaaagauacauccugggccucgaccuggggauugccagcgugggaugggcucuuauccuggucgauggcgccgagaacccuguugggcuccuggacugcggagugcggaccuucgaacgcgcggaggugccgaagacaggcgauucccuugcucuggccagacggcaggcccgcucugucagacggcucauucgcagacgggcucaccgccugcugagacuccggcgccugcuuaaaagagaagggauccugagcgccgcugacuuuaauuccgauggacuccccaaccugccuauugacgccuggcagcuucggguggcgggccuggagcgcaagcucacgaaucaggaaugggccgcuguucugcugcaucucgugaaacacagaggcuaucugucucaacggaaaagcgagacccagacagagaacaaggaacuugggagacugcucgccggagucgcugaaaauuccaaacugcuuucugaaagcuccgagcaguaccgcacccccgccgagcuggcggugaagcuguucgccgaacagagcggccaucugcggaacaaagggggagaguauacacacaccuuuaauagacuggaucuccaaaaggaacugcaucuucuguucgagcgccaguacgcucucggcaacccuuuugccucugcugaacugcaguccaaaguugacgagcuucugaugacacagcggagcgcccuccaaggggaggccgugcugaagaugcugggaaaguguaccuucgaacccucugaguauaaagcugcgaagaauacguacuccgccgaaagauuuaucuggcucaccaaacugaacaaucuucgcauccuguauaacggcgaggaacgggcucucgaugagggcgacagaaagaaacugcuggaugagccuuacaagaaagccaaacuuacauacaagcagguccgcagcauucucaaucugccggaaucugccguguucaaagggcugcgguauggaaaggacuccgauggccucaaagcugagaacgggacccugauggaaaugaaggccuaccacaaaaucagaacaauucuugacaaggcgggacugaagggcgagugggaaaaucgcauccggaaccccgagauucucgacaaaaucgggaccgcuuuuagccuguauaagacggaugaggacauucaggccgcccuggcugaucuuagacucccugaaaacgugcuggacgcccugcucgcuggacugaauuucgauaaauuuauccaacuuucccugaaggcccuccggaacauccugccccugauggagcgcggcauuagauacgacgaagcgugcaaagaggucuauggcgaucaccgggcccuugcugagucuaagaaucagguucuccugccucccaucccggccgacgaaauuagaaacccuguggugcugcgcacacucacccaggcucggaaggucaucaaugccauuaucagacgcuacgggagcccccagagagugcauaucgagacagcgcgggaacugggaaaauccaagcaagagcgcgauaaaauugacagaaagaacaaagaaaaucagaacgaucggaaucgccuugccagcgacaucagaaagcacuucaacuuugagccuacccccaaggacauucugaaacuccggcuguaugagcagcagcauggcaagugucuguacucugaucuucgcgaagagaaaggggaaugccucuacaccggaaauguuaucgagcugcacagacuguucgaagacggcuauguggagauugaucacgcucucccccugucccggacaugggacaacagccuuaauaacaagguccuggugcucaaaucuagcaaucaaaacaaggggaacaaaacgccuuacgaguggcuggauggcgccaauaacucccgcagauggcgggaguuccaggcuagaguucagggaugucauuuuccguaugugaagaagcagcgcauccaaaccgccaaacuggacucuaaggccgagcagggcuuccuugaacggaaucugaacgauacaagauacaucagcaaauuuaugugccaguucauuaccgcuaaucuccgccuggcggagacauccaacgcccucauggaagaggucgcuggggagaaucccuauuggaaggaacggaaaagacagcgcguguuugccccuagcggaucuaucauugcccugcuucggggccugugggggcucaagaaggucagagaggacaacgaucgccaccaugcucuggacgccaucgugguugcguguuccaccgugagcaugcaacagaaaauuacgaaggcuaugcagcggagagaaacacuggagaccgucgauucugagaccggagaagugaaaacacggaucccccaaccuugggacuucuuucgccaggagguuaugauuagaguguucuccgauagcccccgggaggaacuugccgaaaagcucaauucccgcccggaggcccuccacgacuuugucucuccucuguucgugagcagagcucccaaccggaaaaugaccggccaggggcaucucgagacagugaaguccgccaagagacugucugaaaauaucagcguuguccgcaaaccucuuacggcgcugaagcucaaagacaucgagaacauugugggcuaccccgaucgggaaccugcucuguaucaggcccugagagagcgccuucuggcccacaaggacgaucccgugaaggcuuuugccgacaagccguucuacaagccugcuaaagauggaggccaagggucccucgucaaggccgugcggaucauugaaaauaccaaacacggacugaagaucagaaacggcauuacagacaccaauggggauaugguucgcacagacguguaccagaaaaccgauaagaaaggaaagcggcaguauuuuaucguccccguguacgcguggcagguugagaagaacgagcuccccacgguggacugcaaaggcuaugaaaucgaugacaacuacgaguucuguuucagccuguauaaguacgaucuuauugaaauccaaaauccuaacgacauuaaucaggagcugagagccuauuacaucaacugcgacucuuccgaugggcgcuuuuggcuggcuuaccaugacaaaagcgccaaggaacagcaguucagaauuucuacccaaaaucagccgaucaucaaaaaguaucaggucgauacacucggcaaggagauucggcuguguaaagcugagaagcgcaccgcccuuaacggaaagaagaaaaaguga

SEQ ID NO: 3908 - RNA, 3294 nt, Artificial Sequence
  Cas9 variant
augggcaagggggacauccuguucagcuuugauauuggaaccaacuccaucggcuggugcguguucgcccucucugacaauggggaucccuguagaauccuggacgcuaacgcccggaucuuugcggauggacgcgagccuaaaagcggcaauucccuugcugaagggagacgggccgcccgcgcuauggccagacggcgcgacagauacaagcggcgcagaaaagcuguccugcggacacucacggaguauggacugaugccggccgaucccaaggcgcgccaggcccuuguugcuaaaaccggcgacagaggcccuaagucugaagaggcccuggcugauguguacagccuccgggcccgcgcgcugauggaaaagcugccccuccaccauauugggagagcccuguuccaccuuaaccaacggagaggauuuaaauccaaucgcaagacagaccggaaaucuaacgagaagggcgcuaucgagaccggggugaauagacugcucgaagagaugcgcgauacaggagccccuacccugggcgcuuaucuugccaaacggagaagcgacgggcgccccguccgggugagagccggagcuuccgaacaggaggcggaggauggcaagccugccaagacagcuuacgacuucuauccgguucgccggcugcucgaagaggaauuugacgccaucugggagaaacaguacagcuaucaucccgaagugcugaccgaggagagacgcggccaccuguuccgggucauguuucaucagagaccucucaagcccgccauuguggggcggugcucuuucaacuccgcugaaacgcgccuggccaaagcgcacccucuuuuucaagaguucagacuguacaaggaaguuaaugagcucgaaguggucaugcccgaucagagccaccggaaacugacccuuccggagagagaccgccuggugcucaagcugcggggacagagaaaagcuacauacgccgcccugcgcaaggagcucagacugcgggaucuucgcuuuaacaaggaaaccgagaauagaacagacaugaugggcgaugaagugaccgcugcccuggcugacaaagccgucuucgggaaccgguggucuggauucuccacggaugagaaguggcgcaucguugaaagacuccgggaggaggaagacccuuuugcgcugcaugaguggcuugugagcgaacacggccugucugaugccgaggcugagcaggccgcuaaagugcaucuccccgacggguauggacgccugggcccuacagccgucuccaccaugcuggaagaacucaaggcggaugugauuacagaagccgacgcugccagacuggcuggcuacgaccacagccuugcccgggccgaugaggacgggcuggaucgccuccccaaauaucaagaaguucuggagagacggauucccccuggaaccaaugacccggaugaccccuacgauauugcuaagggcagaaucaccaacccuacagugcacauugcgcugaaucaguuccgccaugucgugaacgcccuugcucggagauuugggaagcccgaccagaucgccaucgagcucgcccgcgaacugaaacugaacgaucggcagaaggacgagguuaauagagugauuggacgcaacacgcgggcugccgcgcucagaucccaaaaacugcgcgauaucggccagaaggacaauggguauaaccgggcccuucugaaacucugggaggagcugaauccugauaagcccgaagacagagucuguguguacaccggccggccgauuugcaucucuaugcuguucagcggagaggucgacguggaucacauucuuccuuggucccgcacaauggacgauagccaggcuaacagaauccucuguguuguggaggccaaucgggucaaggcuaaccgcgcccccgcggaaguggcugaguggggcgggagauaugacgaaauccuggagcgggccgccagacugccucgcaauaaacgguggagauuugcucgcgaugccauggaaaaguacaaagagaacgagggauuccucgcucggcaacugaccgacacacaguaccuuucuagacuggcccgcgaauaugcggaggcccucuaccccaccgaggaaccugaucggcugggcgagcugagacgcagaaaucauguucgggugauucccgggcgccuuacggaaaugcucagacggggauggggccugaacgcucugcucccggaccacaauuuuggggccggccaggcuaagaaccgcaaagaucauagacaccacgccaucgacgccgcugucgugggagugacaacccggggccugcuucagagaauuuccaccgaggcggggcugcgcgaaaagcucgcccuggaggaaacaaucgcugauauuccuaugcccuggcccggauuccgggaggagcugaaggccgccaucgacagagcuguugucagccauaaaccugaucacggcacccuuccgaagcccggggaacauggacgcacagccggccaacuccacaaugacacggcguaugggaucaccggcgagacagacgcucggggaaacccuauuguggugagacggaaacccuuucugucucugaccgauaaggacaucccuagcauucgcgauacagaacucagaggccgggucuacuccgccaccucugggcugagcggacgcgagcuuuccgccgcucuggacuauuucagaaaaacggauaagcaguuucggggcauccgccacgugagaguuaccgaaagccucucugugauucccauccgggaccgcgaugggaacauuuacaaaggauauaagggcgacgccaauuucagauacgaugucugggagcugccugacgggaaguggaaagcggaugugguuacaauguuugacgcucaucggcccgacagagccgccgaggaacgccggccgcacccugcugccagaaaggugcugucccuuaaacagaacgauauggucgcuugcgagcaucccaaggacggcuacaccaucggacgcgugguuaaauucaauacagccggccagaucuauuucgcggcccacaacgaagggggaagccugaaggcucgggaugccgacagagcugauccuuuuaaguacuucucuaaauccgccagcggccucaaggagauugccgcucgccaagugcggaucgacgcgaccgggcagguccuggaucccggaccgcaggacagagaaucccgccucgcccggaauaaaagacuggagcgcgagcgggcuuga

SEQ ID NO: 3909 - RNA, 3303 nt, Artificial Sequence
  Cas9 variant
augaaguacaccaucggccuggacauugggacaagcuccgugggauggggcgucaucgauacggagagaaaccggauucaggaccucgggguucgccuguucgaaucugccgagaaucaaaaagauggagaaagccuugcuaagcccagacgggacgcccgcuccaugagacggcgccuggcgagacggggcucucgccucgagagagugaaaagcaucuuugaaaaggcuaaauuccugacccgggggcagaugggaauuacacacgcccgcccuaacgauccguauagacuucgggccgagggccuggaccgccuccuguccaaugaggaucuguuuaucgcuguguaccaucucgccaagagacggggcuauaagucuaacagaaagaauguccuggaaggggacggagaggaugugcgcgaaggcaaggcuguucuugacgggguggcccagaacaaaaagcugauggcguuccggggauacagaaccgucggcgagauguuuuucaaagauagcguguuuacagaggccaagcgcaauaaggcuggguccuauaaacacugcguucuccgggaaaugcuggaggacgaacuuggaaagauccugcaugcccagagaagccucggcaacacccuggugacagauucuuucauuuccaaacugcucgagaagaaaaccggcgucuuuguguaccaacgccccuucgcuagcgggaaucagauccugaaacuugugggaccuuguacguuugaacccgaggagauucgggccgcgaaagccaccuauucuuuccaguacuuuaacguccugcagagacucaauaaccugacaaucaagaauaccgacacaggcaccgaacgcaaacuuacguccgaggaacgggcuaagaugauugccuucaucuucagccacaaggacguucaauacgcucagauuagacuggagcucaaacugucugauguggaccgcuuuaacauggugaauuauuucguccagcggaaggaacuggagacaaaaaccgccgaggaacucagacgggagaucgaaaagaagacaaaauuuccuucccugagcgauuacuauaccauccgcaagaccguguccgagauugacucugccuucuggauccagauugaaaaacaacaugauguuaucgacgcuauuggggagaucuuuacacuuuacaagacggaugaggacaucauugcgcagcugaacaccagaauccccagcauuccucggccgguggucuccgcccuccugggacuuagcuucacaaaauuuggccaccugucucucaaggcucugagaaagaucauuccccaccuggaaaacggggauaccuaugacguggccugcgccaaagcugauccuaaguacacagaccgcgccaaaacccgggcgagaaagcuccgcccccuggacaaagaggaucauuccaucacgaauccuguugcuagacgggccaucgcccagacaauuaagguggucaacgcuaucauugacaaguaugauagccccucugaagugcacaucgagcuuggacgcgaccuggccaaaaauuucaaggagagaaugaaaauucaaaaggaacagaaacagaaccaggagggcaaugaacgggcuaucgccaagauucaugagcucuacaaacuggaaaacccgcgcggccaagauaucaucaaguuuagacuguggaaugagcagaacgggcaguguauguacagcggagagcggauugacgaaauccgccuuuucgauaauggcuauaccgagauugaccacaucauuccuuuuuccagaucuuucaacgauagcuacuccaauaagguccucgugcugaaaaugcggaaccaggaaaagaugaauaaaacccccuaugaguacaugggaggagacgcggauacauggcaacgcuuugaaaaccugguuaauagcaugcacaacaucggcccuagaaagaaacagaaccuccugcuuaagaaguauguggccgacgaucugacccuccggacacugaaugacacgagauucaucgcucgcuacaugaaaaacuauauugagaauacccugcuuuucacagaggggccccagaagcagcgggucuacaccgugaacggccaagccacagcuuaccucagaaaacgcuggguucugcauaaggaccggaccgaaaauaacagacaccaugcccaggaugcgguggucguggccguggcuacgcccucucugguucagggaaucaugcgccacgccaaaaugggcgagauugucgacuaucuccauucccagaaguuugcuccuaaugugaccgauaucgaaacagggaagccguucgagagcgccgacauucaaucugccaaagaacggaucaucgcuaagcacgagcacagacugcgcauucccgagccuugggaaggauuuuccgaugagcuugacgcgcggaugggcgaugacguggucgaaaaacugagccucagaaaguccaacauccauggguacaaaaccacaucugauuucagccagauucaccccaucuuugugucccggaugccuaagcgcaagaccacggggagagcccaucaggagacacugcggucuccccgcagauucaaagaguuucaagaaagcguugugcggaccccgcuguccagcauuaaucuuaagaaacucgaggaaaugucuggcaagaacuccgacaaacugcuguaugauauccucagaaagcgccugcuugcucacggggacgauccuaaaaaggccuucacagagcccguccacaagccucggaaagacggcacccagggaccccuggugagaagcaucaagaugguuucugaaggccagcgcuccgggauucucgugaauaacgagcaggcccuggucgaccaagauagcaugauccggauugacaucuuuucuaaaccuaauaagaaaggaaaggaugaguacuauauuauccccguguacgcuuaucauuucgcccagaaggaacugccgaacaaaguuauuaccgcgaaggcugaggccgacuggagaacaaucgaugacacguuugccuucgaauuuagccuuuacccuaaugaucucgugaaacugaccaagggcgacgauauccgcuucggguacuauuccggaugcaaccgggcucuggccgcgauucacauccucccccaugaccagaacaugccccuggucaauaacggcauuaaaacacuugauaagaucgacaaguacgugguggacauucugggggaguaucacaaagucggcaaggaaaccagacagcaaauccaguga

SEQ ID NO: 3910 - RNA, 3303 nt, Artificial Sequence
  Cas9 variant
augggcgccaccaucgugacagacauuagcagauccgcuuucgccuuugauaucgggacgaagucuauuggaagcgcgguccugcggcucgacgaucgcggcgagcccaucgggauuaucaacgcugccguuagaaucuacgccgacggacgggaaccuaaauccggcaccucucuggcugaggggcgcagacuugcccggggaaugagccgcagacgggaucgcuauaagagacggcgcagaacacugcucaauacccugacagaguucggccuuaugccgcccaccgacgaggcucggaaagcccugcucgcggaaacaaacgaucgcagauuuggcgccguggcugggaauguguacgcccugcgggcuagagcccuggacgagaagcucccucugcaccaucuuggacgcgcgcuguuccaccucaaccagcggagaggcuuuaaauccaaucgcaagaccgauaagcgggacaacgaucaagggaaaauugccucuggaaucagcagacugggccagaaacuugacgaggcuggggcccgcacgcugggagaguuccuccaucggcagcacuccgcuggcaaaugggucagagugcgccccagccggguuccuucuaaggaugacaaagaggaagacggcuauggguuuuaccccgagagauccuuccuggagcgcgaauuugccgccauuuggaaggcucaggcggccuucuauccugagcugcucaccgaagaacggggagaucaucugcacagagugauguuuuuccaacggccgcuuaagcgccccaaagucggcaagugcagcuuuuacccugacgaagauagacugcccaaagcucacccucucuuccaggaguuccggcuggugaaggagcuuaaugaacuggagguugugcauagaggggaccgccgggaaaaacucacacuggagcagagagauacccuguuuaaccagcuccgcacacaaagaucuuccgccuucaccgcccugcggaagacgcuuaaagcucccacaggaacccgcuuuaauaaggaaagcgacgccagagauaagcugaaaggcgacgaggucgcggcugagaugucucacaaggaucgguucgggcaggccuggaucggaaugccgcucgccgaacgcugggcugugauugagaugcugcuugacacagaagauccucuggaggugaaagccuggcucgaagaacauuauggcuuugcugccgacagaaucgacgcgauugccgcugccaagcugcccccuggcuacgggcggcugggagagaccgcucuccgcgauaugcuggacgaacuuaaaaacggcaccgucaaggaugacuccgggagagauguugugcugacagagcggcaggccauggacaauaucuggaaggauaaccccgcgcuccagcgcguggucgccgacgcuagagaacugcccccuuaccaagaggugcugggacggagaaucccgcccggcacggggaaaccugaggaucccuaugacguucagaagggccgccuuaccaauccuacagugcacauuggacucaaccagcugaaacgggucgugaaugcccugguuagacgccacggccggcccgaucaaaucgcucucgaacuggccagagagcuuaagcugaacgaggaacagaaagccgaaaaggaccgcgagauugcucggaacaccaaggcggcccaggcuagaagcgagaaacuccgccagcuggauaucgacgacaauggguacaaccgggugcugcuuaagcucugggaagaucugaaucugagacaaccggagaaccgggaauguauuuauugcggaaaagccaucggcaucgggacacucuucuccaaucaggucgacauugaucauauccugccuuggucuaagacccuugacgauagccaggccaaccgcauugugugucacgucgagugcaauagacagaaaggaaaccaugcucccgccgaagugccucaauggcacgaccgguacgaugacauccuggcgcgcgcugagagacucccccggaauaaggccuggagauuuggccgcgaggccaugaagaaauucaaggaugacgaauccuuucuggcucggcagcugacggauacacaguaucuuagcagaauggcccaugaguacguugcggcucucuauccugacgaggaacccgaugaauggggcguguucacccgccggaaccacgucagagugauuccggggcgcaugaccgagaugcugcggagacaguggggacugaaugccaucaucucugaccacgaccaaaagaaccgcaaugaucauagacaccaugccauugacgcuaucguugugggcgucacaacccggcgccuccugcagagaauugccacagcugccgggggacgggaggcgcuugcccuggaagagacgaucggcaagauugaaccucccuggcccggguuuuacgaugacgugaaagaggcuaucgaucgcauugugguuucccacaagccugaccacggaagccucccgaaacccggcgagccugccagaaccgcugggcagcugcauaacgauacagccuacggcuucaccggagaggaacggaagggcguccccaucauggugcacagagugccuuuugccacacugaccgaaaaggacauccccucuauucgcgaucggcagcuugcugaggcgcucuauggggccaucgcuggaauuagcggcaaagccgaacuggccgcugcccuggcgagauucuccgcuucugggccuuacaagggaauccgccauguccgggugguugagcccgugagcgucauugccaucaaagacagagauggcacgccguauaagggguacaaaggcgacgccaauuaucgguacgacgugugggagcucccuaacggaaaguggacccacgaaguuguguccauguucgaugcucaucgccccgacuggcaaagcgagaucagaaacaagaauccugccgcgcggaaaguccugucucuucaccagaacgauaugguggcuuaugaacacccccaggacggcuacacaauugggcgcguugugaaguuuggauccggcgggcaaauggcccuggccggaaauagagagggcggcgcucucaaaagccgggaugccgacccggaagaucgcuucagauacuuuuauaagucugggggagcuaugcgggacgcccgccugagacagguccggguggaugagaccggcagaguguucgacccugggccccaggaucgcgagucccggaacgcgagaaaacagagcgccgcuggauga

SEQ ID NO: 3911 - RNA, 3306 nt, Artificial Sequence
  Cas9 variant
augaagacccugggccucgaccuggggacaaacagccuuggaugggccaucguggagacgagagaugaacccaccaaauacuccgagggcucuauugucgcuagcgggguucggaucuucucccagucugaaauggccggacgcgacccucaaagcaaggcgucccuggcuguggccagacggcaggcccgcggcucuagacggcgcagagaucgguaucucaaacgcagacagcggcugguggaccuucuggucgaucucgggcugaugccggcugacaaggccgcucgcgccgagcuggugaaaaaucacggagauggcaagacaggcgaccucagcuccagcguuuacgcgcugagagcccgggcucuugaugaagcccugucucccuaugagauugggcgcgcuaucuuucaucucaaccagagacggggauucaaguccaauagaaaagccgacagcaacgauccugagcaaggcgugauuucugaagggaugcgcgcgcuggacgagaagauggccgaagcuggagcccggaccaucggcgaguggcuucacaugagacgccugcaggggcuccccguccgggcuagaaucgccccugauggagagggcuacgccuuuuaucccucccgcggcgcucuggaacgggaguucgacagaauuauggcgcgccagacacuguuucauaccgaccuccugacagauaccgccauccgggaacuuagagaggugguuuuccaccagcgcccucugcggccggugaaacccgggaagugcagcuacaauccucucgaagagagacuggcuaaagcccauccccuuuuucaaaaguuccggcugcucaaggagcugaacgaacuggagauugucggagaagaccagaaacacaucaagcucacgccugagcagcgcaaugcccuggcucuccagcugagaaccucucucacaaaacaaggcaaggugcccuuuuccaaacugcggagcacccuuaagcuggggagagaagugcgcuucaacaaagagacagauaaucgguccgaccucgagggagaugucauuuauuuuagaaugucucgcccggaauguuucggcaacagaugggccgaccugccuguugagaugcaggcggcuaucaccgaacggcugcgcacggagcccgauuacaagacacucaugaauuggcugaaggccgaaaccgggcuugacgaggugcacgccagagcuguggccgauacaccuguccccgacggauuuggccggcugggccagagcgcucucaccgcccugauugaugcgcuggagaacgaagugggggagggaggcuucguuaucaccgaagccgaggcugccaaacgcguguacgggagaacaaauuccgaggcugaccccgaccggaagggagucgaugaacuuccuaaauaucaagaggugcucgcccgccauaucccgcccggcacgggggaaccugacgaucccuacgacgauuucaugggcagaauuaccaacccuacaguucacaucgcgcugaaucagcugcggcgcguggucaacgcccucauuagaaccuauggaaagcccgaccggaucgcuauugaggugggcagagaucugaaaaugaacgaccgcgaacgggaugaggucaauagacgcaucgggcggaacacaaaggccgcuaucgagagaggagugaaacuuaccgaaacguuucgccagcuggacacaggcuacaaucggcucagacuggagcugugggaagaucuuaaccagaaaccggagaaucgcguuugcauuuauugugggaaggccaucgccggacauaugcuuuucaacggcgaaaccgacauugaucacauccugccuuacagcaaaacccuggacgacucuaaggcuaaucggauucucugcuguacauccugcaacagagagaaaaagaaucggcccccuagccgcgugccccaauggagaucucgguauggggagauccuggcgcgcgccaccacacuuccuaagaacaaacaguggagauuugcugaagaugccaugacgcgguucggcgaggaagagggauuucuggccagacagcucaccgacaugcaguacaucagccgccuggcucugacauaccuugcccaccucuaugauuacgaagaggucgaccuggauggcauuuauaagcggcaugcgagagugcgcgcucugcccgggcggaugaccgagaugcucagacgccaauggggacugaaugaacuucugcacgaccauaaccucaucggcggggauguugccaaaccgaagaaucggcuggaccacagacaucacgccauugaugcuaucgugauugccuguacaucccgcgcgcugauccagagacuugcuaccgccucugccgcugccgaggaacggggagcugagcgcgucguggagagaauugacccucccuggagcggcuuccgggaagaugugcgcgccgcgguuggggccaucgucgugucccacaaacccgaccauggcacggugggaagagagggcuacgcuaaggggcggggacagaccgccggcaagcuccacaacgauacagcuuaugggcauaccggagaaaaagacgccagcggcaaugacaucgucgugagacgcauugccguuacagauauccggucuccugcugacauuagaaagauccgcaccaacgcgcacgggcacuccgagcugcgggauagacuguacgaagccacgcggggccucgagggaaaggcuuuugagcaggccgugcuggacuucgucaagggcgaugccaaauuucgcgggauuagacaugugcggaucacagaaguugcuaacccgguguggaucacccacggagacggccgccauaagaaaggguaucuucccggaggcaaugauagauucgacgucugggagcuggccgauggccggugggacgcggaagugguuacaaccuuugaugcucaccgcccuggguucgugcccagaaugcggcucgagaaccauaaugcccgcaagauuaugagccugaagaaaggagacaugaucgccuacaacgacccugucucuggccaaagaauuaucgcuauugugcggaaguuugaucagagaaauaaacagcuguaccuugacccccacaacgaagccgggaaucuggaucgccgggagaaggagaaaaccuauaagccucucagacccaugccgaacccucugaagaaauaccgccccagacaggugcggaucgacgaaaucggacaagucuucgauccuggccccuggugggagcgccaggacggguga

SEQ ID NO: 3912 - RNA, 3306 nt, Artificial Sequence
  Cas9 variant
auggagcagaccagccuggaccucucccaagccaugaagaaaguggcucagccccagaagccuuacagacugggcgucgauguugggguggccucuaucggagcggcugccgugacagacacggaaauucuuggcauccacguccggaccuucgagaaaggggaaauuaacggaaagagcggccgcaaaccgcugaaugccgauuauagacggcagaaggggcaacgcaagagacuccggcgcaaaaagaacagacugcuuucccugcggcgccucuuuagacgggugggaaugaucgagucugcugccauugaggcuuuccccaucagcuccacaucuccuuggcagcugcgcaccgaaggccuggacagacggcucacaaaugaggaaugggcccagguucuguaccauaucgcgaaacaccgcggcuuucagagcaacagacggguggauauggacgaggccaccaaacuuuccgaugcugccggggacagccccgaaacaaccacgaauaccgagucugauuccgacacaaagaagaugcuggcuggagucgccgauaacaagagacuccuggcggagaaaggcuaucgcaccauuggggaagccguggcucgggacccuaaguucagccauagaauccgcaauaaagaggaaucuuacucccacacaauuggacgggaugagaucaacgccgaacuuaauugccuguuucaagcucagaaccauuauggcaauccccacgccaccgaggagcucagcgaacagauuaucgaccugauuaacuggagacgcaagacgguuacaggggacgauaucaaacggauggugggaagauguacccuggagccuaaggaauaccgcgccgcuauccacucugucuccgcggaggaguuccgguggcucagcacacuguccagacuucgcauugugacccagggcgaaucucggccgcugaccaaaugcgagugggacaagguggucgaucuccccuggagacaagaagccaucacauauacgagcauucggaaugcuaucggccugcgccaugacauuagaucccgguuuaacaucagauacgagaccgggggaaagaaaacaaagaccgauaccaaaaaugaaaccacgaagggccagagcgccgacgccguuacaucugaggugaaaaccgcugaaaaggagaccgccuucaaggcgaaaggguaccacauccuucgcaaggcuuauaaagccuuuggauacgaugagcagugggaccgggauagauucaacacagaacugcucgacacccuggccacagcugugacguuuuauaaggaugacuccgagauucaagcccaucuggaaaccaacgacacaccugaguacgcuauccagauugcccuccgccugcccacccuuacaaaauucagcaagcugucuaauaaggcgauccucaaaauucugccucacaugagagagcggcagagcuauuccaacgccugucuucuggcuggcuacaagaaucaccauaaacaguaugaugacacaccccaaaacgggaagaucccgcgcucugccaucgaacacauuaaaaauacggucguguacagaagccucaaccaggcucggcgcguuaucaaugccauggugaaggaguacggagcgccucaggaaguccauauugagcuggccagagauauggaaaaguccgcuaaaaagaaagacgagaucgaucuguggaugaagaaacggaagaaaaagaacgacgagcuccgcgaaagauuuggcaagaaucugagccgggaugagcuucugaaauauaagcucuacgaggaacagaacggccaaugcgccuauucucugcagcccauucagcuggggcgccuucucgaaccuaauuacguggagguugaccacgcucugcccagaucccggagcauggauaacucuuauaauaacaaagugcugguccucaccaagcagaauagagacaaaggagaucgcacacccuucgaguacuucggcgaagaccaagaguccguggauuggaagcgguuuaccaacugggucgaaagcaacccucagaugccgcaggccaagagacgcaaacugcuuacaaagucccugcagaaagggauccucgacaauuucucugcccggaaccugagcgacaccagauauauugcucgcgagcugaagacgcuuaucgaacauuacauccucaauacacccgagcgggagaaaaccaaguacgaaagaugugugguuauuuccggaaagcugacagcgcaaaugcgccagcuguggggcaucucuaaagcccgggaugugagcgacagacaccacggguccgaugcugccgucauugccugcaucaccccuagcauggugcggcgcauuaccagauaucuccagcugcaagagcggcgcgcuaugcccucugccccuggcaagggagacgaacaucccgcgguuguggcuagagccaucccgcacgccccuguccccuggccuacauuugagcaugaucuugaggcugcccuggaaaaagugcucgugucccggccccagagcagaaaguggucuggcccuauccacgcggacacgauuuacggggagcacaaagaucaggaaaccaacacaguugcucccacccagcgcaucaagcugacacaacugaccaaguccaauuauaaaaacauugucggauacgacgaggaacggaauaaggauuucaucgaccagauugaggagagacuugaaugucauaacuuuaauggcaaacaggccuucgggacgagccagucuccgaucuaucgcaucaagaaaaacggagagcucggcccugaagugaagaaagugacaauuaagcugcccaucaagaauagcgucuuucggauuagacgcggguacgugaaaaacgccaaaaauuccaccaucuauauuaacaucuaccaaaauaccaagacaggcaaguucgagaugcaccccguuuacgcuaaagaucugaccagcucugccaacgcuuccaagagcuuugaauauuccccugaccuccagcugguggauacaauccggagaggagacuacauugagaucacgcgcagaaacggcgaggucauuucuggguauuacgccacccauaauaucagcacauccgugcuugaacugcagccgcacgacaccacagauucucggaacaaucgcacccccgcgauuaagacgagccucaacaucgagagauuccauauugacauccugggacggaaacgcagaguugugcggagagccaagaauggccuggcugaugaccgcgauaaauga

SEQ ID NO: 3913 - RNA, 3309 nt, Artificial Sequence
  Cas9 variant
augggcuacagaaucgggcuggacauuggaaucaccagcgugggcuaugccauucucaagacagaugagaaagggucccccuacaagaucgaacaccugacgucugucauuuucccuaucgcugagaacccgaaagacggaaagagccuugccaugccccggcgcgaacagagaggcgcgcggcgcagaaaucggcgcaccaaauuuagaaagcaucggacaaagaugcuguucguucgcuccgagcuccugaccaucaaacaaauugaagcuaucuauucugagaagcagaaacuuagcuccauuuacgagcugagaacaaaggcccucaacgaacggcugaccaaugaggaacuguuucgcauccucuauuucuuuucugggcacagaggauucaaaagcaaccggaaguccgagcugacagagaaggauaugggcccugugcuuaccgccauuaaagacaucgaagagaagcuggcugauggcacguaccgcacccucggggaauauauggagcuggacgaaaaauaccaggagcauaagagaaauaaagauggaauugaccgguaccuuggcacagccaagagaagccugaucgaggaugaaaucaaacagauuaucauugcucaacagcaguuugggaacaccaagcucacaucuggauuccagguggccuuuaucggcgacgaggaacaaaccgggauuuucaaugaucagcgcgaguuugaagacggacccggcaagcaguccccuuaugcgggcaaccagaucgagaaaaugaucggggccugcacguucgaggaaaaugagaagcgggcucccaaagccagcuacacauuucaauauuucgauuuccuguguaagcugaacaaucucaaauacagagaaaccauuggaggcgaguaucgcuuucugucucuugaacagaagaacguccugaaggagaaagugcucacaacccagaagaucaccuucuccgggguuaaaaagcugcuugaccugccugagcacgcucaauuuaaucucgugaacuacggaacaaaaagcacggucaaggaaaccgagacaaagucuguguucuaugccaugauuuccuaccauaaacugaagaaagcgaucccggcccccauuuuuagcaaucuguccaccgcugaacucgacgagaucggccggauccugacacuuuacucuagcgauaaggggcgcaaaaacgaguucuauuccagacuggccauuccugaagagguuguggaagcucuccugcccaucaacuuuagcaaguucggaaaucuuucucugaaggccaugcggaaaauuaucccuuaccucgagaugggccuggucuauuccgaagccgcuacccaggcgggcuacgacuuuagacacaagaaaauugaucaggccuauauccacgagaacgugacgaaucccguggucaagcgcgcugccagccagacaauuaaaaucguuaacaauaucauucggaaguacggggagccggacggaaucaacauugaacuggccagagagcucucuaaaaauuucagcgaacgcaagaagaccgugaaauaucaagaggaaaaccgggcuagaaaugagcggaucgccgauaagcugcgcgagugcgaacuuccugugaacggcgcgaauauuaccagacugaaacucuuugaggaacagggggaguucgaccccuacacaggacugaagaucccuuuugaucgggcuuucuccgaagaguacgaggucgaccauaucauucccuauucuaaaacccuggaugacagcuacggcaacaagauccuuguguccgccaaggccaaucaggaaaaagggaaccgcauucccauggaguaucuccagggcaagccugaaagaaucaaaaagcuggagagcauuacagcuacgaucaaaaauccgaagaagcgggagaaacugcucaagcaacagcugaccaaagaagauguugacggauggaagacaagaaaccuuaacgacacccgcuacaucucuucccugcuccacgauuauuucaaucagaacauuagcuuugccaaacuggagucugaaaagaagaaaagagugaucgcugucaauggcgccauuacauccaagcugcgggcgcgcuggggguucaacaaaaucagagagaauggagacgaacaucacgcccuugaugcucucauuguggccuguguuaccgacaaguacaucaaagagaucacgagcuuuuccaagcggaaagaggugcgcuucaacgaaaaucuguggaagagagagaagacaccccaggaaauugagcaagaagucgugcacuuuaaaaaggauuaugaccggaucuucaaccaggcuuuuccucugcccuggaccaauuuccgcgaggaggucucuugcagaaugagcgaaaacccugccgagcucaugaaaaaucauaccugggaaacauacaccgaugacgagauugcggcccugcggcccaucuuuauugugcgcaugccgaacaugaagacguccggcccugcucaccaggaaacaaucagaucugggaaacuugaggagaagggacugaauauuagccggguuuccaucgaaaagcucaaacuggauaaggagggcaccaucaaaagcgggaacgcccaguucuacaaggacucuggcaauggauggcaacugcuucaugauaaacucaagguggcucuggaaaagcacgacggcgauggguccaaagccuuucccgacggagucuucaaguaucaguaccuggacaaagagcauacagugagaaagguucgccucguggccaaaagcacccugcagaccucucuuaacgagaagaaguccgucgcugauaacggcagcaugauucggaucgacguguuuagaaaugaacaagggaaauaucaguucgugccuauuuacgcgaaggaucgcguugccaaaaagcugcccaaccaggcugucgccgugggaaaaaucgccaaggaguggccucucauugaagagucugacuucaaguuuagccuguauuccaaugaucugauccgggugaaacacaagaaaggcgucaagcacgugagcaaagacgggaacaaggaagagaaaucuaagacagauuucuuuggcuacuauacgggagcugacaucgccaccgcguccauuagcggcaucucccccaauaacuucuuugaguucagaucuauggggcuugcuacacucauuagcaucgaaaaguacaaaguugauuacuuuggaaauuaucaucaggugaacgagaagguccgccaaaaauucccgaagaaucggauguga

SEQ ID NO: 3914 - RNA, 3312 nt, Artificial Sequence
  Cas9 variant
augaaguacgacaucggcauugauaucgggguggccagcgucggagaggcuguuauugaccaggaaggcaacauccuggaggccugcuccaaucucuucgaugaagcggacgcugccucuaacguggauagacggaauuuucgcgaggggagacggaacaaacgcagagaacggacccgcgugaaugacuucaagaaacuguggacaaaguuuggauucgagauucccaaaaacgucaugaaugauacgauccuucugagaaacaagggcaucaagugugagcucgaccugaccgaacuuuauagcgugcugcucuacaugcugaaacaccgggggauuuccuaucuggaggaugccaucgacgaagcuaagggaucuaauuacgccaaaggcauugcucucaaccaaaaggagcugaaagagaagcucccuugcgaaauccagcuggagcgccucaagauuuauggcagcuacagaggggauuguaucguuaaaaaggaagacgaggaugaauaucauuccaauguguuuacaauuucugccuacaaaaaggagcuggagauccuuuuccggaaccagaaacugccggaagaguuuauccagggauacaugaagauuuucgaacgcaaaagagaguauuacaucggccccgggaaugaaaagagccggaccgacuauggagucuacacaaccaacaaggacgaggagggccacuauauuacagauaaaaauaucuuugaaaagcucauugggaaaugcuccguguacaaggacgaguuccgcgcggccggagcuagcuauaccgcccaagaauuuaacguucugaacgaucugaauaaccucacggugaauaacagaaaacugaccgagaaugaaaagaagaaaaucgucgagaagaucaaaucuuccaacgcugugaauaugcggagcauuaucaagaaagugcuuggcgaggacauugaacaguucggcggggccagaaaggauaaggcggacaaagagaucuaccauacauuugaagucuaccgcaagaugaaaaaggaguucgagaaaaacggaauugauaucgccgacuucucucgggaaaagcuggaugagaucggcaauauucucacccugaacacagaaaccgaggggaucaagggagcccuucacgaagcuaaaaauuccuuuacguauagcgagauugagacacugaucgacauuagaaagaaaaacucuucccucuucagcaaguggcagucccugucucugaaaaucaugaaugaacucauuccucagauguacgcucaacccaaggagcagaugcagcugcuuaccgaaaugggcguuuuuaaauucaagagcgugaaguuuaaaaacuccaaguauaucccuguggaggaaaucauuaaagauaucuacaaucccgucgugguucgcagcgugcggacaaccauuaagaugaucaacgagaccauuagaaaauauggguacccugacaacaucaucauugagaugccgcgcgacaaaaauucuacagaagagaaggaacggaucaagaaggagcaguccaaaaacgaaaaggaguaugagggcauucugaaaagaaucaaggaugaauacgacauugagaucaaucgcgaugacuaccggaagcaagaaaaacucgcccugaaacuuaagcuguggaacgagcaggagggaagaugucccuauagcggcaagaugaucucuauuuacgggcuccuggaagauccucagcuguucgagaucgaccauauuauccccaaaagcauuuccuuugaugacucucgcaauaacaagguccucguguaucggagcgaaaaucaaaagaaaggaaacaauacgccuuacauguaucuguccaagggcgauaaaaacuggaauuacgaccaguauaagagcuacguucuugggcugaaaaacaagggaaauaucucugauaaaaaggugaacaauaugcuuuucauggaggacaucaacaagauugauguccugaaaggcuuuaucaccagaaaccugaaugacacacgguacgccucccgcgugguccuuaacaugcuccagagcuucuuuaaugaaaaggacgggugccccaccaaagugaagguuauuagaggcucuuucacacaccagaugcgggugaaccugagaaucaauaaagaucgcgacgaguccuauagccaccaugcugucgaugcgaugcugauuguguacucccaacggggauaugaggccuacagaaagauccaggaggcuuguguugacuuugaaaccggcgaaauuaucgaugaggaacgcuggcagcagugcaucugggggaaggacuaugaucaagugauguacgaggccaaauggucuaagauuagagagaaaaucauugaagccgagaagaacgucaaauaucaccaucggguggacaagaaggugaaucgcggacucuguaaccagacgaucuacggcacaagaauuaaagaugggaagaucuacaaaaucagcuccuauaauauuuacgacaacaaggaaugcgcuucucugcuuaaaaugaucaagggaggcaaggagagcaaaauucugauguauaauuacgauuccaagaccuaucgggacaugaucaaaauuaucgaugaauacagcgacgagaagaacccguucguugccuauaugaaagagaccggggacuacuuccgcaaguacgcgaagaaacacaauggcccuaagaucgaaaaagucaaguauuacaaagaggaagcuggaucuuguauugauaucucccacaaguauggcuacgagaaagggagcaagaaggugauucucggaucucugaaccccuauagaacagacguguuuuucaaugagcggcugaaaaaguacuaucuuaucggcauuaaauacaaccauaucaagugcgaagggaacaauuacgucauugaugaggacgccuauaacggacuccugcgcgaugccggcgugaucucccacgaaaauaccaucaacgaccuggagaaaguuggggugaaguaccucuuuagccuguauaagaaugauauuaucaaauacgaaaagaacggcgagauguucgucgagagauuucuuucucggacaauggaauaugcuaauaacuacauugagacgaaaccuauccauaagcccuucuuucagaaaaaggacaagaaaggaaauauuaagaacagccagaaucuggugggccucuccaaaaccaaguauaucgggaaacugguuacagaugcccugggaaacaccuacaugguggaaaaggagaaguucagccuuaucgucgacauuuga

SEQ ID NO: 3915 - RNA, 3315 nt, Artificial Sequence
  Cas9 variant
augaagcugauccucgcccuggacauuggcaucgcuagcguggggugggccguccuugauaaaaaguccgagaccguucuggaagcgggaucuaacauuuuccccgaggcuagcgccgccggcaaucaggugagacgggaaaugcgccaagcuagacggaucaaacgcagacagcggacacgccucgacgauuuuaacaagcuguggagaaagaauaaccuuuccauuccucaguacaagucuacggagaucgugaaucugaaggucaaagcccuccgggaagagaucagccuggacgagcuguaucucauucuguacuccuaucuuaagcaccgcgggaucucuuaccuggaagaugcucaggacgauagccucuccagcucuaacgccuauaccaauggacugagagagaacgcgaaagcccuugaaaagcauuacccgugcgagauucaacgggaccgccugcagacaaucggcaaauauagagggcagacccagauuacagaugacaauaacgagaagaucgaucucuccaauguguucaccauuggagcuuaccggaaggaaaucaaaaagguucuggagacacaaaaacuguaccacaacgaacucaccgacgagcugugugaugacuauauccuuauuuuuaaucgcaagagaaaauacuaugaaggccccggcaacgaaaagagccggacggacuacgggagauucaccacacgccuggaucagaauggaaacuauaucgacgaggaaaacauuuuugagaaacucaucggcaagugcucuguguacccugaugaacugagaggggccgcugccuccuauaccgcgcaggaguucaaucuucugaacgaccucaauaaccugacaauuaauggaagaaagcuggaagagagcgagaaacaugccaucguccagcgcaucaagaccucuaacacggugaauaugcggaaaauuaucgcugauuguaugggcgaaacaauugagaacuuuuccggggccagaaucgacaagagcggaaaagaacaauuccacaaguuugagaccuacaauaagaugcgcaaaucccucucugaaauuggcacagauaucgacgaguucagccgggaugagcuggacaagaucggcuacauuaugaccaucaacaccgauaaagaagcucuuauggaggccuuuaaugaauccgggcugaaccucgacgacagcguuaaggagugccugauuucuuucagaaaagccaauuccagcucuuuuagcaaguggcaguccuucucucuuaagaucaugaacgagcugauucccgaaauguauauccagccuaaagagcaaaugacacuccugacggaaaugggaguggcuaagggcagcuccggggauuucgcgggacugaauuacauucccgucgacgugaucagcgaugagaucuauaacccugugguccgccggucuguuagaauuuccuuuaaaauccucaacgccgugcugaagaaauacaaggugcuugacaccauugucaucgaaaugccgcgcgaucggaauagcgacgaggagagaaagcggauuacagauucucagaaacugaacgaaaaggagauggaguucaucgagggcaaacucgcucagaucuauaauauuaagcuguccagcuccgacuuuucuagccagaaacaacugucccuuaagcucaaacuguggaacgaacaggaugggaucugucuguacucuggacgcaccauugaccccgaggauaucauuaagaauccugaccucuucgagaucgaucauaucauucccagaagcaucuccuuugacgacagccggucuaacaaggugcugguuuauagauccgaaaaucagaaaaagggcaaccagacaccuuacuucuacauuacccacagcgauggcgccuggacguaugagcaauuuaaagccaaugugaugaaccuuucuaagaaaaaggaauacgcuaucucccgcaagaaaguccagaaucugcucuauagcgaggacauuacaaagcgggaugugcugaaaggguucaucaacagaaauaucaacgacaccggauacgccucucgcguugugcugaauaccguccagaacuuuuucaaggcgaaagaagcugauacaaaggugaaggucauuaaaggcagcuauacccaccagaugagauccaacaugaaacuugacaaaaaucgggaugagagcuacucucaucacgccguggacgccaugcucaugggguuuuccgagaugggauaugaagccuaccgcagacugcaaggcgaguucaucgauuuugaaacaggggagauucugaagaacgacauguggaaugagaaaaugagcgaugacguuuacguggauuaucucuacggccggaagugguccgcuauccgcaacgaaauugucaaggcugagaaagacgugaaguucuggcauuucaucguuagaaaaucuaaucagggacugugcaaccagacgauucggggcacccgcgaauaugacgggaagaaauacaagaucaauaaauuugauaucagaacaaaggagggagugaaacuuuucaagaagcuggccuuuagcgaaaaagaguccgaccgggagaagcuccuggucuaucugaacgaucgccagaccuucaauaaccuugugaaaauuuuugaagacuacaaggaugcgcccaauccguucgugcaauaugagaaggaaacaggcgacguugucagaaaauacucuaagcggcacaacgggccuagaaucgauaaacucaaguacaaagacggagaggugggcgccuguauugauaucagccacaaguaugggcuggaaaaggacucccgcaaagugauucuggagucucucguccccuaccggauggauguguauuacaaggagagcgacaaaauguauuaccugguuggcgugaagcaguccgacaucaaaagccagaauggagcuaacgucaucgaugaagaccuuuauacccggauucugaucaaugagaagaugauugaaccuggccaaucucgcgaugaccucgagcagcugggguacgaauuucgguucuccuuuuacaagaacgauaucauugaguaugagaaagaaggaaagguguucguugagagauuugugagccgcacgaugcccaaaguccggaacuacaucgaaaccaagcccaucaauaaagccaacuucgagaagcagaauccugugggccuggggaagacaaaaucuauuaagaaauauagaaccgacauccuuggaaaccgcuaccucugcgagaaggaaaaauuuacaaaguucuguuga

SEQ ID NO: 3916 - RNA, 3315 nt, Artificial Sequence
  Cas9 variant
augaaccacuacgugcugggccucgacaucgggauuaccagcgucggauauggcguuaucgaucuggacaauuaccaguucguggauuauggggugagacuuuuuaaggagggaacagccgaagacaacgucaaucggcgcacgaaaagaggcucccggcgccugaagagacggcgccaaaccagacucgaugacaugaaagagcugcuucagaaggaaaagauuaugucugagacauaccauagcuccuaugaucccuacgacaugcggaucaaggggcugucucagaagcucagcaacgaugaacugaccugcgcuauucugcacaucacaaaaugucgcggaaccacacucgaggcccuggacuccgcggaugaggacucugaaggcaccaagagcauccuuuccaaaaaugaucaggaccugaagaaauaucauuacgugugccucguucaaaaggagagacugaagcagagcggcaaaauucgggggacggaaaacaauuucaagaccgacgauuacaucaaagagcuugacgagauucugucucaccaggaucucuccgaagaccugugugagaagauccgcacaauugugagcagacggcgccaguauuacgaaggaccuggcucugagaaauccccgacccccuaugggagauggaucgcucaaggagucgccccuauugaucugaucgaaaagaugcggggcaaaugcagcguguuucccgaccagcucagagccgcuaagaacucuuacacagccgagcuguucaaucuucugaacgaucucaauaaccuggagugugaaggggagaaacuuaccacgucccagaaacaggacguuaucgauuuugugaaugaaaagggaggcauuacaccuaaacaacuggcuaagcuccugaacgucgaccugaaucagaucaaaggcuuccgcauugauaagaacgacaagccccuccugaccgaguuuaaaggguauaaggccuucaaaaagaucuuugacacaaacaauugcgaucuuuacaaaaaggaccugagcauucucgauggacuggcggaaaucgugaccggcaagaaagggaucgaggagcggaagcaggccauucaacaggcuuauccugaaaucgacgaggccauuguggaacagugugcugucaugaaaggaaugacccaguaccauucccuuucucugaaggccaugcaccucaucaaccaagagaugcugcagagcccgagaaaucagaugcagguucugcacgaaucccauguguucgauaaaaaccgcgugagccacaagggccaaaaguacauugaggcggacgaugaggccauccucucucccgucgugaaacgggcucagagagaaacauuuaagguugugaaugcccugcgcgagaaauauggggaguucgaauccaucgucguggagacgacccgggacagaaacagccaggaacagaagaaacgccuuaaugauucucaaaaguacuaugagcaggaaaaccggaaaguugacgagcugcucagccaugaaggauacgauccuuccaagauuaauggcaagacaaaacugaaggugagacuguaucuucagcaggagggcaaaaccgcuuacacaaacgcccccaucgaccucaaucugcugauuaaggaugccaccgcuuaugaggucgaccacaucauuccucucucuaucagccuggacgauuccauuaacaauaaagcgcuuaucaaccgcacggaaaaucaaaacaagagcaacaugacacccaucuacgccauucugcgggggaagcucaauaucucucuggacaccuacaaaaccguggucaagaacaauagaaacuauacaggcaaaaagcgguccuaccugcuuuaugauaaagacauuaccaaguuuagcaauaugcaggaguucaucgcucgcaaccucguggauacaucuuacgccugcagaguugugauguccacgcugagcgacuauuucaaggauaaugaaauuuccacccacguccauacagugcggggaagaguuaccaacauguuucgcaaucggaucaacaugcagaaagagagagaaaaggacuaccugcaccaugccguggaugcucucaucgucgccucuauuaaaaagcugaaucuucugaacacauaucuccugaaauacaauuucaacgaccuguacaaugaggagaccggggaaguguuugcggugggagaugaccaacagguucuugauccgaaguauauccgcuucauuacgcagcucaagaccaucuacgacgagagcaacauguauuacaacggccugauugaaagaaaugucaugcaguuuccucccaucaaaaucucccacaagauugacacaaaaccuaaccggcaaaucucugaugagaccauuuauagcacacgcaccguggggaaugaagaguacguggucaagaaauauuccgacaucuacgaucccaaguucacgcagcugacagacgauauuaucaacgacagaccccucgaucgguggcugauguaccgcaaugacaaccagaccuuuaaaaucauucagagcaucauucuugaucauuuccacaucuuuaaggacgaugagaagcacuauucuuguaccaaaaagaaaggccaaauucaguacgcucugaagggcaaaaauccucucuaucuguacaagcaggaacauggaaaggugagaaaauaugccaagaaagggaacggaccggagaucacaaugaugaaguacuucgacggcaaacuggggaauaacauugacaucuccaaucacuaucauguucacaacaagaaggugguccuucuccagaucagccccuaccggaccgauuuuuacgugucuccugaaggaaaauauaagaugcugacaguucgcuacgccaauguguucuauaaagaguccaagaaaaaguacgucauugacgagaagugguaugcuagcgagaaaaagcggaaaaacaucacggaugacgauauuuuugugugcucucugcaccaugacgaacucaucggcauucaaaagaaagauggggccaaguacguuuaugaccugagcaccgaagauggcggaaagcccagacuuuaccacggcgagauggaaauccugaaauucacagcuaccaauaacgacuccaagaacaucauugaggugaaaccuaucuacacauauuguaagaaacagcucaugauuagcaucgggcccauuaccaagcuggccaaauacgcgacggauguccugggaaauguguaugaggugaagaagaacaucaucgaccaucuuucucaccuguga

SEQ ID NO: 3917 - RNA, 3318 nt, Artificial Sequence
  Cas9 variant
augggcaucagaauugggcuggacaucggaauugccagcgugggcugggcugucguugaugacgauuacaacaucauugaguccggggccaauaucuucaacgaagcgaaggcugccucuaauguggaccggcgcaccuuuagacagacaaaacggcuccugcgcagacaaaagacgcggcuucgcgauuucgacauccuguggauuaacgccggacucgauauccccaaagagaaggugaauaaacagcugcaguuuagaguccagggcaugaccauggaacuuagcgagaacgaacuguaugcugcccucaagaauaugcugaagcaccgggggauuuccuaccuggaggacgcucucgaugaggaacaaucuggaaaaagcacauaugagaagggccuccaggugaaccagaaagcccuuaagugcgacaaaaugccuugugaaauccaguacgagcgccugaugaaguauggcuccuacagagggcauauugagguuaaggaugaaucuggagaggaaaugauccucagcaauauuuucacccuggacgcguauugcaaagaggccaagaaaauccuugaaugucaaaagcaguaccacuccuuuaucacagaggcuuucgaggaugacuaccuggcccuccugcggcgcaaaagaaaguauuacgaaggcccggggaacgagcagagccggaccgacuauggaaaauacacaaccaagcugaaucccgaaacgggcgaguaugugaccgaagagaacauuuuugagaagcucaucgggaaaugcucugucuacccuaaggaaaugcgcgcuuccgccgcgagcuauacagcccagauuuacaauaugcugaacgaucuuaauaaccugaccaucaacggaagaaaacucgaguacgaagagaagaaaucuauuguggaagagguucaaaaggcuuccagcgugaauaugcugaagaucaucaaaaaggucauuaacgaggacaucacaaccauugaaggcgcccggaaagauaagaaugacaaagagaucuuccauaagauggaaacguauaacaagaugagacacuacuuugagaaaaauggccuugaguucaagaaaauuucuacagaugaccuggaugaaaucgggaacauccucacccugaauacagagaaggaagcuauucuggaggccuuuaacaaaucccagcucgaacugagccaggaggagaaggaagccuucaucgagauucgcaagaaaaauggaucccuuuuuaacaaguggcauucuuucagccugaaaaucaugaaggaacucauucccgagcuguaucuucaauccaaaaaucagaugcagcugcucaccgacaugggcguguucaagaaaaagaccgaaaucuuucagaacuacgauaagauuccuacagacgugaucaucgaggauauuuauaaucccgucguuaaacggagcaucagaauuacggugaagaucgugaacgcucugauuaaaaaguacggguauccucgcgaggucgugaucgaaaugccgcgggacagaaauucugacgaggagaaaaagcgcauccaagaugaacagaagaaaaacgacaccgaacugaagaaaauuaucgagaagguugaguccgaauacggaauuaaaaucacagauacccacuuccggaaccacaagaaucucagaaugaagcugcgccuuuggcaugagcaggacggccggugucuguacagcgggaaagugauugauaucucugaacuccugaacgacugcagcaaguuugagaucgaucacgucauucccaaauccaucucuuucgacgauagcagauccaauaaggugcugguuuauagcacagagaaccagaaaaagaccaaucaaacgccuuaccaguaucuugaaggaaacggcaaggaguggucuuuugacgaauacaugaaucaggugauugagcucaaagaucgcaagcugaucuccaaagcgaagaugaacaaacugcuguuccgggaagacauuacaaagaucgagguccugaaaggcuuuaucgccagaaauauuaacgauacccgguaugcuagccgcgugguccuuaauucuuuccagaaguacuuugaguccaagcaaagcgacaccaaagugaagguuaucagaggguccuucacacaucagaugcggaaaaagcugcagcucucuaaaaacagagacgaaagcuaugcccaccacgccguggaugcuaugcugauuuguuacucccagaugggauacgaggccuaucgccaacugcaggaagaccuuaucgaucccgacucugagaagauucgggaucucggccuguggaaggaaaccaucacagaggcgaaauacgacgagguccuguauacggcuaaguggcucgaaaauagagggaaaauucaggaggccgaaaagaaagugaaguuuuggcauaagguugauagcaaagccaaccgcgcucugugcaaucaaaccaucagaggaacacgggugaucgacggcuccauucagaagaucaacaaaauuaacaucuacagcgucgauggguauaagaccuucaaaaauaugauucagaagggcaaggagaaagacuuucuuauguaccgcaacgauagacggucuugggacgaucugaugaagguguaucgcgaauacuccgacgccaaaaaugcuuucgccgcguaccaggaggagacaggagacuaugugagaaaguacgccaaaaagcacaacggcagcaagaucaccaaucucaaauauugugcuaaggaacuggggucuugcaucgauauuucccauaaauacggacuggagaaggacagccggaaaguuauccuugaaucucucagcccuuaucgcuccgaugucuacuauaacgccggccugaagcaauacuacauuguggggaucaaaaauagcgaccuguguuuccucaagggagaguauuuuauugauucuaagagauaccugcagauccuucgggaggaaggcgugcugacggagcagcacacccucaacgaccuggcugccaucgggacagaguuccaguuuucccuguaugaaaaugauuaccuugaauaugagaaaaacggcgagauuaagaccgaacgcuuccucagcagaacaaaacccaagcagaaaaauuacaucgagaccaaguccauugacgcgccgaagaucaaaaacaagaaacaaaaucuggucggacuggccaagucuaaaagcauuaagaagauccggguggauauucucggcaacagauauuacgcuuccaaagaaaaguuuucucugaugguugacaaauucuga

SEQ ID NO: 3918 - RNA, 3318 nt, Artificial Sequence
  Cas9 variant
auggacauggccuggagacugggccucgaucuggggaccaacagccuuggaugggcugcccugucccucgacgcggcuggcgcccccgaugccauccuggcugccgggucucggauuuucggagacggccgcgauccucagagcgggacaucccuugcuguggacagacgggccgcgcgcgccgcuagacggcgcagagaucgguuuaagcaacgccagagagcccugcucaaacaccuggaggcugacggacuguucccggccgaucccgaaguccagcaggcgcucgccgcucuggacccuuacgcccuucgggcucgcgcccuggaugaggcccucucucugcaugaaaucggcagagcucuuuuucaccugaaucaacggcgcggcuuccagagcaacagaaaggcggaccgggggaaagaugaggacgccggaaagauugcuaucggcguugacagacucaaagaugccauugccgcugccggggcgcgcacguuuggagaguuccugcggcagagacgcgcuggcgccaccggggagaaucagauccccuccgugcggacaagacugcgcgccgagaccggagaaggcgcuaagggcucuggguaugacuuuuacccuagccgggcccuccugaaggaugaguucgacgcuaucuggcaugcccaagcggaacaccaucccaaagugcuuacagaugaggccuaucacagacugcacgagauugucuuucgccagcggccucucagagcuccgaaggugggagccugcacccugguucccggcgaagcucgccuuccuaaagcccauccccuguuccagcggagacggcuccuggaggaacugaacgcgcucaugaucgugcgcgccggggcugucgccgagagacugacaccugaacagcgggaccuucugcuccugaaacuuaaggauaagggaaaggugaccuuuaaaucccugagagagaagguucucaaacuggacggcgaugcucgcuucaauaaggagagcgaacaccggacggagcugaaaggggacgaaguggccgccgagaugggaggcaagaccagauuuggcucucucuggccccaucuguccacagaacaacaguggaccgucauugagcgccagcaagcucuugagagcgaugcggacgaagccgcuuucagaacauggcugguggagacccacaaacucacggccgaacaggcccgggcuguggccggggcgcgccugccggcuggacacggcagauucgggcugacagccaccgccgcccuucucgcugcgcugcgggacggacgcacaccugagggcagagggcccaacgcuccugccaccgaagccggccgggucguuguguacucugaggcugccgcuaucgccggauaucaucacuccgaucaucgcagcggcgagguguuuaccgacgcgaaggggagacccgcccugcccuacuauggagucccucucgaucggcacauugugccgggcacagcugaccccgaugaaccugacgaggccgcucgcaucgggagacugacgaaucccaccguucauauugcccuuaaccagcugcggagaguggucaaucgccucauccggguguacggaccucccgccgaaguugcucuggagcuggcgagagagcuuaagcucucugaagaugagaaaaaggaacgcaaccgggaaaauuccagaaaccgccuggacgccgaaaaacggagcuccaagcuggcugagcucggccagagagauaaugggggcaaccgcgcccugcuuaaacugugggaggaacucaauccggagaacauccuggaccggagauguauuuacucuggacggcaaaucagcauuggcaugaucuucuccggggccgcugaaguggaucacauucugccuuuugacgccacacuugaugacagcaacgcgaauaagauccucugccugcgcgaggcuaacagagacaagcggaaacgcucucccuucgaagccuggggaggcaccccucagugggaggagaucgccgaaagagcuucccggcugcccagaaauaagcgcuggcgguuugagccugaugccauggaaagauucgcggaggaagggggauuucucgcucgccaccuggucgacacacaguaucuuggccggauugcccaugauuaccugagaugucucuaucccgacaaaggggauggcagcucucacgugugggucagcccgggacgccugaccgagauggugcggagaaagcugggccuuaacgggcuccugggagaccauaaucugggcgccgagcagccuaaaaaccgcaaggaucacagacaccaugcuaucgacgccguugugacggcuauucucgaucgguccaugcugcaacgcauccagagagccucuggggaaggagcgagcgacgccgagcuucugcggauuaucguccccgaacccuggacaggcuuccgcgaugaccuccagagagcuguggaucggaucguuguggcccacagagcugaccaugggaccgucgccaaggccgcuacccgcggccgggaccagacagcggccagacugcacaaugauaccgcuuacggauuuacaggcgaggccgacgccaaagggacgccuauuguggugcaucgcgcuccgcugggagcccuuaagaaacccgagcacaucgaucaaguucgggacccucugcucagagcggcucugcacgauuucaccgccggccucuccgggaagcccuuugaagaccggauugccgcuuucccucgccugggaccccuugauuauagaggcauccggcgcgucagagugguggagccucugcaggucauucccauccgggacgccgcgggccgcgccuacaaaggguauaagggagauagcaacuacagauacgacgugugggaacucccggauggcaagugggagcagcggguucugcagauguauuacgcucaucaaucuggggaaccuccccgcccucaccccgccgcuagaaaagugcugucccuucaucgggacgacguccuggccauugagagaggagagggcgggcgcgaacucgugcggguugugaaguuuagcacaaaugaguucacccuggcuccgcucaacgaaggaggcgcccugaaaucuagacacgcggauaagggcgacccuuuccgcuaucuuuaccccuccccuagcacacugaaagccuggcgggcuagagagguccgcguggaugaacucgggcggguucuggaccccggauuucccgccagaaagcgccggagagugacccgcccuggccgggcugaugccgacuga

SEQ ID NO: 3919 - RNA, 3321 nt, Artificial Sequence
  Cas9 variant
augcaguacaucguggccauugacaucggcgucgcuagcguuggguaugccgugauugauaagaccuccgagacagugaucgaagcgggaucuaacauuuuccccgaggcuagcgccacggacaaucaagaaagacggggcaugcgccaggccagacggcugaaacgcagagagcggacccgccucgaugacuuuacaaagcugugggaauaccacgggcuugcuaucccucaggucaaaaagaacgauaucgugggacugaaaguuaaggcccucuaugaguccauuucucuggacgagguguaccuuauccuguauagcuaccucaagcauagaggcauuuccuaucuggaagaugucgaggacucuagcguguccgggagcaccgcuuacgccaauggacugaaacucaacgcgaaggaacuggagaaaaauuucccgugcgagauccagaaguaccggcuugaaaacauuggcaaauaucgcggccaaauccagauugaggaugaccagggggaaaagcuggaucucucuaauguuuuuacaaucggagccuacaccaaggagauccagcaaauucuggacacacagaaaaaguaucacgcugaaaucgaggaugaguucugugaaaaauaccuuaagauuuuuaccagaaaacggaaguauuacgagggccccgggaacgaaaaaucccgcacggacuauggaaaguacaccacaagacugaaggagaauggcgaauacaucaccgagaaaaacauuuucgagaagcucaucgggaaaugcagcguguauaaggacgaacugcgggccgcuucugccuccuacacagcgcaggaguuuaaucugcucaacgaucugaauaaccuuaccgucaauggacgcaaacuggaagagaacgaaaagcaucucaucguggacaaggugaaaacgagcaacacaauuaauaugagaaagaucauugccgaugcuaugggcgagaaaaucgaggaguucuauggcgcccggauugacaagucugaaaaagaaaucuuucacaaguucgaggucuacaacaagaugagaaaagcucuggccgccauccauguuaauauugaggaauuuucccgcgaugaccuugaugagaucggguauauucugaccaucaacacagacaaggaagcuaugauggaggcguucgauaauagccggcucgaacugccuggagagauuaaaaacugucugaucucccucagaaagaccaauggcacccuguacucuaaauggcacagcuuuucccuuaagauuaugaacgagcugauccccgaaauguaucgccagccuaaggagcaaaugacacuccugacggaaaugggggugaugaaaggacagaccgacgaguucgaaaagaauaaauacauccccguggaugucgccagcgaggacauuuucaacccugugguucggagaucugugcgcaucuccuuuaagauucuuaaugcucugaugaaaaaguacggcacacucgacgaggucgugaucgaaaugccgcgggauagaaacagcgacgagcagaaaaagugggaaaaggagacccaaaagaagaaugaaaaagagcaggaguauauugaaaacaagcuggccacaguuuacgauauccgccugucuagcgccgacuucuccucucagaaacagcucaaucugaagcugaagcuguggaacgagcaagaugggaaaugccucuauagcggaaagaucauugaacccgaggaccugaucaaacacuccgagcuguuugaaauugaucauaucauuccucggagcaucucuuucgacgauuccagaagcaacaaggugcuugucuaccgcaccgagaaucagaacaaaggcaaucagacgcccuauuacuaucucacacacaccaacucuaagugguccuuugaacaguacaaggcucuggugauggaccugagcaaaaagaaagaguacggccucuccaagaaaaagguccggaaucugcuuuauucugaagauaucaccaaggccgacgugcugagaggguucauuaaccggaauaucaacgauacaagcuacgcggcucgcguugugcucaauaccguccaaggauauuuuagagccaaagagaugggcacaaaggugaaaguuauucggggguccuacacgcaucagaugagagugaacaugaagcuggacaaagaccgcgagaagucuuaugcccaccacgcugucgaugccaugcugaucgcuuucagccagcuuggauacgaagccuaucggaaacuccagggcgaguuuauugacuucgaaaccggggagauccuuaauuccgaaaaguggaaggaucaaaugagcgacgagguguacaaacaguaccuguauagaaagaaauggucuaacauccgcaaugagauuacaagagcggaaaagaacgugaaauacugguauuacguugaucauaaguccaaucggggccucuguaaccagaagauccgcggaaccagagucuaugacggcaaaauuuacaagaucaacaaacuggauauucggaagaaagagggggccgcucuuuuuaagaagcuggccuucagcgaaaaagagucugaccgcgaaaagcuccugguguauaaaaaugauaagaaaacauacgaggaccuggugagaaucaugcaggauuacuccgacagcaagaacccuuuuguccaauaugagaaggaaaccggagauuacgugcggaaauaugcuaagaaacacaauggcccccgcauugacaaacuuaaauacaucgacggggagguuggaucuugcaucgauauuagccauaaguauggcuacgaaaagggguccagaaaagugguccucgagagccuggugccguaucggauggacguuuacuacaagaaagaggaacagacguauuaccuggugggcaucaagcagucugaugucaaaugucaaaagggagaguaugugauugacgaagaugccuacgcgaucaaccucguuaaagagaagaugauucagcagggccagaagcgcuccgaccuggaaagccuuggguucgaguuccaacuguccuuuuauaaaaaugauaucaucgaguacgaaaaggacggaaaaauugugagagagcgguuccucucuagaaccaugccuaaggucaaaaacuauaucgaaacaaagcccauugaucgcgccaaguacgaguggcacgaccggaaacuggugggccuggggaagaccaaaagaauccgcaaguaccggauggauauucuuggaaauuauuaccucugcaacaaagaagaguuuagcaaguauuguuga

SEQ ID NO: 3920 - RNA, 3324 nt, Artificial Sequence
  Cas9 variant
augggcuacaccguggggcuggacaucggagucgccagcguuggcguggcugugcucgaugagaacgacaauauugucgaagccguguccaacaucuucgaugaggcggacacaucuaauaacaagguuagacggacgcugcgcgaagggagacggaccaaacgcagacagaagacacggauugaggauuuuaaacaacuuugggaaaccagcggauauaucauuccccacaagcugcaucucaauaucaucgagcugcgcaacaaaggccuuacagagcugcucucccuggacgaacuguacugcgugcuccugucuaugcuuaagcacagagggauuagcuaucuggaggaugcugacgauggagaaaagggcaaugccuacaaaaagggccucgccuucaacgagaaacagcugaaggagaaaaugccuugugaaauccagcuugagcggaugaagaaguaugggaaauaccauggagaauuuauuaucgagauuaaugacgaaaaggaguaucaguccaacgucuucaccacaaaggcuuacaagaaagagcuggaaaagaucuuugagacccaacgcugcaauggcaacaaaauuaauacgaaguucaucaagaaauacauggaaaucuaugagagaaagcgggaauacuauauugggccgggaaacgagaaaucucgcaccgauuacggcaucuauacaaccagaacagacgaggaagggaauuuuauugaugagaagaacaucuucggaaaacucauuggcaaguguagcguguaccccgaagaguaucgggccuccagcgcuucuuacaccgcccaggaauuuaaccugcugaaugaccucaacaaucugaagaucaacaaugagaaacuuacggaguuccagaagaaagaaaucguugagauuaucaaggacgcguccagcgugaacaugcgcaaaauuaucaagaaggucauugaugaagacaucgagcaguacucuggcgccagaaucgauaaaaaggggaaagagauuuaucacacauuugaaaucuaccggaagcugaaaaaggagcucaagaccauuaauguggacaucgauuccuucacaagagaagaacuggacaaaaccauggauauucuuacccugaacacagaacgcgagagcaucgugaaggcuuuugacgagcaaaaauucgucuaugaagagaaucucauuaagaaacugaucgaguuccggaagaacaaucagagacuguuuucuggauggcauuccuucagcuacaaagccaugcuccagcugaucccuguuauguauaaggagcccaaggaacagaugcaacuucugacggagaugaacguguuuaaauccaagaaagagaaguacgugaauuauaaauacauuccugaaaacgaggucgugaaggaaaucuacaaucccguuguggucaagucuauucgcaccacagugaaaauccucaacgcucugauuaagaaauauggcuacccugagagcguugugaucgaaaugccgcgggauaagaacuccgacgaugagaaagagaagaucgacaugaaucagaagaaaaaccaggaagaguaugaaaagauucuuaauaaaaucuacgacgagaaggggauugagaucaccaacaaagauuauaagaagcaaaagaaacugguccucaaacugaaacuguggaaugaacaggagggacucugccuguacagcggcaaaaagauugccaucgaagaccuucugaaccaccccgaguucuuugaaaucgaucacauuaucccuaaaucuauuucccucgacgauagcagaucuaauaaggugcuggucuauaagacagagaacagcaucaaagagaaugacacccccuaccauuaccugacgcgcauuaacgggaaguggggauucgaugaauauaaagcgaaugugcuugagcuccggagacgcggcaagaucgacgauaaaaagguuaacaaucugcuguguauggaagacaucacaaagauugauguggucaaaggcuuuaucaaccggaaucucaacgacaccagauacgccucccgcgugguucugaacgagaugcagucuuucuuugaaagccggaaguauugcaauaccaaagugaaggucauuagagggucccuuacauaccagaugcggcaagaucugcaccucaaaaagaaccgcgaggagagcuauucucaucacgcuguggacgccaugcugaucgcuuucucccagaagggauacgaagccuauagaaaaauucagaaggacuguuacgauuuugagaccggcgaaauccuggacaaagagaaguggaauaaauacauugaugacgaugaguucgacgauauccuuuauaaggaacggaugaacgagaucagaaagaaaauuaucgaagccgaggaaaaggugaaauacaauuauaagauugacaaaaagugcaaccgcgggcucuguaaucagacaaucuacggaacgcgggagaaggauggcaaaauucacaagaucagcucuuauaacaucuacgacgauaaagagugcaauucccugaagaaaaugauuaacagcgggaagggcuccgaccugcucauguauaauaacgauccuaaaaccuacagagacaugcugaagauccuugaaacauacucuagcgagaagaaucccuuuguugcuuauaacaaagaaaccggagacuacuuccgcaaguauuccaaaaaucauaacggcccgaaggucgagaaagugaaguacuauucugggcaaauuaacagcuguaucgauauuucccacaaguacggacaugcgaaaaauagcaagaaagugguccuggugucucucaacccuuauagaacagacguuuacuacgauaaugacaccggcaaguauuaccuggugggggucaaauauaaccacaucaagugcgugggaaauaaguacguuaucgauuccgaaacguauaacgagcugcuucggaaagagggcgugcucaauagcgacgaaaaccuggaggaucucaauucuaagaacauuaccuacaaauucucccuguauaagaaugacaucauucaguacgaaaaagggggcgaguacuauacagaacgcuuucugagcagaaucaaggagcagaagaaccuuauugagaccaaacccaucaauaagccuaacuuccagcggaaaaauaagaaaggagaaugggagaacacacgcaaucaaauugcccuggcuaagaccaaauacgucggcaagcucgugacggauguucuggggaacugcuauaucgugaacauggaaaaguuuucucuggucguggacaaauga

SEQ ID NO: 3921 - RNA, 3324 nt, Artificial Sequence
  Cas9 variant
augggcuacacccuggggcucgacaucggaauugccagcgugggcuucgggcugaucgauaacgucgacggaaagauucuugaguccggcguuagacuguuuucuagcgcugaucccgacaauaaccagacacggcgcuccucuagacaagcccggcgccucaauagacggaaagugcaccgccuggaaagaguggcgcaucuucuggaggaagcuggguucgagaagggagaaguccucgccccuacgccguaucaccugagagugaaaggccugaccgagaagcucagcaaacccgagguuuacgccgcucuguauaaccuuaugaagcaucgcggcaucuccuaccuggaagauguggagcucgacgaagccgauucuagcuccgucagccagaauguggagcugcuuaaggaguauuacccuugcgaaauucagcuggagagauaugaagaguacgggcagauccggggaaucauugaaacauacaacaaagacggcgagaaggagucucucguuaauaucuuucccaccggggcuuauaaaaaggaagccgaggcgauuauccugaaacaaggacaguucuacccugaacuggauaagguguuucucgagaaguucacagaaauucugaccgucaaacgccccuauuacgugggcccugggaacaagaaauccagaacagacuauggaaucuaccgggagaauggcgagacccuugaaaaccuguuugauauucucaucggcaaguguacgaucuauccgcaggaggcccgcgcugccaaauucagcuacaccgcucagcuguuugacuuccuuaaugauaugaacaauauuucuaucgccggggaaaagcugacagaggugcagaaaagagaaauuuaccaccaaaucauguccagcaagaccgucaacaugaugaagauuaucacaaaaguuaccggaugccucaaggaggaggugacgggcuaucggguggacucuaaauacaaggcggaauuucauuccuucgccagcuauagacaguuucgcaauaaaaugcuggacuacggguucgauguccagacacugaacguggagauguucgacaagcucgcugccaagcugacccuuaacacagaauaucaccaaaucauuacccagcuggagucccucaaucugggacuuucuaaagagcugaucgaaaagauugcugauuuucggaaaaagaacagaagccucuucuccaaauggcacagccugucucugaaggccaugaaugagguuguggacgaacucugguccaccagcaagaaccagaugcaaaucuuuucugagcugggcggguucaaaagcaauauugaagucuuuaagggacuuaaauacaucccccuggaugccaugguggacgagaucuauaacccuguugugcgcuguuccauucgggagucuaucaagauuaucaaugcucuccugaaaaaguacggcgcgcuggauaaggucgugauugaaaugcccagagacagcaacgagaaagaagagaaggaucgcaucacaaaacuuaauaaggaaaacgacaauaaaaagaaacaggccauugagaaggcucggaacgaguacggcuucggggaagaggccuauagacagcagaaugaucucaacacgaagcugcgccugugguacgaacaaaaacagcggugccucuauuccggagagaucaucaagauuuuugaccugaucaaaaauccucaucuuuucgacauugaucacaucauucccaagagcaucucuuacgacgauucccugagcaacaaaguccucuguuaugccaccgaaaacagagagaagggcaaucugacaccguaccgcuauuuuaagcggaaggcuucucugaccuggaacuacgaggccuacaaauccuaugugaucgaacuuuacaaagacgggaagggagaucucagcagaacaaaacuggagcugcuccuguucgaagaggacauuaauaaguaugagguucggcagcgcuuuaucaacagaaaucuuguggauacccgguacgcguccaaggucgugcugaacacgcuccaggacuucaugaaagaaaauuauccuacaaccaccguugagguggucagaggcaaguuuacagcucaacugcgccggcauugggggauucggaaaaaccgcgaugaaaaucacgcccaccaugccaucgacgcucugauuaucgccugcgugccccaccuuucucucuggaaggagcagaaaaagguguucagcaccgaugaguucagaguugacgaaacaacgggcgagaucauugaacaguccuacaaccagcugaccuaucaagagccuuuuucucaguucuuuuaccagcuggaaaaggucagcaucgauugucgguacuccuauaaaguggaccgcaaguucaauagacagguggcugacgccacaauuuacagcacccggcaaggaaucgucaaacagacaucuggcgauaaguccuuuacccucgacagcaacucuaaagagcauuaugugauugcgaagaucaaaaauaucuacgaagauguugacgccaagcgcuucauggauagauauaagaaagacaagacgcaguuucugauguaccaccaugauccccaaaccuucuccauucuugaggacgugaugaaaacauaucccgauaagaaaaacccuuuucaggcuuaccggcuggaguacgggccgauccgcaaguauagcaagaaaggaaauggcccccagauucagucuaucaaguacuaugacagcaaacucgggcaacacauugaacugaagcaggccaaccaguccaccaaaaaggucgugcugcagagccuuaacccuuggagaugcgauaucuacuauaauaagaaagacaagcgguacauugcugccggacucaaauaugcggaucugucuuaccaaaagggcacagggcuguacggcaucucccuccagcgcuaucagcagauccugaacagcgagaaaauugaacuuuccaucgagcaaauugaacugcuccuggagggaagacugaaugagucuaacuucgaauuuuguuucagccuuuacaagaaugacuuuauccaguggaacgacgagaauaaccagaccuuccaauaucgguuccuggccagaaaucucuccucucccaaccgcauugaaguuaagccuaucaauaaaagcaaguacgauaaacaggcugagggccugaagacgcucaaaaaggggcugaaccgguuuuauaagaucuccguggacguccuuggauaccagcacuucauuaaaaaggagaaacugaagcucacauuuaaauga

SEQ ID NO: 3922 - RNA, 3330 nt, Artificial Sequence
  Cas9 variant
augagccacuacgugcugggccucgacaucgggauuaccuccgucggauauggcaucauugaucuggacacaaacgauuucaucgacuacgggguuagacuuuuuaaggaaggaacggccgcuaauaacgaagaucggcgcaauucuagaagccggcgcagacugcucucccggaaacauacccgccugauggacaugcagaaggugcuuaaagaggccggcauuaugacagaaucuuauagcccccuguccaacguguacgagaucagaaagaaagggcucaccaaggaacugacaaaugaugagcugaccgcggcuauccuccacauuacaaagcaucggggaucugucaucgagaccguggaagacgaugaggccgccgcuaaagaaacgggcgagcuuaagagcacccuucacgagaacgcccugcuccuggcuaauaacaaauucguuugcgaaauucaacuugagcgccugaauacagaaaacaagaucagaaaucauaaaaacaauuuuaagaccaaggacuauguggccgagcucaaagaaauucugaaccaccagaaucuguccgaggaggucaagaacaaaaucauucagaucguggaacggcgcagagcguacuaugagggcccugggagcuucaacucuccgacacccuacggacgguuuaucgaaguuaauggccaggugcaagagauugaucucaucgaaaagaugcgcgggaaauguuccgucuacccugacgaguucagagcccccaagaugagcauuucugcugaucuguuuaacauccuuaaugacuucaacaaucugcucgugcagggagagaaacugcaggaagaggacaagaagaaccuucugaaaauuaucaaugauaagggcuccaucacccuccggcagauuagcaaaaagcuggaagugaacgaggacgaaaucaaaggguauagaauugauaagaagggaaaagcccuguuuacggaguucaagggcuacaaaauccucaagaaacuguuucuuaauugcggccaaucuauuucccuggaggacuaugaaaugcucgaugagaucaucgaaauugucacaaagaagaaagggaucgacgagcgcaaggaugcucugaaagagcuuaagugggaccugagcgaugacauuaucaacucccucucugaaguuaccggaauugugggcuaccacagccugucccugaaagccauccgggagcucgauagcgaacuguauaagacaucucuuaaucagaugcagcugcuccaugagcugaagauguucgacaaaaacagaccuuccuacaaggggaaaaagaauauuguggcggaccccgaagccauccugagcccugucgcuaaacgcgcccagaacgagaccuuuaaggugaucaaugcucugcggaaaaaguauggagaguucgauucuauuguuguggaaaugaccagagacaagaacagccaagagcagaaaaagcgcaucaacgauucccagaaagcccucgaaucucugaauaaggaggucgaccaacugcuccagcagaaaggcuacgauccgcagaaggugaaggggaaaacaaagcaaaaaguucggcuguacaugaugcaggaaggaaagagcgccuauacgcuucaggagcuggaccuccacagagugauuaaagaugacaaguacaccgagaucgaucauauuauccccaucuccauuagccuggacgauucucaguccaacaagguccuggcgcuucacagcgaaaaucaacagaaaggcaaccucacaccuuucauggcuuuucacaccggccgcuucgccgacaugggguguacauggaauaaguuuaaagagaacgugcugucuaauaagaacuauaaacauaagaagaaaaauaaccugcucgaugaacgggacaucaauaaguucuccgucauucaggaguuuaucaacagaaaucugguggacaccagcuacgcuaaccgcguugugcuuaauacgcugacagauuauuucaaagacaacgaaauugauaccaagguccacaccgugaacggaaaacucacagaccuguuucggaagagaaucaaucugaaaaaggaucggaacgaggacuaccuucaucacgccaucgaugcccucauuguugcuuccaucaagaaacugcgccugcucgacggcuaucuggccaaguacggguucgagacccuuuacgaugaaaugacaggagagauuaaagaaauccccgaggacaaggcguuuuucgaugacaaauauauuagauacauccugaaucucaagacgaucuaugagucuagcaacauguacuaucggggcauucuggaaagagaggaacugaucuaccagccuauuaagaucucccauaaaauugauaccaagcccaaucgcaaagugucugacgagacaaucuauagcacccggauuaucgacaacgaagaucaccuuaucgagaaguacuccgacauuuacgauccgaaauuuaagaaucucacagaggacauccugaacggggaaaagaauaaauaucugauggagaagaacgauccucaaaccuucaauauucucaaacagaucauuuuuaaccacuacaauacguauaaggacagcaaagaauacuauaagaucgagaagaaaaaggaaaaagagaucauuaagcuggucggcaucaacccccuuucucuguacaaagaggaaaauggaccuauuaagaaguauuccaaaaagggcaacgggcccgugaucaugagcaugaaauacgauucugagaagcucggaaaccauauugacaucacccccgauuccgcuaaaaauaagaaagugauccugaagcagauuagcccuuacagaacagacuucuauaagugcucugaugaaaaauuccgcuuuguuaccgucagauacaaggacgugcacuaucagaaaagcaucgacaaguacuguauugauaaagagugguaucaaaacgaaaagaagaauaaaaagaucgacgagaaagccgaguuccuguuuuccaugcaucacgaugaacuuauuggcaucacacggaaggagagcgaacaguucauuuacgacgagucuaaagagaaccacggggauccgcgcuaucaugacggagugaagcccgaaauccugaaguuuaccgccacgaauaacgauacaaaaggcaucauugaggucaagccucucuacaccuacuccgcuuauagacugaaacccacagugcucaauguuaagaacaucaaaaaguacgccaccgacgugcuggggaaucuuuaugaagucaagcagaacgagcugaaacucgaguucuga

SEQ ID NO: 3923 - RNA, 3333 nt, Artificial Sequence
  Cas9 variant
auggccgagggcaagaaaagaaucuggcggcugggggcugaccucggagccaacagccugggcugggcggcuauugaacuuuccgcccccgugaaugggaagccuaucgccauucuggcugccggaucucgcaucuucagcgauggcagagacccgaaauccggggcuucucucgccgucgaucggcgcgacgcgagagccaugcggcgcagacgggaucgcuuuaagcagagacaaaaagcucugauuaaguaccuuaucgccgacggacuguuccccgcugaugaggccgcgcggaacgccauggcugccaucgacccuuaugcuguucgcgccagagcccucgaugaagcucugagccugcccgagcucggccgggcgcuguuucaccuuaaucagcgcagaggcuucaaguccaaccggaaagccgacagaaaggcugaugacgaugccgggaaaauugccaucggaauugaccgcacccgggacgcuaucgccgaagaugaggcggacgcuggcgccgagccugggucuuggacauuuggaaaguggcugcaugaaagacgccucaaaggccagagcgugcggacgagacugcgccccgaguccggggaagaugccaagggagacggcuacgauuucuauccugaccgggcucuuauggaggaggaauuugaugccauuugggcugcccaggcgccgcaccaucccgacgugcugaccaaugauguccacgacagacuccaugagaucauuuucuaccaacgcccucugaaggcuccccaggugggcaugugcagccugaucccuggggaucggagacuccccaaagcucacccgcuguuucagcgccggagacuucuggaggaacucaacgcccugaugaucguucggccuggagaaguggcucagcgccuuacaagagaggagcgggacauucugcuccugaagcugaaagacaagaauaaagucucuuucgccacccucagaaaggcgcugaaacuugaucccgacgcccgcuuuaacaaggaauccgaggaucggacagaccugaagggcgaugaaguggcugccguuauggggagcaaaaccagauucggaaaucucugggugcaccugucuaucgaggcucaaugggacguccuugcccgccuggaugccguggaauccgacgcugaggaugcggccuuuugugcuuggcucguggagacauaugcccugaccccugaacaggccagagcugucgccaacgcgccccugcccccuggcuacgggcgguucggagagacggcuacccgcaagcucauugaagcccugagagacggcaaaaaggaugaccggguucuuguguauagcgaggccgugacagaagcuggccuggggcaucacucugaucgcagaaccggagaggucuucgaggacgccaaaggccggccgcagcuccccuacuacgggguggcgcuggaacgccauaucaugccuggaacaggcgaccccuccgauccugaggaaaugagaguugggcggcugaccaaucccacggugcacauuggccuuaaccagcuccgcagaauccugaauguccugauccgggcuuauggaccgccugccgagauugccaucgagcucgcuagagaacugaaacuuacagacgaggauaagaaacgcauuaaccgggaaaauaacgacaacagaaucgccgcugagcgccggagcgaaaagcugcucgccauuggccaagcggauuccggggccaauagagcucugcugaaacuuugggaggagcucaaccccgccaaugugcuggaccgccggugcaucuacucuggaagacagaucagcauugauaugcuguuuuccgcugccguugaaguggaccacauccucccuuucgccgcuacccuggaugacagcaacggcaauaagauugucugucuucgcgaggcgaaccgggaaaagagaaagcggucuccccaugaugccugggggcacuccgcucgcugggacgagaucgccgccagagcugcccagcugccucggaauaagcgcuggagauuugaacccgaugcgauggacaaauuccgggacgagggaggcuuucaagcuagacaucucguggauacacaguaucuggcccgccugagccgggaguaccuugccacccucuauccggaaaagggggagggcucuggacacauuugggucagcccuggcagacugaccgaaauggugcgccggaaacuggggcucaacgaccugcuucccgaucauaauuucggaggcggggcugaccaggccaagaacagacuggaucaccgccaccaugcgaucgacgcuguuguggucgccauuguggaucggggaaugcucaaugccaucgcuagagccuccggccaggagggggcugaaggccgcgagagaaucauuauccccgagccuugggacggauuucgggaugcccugcgcgaaacaguuaacagaauuacggugucucaccggaccgaccauggcacagcgagcaaagccgggcugccgaagggaaaggaugcuaccgccggccgccuucacaaugacacagcuuacggguucaccggagacacggaugccaaaggcaacuccaucgucgugagacgggugccccucagcucuuuuaagaaacuggccgaccuggaucgcauuagagacgcugaucucaaggcggcccuguaucaacaccuuaaugggcuggagggcaaagccuucgaaaaggcccucgccgaguuucauaaacuggaguggcacaacuucggaggcguucggagaguccgcgugacagaaccucugaccgugauccccaucaaggaccggaacgggagaauuuacaagggauacaaaggcgauuccaauuaucgguacgacgucugggagcuuccugaugggaagugggugaccaacuggaaaaaugaagcuggagaggccaugagcucuguuaucuccauguuugacgcgcaucagagcuccgaacccccucgcccccacccggcugccagaaagauucugucucuccaucagaacgaucugcucgccaucgagcgggagggcgaagaccgcaaacugaugagaguggucaaguucggccagagcgggcaaauuacacuugcugagcaccagcaggccggagaucugaagaaacgggacgcgguguccaaugacgaugacccuuucaaguauuuugcccccaccucuggcgggcucaaaaagguuaaagcucgccaggugagaaucgaugaaaucggacggguccuggacccuggcuuccccgcccgcacagcuagacggaagacgagaggguga

SEQ ID NO: 3924 - RNA, 3333 nt, Artificial Sequence
  Cas9 variant
augaccgcccggacacacaagaucuggcggcugggcgcugaccucggggccaacagccugggaugggcggcuauugagcuuuccgcccccguggauggcaaaccuaucgccauucugcaugcugggucucgcaucuucagcgacggaagagauccgaaguccggcgccucucucgcugucgaccggcgcgaugccagagcgaugcggcgcagacgggaccgccugcagcaaagacagcgggcccuuauuaaauaccugaucgcugaugggcucuuucccgccgacgaaaaugagcgcaaggcuauggccacgaucgauccuuaugcgguuagagcccgggcucuggacgaagcccugacccuccccgaggugggacgcgcucuguuccaccuuaaccagagacggggcuuuaaaagcaauagaaaggccgaucgcaaggccgacgaagaugcuggcaaaauugcgaucgggauugaccggacaagagacgccauccgccaggcugaggaggaagccggagccgagccuggcuccuggaccuacgggaaguggcuguaugaacggagagcuucugccacagaugcgaacgcuauucccagcgugcgcacccggcucagaccugagacagacgagcaugccaaaggagauggcuacgacuucuauccggggcgcgcccugauggaagcugaguuugccgcuaucugggaagcccaagcggcccaccaucccgaugcucuuaccaaugagguccacgaccggcugcacgaaauuaucuucuaccagagaccucucaaggcuccccagaucggagugugcacgcugauucgcggcgaucagcggcugccuaaagcucauccccucuuucaaaagagacggcugcuugaggagcugaacgcccucaccaucguucgcccgggcgaaauggcgcagagacugacacgggaggaaagagacacccuuuuccugaagcucaaagauaaggccaaaguguccuuugucagccugcgcaagacacugaaacucgacccugaugcucgguucaauaaggagucugaaaacagauccgaccugaaaggggacgagguggccgcugccaugggagccaagacccgcuuuggcaauagauggguucaccuuagcauugaggaacagugggaugugaucgcucggcuggaggaagucgagucugacgcggaagaugccgcuugucgcgccuggcucgccgcuacguucgaccugacacccgagcagauuagagccgugaccaacgcgccucuuccucccggguauucccgguuuggaaagguggcuacacaacgccugaucgaugcccucagagacggcgagaaagaugggcggguccugguuuacagcgaagccguggcugccgcgggacugggccaucacucugaccuccgcaccggcgagaucuucgaagaugcucaggggagaccccagcugccguacuauggaguggcccuugagcggcacauuaugcccggcaccgggaauccugaccauuccgaugagaugcgcaucggaagacugacaaaccccacgguccacauuggccucaaucaacugcggagaaucgugaacacccugauucgcgccuacgggccucccgcugaaaucgccaucgagcuugcucgggaacucaagcugacagacgaugacaaaaagagaauuaauaaagagaacaacgaaaaucgccuggccgcggagaagcggagcgagaagcuccugaccaucggcagaccggacacaggagccaaccgcgcccuucugaaacucugggaggaacugaauccugccaacguucuggaucggagaugcauuuauaccggcacgcagaucuccguggacaugcuuuucucugcugccgucgaaguggaucauauucuccccuuuacagccacccuggacgauagcaaugggaacaagaucguuuguaugcgcgaggcuaaucggaccaaaagaaagcaguccccuuacgaagcguggggacacacagaccggugggaggagauugccgcucgcgccgcccagcugcccagaaacaaacgguggcgcuucgaaccugaugcuauggagaaguuuaaggacgaaagcggcuuccaagccagacaucucguggauacccaguaucuggcgcggcuuucuagagaguaccuggaaacacucuaucccggguccggagagggcagcucucacaucugggucagcccggggcgccugacggagauggugcggagaaaacugggccuuaaugaccuccugccugaucacaacuuuggaggcggggcugaccaggccaagaaucgccuggaucaucggcaccaugccaucgacgcugucgugguugccauuguggacagauccaugcucaccgaaaucucucgcgucagcggacuggagggcgcggaagggcgggagagaauuaucauucccccucccugggaugaguuccgcaacgaccuuagaacagcugugaaugccaucaccguuucccaccggacagaucacggaaccaucagcaaagccggccugccgaaggggaaagacgcuacggccggccgccuccauaacgauaccgcuuacggauuuacaggcgaaaccgacgccaagggaaauucuauuguggucagacgggugccccuggcguccuucaagaaacuggccgaucuugaccgcaucagagauacagaccucaaggcugcccuguaccagcaccuggaggggcucgaaggcaaggcuuuugagaaagccgugauggauuucccuaaccuggaauggcaucccuuugggaacguucggagaguccgcgugaccgaggugcuuagcgucauuccuaucucugaccaaaauggacggauuuauaaaggcuacaagggggacuccaacuauagauacgaugugugggagcugcccggcggaaaaugggaagccgagguugugagcacguucgacgcucaccagccugauugggucuccaagauccgcucucggagccccacagcgagaaaggugcucucccugcagcagaaugaccugaucgccguugaacgggcucaugagacccgcgaacuuaugagaguggucaaauuucggcaaaacggcgagauuacauucgccccgccucaggaggccgggucucugaagcgcagagaugcuacccccaaugaagacgauccuuucaaauauuuugccguggcggcuagcucccuccagaaggccaaagcccggcagguucgcaucgacgagcugggaagagugcucgaucccggcuucccggcucggaccgcccgcagaaagacaagaaagagcacguga

SEQ ID NO: 3925 - RNA, 3333 nt, Artificial Sequence
  Cas9 variant
augagaauccugggcuucgacauugggaucaccagcauuggaugggccuacguggagggcgaagaacucaaggauugcgggguccggaucuuuacaaaagcugaaaacccccagaauggagacucccuggccgcgccucgcagagaggcucggggcguucgcagacggcuugcccgcagaaaggugcggcugaacgugauuaaacgccuccuguguaaggaguucgggcuuaaucugucugauuauuuugccaacgacggagagcucccgaaagccuacgagacgaccaaggauacaaagagccccuaugaacugagaucccuggcccucgagcaaaaacuggaaccuaaggagcuugcucgggucauccugcacaucgccaaacaucgcggcuacggcaauaagcacgcgaaaagagaccucgaggccgaagagaaggcuaagaaagccgcugaaaaggcuccccaggagaaagaaucuaccacaaccaacggggauagcaagaaagagcaggagaaggugcugaaagcgcuuuaucagaaugaaacacugcucaagaaguaccaaaccaacuaucagacgaauaacaaaaccaaugacgagacaaacaauaagaccauuuuccugguuggaaaauaccuguacaaggaauuucaggauaaaggccagcggauccgcaacacaaccaauaacuaucaacauacgaugagacaggaguggcucaaggacgaacuggaguucauuuuuaagaaacagaaggauuucggggccacauuuuccgagaacuucgaaucucagauccuugagaccgcuuuuuaccaacgggaccugaaauccuucgaagauaaggugggaaaaugcgucuuuuaugagaaugaaaacagagccccuaaggacagccucagcgcuauggaguucguggcccugacacgcauuaucaauacccuuaagaaccuggagaaaaagucuaaaaaucucggcauuggggaaaccuacggaaaggacaaaauccaggagauccugaagauuguucuggauaagggcgaaauguccuauaaagagcuccggaagauccugaaacuuaacgagagcauucuguucgccaaggacucuaaacucgauuacacaaagggcaugcaggaagcugagaaagcgaaguuuaucgaacugaagaaucuuaaagccuucaagaaagcuaugggaggggacuuuuccaaguuccccagagaggaacuggauaaaauugccacggacaucgugcucaucaagagcaaggagaaccuggccaaaaagcugcaaaauuauucugcucucuccaaagagcaggucgaagcccugagcaaccuuaauuuugcgaagcacauugaucugucccucaaagcucuggacaagauccugccuuucaugcgcgagggccuuucuuacgaugaaguggugaagaaagucgggcuccaggagcaucggaaguacaaacagaagggagaauuucugauuccgcugaaagaguaugagcccuaccucgccaacccuguuguggccagagcucugagcgaauaucgcaaggugcuuaaugcccugcuccggaaguacggcaacguccacaaaauccaccuggaguucaccagagaagcugggaagaauuaugacgagcgcaaaaagauugaaaaagagcaacgggagcauuuugaagccaaccagaaggcgaucaaacagagagagauccugggacuucccauuaacggcgccaauauccucaagaugaagcuguggauugaacagggcgaguguugcguguacuccggggagaaaaucacaagcaagcacuucuuugauucuaacgcucugcaaguugaccauauuuauccuuacucccgcagcuucgacgauucuuacaugaauaaagugcucgucuuugccaaggaaaaccagaauaaacugaacaagacccccuucgaggcuuucggaagcgacaaggaaaaaugggaucggauccuuucccugucugccaagcucccgaaacagaagcagagacggauuagcaauaaagacuuuaaggauaaggagcugggcuucaucgcgcgcaacaucaaugacacaggguauauugccagacuggcuucccaauggaccaacaauugucuuaaauuugaagaucuccgggagaacgaggugacgaucgccggagaaaagggcagcaaaaaucaccuggagguuauuucugggcagcugacauccaugcucagacacuacuggggccugggagacaaggaucgcaacaaucaucuucaccaugcuguggacgccgucaucauugccuauaccaacgcuaaaaccaucaaggcguucgccgauuuuaagaaaaaccaggaacagaaucgggcuaaguucuacgccaaacaaaucagcgagcaggaauauaagagacagcgcaacccuuuugagcccugcgccaauuucagacaacggguggaggagaaaauuaacaagaucuuugucucuaagccuccccgcaaaagagcucggggcgcccugcacaaggaaacauucggguccauuugucucgacggaaauaacaauuggguggcgcgcuuuaaaaucaagagcaaaaaggaacaggaggauauuaccaaagaaaaggcuacaaaggccaaauacaaggacgaguucaaaggcgaggaaaacaucagaaaggcccugaaacuggggaagauccggcgcauuaauaacacgcagaaggacaucgcuauuggagauaaaaucguuaagaaugagaccauggugagagucgacauuuuuaaagauaagaaaggcaaguucuaugccgugcccaucuacacaauggacuucgcgcuugggauccucccuaacaaggcuguugccaccggcgaagaugaggacggagugauuaaagauuggaucgagauggacaagacaaaauacgaauuuugcuucucccuguuuaaggaugaccugauuaaaguccggaagaagaaaaugaaggaggccgaacucuguuauuucgugggcuuugauaccgacgggucucgcaucauuguggcuaaacauaauaacgauuaccagacgaugaccgagaaugaaugcaagcuguucacacuuaaagagaagaaaaagaagcagaaaacccugaacgacgaggaagacaaccaagagagaaucgaaacagaguauaagauuaucggaggccggaccgggauccagaaucucgaaacguuugagaaacaccagguuagcccgcugggagagguccaaaaggccgaguucgaagauagacaggaaauuaaacugaaguccucucccaagggcaaagacuga

SEQ ID NO: 3926 - RNA, 3333 nt, Artificial Sequence
  Cas9 variant
augagcgagaaguacagacugggccucgacguggggaccaacucccugggaugggccgucaucggccuuaaagaagauguucccucuagcgugcuggcuacaggggugcggauuuucuccgagggacgcgacgccaagacgaaaucuacccucaaggcgagcagaacagaaaaacgguccgcucgcagacggcgcgauagauuucugcagcggcaaaccuuccuuaucucugagauggucaagagcggccuguuuccuaaggacauuguggaacagaaaaaucucgagcugcuggauccguaugagauccgcuucaaggcccucacagaacagguuccccugcaccaucuugggagagcccuguuucacauuaaccagcggcgcggauucaaauccagcagaaaggacaaaucugaggaaaccacauccggcguggucagcaagucugugcgggcucucuacgaggagaugcaacugaucaauccugcccccguuaucgaugacccuaaggcucuuuccaaagaagaacgcagagaaauucgggugcaggaggccagcucuagagaagaggcgcuggucacccucgccgagcagaagggcgugacguuuggggcuuuccuguaucgccggcugcaguccggaaaaagcgugagagcccgcaaggaugcugacucccaacucuacgaugucuaucccacccgggaacugcuuaaagacgaguacucuaagcugaugcagcaucaggcccaguauuacccuaacguuaucaaugaagcgcucauuagcagacugcacgaugugaucuuuuuccaacgcaaacuuaaggagcaggaacggggcuuuugcacauacuauccguccgagagacgcaccuuccgguguaugcccagcuuucagcaauacagaauggugcaggagcugaacgcccucgaaugggucgacgcugccgggaagcauugccugcgcgacuauccugagucucgggaucugauucucuccgaacuggagaauaucagcacaaaagcuggagaguucaccuucggcaacaugaagaaaauucuuaagaaaaugggggugaucgacggagagguuucuuuuaauuucgagggccccaagagaaagggcuuucaggggaacgugacgagccgggaaaugcgccacgaggauuguuucggaacaagaugggacgaacugucccucgaugagaaagacgauaucauugacaagaucaaugaugaccaccuggaugacgaggacauggaacgguaccuuauugauaccuauggccugucuagcuuuuccgucgggaacgccaucaaugccagacuccuggagggaacagcuaacgugagccgcaaagcggcccggacccuguacgaaaccaugcucucugcuaauugccugcaguccgacgccguuauugccgugagcgagcaagaugacacauucgucaacccuuauucuagaacgggccgcggggaacuucuguccgagcuccccuacuacggagaggcuuuucaggauggcagacauaucaucccgggcaagcgggaaccuaaagugagccacgaccagcugaaguucuaugggggagucuccaaccccaccgugcauauugcccugaaucagauccgccuuguugugaacgagauuaucaagagauacggccucccuucuagcauuuccaucgaacuggcgcggaaucugcccgaggggcaagauggacgcagaaaaaucgaaaagaugcagucugagaaccagaaaaauaacgagcgguaugaccagauucucacagaaaauggccaaagccccaaccgcgauaauagacugcggcuugcucugugggaggaacucggggagggcccuaccgaccgccugugugucuuuacaggaaagcugaucgaacuugccgaucucuucaacggcuccguggagauugagcaccugaucccguuuagcguuucucuggacgauuccaaagccaauaagaccgugugcuggaaggaagcuaacagauucaaagggaauaagacgcccuacgaggccuuugcuaacaauagcggagacuauucuugggaagagauuauggagcgggucagagcccucccuaacuccaaacaguggcgcuuccaggaagacgcgcugaagaucuggaacagcgaucacucugacuucagcggccggcaucuuaaugauacaagauacauuucccgccuggcccgggaguaucucgaaaacaucugucccuuuaauaaaaucgacguggugaccgggagacugaccgcucugcuucgcggacacuggggccucaacaauauucugcgggggcauaacgagccugaaacagccacccccaagaaaaugagagaugaccaccgccaucacgcuaucgaugccguugucauugcgaugacaagccugacgauccuccagaaggugucuuccgccgcuggcaaggccgaggagcuggacgugggaaaacuuuucgcuaaggaugaaagcggccgguccgucauugacccgugggauggguuuagagacgagguggccgaaaaaguucggaauaucaucgugucucacaagaccaaacgcaagacaauuggaaacagcggcaaguccaccgauagagcccugcauaaugagacagcuuacgggcucaucgacggaccugacgaaaaaggccuguacucugucgugaccacgaagcccauuagcuauuucgauaaccgggacaaaaucgagaagauucgcgaugagaaacugagagacgauuuucuuaccgcgugggacggggaaggcgauaauaaggccucccaacucgcuguucuggacaaggccucuggacugaacgugaaaaagugccgguacgucgagcgcaaaaaggugaucccuaucaauggccccgaugggcagccuuauaaagccuacgacggaaacagcaauuggggcauggaaauuuaugaguuccccaacgggcacccgaaggaaaagaaauggaacggaguugugaucuccacauacgaugcuaauaagagcgaguuuaaaccuggcgagaccuucagaccccaucccgccgcgaagcucgucaugcggcugcacauuaacgacaucguggaagugcagaaugacggggagccuauucuuuauagaguccaacugaucucugcuggcacacucaccguuuccccgcugcacgaagccaacguggauagccgcaaucgggacaaacaugaugaguuuaaguacaaaucucuguccgugacgcccaugcagaagaugggagccaagaaagucaacaucagcccuacaggccuuaagaauuacucuagauga

SEQ ID NO: 3927 - RNA, 3345 nt, Artificial Sequence
  Cas9 variant
augggcaucauuaucgggcuggacauuggaaucgccagcgugggcauugcugucguugauaaggacacccucgauaucaaaugcgugguguccgaccuguucgauucugccgacgcgagcaagaacaucgagagacggaauaaccgccaggcuagacggcuuaaucgcagacggaaaacacgcauuggggauuuuaacacgcugugggucuccauguucggagaacuccccgaggaaguggacucuaauguucugcuucugagaaacgccggccucgaugagcaacugacccuggacgaaaucuacugugugcucaaguauaugcugaaacaccgggggauuagcuaccuugaggaugcccugaaugaggaaaacgucacaggauccuaucagaagggcaucgcuauuaaucagcgcgagucugaauacaugcucccuugcgagauccagcuggagagauuucggaaguauggccaauaccgcggggaaugugaggccgaaaacgagaauggagaaaagauuacccuuagcaacguguucaugacaaauuccuauagaaaggagaucgacaaauuucugaacacccagggcaaguacgggauccucaaucagaaauucauugaugaguaccugaagaucuuuaaccggaagcgcaaauauuacgaaggaccgggcaacgaaaagagcagaacagacuaugggaaauacaccacgggaaaggaccuggauggcaaauauauuaccgaaaagaauaucuucgagaaacucauuggcaagugcucuguuuacaaggaggagcugcgggcugccggggcguccuauacagcccaggaguuuaacauccuuaaugaccugaacaauaucaccgugaacaauaaaaagcucacaacccaacagaaaaaggaugucauugaaaucgugcagaacagcgacagaauuaauauggagaaaaucauuucuuccuguaucggagaaaagaucgagaagauugaaggcgcucgcaucgauaaaaacgagaagaauauuuaccauacguucgagcaguacaacaaaaugcggaagaucuuugccgagaaaaauuaugacauuaaggaacugacaaucgaacaacuugaugagauugggagaauccugaccaucaacacagagcgcgaaggaauuaaggacgcuaucauggagagcgaacuccugcaccugaauaacgagcagauuaaccuccugaucgaacuucgguacaaaaauucuucccuguucaccaaguggcagagccucuccauuaaagccaugagagagaucauccccgaucuguaugaccgcaacgugaaucaaaugaacauucuugcggagcggggcgucuuuaaggauaaaaucaaucuguucgaaaacucuguuuaccucccuaaggagcccgugcuggaagagauuuauaauccuguggucagacgcagcaucuccaugaccauugacgcccugaacgcucucaucaagaaauacggguaucccgaagacaucgugauugagaugccucgggauagaaaugacgccgagcagaaggaucgcaucaaaaaguuccagaaaacacgggaaaacgagcugaagaauauuaaaaagaagaucaaagaagaguacggaauugaaaucacggacgaguacuuuagaaagcauaaaggccuugagcuggaacucaagcuguggguugagcagaacgaaaaaugcccguauagcggcaaguacaucaaugugcaagauauucuguaucaccaugagcuuuucgagaucgaccacauuaucccccucucuauuuccuacgaugacagccggaacaauaagguccugguguauaaagaagagaaccaggauaaggggaaccgcaccccucugauguaccucucuacaguuaauagacaguaugaccagcacgaauuuaugaacuacgugcugagcaccaaaacacuuccccggaagaaaagagagcugcuccugaauuacgaagauaucaccaagauugacguccugaagggauucaucaaccgcaaucuuaacgauacgcgguaugcuuccagaucugugcucaaugccauccaacuguuuuucggcgggaaagagugugacacaaagguccgcgugauuagaggagccguuaccaaccagcugcggaucaaacucaaucugccuaaggaccgcgagaaaagcuacucccaucacgcuauugaugcggccaucaugugcuauagccagaugggccuuaugaacuuuagaaauauucagaacaaguucaucgacuuugaaaaugagaccuaccugucugaugaacgggacuccuguuucgauaacaaguauuacgacgaggcucucuuugggcaagugcugaaaaugcgcaagaaucugcuuaaagccgaaggcaagccccagagaagcguccagucuaaaggaguguucgaugaggaggaaaagaacaacggcaucguucgguaucaucacaaaguggacaagaagccgaaucgcgggcucuccaacgccagcauuuacggaacaagaaaaaucgaugacaagauuuacaaaaucgucggcuaugauauucggaauaacaaggacgcugaggccaucaucaauauuaucaaaaaggggaaguccgauaacuuucugauggcgaaacacgacccugaaaccuucaagaaucugauggagauuuacgaacaguauaaagaggagaagaaccccuuccucgcuuacgaacaagagacaggagacuauauccgcaaauacgccaagaaucauaacggcccuauuaucaagaaaauuaaguauguggauucugaaguggggagcugcaucgacaucuccgccaauuacggcuacaaaaacggagauaagagaguuauuauggacacgcugacccccuaucgggcugaugucuacuauaauuacaaagacggcacauauagaaucauuggggugaaguacgccgauuuuaaguauucuaacgcuaaauacgugcuugacgaggaggccuacgcgcugauccucauuaaggaaggacugcugaaaaucggcgauagccuugagaauaucuccagcucuggguaugaauaccgccucuccuucuauaagaacgacauuaucgaguacaccaaaaaugauauugucuauaaggaacgguuucugagcagaacaaugcccaaggugaaaaacuacaucgagaccaagccuauuucugccgcucuguaugagaaacgcaacccgaucggacucacgaaugccaccaacaucuguaagauuuacacagacguucugggcaaugaaaccaaaaucuacaaggagaaauucaaacuuuccguggacuga

SEQ ID NO: 3928 - RNA, 3345 nt, Artificial Sequence
  Cas9 variant
augaacuacaccgagaaggaaaaacuguucaugaaguauauccucgcccuggacauuggcaucgcuagcguggggugggccauucuugauaaagaguccgaaacagucaucgaggcgggaucuaauauuuuucccgaagcuagcgccgccgacaaccagcugagacgggauaugcgcggcgcuaagagaaauaaccggcgccucaaaacgagaaucaaugacuucaucaagcugugggagaacaauaaccuuuccauuccucaauuuaagucuaccgagaucguugggcugaaagugcgggccauuacagaagagaucacccucgaugaacuguaccugauucucuauagcuaccugaagcaccgcggaaucuccuaucuugaggacgcucuggaugacacagugucuggcagcuccgccuacgcgaaugggcucaaacugaacgccaaggagcuugaaacccauuauccgugcgagauucagcaggaaagacugaauacaaucggaaaauaccggggccagagccaaaucauuaacgagaauggcgaaguccucgaucugucuaacguguucaccaucggggcuuaccgcaaggagauucagagaguuuuugagauccagaagaaauaucaccccgaacugacggacgaguucugugauggauacaugcucauuuuuaaucggaagcgcaaauauuacgaaggcccugggaacgagaaguccagaaccgacuauggacgguucacaaccaaacuggaugccaacggcaauuacaucacagaagacaacaucuuugagaaacuuauugggaagugcagcguguaucccgacgagcugcgcgcugccgcggccucuuacaccgcucaggaauacaauguccucaacgaucugaauaaccuuacgaucaauggaagaaagcuggaggaaaacgagaagcaugaaauuguggagcggaucaaauccagcaauacaauuaacaugagaaagaucaucucugacuguaugggcgagaauauugaugacuucgccggcgcucgcaucgauaaauccgggaaggaaauuuuucacaaauucgagguuuauaacaagaugcggaaggcccuccuggaaaucggaauugacaucagcaauuacuccagagaggagcuggaugaaauuggcuauaucaugaccaucaacacagacaaagaggccaugauggaggcuuuucaaaagucuuggauugaucucagcgacgaugugaaacagugccugaucaauaugcgcaagaccaacggggcgcuuuucaacaaauggcaguccuucagccugaagauuaugaaugagcucaucccugaaauguacgcccagcccaaggagcaaaugacccugcuuacagagaugggagucacgaaaggcacccaggaagaguuugcugggcugaaguauauuccuguggacguggucucugaagacaucuucaacccgguugugcggagauccgugcgcaucagcuuuaaaauucucaaugccguccugaagaaauacaaggcccuggauacaaucgugauugagaugccccgggacagaaacucugaagaacagaagaaacgcaucaaugauagccaaaagcucaacgagaaagaaauggaguauauugaaaagaaacuggcuguuaccuacggaaucaaacuuuccccuucugacuucagcucccagaagcagcugagccucaagcugaagcuguggaaugagcaggauggcaucugucuuuacucuggcaaaacaauugaccccaacgauaucauuaauaacccucaacucuuugaaaucgaccauauuaucccccgguccaucagcuucgaugacgccagaucuaauaaggugcuggucuaucgcuccgagaaccagaaaaaggggaaucagaccccguacuauuaccugacgcacagccacuccgaguggucuuuugaacaguauaaagcgacagugaugaaccucagcaagaagaaagaguacgcuauuucccggaagaaaauccaaaaucugcuuuauucugaagauauuaccaagauggacguucugaaaggauucaucaacagaaacauuaaugauaccagcuacgccucccggcucgugcugaacacaauccagaacuuuuucauggccaaugaggcugacaccaaggucaaggugauuaaaggcagcuacacacaucagaugcgcugcaaucugaaacuugacaagaacagagaugagucuuauucccaccaugccgucgacgcuaugcucaucggguacagcgaacugggauaugaggccuaccacaagcugcagggcgaauuuaucgauuucgagacgggggaaauucuccggaaagacaugugggaugagaauaugucugacgagguguaugcggauuaccuguauggcaagaagugggccaacaucagaaaugaaguugugaaagcugagaagaacgucaaauacuggcacuacgugaugcgcaaguccaaucggggacuuuguaaccaaaccauuagaggcacacgcgaauaugacgggaaacaguacaagaucaauaaacuggauauuagaaccaaggagggaaucaagguuuuugccaaacucgcuuucagcaagaaagacucugaucgggaacgccugcugguguaucuuaacgacagacggacauucgaugaccucugcaagaucuacgaggacuauagcgaugccgcgaauccuuuuguccaguacgagaaagaaaccggcgacauuauccgcaaguauuccaagaaacauaacgggcccagaauugauaagcugaaauacaaggacggagaggugggcgccuguaucgauauuagccacaaauacggguucgaaaagggcucuaagaaagugauccuggagucccucguuccuuaucggauggacgucuacuauaaggaagagaaccauagcuacuaucuggugggagugaaacaguccgauaucaaguuugagaaaggccgcaaugucauugacgaagaggcuuacgccagaauccuugugaacgaaaagaugauucaacccgggcagucucgggcugaucuggagaaucucggauucaaguuuaaacugagcuucuauaagaacgacaucauugaguacgaaaaagauggcaagaucuacacggagcgccugguuuccagaaccaugcccaaacagcggaauuauauugaaacaaagccuaucgacaaggccaaauuugagaagcaaaaccuuguggggcucggaaaaaccaaguucaucaaaaaguacagauaugacauucugggcaauaaauacucuugcagcgaagagaaguuuacauccuucuguuga

SEQ ID NO: 3929 - RNA, 3348 nt, Artificial Sequence
  Cas9 variant
augagcgccaccuacacaaucggccuggacauugggaucgcuuccgugggauggugcgccuucggcgagacgcacauucucgaucugggggucagagcguuugacaaggcugaaaccgccaaagagggagaaucucuuaaccuggcccggcgcaaugcuagacucaugcggcgcagacuguuccggcgcacauggagacuuaagaaacuggcccggcagcucaagagcgagggccugaucgcugauaccaaacuguuuaagcccgaacucccuuucuccaagucucuguggcaacuucgcguugacgggcuggauagacggcucaacgacgaggagugggcccgcgugauuuaucaucuguguaaacacagaggauuucauuggaucagccgggcggaagccaagcaggcugagggcgauuccaaaucugaaggcgggaaggugaaacagggacuugccggcacagcuaagcugauggacgagaagggguaccgcagcgccgcggagaugguccucgccgaguucccgcaggcucaaagaaauaaacagggagaguaucagaaggcccugucccgggaacugcucgcuaaagagcuggcccuucuguuugcccagcaaagagaauacggcaaccuccacacccccggggcucuggagacagcgauccuuggaaauggcgauaagaaaagcggccuguucuggcagcagaagccugcccucgcugggaccgaccugcugaaaaugcucggaacgugcaccuuugagaagggcgaauaucgcgcccccaaggccucuuucacagcugagcggcauguguggcugaccagacuuaacaaucugcgcauuguuacagauggggugacccggcagcucacggaacaagagagacagcugugucuuccucugcccuaccgccaggccggagaccucacauauaaacaacugggcuccgcgcuggcuaaggccgggcuccuggaagccggaggcuuuaaauucaccggccuugcuuacccuacagaggcccagaaggcugaggggaaagccaaggauccggaaagcgcgacccuggucaagauccccgccuggcacgagcuccggcagacccugacaaaaggaggccugaacgacgaaugggagaaacuugcuggggacgcccucugcggacagccugaaauuuuugauaagaucgcuugggugcugucuguuuacaaggacgaugacgaggugagagccgagcuggcgaaacucgcccugcccaauccucaagcucuuacggaagcccugcucaacauucgcuucgauaaguuccacucccugagccugaaggcccuucgggccaucgucccccauauggagcagggccucagauaugacgaagccugugugcaggcuggguaccaccauucucagcugcugaaagugggcgagggagagcacaaguaucucccgccucuguacgauggccgcgacggggauggacggaugauuuuugcggaagacgccgauauccccagaaauccugucguucuucggucccugaaccaagcucgcaaaguggugaaugccaucauuagacgguauggcagccccuccgccguccacaucgagauggcuagagaccucucucgccccuucgacgaacggaacaagauuaaaaaggaucaggacgaguaccaggccagaaaucagcgcgauagagaacaauuuagcgagcuguucgggcauccuccgaagggacuggaguuugaaaaauggcggcuuuaucgcgagcagaacggccagugcgcguacucccagagaccccucaccgcuagcgggaacguggccgaaaucuuccuggacggcucuacagagauugaucacgcccugccuuacucccggagcuuugacgauucuaagaauaacaaaguucucgugcugacccgcgaaaauagagacaagggaaaccggacacccuaugaguaccuuggcggggcugagaauagcgaauccuggcaacgcuucgucucuuuuguggagagcaacaaagccuauagacuggcgaagcggacccgccuccugagaaaagauuucggagcuaaggaauccgaggaauuucgggagagaaaucugaacgacacgcgcuacguuugucgguucuuuaagaauuauguggagcagcaucuuaaacucgccgaaggcagcgagacaaagagaugcgucguggucucugggcagcugaccaacuuccugcgcgcccgguggggacuccugaaagugagauccgauagcgaccgccaccaugcucuugaugccgcuguuguggccgcguguucucacuccaugguccaacggcugagcaauuacuccagaacccgcgaacucgaacaggugcgggacggcuucguugacaucgagacaggggaaaucgugaacccugccaugcaccagcagcugagagagcauuuucccgauccguggccuuauuuccggcacgaacuggaggcucgccuuaagauugacucucccgaacugcucagagaggagauggcccggcugggcagcuacuccgaagaggaacucaaaguccugaagccucuuuuugugucucgcgcuccccaaagacggaauggaggcgccgcccauaaggauaccaucuacgggcagccugagaaacugaagaaaaacggaagcgugacacagaagguugcucucacgucccugacccugaaagacauugaucuucuggcggacccccacagaaaugccaagcucuauggcgcuauccgcgaacggcuggaggcccacgggggaaagggcgauaaagccuucccggcuacaaacccucucagaaagcccgacaaagaggggaaccccaccggcccuauuguccgcacagugaccaaggugaucgauaaacugagcggaaucccgguccggggcgggauugccaagaaugacacgaugcuuagaguggauguuuuuaccaagggaggcaaauuccaucuggugcccgucuacgugcaccaucgcguuacagggcucccuaaccgggcgaucauugcuuuuaaggacgaagaugaguggacccugaucgacgacucuuucgauuggugcuuuucccuguaucccaaugaccuucugagaauuaaacucaagaaagaaagccacucuggauacuauuccagcuguaaccgcucuacaggcgccgugaaucugugggcccaugauagaaacgucaaugugggcaaggacggguucaucgagagcauuggaguuaaaauggcuguguccaucgaaaagcuccacgucgauacccugggcaacaucuacccugcucccccugagaagcggcgcgggcuugcguga

SEQ ID NO: 3930 - RNA, 3351 nt, Artificial Sequence
  Cas9 variant
augagccagaaccagaaucccaacacccagucccaccugaauccuacaacgcagucuagcacccaguccaacccgcaacccacaacccaggagucucucaagauccugggcuucgacauugggguggccagcaucggaugggcuuuugucgaaggcggggagcuuaaagauugcggaguuagaauuuucacaaaggccgaaaauccuaaagacggcuccucucuggcgcucccccggcgcgaggcuagaggggugcggcgcagacuggcccggcgcaagggaagacuuaacgcccugaaagugcucaucuguaaggaauuuggccugaaucggagcgauuaccuggcuaccgccggcgagcucccuaaggcuuaugccacauccaaagagaccaagagccccuaccagcugcgcgcggaaucucuugagagaaaacuguccgccgacgaguucgcucgggucauucuccauaucgccaagcaccgcggguauggaaacaaacaugcuaaggaaagcucugaugacgauuccggcaaggugaaaaaggccaucagcgagaaucagaaaguuaugucugaaaagggguacacgaccgcgggacaauaucuguacggcgaguuuuaucagaaagccagaaacuucuccgaagcugagccuaagagcccgaaaaaugcccgggggacacaggaauuuaagaacgugcgcaauaaguccgagaacuacgcuagaugccuugcccagucugagcugcaaaaagaacucgagauuaucuucgccaagcagcgggaauuuggauuccaguuuagcgacaaaaagcacaaaaccauuaaugcuaacggcaagcugaaggagcuggauuucgcggacgccguccucgaaaucgcuuuucugcaaagaccccuuaaauccuucgccgauaaggugggcaaauguacauucuacgaggacaagccucgcgcccccaaagauagccugucugcuauugaguuuguugcccucacccggaucauuaacacgcuggcgaauaucacaaagagauccggggaaguguauagcgcugacaagguccgcgagauccuuucuauugugcuggacaaaggagaaaucaccuacaagaaccuccggaaagugauugcccuggaugagagacugcaguucccuaaggacagcaaacucgauuaugccaaggaagacgcugagaaggccaaagcuaucgaguuuuccaagcugaaagccuuccgcaaggcgcuuggcgggucuuuugaaggauucauucgggccgagcuggauagcaucgcuacagacaucgcccucauuaaauccaaggaugaacugaaagcuaaacuugccaauuaccagagccugaacgacgagcagagagagaagcucucugaacuguccuuugauaaguucaucgaccugagcuuuaaggcgcucgaggccauucugccccuuaugcgcggcgauaaagacgacaagaucuaucgguacgaugaggcuuggagagaagccgggcuggucgaaguugcuaaaaagacccaaaagggagacucucucccgccucugauugaguaugagaaagaucuggccaaucccgugguggcccgcgcucuugcggaauaccggaagguccucaacgcccugcugaaaaagcauggcaaagugcacaagauccaccucgaguucaccagacaggcuggcguuuccagcaaggaacggggagagaucauugccgaacagaauaaacgccugaaggccaacgaggaggcuagaaaacggugcgaagaguacggacuuaucccuuccggcaagaauauucugaaacucaagcuguggcaggaacaaggggaguuuuguguguauucuggaaagaaaaucacacagagcgaccugagagaugaauccacgcuucagauugaccauaucuaccccuauucucgcagcuacgaugacucccagaacaauaagguccucguguucaccgaugccaaccaaaauaaacugaaccagacacccuaugaggcguuuggcaaggacauuagcaaauggaaucagauccuggggcggaucgagaagcucccuaaagcuaagaagaacagaauuaccaacaaaaauuucgccaacaaggaagccggcuucaucgcucgcaauauuguugauacaucuuacaucgccagacuguccgcgagcuauaccgacgcuuuuauugaguucugcccgcuugccgaaaacgaggauacgacacugggacggggcgagaaagggucuaagaaacacaucuccguggucaauggaagccucaccgccaccaugcgccauuacuggggccugaacacacugcuugacggggaaaauucugagagcaaggacagauccaaccaccuccaccaugcucuggaugccaucauuaucgcuuacgugaaugacagcgucauuaaggccuuuucugauuucaaaaagacccaggaacaaaacaaagcgcggcugaucgccaaggagauugaauccgcugaguauaaaaucagccgcagauuuuucucccccucuggauuugagaauaacgaagccuuccggcaggcuaucaagcgcaagauucucggccagagccuggaguccagagaaaaugacaugacaaucaacucugaggcccuuggggaaaaagugggcggaauuuuuguuagcaagccuccccggaaacgcgccagaggcgcucugcacaaggagacguucuccucuaucgaugacaaagaucuccugaagaccuacgggggaaaggagggcgugaaucgggcgauuaaacuggggaaggucagacaaaucggaagcaaaaucgccgacaacggcacaauggugcgcguugauauuuuucggcauaagguguccgggaaauucuauggcgucccuaucuacaccauggacuuugcucuugggauucuccccaacaaggccguggugggcgggaaggauaaaagcggaguuaucaaggacuggcugccgauggauucuaauuaugaguucuguuucucccuguuuaaagacgaccucauucugguccagaagaaagaaaugagcaaggccgaacuuugcuacuucgcuggcuuugauacaucugggggacagaucaaaguggagaagcacgacaaccauuucgccacccugacggauaaucagagacuccuguuuaacauugcgaccccuaaggaaguggcuggcaaauccaucgggauccaaaaucugaaggucuucgagaaauggcaagugagcccccuuggcgagguuucuaaggccgaauuuaaagagcgcgaaccuauugcccugaaguccacacccaagcgguuccuccagggauga

SEQ ID NO: 3931 - RNA, 3354 nt, Artificial Sequence
  Cas9 variant
augaagcacauccugggccucgaccuggggagcaacuccauuggaugggccuucgugcagcaagauuuugagaauaaacagggcaagaucauugcuaccgggucuagaaucauucccauggaccagggaauccuuggcgauuucgaacgggggaacacagucagccagacggccgagcgcaccacauacagauccaugcggcgccugagagaacggcaucuccugcgcagagagcggcuucaccgcguucugcaucuccugggauuucugccuccgcacuaugacgcgcaaaucgauuucaccaaaagauacggcaaguuuauugacaaugcugaacccaaaaucgccuauaacaauggcaacuucauuuuuaugaauagcuucaacgagaugguggaggauuuuaagaagcaucagccucaacucuucuacaaaaagagcaauggggaagagucccggauccccuaugacuggacaauuuacuaucugcgcaaaaaggcccuuucucagaaaaucacccagcaggaacuggcuuggcucauucugcacuuuaaccagaagagaggauacuaccagcuucggggcgaggaggaaacagagaauccuaacaaggaaguggccuuccacagccugaaagucguggauguugaggcugaagcccccaauaagaaaggggagaucugguauaccauccgccucgagaacggauggauuuacagacggacguccaagaauccucuggacgauuggaaaggcaagaccagagacuuuaucgugacaaccgaucugaacgacgacgggacaauuaaacucgauaaggaaggaaaggagaaacgcagcuuccgggcgccggacgaaaacgauuggaaucugcuuaagaaaaagaccgagcaugacaucgauuucucuggcaaacccgucggcacguauauuuacgaccaucugcuccaaaacccuaaucagaagaucaaggggaaacuggugagaacaaucgaacgcaaguauuacaaagaugagcuuaaggccauucuggcuaaacagaucgcccuccaacccgagcuguuuaccgaaacacugcucgcugacugcauucgggagcuguauagaaagaacgaaacccagcagcagaaucuucuguccaaggauuuccuccaccuguuuguugaggacaucauuuucuaccaacgcccucuuuguagcaaaaagucuaccaucgccaacugcacacuggaaaaacgguccuacaucgauaaggagacgaaugagagaaaagacgcgcccauuaaggugugugccaagagcaacccguauuaccaggaauuucgcguccuccaguggcugcagaaucugcggaucuaugagauugaaaccgacagagaggugacagcugaguucaucgaaaccccucaagauuacgaggcccucuuuaacuuccugaugucucagaaagaaauugacaaugagggacuucugaaguauuuucucuucgcuaaaaacccccagaucaaggauaaagccgccaaguccgaacugaaaaaguggcugacaaccuaccgcuggaauuauguguacgacgcugcggauaacagcuccaagaaauacccuaugaaugagacgggcuaugagcuucagcgguaccuccaaaaggucgaagggcugcccgccaacuuucugacauucgacauuaccuaucagcucuggcaucugcuuuacucuguuaaagauaagguggaguuugaaaaagcucugaagaaguucgccaaaaagaaacagcucgacaagaccagcuucguggauuccuuuaaaaacuucaagcccuauccuaaugaguacggaucuuuuucugaaaaggccaucaaaaagcugcugccgcuuaugagauucggcaaccacugggacuuuaaucggaucgaugucuccacacagaaacgcauugacgaucucaucaacgggguggcuaaugaggacauuagaaccaucauucgggagaaggccgaaaaauaucaacugaacagcgagacaugcuuccaggaccugccccucuggcuggcgcaguacguuguguacaauagacacgcugaagccacggauaucgagaaguggaccucugucagcgaccuugaagccuaucuggaggauuuuaagcaacacucccuccgcaacccuaucguggagcagguugugacagaaacccugcgggucgugagagacauuuggcagcaguacucuggaggccaagcuaauuucuuugaugagauccauauugaacugggccgcgagcuuaaaaagacagccgaggaaagaaaacagcucagcgacaagaaccaggagaaugaaaacaccaaucugcggaucaaaaagcugcucgcugagcugaaagaagaugccuccauucagaacguccgccccuauagccuugugcaacaggagcugcucaagaucuacgaggaagggguuuucucuuccacggacgagaucgaagaggauauucagaagaucagaaagaagguggaaccuacacccccggagauucagcgguauaaacuguggcuggagcaaaaguacaaaagcccuuauaccggagaagucaucucucuuaccaagcucuuuacagaggaauacgagauugaacacaucaucccccagucccgcuacuaugacgauagccuguccaauaaggugauuugugagucugcgguuaacaaacugaagaccaaccagcucggccuggaguucauccaaaaucaucacggggaaaaagugagaauuacggccaacaaggaggucacaaucuuuaccgaggaacaguacaaagaguucgugaagaagcacuaugcuaauaacagcgccaaacagcagaaacuucugcucaaugaaauuccugagaaaaugguggcucggcaacugaacgacacacgcuacaucuccaagugcauuucugaaauccugagcaaaaucguuagauccgaugagaaggacgaaggagucaauagcaagaacauuauccccuguaccggcaaaauuaccacagcccuuaagcaggacugggggcugaaugauguguggaacgagcucauccugccucgguucgagcgcaugaaucagcucacgcagacccaacuguuuacaucuuauaacgacagacuucagaaaaaucugcccaccgugccgauugaauacucccagggcuuccagaagaaacggaucgaucauagacaccaugcgauggacgcccucgucaucgcuugcgccacacgcgagcacauuaacuauaugaauaaccaacacgcucuggauaagagcaaggacaaaaaggaaaaacagcagucucggaucgaucugcauccucuuuga

SEQ ID NO: 3932 - RNA, 3354 nt, Artificial Sequence
  Cas9 variant
augcagaccaagaaccugcucuacacacugggccuugacaucgggauugccagcgugggauggugcguccugggcgagaauagaaucauugaucucgggguucgguguuucgacaaagcugaaacgcccgaucgcggagagucccugaacaaggugagacgggacgcccgccuuaugagacggcgccugagacggcgcgcguggagacucaccaaacuggcucggcugcucaagcacgccggccugaucgauucuacacgcauugugagagaccggcaugauggggccgucagcccuuggcaacuucgcguggaaggacuggacagaaaacucgcuccggaggaaugggcccggguuaucuaucacaucgugaagcauagaggcuuucacuggauuucccgcgcugaggagcggaaggccgaaucugauaaaggcgaagggggaaaggucaaacagggccugagcgcgaccaagcagcuuaugguggaaaagaauuacagauccgccgcugagaugguucugacagaguuccccggggcccagcgcaacaagcggggagaauauaccaaggcucucucuagaauccugcuggccgcggagcucacaacccuguuugaacgccaacaggagcuuggcaauccucaugccgggcccgaccugcagacgaaaauucucggaaacggcgauagaaagagcggccugcuuuggaugcagaaaccuccccuguccgggagcgcucuccugaagaugcugggaaaaugcaccuucgaacgggaggaguaccgcgccccuaaggcuucuuuuacagccgaacggcacguguggcucaccaaacugaauaaccuuagaguccugguggacggcgugacacgcccgcucuccgaucccgagcggagacuggcccuuagccugccuuaucaacaggcuucugacuucaccuacaagcagcuccgggcggcccuguguaagaaugggcugcuccccgacuccuuucaguucagcggacuggcuuauccuacgggcgcccaacagcccgaugggaaagccaagaacccggaaaaugaccgccuugucaaacugccugcuuggcaggaguuuagaaagacacuccgggaugccggacuggaaaccgagugggagucuaucgcgggcauggcugccggcgggcaacccgaccugcuugaucagauuggauggguucucuccguguucaaagacggcgaugaagugcugagagagcugcgcaagaucccucuccccgggggagaaaagaugguccaggcccugagcggcguguccuuugacacauuccacaaccuuucucugaaagcucuccggaagauuguuccccauauggaggccgggcugagauacgaugaggcuugccuggccgcgggcuaccaccauagcgaccuucgcaaagauaccgacgagagaucccucuaucugccuccgcuguacagcggacggaccacagacggccgcaugguguuuagagaugacaucgaugucccccggaauccugugguucuccgcgccaucaaccaggcuagaacgguggucaauucugugguccggcgcuaugggucccccagcucuaugcacauugagauggccagagaccugagccggccuugggaugaacgcaacaaggugaaaagagcucaagaggaauaccgggacagaaacgagaaacuuaagaucgauuucgccgcggaguauggaauugaacccaaaucccgcgaguucgaaaaguuucugcucuaccgggagcagggcgggaaaugugccuauucucugaagccgcuggaccuugauagaguucuccgcgaccugggauacgcugaaguggaucacgcccugccuuacagccgguccuucgacgauagcaaaaauaacaagguccucgugcuggcugaggagaauagaaacaagggcaaucgcacccccuaugaauaccuugacgggacaucugaguccccucgguggagagaauuuaaagccuucguugagaccaacaaggccuaucgccuggcuaaacgggcgagacuccugcggaaggacuuuagcggcaaaggaucugaagaguuccgcgauagaaaucugaacgacacacgguacaucucccgcuuuuucaagaauuauguggagagauuucuuaaacucgccgaagagagcgaggaacggaccugcgucgugcuguccggccagcugacggcuuuccucagagcccgcugggggcuggccaaggugcggggagauucugacagacaucacgcucuugaugccgcgguuauugcugccuguagccgcuccauggucaagcggcugucugacuacgccagacgccaugaacucgagaaagugcggacaggcuuuguggauuucgagaccggggaaaucgucgacgcuggaaaguauagacagaucgagcgcgauuuucccagcccuuggcccuacuucagagacgaacugcugacccggcuuaacacagaugacccggccgagcugcgcgagagaaugcaaucccucggcagcuacccucccgaagcgcuggagacccuccggcccauguucgugucucgcgcuccucagagacggaaugggggcgccgcccacaaagauacaauuuauagacagacggaacgccugaagaaaguuggauccgugacccagaaggucccgcuugcugcccugaaccuccgggaccuggagaaucugguggacccccauagaaacgaaaaacuuuacgcugccauccgcgcgcggcuggaggcccacggcgggaagggagagaaggcuuuuccucccaauaacccucucagaaaacccgaucgggacggcaacccuacagggcccauuguucgcaccgugacacuggucaucgauaagaugagcggcauuccggugagaggagggguugccaaaaaugacaccaugcuccggguggauaucuuccgcucuaagaaggacggcaaauuucaccuggucccucuuuaugugcaucacgcuguggccaagcaacugcccacgagagccgucaucgcuuacaaagaugaaggagaguggaccccuauuaacaaucaugacuucgauuuucucuucgcgcuguaucccaacgaccugguucggaucacacuuaagaaagaacgccacuuuggcuacuaugccgggugcaauagagcuaccggagccguguccauuugggcccacgaucggaaccagcgcaucggcaaggacggguucauugacggaaucggcgugaagacagcucugagcgucgagaaauuucauguggauacccucggcaauguuuacccggccccucccgaaacgagacgggggcuggcguga

SEQ ID NO: 3933 - RNA, 3357 nt, Artificial Sequence
  Cas9 variant
augggcaccagauacagcuucgacaucgggacaaacuccauuggaugggccguguggcggacgggccgcgaucccaaggggaucuuuggagagaaagacgcuccucuggaacuccugggcgccggggucagacuuuucaaggauggacggaauccgaaagacggccagucucuggcgaccaugcgccggauucccagacaagcucgcaagagacgggaucgcuuuguucucagacgggaggcccugguggccgcucuuaucgaagccggccugaugccugcuagcgagaaagaacgcaaggcccucgcggaccuggaucccuaucagcugagagccgcugggcucgacaaggcccuggcuccucacgagcuuggacgggccauuuuccaucugcaccagcgcagaggcuuuaaauccaaccggaagacagauagaaaaucugacgaucgcgacaaggggaaaaucgcgaccgccagcgcugcccucgcuaagaaguucgaggaugaaaaugcccggacauuuggagaguuccuguggagacgccaucgggaccccgacaugaaaagacaggccgugcuuaaggcucacgauccugcgaaaggcaagccggaccugcgcgccgcuaaacuccggcaacccaccagaauccgccuggaagggcagggagccacagcccuguacgaguuuuauccuacccgggagaugcucugccaugaguucgaugcucugugggaagcccaggcgagacaccaccccaugcuucugacgcgcgaagcuggcgacaagauucgguccauccucuuuagacagcgggagcugaaaccuccccuuauuggccuguguaccuucgaauacgccgccggggagaaggagucucgccucccgaaggcucugccuagcguccaagccagagaaaucuaugagcggcugggacauauuagacucuccacaggcagcgggaccgaucgcccccugaaaucuuccgaacgggacgaucuugcuacagcccugcuccacugcggacugaccaagaucaaagugagcaagacgaaaggccuugcguuuaagacagaguucagaaaggcccugcgccucgggggagaaguuagaauuaacuucgaggagaugggcgaagagggccugguggaccugcggaccaaucgccuccugguccaggaugaccauuacgggccuagauggcgggcucuuucuugguccggaaaagaugccuuugugaagaaacugcucgaagcuacagacgacgauaagcugguugcccgccugaugaccgaggacggccuuagcgcggugcaggccagaaacgcugccucuaucccccuccccgauggguauucccggcugggaccuaccgcuaaugccgccauccugcaggcucucauugacagccgcgaugaaaacggcuucgucgugacauacgacaaagcggugagacgggccggggagcgccugggcaaggauuggcaccacuccgacgagagagauggagaaauccuugacgcucugccguacuauggcaagguccuccaacggcauauucugcccgggaugauggauccugccgacagaaaagaugaggccaaguuuuacggacgcaucaugaaucccucuguucacauuggccugaaccagcuucggagacucgugaaugcucugaucgaacgcuucgggccucccgaccagaucguggucgagcuggcccgggaccucaaaaugagcgcgagagagaaggaacaagagcagcgccggaacagagauaaucgcgaagcuaacgagaaacggacgaagaagcugguggaacuuggacaggacaauaacggcgagaacagagcccggcugaaacucuaugaugagcagcaacgcgccgggaauggcguugcucauuguccguuuacccuggacccuauuggaaucacacagcuguucucccccgaaauugagaucgaacacgugcuuccuagaagccggacccucgaugacucugccgcgaacaagguccugugcuuucgcacaauuaauagaaucaaacggggcaagacccccugggaggcuuuccaugccgauccuaaauggcccgacaucgccgcuaacgccgaaaagcugccgccuaauaaaagauggcgcuuucgggaggaugcuauggacguguucgaggccagaacguccgggaagauggauaagacaacccucgaacagaugggacugaccacaggcuuucaggcgcgccaccuuaacgagaccaaacacaugagccggcuggccaaggcuuaccucgggaaaauuugugaccccgaugccguuuaugugacacccggagcucugacgucucugcuuagaggcaagugggggcucaauagcauccuguccgacgacaaccugaaagaucgcaccgaccaucggcaccaugccauugaugccaucacaauuggcgcuaugaccagaucucuccugcuugaacugaauacacucgcgggaaaggccgagcaaagcgacuacgaugacgucgugggcaaggucccuuggccguucgauaacuuucgcgacgcugugagauccguuguggaucgggucgugguuagcaauaaacccgaacacgggaagcagggagcccugcacgaggacaccgccuauggcaucgugggggaugaggcugaagccgaggaaauuggaaaccugguccgcagaaaacuucugguggaccucacgccuggcgagguggaccggauccgcgaugcggggcugagaaaggcuaugcaggccgccguugcucccucucgggacgccagaggcaaagucuccgaugcgaagggauucgcugccgcccucgacaccuucgcuaaggcccagggcaugcgccggaucagaguggggaaagaggauaugagcgcugugacaauucaugaccgccaaaccgauaaggccuacaaagcggucgccccuggagaaaaucaccauguggacguugugcagaugcgggauggcgcuuggaagggguuugccgucacaguguucgaggcuaaccagaaagacuuuagaccccagugggaacgggagaagcugggaggcaaacuuguuaugcgccugcacaagggcgaugccguggaacucgagucuuccggggucagacuggugaaguucguucaacagaucuggaugaaaagcaaucuggugcuucugaccgagcauaacgaaggaggcgaccuccagaagcggcaccaagaugccgacgacccuuuucgcugggauuucgcuaacauugggaaacugaaggagagaggaugcgucgcggugaaaguggacgaacucggccgggucacgaagcgcaucuccaauacauga

SEQ ID NO: 3934 - RNA, 3360 nt, Artificial Sequence
  Cas9 variant
augggcuacagaaucgggcuggacgugggaauuaccagcacaggcuaugccguccucaagacggauaaaaacgggcugcccuacaagauccuuacccuggacuccguuauuuauccucgggcugagaauccgcagacaggagccucucucgcggaaccccgcagaaucaaacggggccugcgcagacggacccgcagaacaaaguuccggaaacaacgcacccagcagcuuuuuauucacagcgggcugcucuccaagccugagaucgaacagauccuggcuacaccccaagccaaguacucuguguaugagcugagaguggccggacucgaucggcgccugaccaacagcgaacuuuucagaguccuguacuuuuucauuggccaucggggcuuuaaauccaaucgcaaggcugagcucaacccugagaaugaagccgacaaaaagcagauggggcagcugcuuaacucuaucgaggaaauuagaaaagcuaucgccgagaagggauaucggacggugggcgagcuguaccucaaggaucccaaauacaaugaccacaagagaaacaaaggguauauugauggauaccugagcaccccuaaucgccagaugcugguugacgaaaucaagcaaauucucgauaaacagcgggagcugggcaacgaaaaacuuacagacgaguucuaugcgaccuaccugcucggggaugaaaauagagccggaaucuuucaggcucagcgcgacuucgaugagggcccgggcgccgggcccuaugcuggagaccaaaucaaaaagauggugggcaaggacauuuuugagccuacagaagaucgggccgcgaaagccaccuacacguuccaguauuuuaaccugcuucagaagaugacaucccugaauuaccaaaacaccacaggggacaccuggcauacccucaauggacuggauagacaggcuaucauugacgccgucuucgcuaaagccgagaagcccacaaaaacguacaagccuaccgauuuuggcgaacugcgcaagcuccugaaacuucccgacgaugcccgguucaaccuggugaacuaugggagccuccagacacagaaggagaucgaaaccguugagaaaaagacaagauucguggacuuuaaggcuuaccacgaucuggucaaggugcuuccggaggaaauguggcaaucucgccagcugcucgaccauauuggaaccgcgcugacgcuguauuccagcgauaagcggagacgccgguacuucgccgaggaacucaaucugccugcugagcuuaucgaaaaacugcucccccugaacuuuucuaaguucggccaccuguccaucaaaagcaugcagaauauuaucccuuaucuugagaugggccagguguacucugaggccacaaccaacaccggguaugacuuuagaaagaaacaaauuuccaaggacacaauccgggaagagauuaccaaucccgucguucgcagagccgugacaaagacgaucaaaaucguggaacagauuauccggagauacggaaagcccgauggcauuaacaucgagcucgcucgcgagcuggggcggaauuucaaagaaagaggagacauucagaagcgccaggauaaaaacagacaaaccaaugacaagaucgccgcggagcugacagaacucggcauuccugucaacgggcagaauaucauccgguacaaacugcacaaggagcagaacggcguggauccguauaccggagaccagauucccuuugaacgcgcuuucagcgagggcuacgagguugaucauaucauuccuuauuccaucucuugggacgauagcuacacaaauaaggugcuuaccuccgccaaaugcaacagagaaaaggggaaucggauucccauggucuaucuggccaacaacgagcaacgccucaaugcucugacgaacaucgccgacaauaucauuagaaacagccggaaacgccagaagcugcuuaaacagaagcucucugaugaggagcugaaggacuggaaacaaagaaauaucaacgauacccgguuuauuacacgcgugcuguacaauuauuucagacaggcuaucgaauuuaacccugagcucgagaagaaacagcggguucugccccuuaauggagaagugaccuccaagauuagaagccgcuggggcuuccugaaaguccgggaggacggggaccuccaccaugccaucgaugcgacagugaucgccgcuauuaccccgaaguuuauccagcaagucacgaaguacucucagcaccaggaagugaaaaacaaucaggcccuguggcacgacgcugagauuaaggaugccgaauacgcggccgaggcucaaagaauggacgccgaucuguucaacaaaaucuucaauggauuuccucuucccuggccugaguuccucgacgaacugcuggcucgcauuagcgauaaccccguugagaugaugaagucccggucuuggaauacauauaccccuaucgaaaucgccaaacucaagcccguguuugucgugagacuggccaaccauaagauuagcggcccggcucaccuugacacaauccgcuccgcgaaacuguucgaugagaaggggauuguucucagccgggugucuaucaccaaacugaagauuaacaaaaagggccaggucgccaccggagacggcaucuacgauccugaaaauuccaacaauggggacaaagugguguauagcgcuauuagacaggcccuggaagcccauaacggaucuggcgagcuugcuuuucccgauggguaccucgaauauguugaccacggaacaaagaagcugguccgcaaagugcggguggccaagaaagucucccugcccgugagacucaagaauaaagcggcugccgacaacggcagcaugguucggaucgauguguucaauacggggaagaaguuugucuucgugccuaucuacauuaaagacaccguugaacaggugcugccgaacaaggccaucgcucgcggcaaaucccuuugguaucaaauuacagagucugaucaguuuuguuucagccuguaccccggagacaugguccauaucgaguccaagaccggcauuaaaccuaaguacucuaauaaggagaacaauacaagcgugguucccaucaaaaacuuuuauggguacuucgauggagccgacaucgcgaccgcuuccauucucgugagagcccacgauagcucuuauacggcccgguccaucggcauugcugggcugcugaaguuugaaaaauaccaggucgacuauuucggacgcuaccacaaggugcaugagaaaaagagacaacuuuucgugaagcgggaugaauga

SEQ ID NO: 3935 - RNA, 3360 nt, Artificial Sequence
  Cas9 variant
augaacgacaagaaaaaucugggcccccucaccuucggguuugauaucggaauugccagcgugggcugggcuguccuguccccuacaagaaucguugaccuuggggugcggugcuucgauaaggccgagacggcgaaagaaggagagucucugaaccucgcucgcagaagcgcccggcugaugcgcagacggcuucgcagacgggccuggcgccugauuaagcucgcuagacugcugaaacacgaaggccucaucgccgacaccaagacauuuauucagccguccgcuucucaugccagccccuggcaacugcggaaggaugggcuugaccgcgcgcuguccccugaggaaugggccagagugcucuaccaccuguguaaacaucggggauuccacugggucucucgcgcugaggccagaaaggcugauggcgacaccaaaggcgaagggggaaaggugaaacagggccuugccagcacaaccaagcugaugaaugauaaguccuaucggacagcggccgaaaugguucucgcugaguuucccagcgcccagagaaacaaacgcggggaauacaccaaggcucugucucgggagcugcucgacaaugagcugaaacagcuuuucgaaagacaacgcgaguauggaaacccucaugccgauacgaaucuggaagccaagauccggggcuccggggaccacaaaagcggacucuuuugggagcagaagcccgcucugucuggcaacgaucuucugaaaaugcucggcaagugcaccuucgaaaagcaggaguacagagcgccuaaagccuccuuuacagcugagcgccacguguggcugacccggcugaauaaccucagaaucauugucgacgggcgcacacggccgcuggccgacgccgaaagaaccauggcucuuagccugcccuaugaacaggugggagauuucacguacaagcaacuccgcgccgcgcugguuaaagcuggccuuaugccugacucuuuuaaguucgccucccuggccuaucccagcgaguuucagaaagcugaggggaaggccaaggauccugaauccgcugcccucacaaaacuggcggccuggcaggagcugcgggcuacccucaagaaagccgaccuggagucugaauggcagcaaaucagcugugcugcccuugagggacagcccgaaacacuggaugagauugcgggcgugcucuccgucuucaaggacgaugacgaagugcugaaugagcugcagaaacuugggcucccgggaggcgccaagaccgagaacgcucugcuggauaucagauucgacaaguuucaugcccucagccugaaagcccuucggaagauugugccuuacauggaacgcggccugagauacgaugaggcuugcgaacgggccgaguaucaccauucucaacuccacaaagucggggagggaaauagaaaguaccugcccccucuguauaaaucccgcgacaaggacggccggaugguuuucaacgaugaacuuggggacauccccagaaaucccguggugcuccgcagccugaaccaggcuagaaagguccugaacgcgcucauugcccgguacggaucuccuagcuccgugcacaucgagauggcucgcgaacugucuaaaccguuugaugagagaaugaagguuggcaaagaacaggaggccuaucgggagcgcaaugaaaaggacaaacagaccuucguggccgaguuugggaucgucggcgcugccaagggaggcgaguucgagaaauggaaacuuuacagagaacaacaggggaagugugcguauagcauucagggaaucgaucugaaccggcuccuggagcccggcuacguggagauugaccaugcucugccuuacucccgcagcuuugaugacucuaaguccaauaagguucuugugcucgccgccgaaaacagaaauaaagggaaccggacacccuaugaguaccuggauggagaacacaauagcgagcgcuggagacaguucgucggcuuuguggaaucuaacaagcuguaucggcaagcuaaaagaucccgccuccugcggaaggacuucgggaaggagcaggccgaugaguuuagagaacgcaaucuuaacgacacgcgguacgucugcagauucuuuaaaaaucagguggagcaguuccugaagcucgcggaaggcagcgaguccaaacgcuguguugugcugucuggacaacugaccgcuuuccuucgggccagauggggccucaucaagguccgcgaugagagcgaccggcaucacgcccuggacgcugugguuguggccgcuugcacacaugggauggucaaaagaauguccgauuaugcccggcgcaaggaacuggaccagguggcggagggauuuguggauguugaaaccggcgagauuaucaacgccgcuauguuccagcagcuccacgaacacuuuccugaccccuggccgcauuucagagaugagguccaaaugcggcugaagaucgacgauccugcccagcuucgcucugaccugcucagacuggggaauuacgcugaggaagaugugcacgccgugcggccccuguuugucagcagagccccucagcgccggaacuccggagcugcgcauaaagagacaauuuauggccaacccgaaagacuuaaggcccaagggggcgugaccgagaaaguugcucugacggcccucacaaugaaggaccuggaucgccucaucgacccucaccggaaugaaaaacuguacgccgcuauuagaaagcgccuugaggaguucggaggcaaggccgauaaagcguuugcugccagcaacccccugcacaagccggacaaagaagggaacccuaccggacccaucgugcggaccgucacacucgagauugacaagcugucuggcgugcccguuagagggggaaucgccaaaaaugauaccaugcugcgcguggacgucuucacaaaggcuggcaaauuucaucuugugccuguuuacgugcaccauaaggucacggggcugccgaacagagccaucguggcguccaaggaugaagacgaguggaccgcuauugaugacagcuucgaauuucucuucucucuguaucccaaugaucucgugacaaucacccagaaaggcaaggccccuguccggggauacuaugccuccugucaccgcggcacaggggcuuuuagccugugggcccaugacagagcuucuagcguuggaaaaggcgggcagauugagggaaucggcauuaagaccgcccuugcggugcagaaauacaacguggauguccugggcacgaccuaugccgcuccccucgagcagcggcgcgggcuggccuga

SEQ ID NO: 3936 - RNA, 3363 nt, Artificial Sequence
  Cas9 variant
augagaaaggugaccaucggcuucgacauuggggucagcuccguuggauggucugugguggauaugaacaauggcgccaucgucgagacaggggugcggcuguuuagcgcuuccucugccgaaaacaauguugagcgcagaaacaaucggcagacgcgcagacucaaccggcgcagaaagaaucggcugaaggacgugaaauaccuucuggaaaccaaccacuucacauuugaucaagagcagggaaccaaucccuaugaacuccgcgucgcgggccugcauagaaagcucacacggagcgagcuggcucgcgcccucuaccaccuggugaaaagacgggggauuuccuaugaccugaccgauaucgaggaagaggaaauuguuacaaccucugccuacaagacggcucucggaaagaaccagagccagcuggccgagaaaaccccuggcgagauccaauucgcucgccuugaaaauuauggcaaggugagaggguccaucgagauuaacgaacaggacauccugcucaauauuuuuccgacaagcgccuaccugaacgaggcgaaacggauccuugccacccagagaaaguucuaucccgaaauuacagaggcuuuuaucgagaaauacugcaccauucugacgcgcaagcgggaauacuaugucggaccuggcacagagaagaauagaaccgauuacgggaucuaucgcacaaacggagaaacccucgacaaccuguucgagauccugauuggcaaagauaaguuuuaccccaaugaagaacgggccgcugggaacucuuauaccgcccagcuuuucaauuuugugaacgaccugaauaaccuuaaaauccaaacaauugaggaucagaagcugacgccuaaacagaaggaagagaucauugaacaggugaaaaccgcggagaagaaggucucccucauccaacugaucagcaaaauuacaaagacccccaaagaccagaucacaggauacagaaccgauaagaauggcaaaccugaccuucauucuauggccguuuuccgcaaggugcggaagcaguuucugacgauggaaauugacauccuccacuggccggaugagcugcugaacgaccucggcagacugcuuacacugaauaccgagaaaggggaaauucgcaagcaacucaccaaagauuucaugaagcgguaucccauccugaacgagcagcuuguggaccagaucauugaaaauagacauaucuucgcugucuccggaaaccacaaauggcaccgcuuuagccugcggacaaugaaugagcuccugccugagaugcuggccaccucuaaggaacagaugacacuccuguccgagagaggcaugauuaagcaacauaaacgggauuaccuuaagaugaacgaacuggacgcucgccucaucagcgaggaaauuuacaaucccgugguugggaaauccgugagagaggccaucaagcuguucaacgagcugaugaaaaaguaucaggaaguccgguacgugguucuugagaugccuagagaugacaacgaagagaaggccaaaaaggaacuccagaaauaucagaaggagaaugagaacgaaaaagagauugcucugucugaauuucaacgcaagggauucuuuagcgaugcgcagcuggagcgggcccucaucaaagacagaaagcugaagacgaaaauccgcuucuggcaccagcaggaaggcaagugucuuuacuccgggcaaauuaucacccccguggagcugcucacaaauagcuuuucuuucgauauugaccauaucauuccgcaguccgucagcuuugacgauucucugaacaauaaagugcugugcaccaaggagaugaacgaccagaaaggaaagcagacaccuuauggcuuccuucucaauggcaacgggcaaggauuugauagauucaaggcuauggucaaugccaaccggcugaugagcaaaggcaagaaaaagaaucugcucuuuauggaagaccugaacaauaucgagacccgcaaaagauucaucgcccggaaccuuguggauacgcgcuacgcuuccagaguugugcugaaugaaauucagcaguaucuccgggccaagaacaaggacacccaagucgcggugguucgcgggaaauucacagcuacccugagaaagcacuggaacaucaauaaaucucgggagacacaccaucaccaugcccuggaugccagcauuaucgcuauuacgccccuucucuccguguggaagaaaaagcagacccugaucccuaagacacugagcgaggaaaaacucgaguuugaauacgacgauaucgucgaggacaccauuuucgaaaaggcccuguaccagcuucccaaagagaacuuuaaggagcagcugaauaacucucaacccaauaucaaauucuccuaucagguggauaagaaaaugaaccgcaaggugagcgacgcuacaauuuacucuguuaagcaggccaaacucuccagcgauaagcaguccgaagaguauguccuggcgaaaaucaaggacauuuacucuguggaaggauauaaaaccuuugccaagaucuacgagaaggacaaaagcaaguuccugauggcucaaaaugauccuaaaaccuuugaaaaacuugaggagaucauucaguccuauccgucuacaagagaaaucauugugggcgagaaagucaaggugguugacgugagccccuucgaacucuaccggaaggaguacggguauaucacgaaauacgccaagaaaaacaauggcccuauuaucagacagcugaaguauuacgaucacaaaauuggaaugcaucuggacaucaccaaccagaagaauaacggcaaggggaaaaaggucauccuccaacagcugaaauccuggcgcacagauguguauuacaaucacgaaaagcaggaguaugagauuaugggacuuaaauacagcgaccugcgguuuaagaaggaucaauacggcauccccaaagaaagauaucaggagguuaagcagauggagaaaauugcuccucagucugaguucuguuuuucccucuaccgcaacgaccggaucaaggugcugaauaaagagaccgaugaagaggucgaacugcuuuucggggccagaaacuauacaagcgcgggauacguggaccugaagcccauugaucgcguugaguuuggcaaaaaggaauggaucccgguguaucaauacgccaccucugacgggaagugcaaaaagaaauucgcuaagaaaggcuaugagaucuacaaggucaacacgacaauucucggagaguccuacuauaucaagaaagaacggaugcugccuaagaauauucucgauuga

SEQ ID NO: 3937 - RNA, 3363 nt, Artificial Sequence
  Cas9 variant
augagcgaccuggugcucggccuggauaucgggauuggauccgucggcguugggauccuuaacaaggugaccggagagauuauccacaaaaauucuagaauuuuccccgccgcucaggccgaaaacaaucuggugcggcgcacaaacagacaaggccggcgccucacgagacggaagaaacaucgcagaguccggcugaaucgccuuuuugaggaaaucgggcugaucaccgacuucacaaagauuagcaucaaccucaauccuuaccagcugagagugaaaggacugaccgaugagcucuccaacgaagaacuguuuauugcgcuuaagaauaugguuaagcaccggggcaucucuuaucuggacgaugcuagcgacgauggcaacuccucugugggggacuacgcccagauugucaaagagaauagcaagcagcucgaaacaaaaaccccgggacaaauccagcuggagcgcuaucagacauacggccagcuuagaggggauuucaccguggaaaaggacggaaagaagcaucggcugauuaacguuuuucccacguccgccuaucgcagcgaggcucucagaauccugcaaacccagcaggaguucaauccucagaucacagaugaauuuauuaaccgguaccuggagauccucaccggcaagagaaaauauuaccacgggcccggaaaugaaaagucucgcacagacuacggccgguauagaaccuccggcgagacgcuggauaacauuuucgggauccuuauuggaaaaugcacauuuuacccugacgaguuccgcgccgcuaaggccagcuauaccgcgcaagaguuuaaccugcucaaugaccugaacaaucuuacagugcccaccgagaccaaaaagcugucuaaagaacagaagaaccagaucaucaauuacgucaagaacgagaaagccaugggcccugcuaaacucuucaaauauauugccaagcugcuguccugugauguggcugacaucaaaggguaccggauugauaagagcggaaaggccgaaauccauacauuugaggcguauagaaaaaugaagacgcucgaaacccuggacauugagcaaauggaucgcgagacacuugacaaacuggccuacgugcucacccugaauacagaacgggagggcauccaggaagcucuugagcacgaguucgccgaugggucuuucucccagaagcaggucgacgaacugguucaauuuagaaaagcuaacagcuccaucuucggaaagggcuggcacaauuuuucugugaagcucaugauggagcugauuccggaacuguacgagaccagcgaggaacagaugacgauccucacacgccugggcaaacagaagaccaccuccagcucuaacaaaacaaaguauauugaugagaaacuucugaccgaagagaucuacaaucccguggucgccaaguccgugcggcaggccauuaagaucguuaacgcugcgauuaaagaauauggggacuucgauaauaucgugaucgagauggccagagaaacaaacgaggacgacgagaagaaagcuauucaaaagauccagaaagccaauaaggaugaaaaagacgccgcuaugcucaaggccgcgaaccaguacaacggaaaggcugagcugccucauagcgucuuucacggccauaaacagcuggccacgaagauucgccuuuggcaccaacagggggaacggugccucuauaccggaaaaacaaucucuauucacgaucugaucaauaaccccaaucaguucgagguggaccauauccugccucucagcauuaccuuugaugacucccuggccaacaagguucuuguguacgcuacagccaaucaggaaaaaggccaaagaacccccuaucaggcucuggauucuauggacgaugccuggagcuuccgggagcucaaggcguuuguccgcgaguccaagacgcugagcaacaaaaagaaagaauaccugcuuaccgaggaagacaucucuaaguucgaugugcggaaaaaguuuauugagagaaaucucgucgacacaagauacgccucccgcgugguucugaacgcucugcaggaacacuuccgggcccauaagaucgauaccaaagugagcgucgugagagggcaauuuacaucucagcuccgcagacacuggggcauugagaagacccgggacacguaucaucaccacgcuguugacgcccugaucaucgcggccuccagccagcuuaaucuguggaaaaagcagaaaaacacacucguguccuacucugaggaucaacugcuggacauugaaaccggagagcuuaucagcgaugacgaauauaaggaguccgucuucaaggcuccguaccagcauuucguggauacacucaaaucuaaggaguuugaagacagcauucuguucuccuaucagguggauagcaaauuuaaucgcaagaucucugacgccaccauuuacgcuaccagacaggccaaaguuggcaaggauaaagccgacgagacauauguccuggggaagaucaaggauaucuacacgcaagacggauacgaugcuuucaugaaaauuuauaagaaagacaaguccaaauuucucauguaccggcacgacccucagaccuucgaaaaggugaucgagcccauucuggaaaacuauccuaauaagcagaugaacgagaaaggcaaggaggugcccuguaaucccuuucuuaaauacaaggaggaacauggguauauccgcaaauacagcaagaagggaaacggcccugaaauuaaaucucugaaguauuacgauuccaaacucgggaaccacaucgacauuacaccgaaggauagcaauaacaaagucgugcugcagucucugaagcccuggagaaccgacguuuacuucaauaagaacacaggcaaauaugagauccuuggacucaaguacagcgauaugcaauuugaaaaaggcaccgggaaguauuccaucagcaaagagcaguacgagaauauuaaggugcgggaaggagucgacgagaacucugaguucaaguuuacgcuguauaaaaaugaucugcuccugcuuaaggacuccgaaaacggcgaacagauccugcuccgcuucacaagcagaaaugauaccuccaaacacuacguggagcugaagccuuauaaccggcaaaaauuugaggggucugaauaccugauuaagagccuuggaaccguugugaaaggcgggcgcugcaucaagggccugggaaaguccaauauuucuaucuacaaagucagaacagacgugcucggcaaccagcauaucauuaagaaugagggggauaaacccaagcuggacuucuga

SEQ ID NO: 3938 - RNA, 3363 nt, Artificial Sequence
  Cas9 variant
augggccuggacaucgggguggccagcgucggauucuccguucucgauauugacaagggcaaagugaucgagcugggggcuagacucuuuucugccaccguggcggcuggaaaccaggaucggcgcgacaugagaggcgcccggcgccugcucaauagaaacaagcaacggcgccaggauacagggaaacuguucaagaaauuuggacuuauugacgauuucgacaagggcagcuuuuacgauaauuucaaccagaaucugaaccccuaugaacucagagucaagggccugacggagcagcugaccaaagaagaacucgccgaaucccuguaccaaaucgugaagcaccgggggauuucuuaugcucuuaaagacgccgauguugacgagggaggcacagauuacagcgugucccugaagaucaauucucaggagcucgcugagaaaaccccugcccagauccagcugcaacgccuuaacgacuaugggaaggucagaggacaggugguuauuggcgacgauccggacaaucagaaggugcugcucaacgucuuucccacaagcgcguacgagaaagaagccaagcagaucauugcuacccaacagcaguucuauccugagucccugacagauaaauuuaccgaggaauacugccaaauccugacgcggaagcgcgacuacuucguggggcccggaaaugagaaaagcagaaccgauuauggcauuuacaagacagacggccggacccucgauaaccuguuugaggaacuuaucgggcaugacaaaauuuauccugaggaacugcgcgccucugcugccuccuacacagcgcagcuuuucaaugugcugaacgaucuuaauaaccugagaauccucaacuaugaggacggaaagcugaccaaggaagauaaagagaagaucauugccgaaaucaaaaauaacacgacaaccauuaauaugcugaacgucaucaagaaaguugcuggcuguagcaaggacgacauuaagggguuucgggugaaugagaaagauaagcccgaaaucucuuccaugccuguguacagaaaaauccacaaggaccuccugaaagccggagucgauauuagcgacuggccgguggaguucaucgaugagcuuucuuucauucugacacucaacaccgaaaauggcgagauccgcaagcagcugaacaaucggcuugcucccaaguuugacuuccugaacgccgaucucauucagcugaucaucgacaauaaagauuccuuugaaauuaagaccaacaauaaauggcauagauucagcguuaagacaaugaacaaacugaucccugagaugauggaacgccccguggagcaaaugacgcuccugaaugagauggggcuugucaagaaggacaaaaagcgguuugaaaacaacaaauaucugccuuacaaggagauugccaaagauaucuucaaucccguggcuuccaagucuguuagagaagcgcucaaaauugugaacgccguccugaagaaguacggacacaucgacuaucugguggucgagaugccgcgcgauaaaaaucuuaaggaggaacaggacaacauuaaagaguuucagaauaagaacaaaaaggcuaaggacgccgccuucgaggcuuuugugaaaagcguuggcuccgaacagcgggugaaggaagcccucagcaaaaauagaaagcugcaaaugaaaaugcgccugugguaccagcagcaggagaucgauccuuauaacggcaagaccaucgacgcgacagaucucauuaauaaccccgacaaguucgagaucgaucauauuaucccucaaucuauuuccuuuuacgacagcaucaauaacaaaacccugugcuucgcuucuaugaaucaggucaaggggcagaaaacacccuaugaauuuaugcuugagggacacggccagagcuacgauaaguucaaagccaccgugauggccaacaagaauuucgggaaggcuaaacgggccaacuaucuguuugaagagaacguuuccgacaucgaaacgagaaagcgcuuccucucucggaaucugguggauacaagauacagcucccgggucgugcugaacagccuucaagacuuuuuccgcgagaaaucugcugauaccaaggugaccguuauuagaggaaaauuuacauccaauaugcggaagcacuggcauaucgacaaaaccagagagacauuccaccaucacgccauugaugcgagcaucauugccgcuacgcccuuucuccgcauguggaagaagggcgggaccaucuucccugucaaagugggcgaagagucuaucgacauugaaacaggagagauccuggacgauaagaacuuugacaaagccauguacgaggaaccguauuccggcuucgugagcgagauuaugaaugcugaugaccggaucaaguuuucccaccaggucgauaaaaagaugaacagaaaggugucugacgccaccauuuacagcacacgcaccgggaaacuggcgaaggauaaaaaggacgccgaauauaucguugcuaaagugaaggauaucuacuccgucgacggauucaagaaauuuaagaaaguguaugauaaggacaaaacgaaguuccuccuguacaaguaugaccccagaaccuucucuaaacuugagcggauuaucagcgauuguccugacaagguugaaaaagugcagacaaauggcaaggucaaagccguggauauuucccccuuugagauguaccgcagagaccaugggaugaucaagaaguacagcaaaaagggaaacggcccugcuauuaaacaacugaaguaucucgauaaaaagcuggggucucacaucgacauuacccccgccaaugccaacggcaaacauguuauccugcagucccuuaagccguggcggacagauguguaccucaaucacgagaccggagaauaugagaucaugggcauuaaguacagcgaccugaaauucaacaagaaugaaggguauggaaucaaaaaggauaaauaccuggagauuaagaaggucgaagaggugucugagaaauccgaauuuauguucagccucuaucgcaaggacagagugaaaguccaggauaugaagacgggcgagucuguugaacugcuguuuuggagccggaacuucuccaauaaaaaguacgcugagcuuaagccuaucagccaggcggaaaacgacaaaaagcuccccguguacgggaaaggacgccugauuaagagacugaucccuaaaaacugcaagaucuggaaggugaauacaaccauucuuggcgaucccuauuaccucgagaaagagucugacuccccuaaggacauccuggauuga

SEQ ID NO: 3939 - RNA, 3366 nt, Artificial Sequence
  Cas9 variant
augagcgaccuggugcucggccuggauaucgggauuggauccgucggcguugggauccuuaacaaggugaccggagagauuauccacaaaaauucuagaauuuuccccgccgcucaggccgaaaacaaucuggugcggcgcacaaacagacaaggccggcgccucacgagacggaagaaacaucgcagaguccggcugaaucgccuuuuugaggaaagcgggcugaucaccgacuucacaaagaucuccauuaaccucaauccuuaccagcugagagugaaaggacugaccgaugagcucucuaacgaagaacuguuuaucgcgcuuaagaauaugguuaagcaccggggcauuagcuaucuggacgaugcuuccgacgauggcaacucuagcaucggggacuacgcccagauugugaaagaaaauuccaagcagcucgaaacaaaaaccccgggacaaauccagcuggagcgcuaucagacauacggccagcuuagaggggauuucaccgucgaaaaggacggaaagaagcaucggcugauuaacguguuucccacgagcgccuaucgcucugaggcucucagaauccugcaaacccagcaggaguucaauccucagaucacagaugaauuuguuaaccgguaccuggagauucucaccggcaagagaaaauauuaccacgggcccggaaaugaaaagucccgcacagacuacggccgguauagaaccaacggcgagacgcuggauaacaucuucgggauucuuaucggaaaaugcacauuuuacccugacgaguuccgcgccgcuaaggccagcuauaccgcgcaagaguuuaaucugcucaacgaccugaauaaccuuacagugcccaccgagaccaaaaagcugucuaaagaacagaagaaucagauuaucaacuacgucaagaaugagaaagccaugggcccugcuaaacucuucaaauauaucgccaagcugcuguccugugauguggcugacauuaaaggguaccggaucgauaagagcggaaaggccgaaauucauacauuugaggcguauagaaaaaugaagacgcucgaaacccuggacaucgagcaaauggaucgcgagacacuugacaaacuggccuacgugcucacccugaacacagaacgggagggcauucaggaagcucuugagcacgaguucgccgaugggucuuucucccagaagcaggucgacgagcugguucaauuuagaaaagcuaauagcuccaucuucggaaagggcuggcacaacuuuucugugaagcucaugauggagcugaucccggaacuguacgagaccagcgaggaacagaugacgauucucacacgccugggcaaacagaagaccaccuccagcucuaauaaaacaaaguauaucgaugagaaacuucugaccgaagagauuuacaaccccguggucgccaaguccgugcggcaggccaucaagauuguuaaugcugcgaucaaagaauauggggacuucgauaacauugugaucgagauggccagagaaacaaaugaggacgacgagaagaaagcuauccaaaagauucagaaagccaacaaggaugaaaaagacgccgcuaugcucaaggccgcgaaccaguacaauggaaaggcugagcugccucauagcgucuuucacggccauaaacagcuggccacgaagauccgccuuuggcaccaacagggggaacggugccucuauaccggaaaaacaauuucuauccacgaucugauuaacaauagcaaccaguucgagguggaccauauccugccccucuccaucaccuuugaugacucucuggccaauaagguucuuguguacgcuacagccaaccaggaaaaaggccaaagaaccccuuaucaggcucuggauagcauggacgaugccugguccuuccgggagcucaaggcguuuguccgcgagagcaagacgcugucuaauaaaaagaaagaauaccugcuuaccgaggaagacauuuccaaguucgaugugcggaaaaaguuuaucgagagaaaccucgucgacacaagauacgccagccgcgugguucugaaugcucugcaggaacacuuccgggcccauaagauugauaccaaagugucugucgugagagggcaauuuacaucccagcuccgcagacacuggggcaucgagaagacccgggacacguaucaucaccacgcuguugacgcccugauuaucgcggccagcucccagcuuaaccuguggaaaaagcagaaaaauacacucgugucuuacagcgaggaucaacugcuggacaucgaaaccggagagcuuauuuccgaugacgaauauaaggaguucgucuucaaggcucccuaccagcauuuuguggauacacucaaaucuaaggaguucgaagacagcauccuguuuuccuaucagguggauagcaaauucaaccgcaagauuucugacgccaccaucuacgcuaccagacaggccaaaguuggcaaggauaaagccgacgagacauauguccuggggaagauuaaggauaucuacacgcaagacggauacgaugcuuuuaugaaaaucuauaagaaagacaaguccaaauuccucauguaccggcacgacccgcagaccuuugaaaaggugauugagccuauccuggaaaauuaucccaacaagcagaugaaugagaaaggcaaggaggugccuuguaaccccuuccuuaaauacaaggaggaacauggguauauucgcaaauacagcaagaagggaaacggccccgaaaucaaaucucugaaguauuacgauuccaaacucgggaaucacauugacaucacaccuaaggauagcaacaauaaagucgugcugcagucuguuagcccguggagagcggacguguacuuuaacaauaccacaggcaaguaugagauucugggacuuaaguacgccgaucuccaauucgaaaaaggcaccgggacguauaagaucucccaggagaaauacaacgacaucaagaaaaaggagggagucgauagcgacucugaauuuaaguucacacuguauaaaaaugaucugcuccuggugaaggagaccgaaaccaaagagcagcaacuuuuucgguuccugucccgcacaaugcccaagcagaaacacuacguugaacucaagccuuaugacaaacagaaguucgagggcggggaggcucugauuaaggugcugggaaacgucgccaauggcgggcagugcaucaaaggccuuggaaagagcaacauuuccaucuacaaagugagaaccgauguucugggcaaucaacauauuaucaagaacgaaggggacaaacccaagcucgacuuuuga

SEQ ID NO: 3940 - RNA, 3366 nt, Artificial Sequence
  Cas9 variant
augaacggccuggugcucgggcuggacaucggaauugccagcgucggcguugggauccuugagaaaaauuccggaaaaauuauccacgcuaacucuagacuguuccccgccgcgaccgcugauaauaacguggaacggcgcaagaauagacaggcccggcgccucaacagacggaaaaagcaucgcggcgugagauuucaagaccuguucgaggauuacgggcuucugacagacuuuagcaaagucuccauuaaucucaacccuuaucggcugcgcguggauggacugaauaagcagcucacgaacgaagaacuguucaucgcccuuaagaauaucguuaaaagacggggcauuucuuaccuggacgaugcuagcgaagacggcgggaccguguccucugauuauggaaaggccgucgaggagaaccgcaaacuccuggcugaacagacaccgggccagauccaacuugagagauuugaaaaguacgggcagcugcggggagacuucaccgugguugagaauggcgagaaaugccgccucauuaacguguuuagcacauccgccuauaagaaggaagcggagagaauccugcggaaacagcaggaguucaauagcaagauuaccgaugaguuuaucgaagacuaccugaaaauucucacagggaagagaaaauauuaccacggacccggcaacgagaagucucgcaccgauuacggccgguucagaaaagacgggacgacccuggacaacaucuuuggaauccuuauuggcaaguguacauucuauccuaaugaguaccgcgccuccaaggcuagcuauaccgcccaagaauuuaaccugcucaaugaucugaacaaucuuucuguccccacagagaccaaaaagcuguccgaggaacagaaaaagacgaucauugaauacgcuaaaagcgccaagacacucggggcgucuacccugcugaaguauaucgccaaaaugauugacacauccguggaucagauccggggauacagaguggacgucaacaauaagccugagaugcauaccuucgagguuuaucgcaaaaugcagagccucgaaaccaucuccgugggcgagcugucucggaacgugcuugaugaacuggcucacauucucacacugaauacggagagagaagggaucgaggaggccauuaacaccaaacuuaaggacagcuucucccaagaucagguccuggaacucgugcaguuucgcaagaauaacagcucucuguucuccaagggauggcauaauuuuagccugaaacucaugauggagcugauccccgaacuuuacgagacaucugaggaacaaaugaccauucugacacggcucggcaagcagaaaagcaaggagaccuccaaaagaucuaaguacaucgacgaaaaggagcugacggaagagaucuauaacccuguuguggcuaaaagcguccgccaggccauuaagaucauuaaugaggccacaaagaaguacggcaucuucgauaacauugugaucgaaauggcucgggagaacgacgaagaggaugcgaaaaaggacuauauuaaaagacagaaggccaaucaagacgaaaagaacgcugccauggagaaagccgcuuuucaguacaaugggaagaaagagcugccggauaacaucuuccacggacacaaggaacuugccaccaaaauccggcucuggcaucagcagggcgagaagugccuguauaccgggaagacaauucccaucuccgaccugauucacaaucaauacaaauaugaaaucgaucauguucucccucugagccuuucuuuugacgauucccugagcaacaaggugcucguccuggcgaccgcuaaucaggagaaaggacagcgcacacccuuccaggcccuggacucuauggaugacggcugguccuacagagaauuuaagagcuacgugaaagaguccaaacuucucgggaacaagaagaaggaguaucugcugacggaagaggauauuucuaaaaucgaagucaagcaaaaauucaucgagcggaaucucguggacaacagauacagcucccgcguugugcugaaugcccuucaggauuuuuauaaggcucacaaguucgacaccacaauuucugucgugcggggccaguuuaccagccagcugagacgcaaauggggacucgagaaguccagagaaacauaccaccaucacgccguugaugcucugaucauugccgcgagcucucaacugcggcuuuggaaaaagcauaacaauccucucaucuccuauaaagagggccgcuucauugacagcgaaaccggggagaucaucucucuguccgacgaugaauacaaggagcugguguucaaagcccccuaugaccacuuugucgauacgcucagaagcaagaccuucgaggacucuauucuguuuagcuaccagguggauuccaaguacaaccggaaaaucagcgacgcuacaauuuaugccacccgcaaggcuaaacuugauaaggacaaaucugaagagacauacgugcugggaaagaucaaggauauuuauucccaggccggcuacgacgcguucaucaaaaucuauaauaaggauaaaagcaaguuucucauguaccauaaagacccgcaaaccuucgaaaagguuauugaggaaauccugagaacguauccuuccaaggagcugaacgauaaaaacaaggagauucccuguaauccuuuugaaaaauaccggcaggagaacgggcccauccgcaaguacucuaaaaagggaaauggccccgaaauuaagagcaugaaauauuacgacaagaacaucccugaguccuucauuaauaucacaccgucuaacagcaauaacaaaguccuucucagacagcuguaucccuggcggaccgacguguacuuuaauccucagacagauaaguaugaacugcucgggcugaaauacgccgaccuucaauucgagaaggcuaccggcaaguauuccaucaccauugauaaauacaacgagaucaaggaaaaagagggagugucuaaggaaagcgaguuuaaauucacacuguacaagaaugaccuccugcugauuaaagauacgaagaacaaugaggaacagaucuuucgcuuccuuuccagaaccaugcccaaccagaaucacuaugucgagcugaagccuuacgacaaaggcaacuucgaagggaaggagaaaauuaagguguuuaaaaugacaagcaacggacggugcaucaagggccucgggaagaaauaucugucuaucuacaagguuaaaaccgauauucucggaaauaagcacuucaucaaaaaggaaggcgacgagcccaagcugaaauuuuga

SEQ ID NO: 3941 - RNA, 3366 nt, Artificial Sequence
  Cas9 variant
augaacggccuggugcucgggcuggacaucggaauugccagcgucggcguugggauccuugagaagaauagcggaaaaauuauccacgcuaacucuagacuguuccccgccgcgaccgcugauaauaacguggaacggcgcaagaauagacaggcccggcgccucaacagacggaaaaagcaucgcggcgugagauuucaagaccuguucgaggauuacgggcuucugacagacuuuagcaaagucuccauuaaucucaacccuuaucggcugcgcguggauggacugaaucagcagcucacgaacgaagaacuguucaucgcccuuaagaauaucguuaagagacggggcauuucuuaccuggacgaugcuagcgaagacggcggggccguguccucugauuauggaaaagcugucgaggagaaccgcaagcuccuggccgaacagaccccgggccaaauccagcuugagagauuugaaaaauacggacaggugcggggagacuucacaguuguggagaauggcgagaagcgcagacugauuaacgucuuuagcaccuccgcguaucggaaagaagccgagaagauccucagaaagcagcaagaguucaauaaccagauuacagaugaguuuaucgaagacuaccugaaaauucugaccgggaagcgcaaauauuaccacggacccggcaacgagaagucccggacagauuacggcagauuccgcaccgacgggacgacccucgacaauaucuuuggagugcugaucggcaaaugcacauucuauccuaacgaguaccgggcuucuaaguccagcuauaccgcccaggaauuuaaucuucugaacgaucucaauaaccugacagugcccaccgagacgaaaaagcugucugaagaacagaagaaagucauuguugaauacgcuaaggaggccaaaacacuuggggcguccacccuccugaaguauaucgugaaaaugauugacgccagcguggaucaaaucucuggauacagagucgacgugaauaacaagccugagaugcauacauucgaaguuuaucgcaagaugcagucccuggagaccauuagcgugggcgaacucucccggaauguccuggaugagcuugcucacauccugacccucaacacagaaagagaggggaucgaggaagccauuaauucuaaacugaugggaguguucagccaggaccaaguucuugagcuggugcaguuucgcaagaacaauuccagccucuucucuaaaggcuggcauaacuuuucccugaagcugaugauggaacucauccccgagcuguacgagacgagcgaggagcagaugaccauucuuacacggcugggcaaacagaagucuaaggaaaccagcaaaagaacaaaguacaucgaugagaaagaacucaccgaggagauuuauaauccugucguggcuaaguccguccgccaagccaucaaaaucauuaacgaagccacgaagaagcacgggaucuucgacaacauugugaucgagauggcucgggaaaauaacgaggaagaugcgaaaaaggacuacauuaaaagacagaaggccaaucaggaugagaaaaacgcugccauggagaaggccgcuuuucaguauaaugggaaaaaggaacugccgggcaacaucuucaaugggcacaaggagcuggccacaaaaauucggcuuuggcaucaacagggagaaaagugucucuacaccggcaaaaccauccccaucucugaccugauucacaaccaguauaaguacgagaucgaccauauucugccucucagccuguccuuugaugacagccuuucuaauaaaguucuggugcacgcgacagcuaaccaggaaaaggggcaacgcacccccuuccaggcccucgauuccauggacgaugccuggagcuauagagaguuuaagucuuacgucaaagaccugaagucccugagcaauaaaaagaaagauuaccuucucacagaggaagacaucuccaagauugaggugaagcagaaauucaucgaacggaaccugguugauacgagauauucuagccgcgugguccugaaugcucuccaggacuuuuacaagucccaccaauucgauaccacaaucucuguggugcggggccaguuuaccagccagcugagacgcaaauggggacuugagaaguccagagagacauaucaucaccaugccguugacgcucugauuaucgccgcgagcucucaacuccggcuguggaaaaagcagaacaauccucugauuaccuacaaggaaggccaguucaucgauucccagacgggggagauuaucagccuuaccgacgacgaauauaaagagcucgucuucaaggcccccuacgaucacuuuguggacacacugcauucuaaaaccuucgaagauggaauccuguuuuccuaucaaguggacagcaaguacaaccgcaaaauuucugaugcuacaaucuacgccaccagaaaggcuaaacucgacaaggauaagagcgaggagacguauguccugggcaaaauuaaggacaucuacucccaggccggguaugaugcguucauuaaaaucuacaacaaggacaaacggaaguuucuuauguaucacaaggauccgcagacauucgaaaaagugaucgaggaaauucugcgcaccuacccuagcaaggagagaaaugacaaaaacaaggaaguucccugcaauccuuuugagaaauaucggcaggagaacggacccauccgcaaguacucuaagaaaggcaaugggcccgaaauuaagugucucaaauacuaugauaacaagcugggcaauuacaucgacauuuccccugacggaagcgauaaccaagugguccugcagucccuuaaaccguggagaacagacguguauuucaaucaccagaccaagaaguacgagcucaugggccugaaauauucugaucugagcuuugaaaagggguccggaaaauacucuaucagcaacgagaaguauaauuccauuaaacggaucgaaggcguuaacgagcagucugaguucaaguuuacccucuacaagaaugaccugauccuuauuaaagauagcgaaaacaaugagcaaaagcuguuccgcuuuaacuccagaaacgacacagccaaacauuacguggaacucaagcccuaugauaaagcucgguucgacgggcagcaggagcugaucacgauucugggaaaugucgccaagggcgggcaaugccuuaaaggccugaacaagagcaauaucucuauuuucaaggugaaaaccgauguucucggaaagaaacacaucaucaagaaagagggcgacgaaccuaagcugaaguuuuga

SEQ ID NO: 3942 - RNA, 3366 nt, Artificial Sequence
  Cas9 variant
augagcgaccuggugcucggccuggauaucgggauuggauccgucggcguugggauccuuaacaaggugaccggagagauuauccacaaaaauucuagaauuuuccccgccgcucaggccgaaaacaaucuggugcggcgcacaaacagacaaggccggcgccucacgagacggaagaaacaucgcaucgucagacugaaucggcuuuuugaggaaagcgggcugaucaccgacuucacaaagauuuccaucaaccucaauccuuaccagcugcgcgugaaaggacugaccgaugagcucucuaacgaagaacuguuuauugcgcuuaagaauaugguuaagcacagaggcaucagcuaucuggacgaugcuuccgacgauggcaacucuagcgugggggacuacgcccagauugucaaagaaaauuccaagcagcucgaaacaaaaaccccgggacaaauccagcuggagcgguaucagacauacggccagcuucgcggggauuucaccguggaaaaggacggaaagaagcauagacugauuaacguuuuucccacgagcgccuaucggucugaggcucuccgcauccugaagacccaacaggaguucaauccucagaucacagaugaauuuauuaacagauaccuggagauccucaccggcaaacggaaguauuaccacgggcccggaaaugaaaaauccagaacagacuacggccgcuaucggaccaacggcgagacgcuggauaacauuuucgggauccuuauuggaaagugcacauuuuacccugaagaguucagagccgcuaaagccagcuauaccgcgcaggaguuuaaucugcucaacgaccugaauaaccuuacagugcccaccgaaaccaagaaacugucuaaggagcaaaagaaucagaucaucaacuacgucaaaaaugaaaaggccaugggcccugcuaaacucuucaaguauauugccaaacugcuguccugugacguggcugauaucaagggguaccgcauugacaagagcggaaaagccgagauccauacauuugaagcguaucggaagaugaaaacgcucgagacccuggauauugagcagauggacagagaaacacuugauaagcuggccuacgugcucacccugaacacagagcgcgaaggcauccaagaggcucuugaacacgaguucgccgacgggucuuucucccagaaacaggucgaugagcugguucaguuucggaaggcuaauagcuccaucuucggaaagggcuggcacaacuuuucugugaaacucaugauggaacugauuccggagcuguacgaaaccagcgaggagcaaaugacgauccucacaagacugggcaagcagaaaaccaccuccagcucuaauaagacaaaauauauugacgaaaaacuucugaccgaggaaaucuacaaccccguggucgccaaguccgugcgccaggccauuaaaaucguuaaugcugcgauuaaggaguauggggauuucgacaacaucgugaucgaaauggcccgggagacaaaugaggaugacgagaaaaaggcuauucagaaaauccaaaaggccaacaaagacgagaaggaugccgcuaugcucaaggccgcgaaccaguacaauggaaaagcugaacugccucauagcgucuuucacggccauaagcagcuggccacgaaaauuagacuuuggcaccagcaaggggagcgcugccucuauaccggaaagacaaucucuauucacgaccugaucaacaaucccaaccaguucgaaguggaucauauccugccucucagcauuaccuuugacgauucccuggccaauaaaguucuuguguacgcuacagccaaccaggagaagggccagcggacccccuaucaagcucuggacucuauggaugacgccuggagcuucagagagcucaaggcguuuguccgggaauccaaaacgcugagcaauaagaaaaaggaguaccugcuuaccgaagaggauaucucuaaauucgacgugcagaagaaguuuauugaacgcaaccucgucgauacaagauacgccucccgggugguucugaaugcucugcaggagcacuucagagcccauaaaaucgacaccaaggugagcgucgugcgcgggcaauuuacaucucagcuccggagacacuggggcauugagaaaacccgcgauacguaucaucaccacgcuguugacgcccugaucaucgcggccuccagccagcuuaaccuguggaagaaacagaagaauacacucguguccuacucugaagaccaacugcuggauauugagaccggagaacuuaucagcgacgaugaguauaaggaguccgucuucaaagcuccguaccagcauuucguggacacacucaagucuaaagaauuugaggauagcauucuguucuccuaucagguggacagcaaguuuaacagaaaaaucucugaugccaccauuuacgcuacccggcaggccaagguuggcaaagacaagaaggaugaaacauauguccuggggaaaaucaaggacaucuacacgcaagauggauacgacgccuucaugaaaauuuauaagaaagauaaguccaaguuucucauguaccgccacgacccucagaccuucgagaaagugaucgaacccauucuggagaauuauccuaacaaggagaugaaugaaaaaggcaaggaggugcccuguaaccccuuucuuaaauacaaggaggagcauggguauaucagaaaguacagcaaaaagggaaacggcccugaaauuaaaucucugaaguauuacgacuccaaacucgggaaucacaucgauauuacaccgaagaacagcaauaacaaggucgugcugcagucuguuagccccuggcgggcugacguguacuucaauaaaaccacaggcaaguaugagauccugggacuuaaauacgcggaucuccaguuugagaagggcaccgggacguauaaaaucucccaagaaaaguacaacgacauuaagaaaaaggagggagucgauagcgacucugaguucaaauuuacacuguauaagaaugaucugcuccuggugaaagacaccgaaaccaaggaacagcagcuuuuccgcuuucuguccagaacaaugccuaaaaagaagcacuacguugagcucaaacccuaugauaagcaaaaauucgagggcggggaagcccugaucaaggugcugggaaacgucgcuaauagcggccagugcauuaaagggcuugccaaguccaacaucucuauuuacaaggugcggaccgacguucugggcaaucagcauaucaucaaaaacgagggagauaagccuaaacucgacuucuga

SEQ ID NO: 3943 - RNA, 3366 nt, Artificial Sequence
  Cas9 variant
augagcgaccuggugcucggccuggauaucgggauuggauccgucggcguugggauccuuaacaaggugaccggagagauuauccacaaaaauucuagaauuuuccccgccgcucaggccgaaaacaaucuggugcggcgcacaaacagacaaggccggcgccucacgagacggaagaaacaucgcagaguccggcugaaucgccuuuuugaggaaagcgggcugaucaccgacuucacaaagaucuccauuaaccucaauccuuaccagcugagagugaaaggacugaccgaugagcucucuaacgaggagcuguuuaucgcgcuuaagaauaugguuaagcaccggggcauuagcuaucuggacgaugcuuccgacgauggcaacucuagcaucggggacuacgcccagauugugaaagaaaauuccaagcagcucgaaacaaaaaccccgggacaaauccagcuggagcgcuaucagacauacggccagcuuagaggggauuucaccgucgaaaaggacggaaagaagcaucggcugauuaacguguuucccacgagcgccuaucgcucugaggcucucagaauccugcaaacccagcaggaguucaauccucagaucacagaugaauuuauuaaccgguaccuggagauccucaccggcaagagaaaauauuaccacgggcccggaaaugaaaagucccgcacagacuacggccgguauagaaccagcggcgagacgcuggauaacauuuucgggauccuuauuggaaaaugcacauuuuacccugacgaguuccgcgccgcuaaggccucuuauaccgcgcaagaauuuaaccugcucaaugaccugaacaaucuuacaguucccaccgagaccaaaaagcuguccaaagaacagaagaaccagaucaucaauuacgugaagaacgagaaagccaugggcccugcuaaacucuucaaauauauugccaagcugcugagcugugaugucgcugacaucaaaggguaccggauugauaagucuggaaaggccgaaauccauacauuugaggcguauagaaaaaugaagacgcucgaaacccuggacauugagcaaauggaucgcgagacacuugacaaacuggccuacgugcucacccugaauacagaacgggagggcauccaggaagcucuugagcacgaguucgccgauggguccuucagccagaaacagguggacgaacugguccaauuuagaaaagcuaacuccucuaucuucggaaagggcuggcacaauuuuagcguuaagcucaugauggagcugauuccggaacuguacgagaccuccgaggaacagaugacgauccucacacgccugggcaaacagaagaccaccucuagcuccaacaaaacaaaguauauugaugagaaacuucugaccgaagagaucuacaaucccgugguggccaagagcguccggcaggccauuaagaucgugaacgcugcgauuaaagaauauggggacuucgauaauaucguuaucgagauggccagagaaacaaacgaggacgacgagaagaaagcuauucaaaagauccagaaagccaauaaggaugaaaaagacgccgcuaugcucaaggccgcgaaccaguacaacggaaaggcugagcugccucauucuguguuucacggccauaaacagcuggccacgaagauucgccuuuggcaccaacagggggaacggugccucuauaccggaaaaacaaucagcauucacgaucugaucaauaacuccaaucaguucgaggucgaccauauccugccccucucuauuaccuuugaugacagccuggccaacaaggugcuuguuuacgcuacagccaaucaggaaaaaggccaaagaaccccuuaucaggcucuggauuccauggacgaugccuggagcuuccgggagcucaaggcguuugugcgcgagucuaagacgcuguccaacaaaaagaaagaauaccugcuuaccgaggaagacaucagcaaguucgaugucagaaagaaguuuauugagcggaaucucguggacacaagauacgccucucgcgucgugcugaacgcucugcaggaacacuuccgggcccauaagaucgauaccaaaguuuccguggucagagggcaauuuacaagccagcuccgcagacacuggggcauugagaagacccgggacacguaucaucaccacgcuguggacgcccugaucaucgcggccuccucucagcuuaaucuguggaaaaagcagaaaaacacacucguuagcuacuccgaggaucaacugcuggacauugaaaccggagagcuuaucucugaugacgaauauaaggagagcguguucaaggcucccuaccagcauuucgucgauacacucaaauccaaggaguuugaagacagcauucuguucucuuaucagguggauuccaaauuuaaucgcaagaucagcgacgccaccauuuacgcuaccagacaggccaaagugggcaaggauaaagccgacgagacauauguucuggggaagaucaaggauaucuacacgcaagacggauacgaugcuuucaugaaaauuuauaagaaagacaagucuaaauuucucauguaccggcacgacccgcagaccuucgaaaaggucaucgagccuauucuggaaaacuaucccaauaagcagaucaacgagaaaggcaaggaggugccuuguaaucccuuucuuaaauacaaggaggaacauggguauauucgcaaauacuccaagaagggaaacggccccgaaaucaaaagccugaaguauuacgauucuaaacucgggaaccacauugacaucacaccuaaggauagcaauaacaaagugguccugcaguccgugagcccguggagagcggacguuuacuucaauaagaccacaggcaaguaugagauccugggacuuaaauacgccgaucuccaauuugaaaagggcaccgggacguauaaaauuucucaggagaaguacaacgacaucaaaaagaaggagggaguggauuccgacagcgaguucaaauuuacacuguauaagaaugaucugcuccuggucaaagacaccgaaaccaaggaacagcaacuuuuccgguuucugucccgcacaaugcccaaacagaagcacuacguggagcucaaaccuuaugauaagcagaaguucgaaggcggggaggcucugauuaaaguucugggaaacguggccaauucuggccagugcaagaaagggcuuggcaagagcaacaucuccauuuacaaagucagaaccgacgugcugggaaaucaacauaucaucaagaacgagggcgacaagcccaaacucgauuucuga

SEQ ID NO: 3944 - RNA, 3366 nt, Artificial Sequence
  Cas9 variant
augagcgaccuggugcucggccuggauaucgggauuggauccgucggcguugggauccuuaacaaggugaccggagagauuauccacaaaaauucuagaauuuuccccgccgcucaggccgaaaacaaucuggugcggcgcacaaacagacaaggccggcgccucacgagacggaagaaacaucgcagaguccggcugaaucgccuuuuugaggaaagcgggcugaucaccgacuucacaaagaucuccauuaaccucaauccuuaccagcugagagugaaaggacugaccgaugagcucucuaacgaggagcuguuuaucgcgcuuaagaauaugguuaagcaccggggcauuagcuaucuggacgaugcuuccgacgauggcaacucuagcgugggggacuacgcccagaucgucaaagaaaauuccaagcagcucgaaacaaaaaccccgggacaaauucagcuggagcgcuaucagacauacggccagcuuagaggggauuucaccguggaaaaggacggaaagaagcaucggcugaucaacguuuuucccacgagcgccuaucgcucugaggcucuccggauucugcaaacccagcaggaguucaauccucagaucacagaugaauuugugaacagauaccuggagauccucaccggcaagagaaaauauuaccacgggcccggaaaugaaaagucccgcacagacuacggccgguauagaaccaacggcgagacgcuggauaacauuuucgggauccuuauuggaaaaugcacauuuuacccugaagaguuccgcgccgcuaaggccagcuauaccgcgcaagaguuuaaucugcucaacgaccugaauaaccuuacaguccccaccgaaaccaaaaagcugucuaaagagcagaagaaucagaucauuaacuacgugaagaaugaaaaagccaugggcccugcuaaacucuucaaauauaucgccaagcugcuguccugugacguggcugauaucaaaggguaccggauugacaagagcggaaaggccgagauccauacauuugaagcguauagaaaaaugaagacgcucgagacccuggauauugagcaaauggaccgcgaaacacuugauaaacuggccuacguccucacccugaacacagagcgggaaggcauccaggaggcucuugaacacgaguucgccgacgggucuuucucccagaagcagguugaugagcuggugcaauuuagaaaagcuaauagcuccauuuucggaaagggcuggcacaacuuuucugugaagcucaugauggaacugaucccggagcuguacgaaaccagcgaggagcagaugacgauccucaaacgccugggcaagcagaaaacaaccuccagcucuaauaagaccaaauauauugacgaaaaacuucugacagaggaaaucuacaaccccgucguggccaaguccauucggcaggccaucaaaauuguuaaugcugcgaucaaggaguauggggauuucgacaacauugugaucgaaauggccagagagaccaaugaggaugacgaaaagaaggcuauccagaaaauucaaaaggccaacaaagacgagaaggaugccgcuaugcucaaggccgcgaaccaguacaauggaaaagcugaacugccucauagcgucuuucacggccauaagcagcuggccacaaaaauccgccuuuggcaccaacagggggagcggugccucuauacgggaaagaccauuucuauccacgaccugauuaacaaucccaaccaguucgaaguggaucauauccugccucucagcaucacauuugacgauucccuggccaauaaaguucuuguguacgcuaccgccaaccaggagaagggccaaagaacacccuaucaggcucuggacucuauggaugacgccuggagcuuccgggagcucaaggcguuuguccgcgaauccaaaacccugagcaauaagaaaaaggaguaccugcuuacggaagaggauauuucuaaauucgacgugagaaagaaguuuaucgaacggaaccucgucgauaccagauacgccucccgcgugguucugaaugcucugcaggagcacuuccgggcccauaaaauugacacaaaggugagcgucgugagagggcaauuuaccucucagcuccgcagacacuggggcaucgagaaaacacgggauaccuaucaucaccacgcuguugacgcccugauuaucgcggccuccagccagcuuaaccuguggaagaaacagaagaauacgcucguguccuacucugaagaccaacugcuggauaucgagacaggagaacuuauuagcgacgaugaguauaaggaguccgucuucaaagcuccguaccagcauuucguggacacccucaagucuaaagaauuugaggauagcauccuguucuccuaucagguggacagcaaguuuaaccgcaaaauuucugaugccacaaucuacgcuaccagacaggccaagguuggcaaagacaagaaggaugaaaccuauguccuggggaaaauuaaggacaucuacacacaagauggauacgacgccuucaugaaaaucuauaagaaagauaaguccaaguuucucauguaccggcacgacccucagacguucgagaaagugauugaacccauccuggagaauuauccuaacaaggagaugaaugaaaaaggcaaggaggugcccuguaaccccuuucuuaaauacaaggaggaacauggguauauucgcaaguacagcaaaaagggaaacgacccugaaaucaaaucucugaaguauuacgauuccaaacucggcaaucacauugacaucaccccgaaggauagcaacaauaaggucgugcugcagucuguuagccccuggagagcugacguguacuucaacaaaacaaccgggaaguaugagauucugggccuuaaauacgcggaucuccaguuugagaagggaacaggcaccuauaaaaucucccaagaaaaguacaaugacaucaagaaaaaggagggggucgauagcgacucugaguucaaauuuacgcuguauaagaacgaucugcuccuggugaaagacacagaaaccaaggaacagcagcuuuuccgguuucugucccgcaccaugccuaaacaaaagcacuacguugagcucaagcccuaugauaaacagaaguucgagggaggcgaagcccugauuaaagugcuggggaaugucgcuaacagcggacagugcaagaaaggccuugggaaguccaauaucucuauuuacaaggugagaacagacguucugggcaaccagcauaucauuaaaaaugagggagacaagccuaaacucgauuucuga

SEQ ID NO: 3945 - RNA, 3366 nt, Artificial Sequence
  Cas9 variant
augaacggccuggugcucgggcuggacaucggaauugccagcgucggcguugggauccuugagaaaaauuccggaaaaauuauccacgcuaacucuagacuguuccccgccgcgaccgcugauaauaacguggaacggcgcaagaauagacaggcccggcgccuccauagacggaaaaagcaccgcggcgugagauuucaagaccuguucgaggauuacgggcuucugacagacuuuagcaaagucuccauuaaccucaauccuuaucggcugcgcguggauggacugaaccagcagcucacgaaugaagaacuguucaucgcccuuaagaacaucguuaagagacggggcauuucuuaccuggacgaugcuagcgaagacggcgggaccguguccucugauuauggaaaagccgucgaggagaaucgcaagcuccuggcugaacagacaccgggccaaauccagcuugagagauuugaaaaauacggacaggugcggggagacuucaccguuguggagaacggcgagaagcgcagacugauuaaugucuuuagcacauccgccuaucggaaagaagcggagagaauccuccgcaagcagcaagaguucaacagcaagauuaccgaugaguuuaucgaagacugccugaaaauucugacagggaagcggaaauacuaucauggacccggcaaugagaagucuagaaccgauuacggccgcuuccggacggacgggaccacacucgacaacaucuuuggaauccugauuggcaaauguaccuucuacccugaugaguauagagccuccaaggcuagcuacacagcccaggaauuuaaccuucugaaugaccucaacaaucugaccgugcccacggagacaaagaaacuuucugaggaacagaagaaagugaucgucgaauaugcuaaggaggccaaaacccugggggcguccacacuccugaaguacauugccaaaaugaucgaugcuagcguugaccagauucgcggauaucggguggaugugaacaauaagccugagauccacaccuucgaagccuacagaaagaugcaaucucuggagaccaucuccgucggcgaacucagccgcaacgugcuggacgagcuugcucauauucugacacucaauacggaacgggaggggaucgaggaagccauuaacaccaaacugaaggauuccuucucucaggaccagguucuugagcuggugcaauuuagaaagaauaacagcucccucuucagcaagggauggcacaauuuuucucugaaacugaugauggaacucauccccgagcuguaugagacauccgaggaacagaugaccauucuuacacgccugggcaagcaaaagagcaaagaaaucucuaagcggaccaaauacaucgaugagaaggaacucacggaggagauuuacaacccugucguggccaaaagcguuagacaggcuaucaagauuaucaaugaagcgacaaagaaacacggcauuuucgacaacaucgugauugagauggcccgggaaaauaacgaggaagaugcuaagaaagacuauaucaagcgccagaaagccaaccaggacgagaagaaugccgcuauggagaaagccgcguuucaguacaacgggaagaaggaacugccggauuccaucuuccauggacagaaagagcuggcuaccaagauuagacuuuggcaccaacagggcgaaaaaugccucuauaccgggaagaauauccccauuucugaccugauccauaaccaguacaaauaugagauugaucacauccugccucucagccuguccuuugacgauagccuuucuaauaagguccuggugcucgccacagccaaccaggaaaagggacaacggacccccuuccaggcucuggacuccauggaugacgccuggagcuacagagaguuuaaaucuuaugucaaggaguccaaacugcuuggcaauaagaaaaaggaauaccuccugacagaggaagauaucagcaagauugaggugaaacagaaguucaucgagcgcaaccugauugacacgcgguacuccucuagaguugugcucaaugcucugcaggauuuuuauaaagcccacaaguucgacaccacaaucagcgucgugcgcgggcaauuuaccucccagcuuagacggaaauggggccuggaaaagucucgcgagacauaccaucaccaugcgguugaugcccucauuaucgcugccagcucccagcugagacuguggaagaaacaaaacaauccucuuaucgcuuauaaggaaggacaguucguggacagcgagaccggcgaaauuaucucucucuccgacgaugaguacaaagagcuggucuucaaggcccccuaugaccacuuuguggauacgcugagcucuaaaaccuucgaagacuccauucucuuuagcuaccagguggauucuaaguucaaccggaaaaucagcgacgcgacaauuuaugccacccgcaaggcuaagcuggauaaagagaaguccgaagagacauacguucuugggaaaaucaaggacaucuacagccaggccggauaugaugcuuuuauuaaaaucuacaauaaggacaagucuaaauuccugauguaucauaaggauccgcaaaccuuugaaaaagucauugaggagauccucagaacguacccuuccaaggaacugaacgacaaaaauaaggagauucccuguaacccuuucgaaaaguaucggcaggagaacggccccauccgcaaauacagcaagaaauccaaugggcccgaaauuaagucucugaaauauuacgauaacaaacuuggaaaucacaucgacaucacaccugagagcuccgacaaccagguggugcuccagucucugaagccguggagaaccgaugucuacuuuaaucaccaaacaaagaaguaugagcugaugggccucaaauacagcgaccuguccuucgaaaaggggucuggcaaauauagcauuuccaaccagaaguacaauagcaucaagcggauugagggaaucgaugaacagucugaguuuaaauucacccuuuauaagaacgaccugauucucaucaaagauuccgagaauaacgaacagaagcuguuucgcuucaauagcagaaacgacaccgccaaacauuacaucgagcugaagcccuaugauaaagccaaguucgacggcgaacaagagcuuauuacaauccuggggaauguggcuaagggaggccggugccucaaagggcugaacaagucuaauauuuccaucuuuaaaguuaagacggaugugcucgggaaaaagcacauuaucaagaaagaaggcgacgagccuaagcugaaauucuga

SEQ ID NO: 3946 - RNA, 3366 nt, Artificial Sequence
  Cas9 variant
augaacggccuggugcucgggcuggacaucggaauugccagcgucggcguugggauccuuaauaaggauaccggagagauuauccacacaaacuccagaauuuuccccgcugccacggcggacaauaacguggaacggcgcaauucuagacaggaucggcgccugaacagacggaaaaagcaucgcggcgugagacuccacgaccuguuugaggauuacgaccuucugaccgauuucagcaaagucuccaucaaucucaacccuuaucggcugcgcgugcaagggcuggacaauucucucacaaccgaagaacuguuuaucgcucuuaagaacauuguuaaaagacggggaaucagcuaccuggaugacgccuccgaagauggcggcguggucucuagcgacuaugggaaggccguggaggagaaucgcaagcuccuggcugaacagacaccgggacagauucagcuugagagauucaaaaaguacggccaaguuagaggggauuuuaccguggucgaaaacggagagaaacgcagacugaucaauguguucuccacaagcgccuaucggaaggaggcugaacggauucuccgcaaacagcaggaguuuaacaaucagaucaccgacaaguucauugaagacuaccugaagauccugacggagaaacggaaguauuaccauggccccgggaacgaaaaaucuagaaccgauuacggacgcuuucggacagacggcaccacacucgauaacaucuucggcauucugaucgggaagugcaccuuuuauccuaaugaguacagagccuccaaagcgagcuauacggcccaagaguucaaccuucugaaugaccucaacaaucugacagugcccaccgaaacaaagaaacuuucugaggaacagaagaagaccauugucgaguacgcuaaauccgccaagacccugggagcuagcacacuccugaaauauaucgccaagaugauugaugcgucuguugaccagauccgcggcuaccggguggaugugaacaauaaaccugaaaugcacacguuugaggucuauagaaagaugcagucccuggagaccaucagcgugugggaacucucccgcaacauucuggacgagcuugcccauauccugacacucaauaccgaacgggaggggauugaagaggcuaucaacacaaagcugauggauguuuucucucaagaccaggugcuugagcugguccaguuccgcaaaaauaacagcucccucuuuagcaagggauggcacaauuucucuagaaaacugaugauggaacugauucccgagcucuacgaaaccuccgaggagcaaaugacgauccugacacggcuuggcaagcagaaaagcaaggaaaccucuaagagaaccaaauacaucgaugagaaggaagugacagaggaaauuuauaacccuguuguggccaaaagcguccggcaggcuaucaagauuaucaaugaggccaccaaaaaguacgggauuuuugacaacaucgugauugagauggcccgcgaaaacaaugaggaagacgcuaagaaagauuauaucaagagacagaaagcgaaccaagacgagaagaaugucgccaucgaaaaagcugccuuccaguacaacggaaagaaagagcugccggauuccauuuuucacggccauaaggagcucgccacaaagauccggcuguggcaccagcagggcgaaaaaugucuguauacggggaagaauauucccaucucugaccuuauucauaaccaauacaaauaugagaucgaucacauccucccucugagccuguccuucgacgauagccucucuaauaaggugcugguucuugcuaccgccaaccaggaaaaaggacagagaacacccuuucaggcgcuggacuccauggaugacgcuuggagcuaccgcgaguucaagucuuacgugaaggauuccaaacuccugggcaauaagaaaaaggacuaucugcuuaccgaagaggauauuagcaaaaucgaggucaagcaaaaguuuauugaacggaaccucguggacacaagauacuccucucgcguugugcugaauacccugcaggacuucuauaaagcccacaaguuugauacgaccaucagcgucgugagagggcaguucacaucccagcuccggcgcaaauggggacuggagaagucuagagaaaccuaccaucaccaugccguggacgcucuuauuaucgccgcuagcucccaacugcggcucuggaaaaagcaggccaacccucugaucagcuauaaggaggaucaguuuguugacucugagacaggcgaaauuaucucccugaccgaugacaaauacaaggagcuugucuucaaagcgcccuaugcccacuucguggauacgcucagcucuaagaaauuugaagacuccauucuguucagcuaccaaguggauucuaaguacaaucgcaaaaucagcgacgcuacaauuuaugccaccagaaaggucaagcuggauaaagacaaguccgaggaaacauacgugcucgggaaaaucaaggauaucuauagccaggcuggcuacgacgccuuuauuaaaaucuauaacaaggacaagucuaaauuccugauguaccauaaggauccgcagaccuuugagaaaguuauugaggaaauccuucggauuuauccuuccaaggaguucaaugagaaaaacaaggaggugcccugcaacccuuuugaaaaguaccgccaggagaauggacccaucuguaaauacagcaagaaaggcaacgggcccgagauuaagucccugaaauauuacgacaagaauaucccugaaucuuucaucgauauuaccccgagcaacuccaagaauaaagucauccucagacaacugaaccccuggcggacagacguguauuuuaaucaccagacggagaaguacgaacugcuuggacucaaauaugcggaucugcaguucgagaagaaaaccgaaacauacucuauuaccaucgacaaguauaacgagauuaaggagaaagaaggcguuggggagcacagcgaauuuaaguucacacuguacaaaaaugaucuccugcuuaucaaggacauggagaucaaagaggaacagauuuuucgcuuccuguccagaaccaugccuaacaagaaacauuacguggagcucaagcccuauuacaagggaaauuucgaaggcaaagagcggaucaaggucuuuaacacgacaucuaaugggagaugccugaaaggccugggaaagaaaggccuuagcauuuauaagaucaagaccgaugugcuggggaacaaacacuucauuaagaaagaaggagagaagccuaaacucaaguuuuga

SEQ ID NO: 3947 - RNA, 3366 nt, Artificial Sequence
  Cas9 variant
auggacagaaccgaggugaacaucggcuucgauauugggaucagcuccgucggauggucuguuguggccacaaagagcggccggauucuggaauccggggugucucucuuuagcggagcuuccgccgcgaaaaaugaggaacgcagaaacuuccggcagucucgcagacugcuucggcgcagaaagaaucggaucagcgaccugaaaaaguaccucaaagagcaauccuuuacguauaacggcgaacugcuuaaugagaaccccuacgagauucgcgucaaggggcugaccgaaaagcucagcaaagaggaaaucgcucuggcccugcuccacaucgugaagagacggggaguuucuuaugaucugggcgacauugaggaggaaggcacaaccggguccuacaaagagggagugaagaaaaaucagaaacuucugaaggaaaagaccccugccgagauccaguuccagcgccucaagaaauuucauaaggucagaggccaaauugcuaucgaugaaaacgacgugcugcuuaauguuuucccgaaccacgccuauguggaugaggcucagcagauucuguacacacagcaagaguuuuaucccgaaaucaaugagacauucauuaaccaggucaccgacuuuaucagccggaaacgcgauuacuucaucgggccuggaucugaaaaguccagaacggacuacggcauuuaucggaccgaugggacaacccuccagaaucuguuuagcauccugauuggaaaagacaagaucuuccccgaugaguuuagagccgcgggcaacucuuacacagcccagguguauaaucuccugaacgaccuuaacaaucuggcuauugacgauaccgaaacgggcaagcucacaaaacaacagaaggagaaaaucaucauggagcugaagaccacagaaaaauccgugaacaugaugaaacuuauugccaagaccgcuggggucaccguugagcagaucagccgcuaccggauuaauagagacggaaaguccgaaauccauaacauggccguguaucgcaagauucggaaaguguuccuggagcucggcuacgaaaucaaugaguggccuucucaacugcuggaugagcucggggacgcgcugagccuuaacacagaaaauggagagaucagacgcauucugacggauaaccucgccaauaaguauaaaauccuggaccagcagcuuauuaaccugaucauugaaaauaagaacgcuuucacccucuccacaaaucagaaguggcaccgguuuagcuacaaaaccaugaagauccugauucccgagcugcucgagacaaacaaagaacaaaugaccauccugacggagaugggccuuaugaagaaagaucagagaaauuacgucgggaagaacaagaucgacucugaagcccugcucgagaaccuguauaauccugugguucgcaaauccacacggcagaccaugaagcuguucaacacccuucucaaaaaguacccgaauauugcuuauguggucaucgaaaugcccagagaggaugacgaggauaaagcccgccgggacuacgugaaguuucagaaagacaacgaaaaggagaaggaugccgcucugaaaaauuucauuauggaaagcggaaagucugaggcggaaguuaucgccaaauauagacaaagcaagaaauuucgguccaaggugcgccugugguaccagcagaugggcagaugccucuauucuggcaaggcuaugccugccgagcgggucuucagagacgaucauuuuacagacauugaucacgugaucccccugagcgucuccuucgacgaugggaugaacaauaaagugcuuugucuggccgagaugaaccgccagaaggacaaacaaaccccuuacgccuuuuucaaugcuggacacggccagggguuucaggcgaugaacgcuaugcucaagaauaacaaucggaucagcucugccaaaaagagaaaccugcuguucacagaaaaucuuaacgaucucgagguucgcaagagauuuauugaacggaaccugguggacacgcgcuacgccuccagagucgugcugaaugagcuccagcaauucguuaaagcuaagcagcuggauaccaaagugacagucauccggggaaaguucaccagcaaacuucgcgaaaaguggaacauuaauaagucuagagacacacaucaccaucacgccguggaugcugccgugaucgcgguuucccccaugcugaaccucugggagaaaggcgccagcauuaucccgaauaaggucggggagaacgugaucgacauuaaaaccggcgaaaucauuacggaccacgauuaugaggcugacguguacgaacugccuuaugccaaguuucuggagcagauccccaaagucaagaaagauauuaaguuccggcaucaaguggacaagaaaaagaaucgcaaaguuuccgaugcuaccaucuacacaaccagaaaggccaaagugggaaaggacaaggaggaaacagauuauguccuuggcaccaucaaagacauuuacucucucgagggguaugugagcuuuaagaaaaucuacaacaaggauaaagcgaaguuccugauggcccggauugacccuaagacguuugaaaaacuggagaagaucguugcugaauaccccgaguccauugaggugguccaggauaauggaaaaguggacguucagaagaucucucccuucgaacucuaucgcaaagauaacggcuuugugacaaaguucgccaagaaaaauaacgggccugcugucaagagccugaaauacuaugacuccaaacuuggaagcucuauugacgugaccccggauaaugccaagaacaagaaggugauccugcagucccucaaacccuggagaacagacgucuacuuuaaugaggaaaaccaagaguaugaaaucaugggccugaaguacagcgaucugaaauucgggaagaacggcaaauauggaguuccuaaggugcgguacgaggagauuaaacaggaagaggaaaucucugagggcuccaaguuucuuuucagccucuacagaggggaccgcauuaaggugaccaaugaacugggagagaaccuggaucuccuguuuucuagccggacccuucccgcccagaaaggcuaugucgagcugaagccuaucgacaaaacaaaguucgaugggaaagaaaagguguccuucuacggaacgguuacccccaauggccaguuugugaagaaauucgcuaagaaaggguauaagauucucaaacugaacacagacgagcugggcaauaccuacaucgaaaacggagagaaggagccgagcgauauccuugacauguga

SEQ ID NO: 3948 - RNA, 3366 nt, Artificial Sequence
  Cas9 variant
augaacggccuggugcucgggcuggacaucggaauuggcagcgucgggguuggaauccuuaauaaggauaccggcgagauuauccacgccaacuccagaauuuuccccgcugccacagcggacaauaacguggugcggcgcucuagcagacaggggcggcgccugaaucaucggaaaaagcacagauccguccgccucaaagaucuguuugaauacuaugaccuucugacggauuucucuaaggugagcaucaaccucaauccuuacagacugcggguuaacggacugaaucaacagcucaccaacgaggaacuguuuaucgcucuuaaaaauauugugaagcgcagaggcaucuccuaucuggacgaugccucugaggacggcggggccgucagcuccgauuacggaaaggcuguggaagagaaccggaaacuccuggccgagcagacaccgggccagauucaacuugaacgcuucgagaaguaugggcagguuagaggagacuuuaccguggucgaaaauggcgagaaacggcgccugaucaacguguucagcacaucugcuuacaagaaagaggccgaacggauucucagaaagcagcaggaguauaauaaccaaaucauggaugaauuuauugcggacuaccugaccauccugacagggaagagaaaauacuaucauggacccggcaacgagaagucccgcaccgauuacggccgguucagaacggacgggaccacacucgacaauaucuuuggcauucugaucggaaaaugcaccuucuauccugaaaaguaccgcgccagcaaagccucuuauacagcucaggaguuuaaccuucugaaugaucucaacaaucugaccgugcccacggagacaaagaaacuuuccgaagaacagaagaagaccauugucgaauacgcuaaaagcgccaagacacugggggcgucuacccuccugaaauauaucgccaagaugauugacgcuuccguugaucagauccggggauacagaguggacgugaaaaacaagccugagaugcacaccuucgaagucuaccgcaagaugcaaagccuggagacaaucuccgugggcgaguuuucucgggaaguucucgaugagcuggcccaugugcuuacgcugaauaccgaaagagaggggauugaagaggcuaucaacacaaaacuccgcgacagcuucucccaggaucagauucuggagcuuguccaauuccggaagaauaacagcucucuguuuuccaaaggauggcacaauuucagccucaagcugaugauggaacugauccccgagcucuaugaaaccucugaggagcagauggccauucugacaagacuuggcaaacagaaguuuaaggaaaccagcaaacgcacgaaguacaucgacgagcaggaagugacagaggaaaucuauaacccuguuguggccaaauccguccggcaagcuauuaagaucauuaaugaggcgaccaaaaaguacggcaucuucgauaacauugugaucgagauggccagagaaaauaacgaggaagaggcuaagaaagacuauauuaagcggcagaaagccaaccacgaugaaaagaaugccgcuauggagaaagccgcguuucaguacaacggggagaaggaacugccggacucuaucuuccauggacacaaagagcucgcuaccaagguccgccuguggcaucagcaaggcgaaaagugucuguauacagggaaaaauauccccauuagcgaccuuauccacaaccaguacaaguacgagauugaucacauccucccucugucccugagcuuugacgauucucucuccaauaaagugcugguucuugccaccgccaaccaggaaaagggacagagaacacccuuccaagcucuggacagcauggaugacgccuggucuuaucgggaguuuaaauccuacgugaaggauagcaagucccucggcaauaaaaagaaagacuaucugcugacggaggaagauauuucuaagaucgaggucaaacagaaguucaucgaaagaaaccuuguggacacccgcuacagcucccggguugugcucaauacacugcaggauuuuuauaaggcucauaaauucgacaccacaauuucugucgugagagggcaguuuaccagccaacugcgcagaaaguggggccucgagaaaucccgggagacguaccaccaucacgccguggaugcgcugaucauugccgcuagcucucagcuucgccuguggaagaaacagaacaauccucucaucuccuauaaggaaggacaauucguugacagcgagaccggcgaaauuaucucucugacagacgaugaguacaaggaacuggucuucaaagcccccuacgaccauuuuguggauacccuuagauccaagaaauucgaggacagcauccucuuuucuuaucagguggauagcaaguucaaccggaaaauuuccgacgcuacaaucuacgccacccgcaagacgaaacuggauaaggacaagagcgaggaaacauauguccuggggaaaauuaaggauaucuacucucaguccggauaugacgcguuuauuaaaaucuacaauaaggauaaaagcaaguuccucauguaucacaaggacccgcagaccuuugagaaagugaucgaagagauucugagaacauacccuuccaaggaguucaacgagaaaaauaaggagguuucuugcaaccccuuugaaaaauacaagcaagagaacggcccuauccggaaguauagcaaaaaggggaauggacccgaaauuaaaucccuuaaguacuaugauaaaaacauccccgagucuuucauuaauaucaccccuagcaacuccaagaauaaggugauucugcgccagcucaacccguggagaaccgacgucuacuuuaaucaccagacagaaaaauaugagcugcugggccuuaaguacgccgaccuccaguucgagaaaaagacggggaccuauucuaucacaaucgauaaauacaacgaaauuaaggagaaggaaggcgugagcgagcauuccgaguuuaaauucacccuguacaagaaugaccugcuccugaucaaagauacagaaauuaaggaggaacaaaucuuccgguuucuuagccgcaccaugcccaaccagaaacacuauguugagcugaagccuuacuauaaaggaaauuucgaaggcaaggagagaauuaagguguuuaacacgacaucuaaugggcggugucucaaaggacugagaaagaaaggccuguccaucuacaagaucaaaaccgacguccuugggaacaagcauuucauuaagaaagagggagaaaagcccaaacugaaguuuuga

SEQ ID NO: 3949 - RNA, 3366 nt, Artificial Sequence
  Cas9 variant
augagcgaccuggugcucggccuggauaucgggauuggauccgucggcguugggauccuuaacaaggugaccggagagauuauccacaaaaauucuagaauuuuccccgccgcucaggccgaaaacaaucuggugcggcgcacaaacagacaaggccggcgccucacgagacggaagaaacaucgcaucgucagacugaaucggcuuuuugaggaaagcgggcugaucaccgacuucacaaagauuuccaucaaccucaauccuuaccagcugcgcgugaaaggacugaccgaugagcucucuaacgaagaacuguuuauugcgcuuaagaauaugguuaagcacagaggcaucagcuaucuggacgaugcuuccgacgauggcaacucuagcgugggggacuacgcccagauugucaaagagaauagcaagcagcucgaaacaaaaaccccgggacaaauccagcuggagcgguaucagacauacggccagcuucgcggggauuucaccguggaaaaggacggaaagaagcauagacugauuaacguuuuucccacgagcgccuaucggucugaggcucuccgcauccugcaaacccagcaggaguucaauccucagaucacagaugaauuuauuaacagauaccuggagauccucaccggcaagcggaaauauuaccacgggcccggaaaugaaaaguccagaacagacuacggccgcuaucggaccagcggcgagacgcuggauaacauuuucgggauccuuauuggaaaaugcacauuuuacccugacgaguucagagccgcuaaggccucuuauaccgcgcaagaguuuaaccugcucaaugaccugaacaaucuuacagugcccaccgagaccaaaaagcuguccaaagaacagaagaaccagaucaucaauuacgucaagaacgagaaagccaugggcccugcuaaacucuucaaauauauugccaagcugcugagcugugauguggcugacaucaaagaauaccgcauugauaagucugggaaggccgagauccauacauuugaagcguaucggaaaaugaagacgcucgagacccuggacauugagcaaauggauagagaaacacuugacaaacuggccuacgugcucacccugaauacagagcgcgaaggaauccaggaggcucuugaacacgaguucgccgauggcuccuucagccagaagcaggucgacgagcugguucaauuucggaaagcuaacuccucuaucuucgggaagggauggcacaauuuuagcgugaagcucaugauggaacugauuccggagcuguacgaaaccuccgaggagcagaugacgauccucacaagacugggcaaacagaagaccaccuccucuuccaacaaaacaaaguauauugaugaaaaacuucugaccgaggaaaucuacaaucccguggucgccaagagcgugcgccaggccauuaagaucguuaacgcugcgauuaaagaguauggcgacuucgauaauaucgugaucgaaauggcccgggagacaaacgaggacgacgaaaagaaagcuauucaaaagauccagaaagccaauaaggaugagaaagacgccgcuaugcucaaggccgcgaaccaguacaacgggaaggcugaacugccucauucugucuuucacggacauaaacagcuggccacgaagauuagacuuuggcaccaacagggcgagcgcugccucuauaccgggaaaacaaucagcauucacgaucugaucaauaacuccaaucaguucgaaguggaccauauccugccccucucuauuaccuuugaugacagccuggccaacaagguucuuguguacgcuacagccaaucaggagaaaggacaacggaccccuuaucaggcucuggauuccauggacgaugccuggagcuucagagagcucaaggcguuuguccgggaaucuaagacgcuguccaacaaaaagaaagaguaccugcuuaccgaagaggacaucagcaaguucgaugugcgcaaaaaguuuauugaaagaaaucucgucgacacacgguacgccucuagagugguucugaacgcucugcaggagcacuuccgcgcccauaagaucgauaccaaaguguccgucgugcggggccaauuuacaagccagcucagacgccacugggggauugagaagaccagagacacguaucaucaccacgcuguugacgcccugaucaucgcggccuccauucagcuuaaucuguggaaaaagcagaaaaacacacucgugucuuacagcgaagaucaacugcuggacaucgagaccggcgaacuuauuuccgaugacgaguauaaggagucugucuucaaggcucccuaccagcauuucguggauacacucaaaagcaaggaauuugaggacuccauccuguucagcuaucagguggauucuaaauuuaaucggaagauuuccgacgccaccaucuacgcuacccgccaggccaaaguuggaaaggauaaagccgacgaaacauauguccugggcaagaucaaggauauuuacacgcaagacggguacgaugcuuucaugaaaaucuauaagaaagacaagagcaaauuucucauguacagacacgacccgcagaccuucgagaaggugauugaaccuauccuggagaacuaucccaauaagcagauuaacgagaaaggaaaggaagugccugucaaucccuuucuuaaauacaaggaggaacauggcuauauccggaaauacucuaagaaggggaacggacccgagauuaaaucccugaaguauuacgauagcaaacucggcaaccacaucgacaucacaccuaaggauucuaauaacaaagugguucugcagagcguguccccguggcgcgcggacgucuacuucaauaagaccacagggaaguaugaaauucugggccuuaaauacgccgaucuccaauuugagaagggaaccggcacguauaaaaucagccaggagaaguacaacgacauuaaaaagaaggaagggguggauucugacuccgaguucaaauuuacacuguauaagaaugaucugcuccugguuaaagacaccgaaaccaaggagcagcaacuuuucagauuucugagccggacaaugcccaaacagaagcacuacguggaacucaaaccuuaugauaagcagaaguucgagggaggcgaggcucugaucaaaguccuggggaacguggccaauuccggacaguguaagaaaggccuugggaagucuaacauuagcaucuacaaaguucgcaccgacgugcugggcaaucaacauaucauuaagaacgaaggagacaagcccaaacucgauuucuga

SEQ ID NO: 3950 - RNA, 3366 nt, Artificial Sequence
  Cas9 variant
augaacggccuggugcucgggcuggacaucggaauugccagcgucggcguugggauccuugagaaaaauuccggaaaaauuauccacgcuaacucuagacuguuccccgccgcgaccgcugauaauaacguggaacggcgcaagaauagacaggcccggcgccucaacagacggaaaaagcaucgcggcgugagauuucaagaccuguucgaggauuacgggcuucugacagacuuuagcaaagucuccauuaaucucaacccuuaucggcugcgcguggauggacugaaucagcagcucacgaacgaagaacuguucaucgcccuuaagaauaucguuaagagacggggcauuucuuaccuggacgaugcuagcgaagacggcggggccguguccucugauuauggaaaagcugucgaggagaaccgcaagcuccuggccgaacagaccccgggccaaauccagcuugagagauuugaaaaauacggacaggugcggggagacuucacaguuguggagaauggcgagaagugccgccugauuaacgucuuuagcaccuccgcguauagaaaagaagccgagaagauccuccggaagcagcaagaguucaauaaccagauuacagaugaguuuaucgaagacuaccugaaaauucugaccgggaagagaaaauauuaccacggacccggcaacgaaaagagccgcacagauuacggccgguucagaaccgacgggacgacccucgacaauaucuuuggagugcugaucggcaaauguacauucuauccuaacgaguaccgcgcuucuaaguccagcuauaccgcccaggaauuuaaucuucugaacgaucucaauaaccugacagugcccaccgagacgaaaaagcugucugaagaacagaagaaagucauuguugaauacgcuaaggaggccaaaacacuuggggcguccacccuccugaaguauaucgugaaaaugauugacgccagcguggaucaaaucucuggauaccgggucgacgugaauaacaagccugagaugcauacauucgaaguuuauagaaagaugcagucccuggagaccauuagcgugggcgaacucucccgcaauguccuggaugagcuugcucacauccugacccucaacacagaacgggaggggaucgaggaagccauuaauucuaaacugaugggaguguucagccaggaccaaguucuugagcuggugcaguuuagaaagaacaauuccagccucuucucuaaaggcuggcauaacuuuucccugaagcugaugauggaacucauccccgagcuguacgagacgagcgaggagcagaugaccauucuuacacgccugggcaaacagaagucuaaggaaaccagcaaacggacaaaguacaucgaugagaaagaacucaccgaggagauuuauaauccugucguggcuaaguccgucagacaagccaucaaaaucauuaacgaagccacgaagaagcacgggaucuucgacaacauugugaucgagauggcucgcgaaaauaacgaggaagaugcgaaaaaggacuacauuaaacggcagaaggccaaucaggaugagaaaaacgcugccauggagaaggccgcuuuucaguauaauggaaagaaggaacugccgggcaacaucuucaaugggcacaaggagcuggccacaaaaauuagacuuuggcaucaacagggagaaaagugccucuacaccggcaaaaccauccccaucucugaccugauucacaaccaguauaaguacgagaucgaccauauucugccucucagccuguccuuugaugacagccuuucuaauaaaguucuggugcacgcgacagcuaaccaggaaaaggggcaacggacccccuuccaggcccucgauuccauggacgaugccuggagcuaucgcgaguuuaagucuuacgucaaagaccugaagucccugagcaauaaaaagaaagauuaccuucucacagaggaagacaucuccaagauugaggugaagcagaaauucaucgaaagaaaccugguugauacgcgguauucuagcagagugguccugaaugcucuccaggacuuuuacaagucccaccaauucgauaccacaaucucuguggugcgcggccaguuuaccagccagcugcggagaaaauggggacuugagaagucccgcgagacauaucaucaccaugccguugacgcucugauuaucgccgcgagcucucaacucagacuguggaaaaagcagaacaauccucugauuaccuacaaggaaggccaguucgucgauucccagacgggggagaucauuagccuuaccgacgacgaauauaaagagcucguguucaaggcccccuacgaucacuuuguggacacacugcauucuaaaaccuucgaagauggaauccuguuuuccuaucaagucgacagcaaguacaaccggaaaaucucugaugcuacaauuuacgccacccgcaaggcuaaacucgacaaggauaagagcgaggagacguaugugcugggcaaaaucaaggacauuuacucccaggccggguaugaugcguucaucaaaauuuacaacaaggacaaaagaaaguuucuuauguaucacaaggauccgcagacauucgaaaaaguuaucgaggaaauccugcggaccuacccuagcaaggagcgcaaugacaaaaacaaggaagugcccuguaauccuuuugagaaauauagacaggagaacggacccauucggaaguacucuaagaaaggcaaugggcccgaaaucaagugccucaaauacuaugauaacaagcugggcaauuacauugacaucuccccugacggaagcgauaaccaagucgugcugcagucccuuaaaccguggcgcacagacguuuauuucaaucaccagaccaaggaguacgaacucaugggccugaaguauucugaucugagcuuugagaaaggguccggaaaguacucuauuagcaacgaaaaauauaauuccaucaagagaauugagggcgugaacgagcagucugaguucaaauuuacccucuacaagaaugaccugauccuuaucaaggauagcgagaacaaugaacaaaaacuguuccgguuuaacucccgcaacgacacagccaagcauuacgucgagcucaaacccuaugauaaggcuagauucgacgggcagcaggagcugauuacgauccugggaaauguggccaaaggcgggcaaugucuuaagggccugaacaaaagcaauauuucuaucuucaagguuaagaccgaugugcucgggaaaaagcacauuaucaaaaaggaaggcgacgagccuaaacugaaguuuuga

SEQ ID NO: 3951 - RNA, 3366 nt, Artificial Sequence
  Cas9 variant
auggccgacaagacccugggcgcucucacauucggguuugauaucggaauugccagcgugggcuggugcguccugggggagaacagaaucguugaccuuggagugcgggcguucgauaaagcugaaacggccaaggagggcgaaucccugaaucucgcccgcagaaccgcucggcugaugcgcagacggcuucgcagacgggccuggcgccugacaaaacucgcuagacugcugaagcgggaggggcucauugccgacgcguuucagaugcaccaacccucugccaccagcccuuggaaacugcgcguggaagcucuugauagacggcugacagacgaugagugggcccgcgucaucuaccaucucuguaagcacagaggauuccauuggauuucccgggcugaggaaaagaaagccgagggcgacgcgaagggcgaaucugggagagugaaaaagggacugagcgauacccagcgccggaugggcgagaaaggguauagauccgccgcugagaugguucuugccgaauuuccggaggcucagcgcaacaagcagggagacuacggcaaggcccugucucgggugcuccugagcgaagaacuggcccuccuguucagacgccaacgggaacuugggcacacacaugcuuccaaagagcuggaggcggccauccucggaaauggcgauagaaagggcgggcuguuuugggcucagaaacccccucuugccggagccgaccugcucaagaugcugggcaaaugcaccuucgaaaaggaugaguaucgcgcucccaaagccagcuuuacggcggaacggcacgucuggcugaccagacucaacaaucugcgcgugguuguggacgggacaacccggccucuuacagaggacgaaagacgggucgcucugccccucccuuacggauaugccgaugccaagcugaccuacaagcagcuucgcgcugcccugucuaaagcuggccucuccaacuucagcuuugccgggaucgcggacgauaaggagaaagacacgcugacaaagcugccggccugggagacccucucuaaaacacugaagggaaagggccuugaaaccgagugggaaggcauggcuggggccgcuaccggaggcgaucccacacugcucgacgagauuuccagagugcugagcguguauaaagauggggacgaagucgauguugagcugcggaagcucccucuccccggaggcgagaaaaugguggaaacgcugucugagaucuccuucgacaaguuucacgcccugagccucaaagcgcugagaaagauugugccucauauggaaaccgggcuucgcuacgaugaggccugugcugccgcuggcuaccaccauucccagcugcacgaggccggagccggcgggcaaaaguaucuucccccguucuacacacggagagacaaagacggacgcauggucuucgaugaggagcuggacgugccuagaaaucccguugugcugcgggcucuuaaccaggcgcgcaagguccucaaugcccuggugagagcuuauggcucuccuagcgccguucacaucgaaauggcccgggaucuguccaaaccccucguggggcaucccaccccuaacggaggcuacauugaggggcgcagagacaucgaaaagcugcagaaagaguaucgggagcgcaaugaaaaggauaaggcugccuuugcggcugagcacggcauugccgccaaaagcagagaguucgaaaaguuucagcuuuaccgggaacaacagggaaaaugcgcuuauucucugaagccgcucgaccugcaucgcguccugcacgauaucggcuacgccgagguggaccaugcgcuucccuacuccagaagcuaugaugacgggaaaaacaauaagguccucgugcugacagaggaaaaccggaauaaaggaaacagaaccgcuuacgaguaucugugugccuucccuggcggggaaaacggagagcgcuggcggaauuuuguugccuacguggaaucuaacaagagcuauagacucgcuaagcgcacgcggcugcuuagaaaagauuucggcgggaaggccgcugaggaguuucgcgaacggaaucugaacgacacaagauacaucugcaaauucuuuaagaauuucgucgagcgcuuucuccagcugaaagugggcgccgauggaaccgcggccaagcgguguguugugcuguccggccaaaccacagcuuuccuuagagcccggugggggcuccugaagguccgcggagcuucugacagacaccacgcccuggacgccgcugugguggcggccugcagccauggcaugguuaaacggcucgcugauuauucccgcaccaaggaacuggccaaagucagagacggguuucccgauccugagacaggagagauuguggaccccgccauguuccagcagcuucacgcucauuucccggauccuuggccccacuuucggggcgaacuggaggccagacuccagcuggacgauagcgcggaacugcgcgcucaacuugagauguucgggacguacccugccgaagcccuggagacccuccggccccuguuugugucuagagcuccucagcgccggaacggcggagccgcgcacaaggagacaaucuacgcucagcccgaaagacucaaagagcagggcggggucacccaaaaggugucccuggccagccuuaagccgacagacauugauaaacugaucgacccucaucgcaaugaaaagcucuaugccgcuauucgggccagacuggaggcucacggaggcaaaucugauaaggccuuccccgcggacaacccccugcgcaaaccugauagagacgggaauccgaccggacccaucguucgggccgugacgauggucaucgacaaacuuuccggcauucagauccgcggcgggauugcuaagaacgauaccaugcugagaguggacguuuuucggcauaagaaggauggaaaauuccaccucgugccucuguacguccaucacgccguggcucaggaacuccccaaucgcgccaucguugccuuuaaggacgaggaugaguggacacugauugacgauaacuuccacuuucuuuucagcuuucauccuaaugacuucaucagaaucacccagaaaaacaaggcucccauucugggcuauuacgcguccugucaccgggggacaggaaaucucaaccugugggcccaugauagaaaccaaaaagugggcaaggacgggcagaucgaaggaauuggcgucaagaccgcuguggcccuggagaaauuucacguggauguccuuggcaauaucuauccugcucccccggaacagcgccaugggcuggccuga

SEQ ID NO: 3952 - RNA, 3366 nt, Artificial Sequence
  Cas9 variant
augagcgaccuggugcucggccuggauaucgggauuggauccgucggcguugggauccuuaacaaggugaccggagagauuauccacaaaaauucuagaauuuuccccgccgcucaggccgaaaacaaucuggugcggcgcacaaacagacaaggccggcgccucacgagacggaagaaacaucgcagaguccggcugaaucgccuuuuugaggaaagcgggcugaucaccgacuucacaaagaucuccauuaaccucaauccuuaccagcugagagugaaaggacugaccgaugagcucucuaacgaggagcuguuuaucgcgcuuaagaauaugguuaagcaccggggcauuagcuaucuggacgaugcuuccgacgauggcaacucuagcgugggggacuacgcccagaucgucaaagaaaauuccaagcagcucgaaacaaaaaccccgggacaaauucagcuggagcgcuaucagacauacggccagcuuagaggggauuucaccguggaaaaggacggaaagaagcaucggcugaucaacguuuuucccacgagcgccuaucgcucugaggcucuccggauucugcaaacccagcaggaguucaauccucagaucacagaugaauuuaucaacagauaccuggagauucucaccggcaagagaaaauauuaccacgggcccggaaaugaaaagucccgcacagacuacggccgguauagaaccagcggcgagacgcuggauaacaucuucgggauucuuaucggaaaaugcacauuuuacccugacgaguuccgcgccgcuaaggccucuuauaccgcgcaagaauuuaaccugcucaaugaccugaacaaucuuacagugcccaccgagaccaaaaagcuguccaaagaacagaagaaccagauuaucaauuacgucaagaacgagaaagccaugggcccugcuaaacucuucaaauauaucgccaagcugcugagcugugauguggcugacauuaaaggguaccggaucgauaagucuggaaaggccgaaauucauacauuugaggcguauagaaaaaugaagacgcucgaaacccuggacaucgagcaaauggaucgcgagacacuugacaaacuggccuacgugcucacccugaauacagaacgggagggcauucaggaagcucuugagcacgaguucgccgauggguccuucagccagaagcaggucgacgaacugguucaauuuagaaaagcuaacuccucuaucuucggaaagggcuggcacaauuuuagcgugaagcucaugauggagcugaucccggaacuguacgagaccuccgaggaacagaugacgauucucacacgccugggcaaacagaagaccaccucuagcuccaacaaaacaaaguauaucgaugagaaacuucugaccgaagagauuuacaaucccguggucgccaagagcgugcggcaggccaucaagauuguuaacgcugcgaucaaagaauauggggacuucgauaauauugugaucgagauggccagagaaacaaacgaggacgacgagaagaaagcuauccaaaagauucagaaagccaauaaggaugaaaaagacgccgcuaugcucaaggccgcgaaccaguacaacggaaaggcugagcugccucauucugucuuucacggccauaaacagcuggccacgaagauccgccuuuggcaccaacagggggaacggugccucuauaccggaaaaacaauuagcauccacgaucugauuaauaacuccaaucaguucgagguggaccauauccugccccucucuaucaccuuugaugacagccuggccaacaagguucuuguguacgcuacagccaaucaggaaaaaggccaaagaaccccuuaucaggcucuggauuccauggacgaugccuggagcuuccgggagcucaaggcguuuguccgcgagucuaagacgcuguccaacaaaaagaaagaauaccugcuuaccgaggaagacauuagcaaguucgaugugcggaaaaaguuuaucgagagaaaucucgucgacacaagauacgccucucgcgugguucugaacgcucugcaggaacacuuccgggcccauaagauugauaccaaaguguccgucgugagagggcaauuuacaagccagcuccgcagacacuggggcaucgagaagacccgggacacguaucaucaccacgcuguugacgcccugauuaucgcggccuccucucagcuuaaucuguggaaaaagcagaaaaacacacucgugagcuacuccgaggaucaacugcuggacaucgaaaccggagagcuuauuucugaugacgaauauaaggagagcgucuucaaggcucccuaccagcauuucguggauacacucaaauccaaggaguuugaagacagcauccuguucucuuaucagguggauuccaaauuuaaucgcaagauuagcgacgccaccaucuacgcuaccagacaggccaaaguuggcaaggauaaagccgacgagacauauguccuggggaagauuaaggauaucuacacgcaagacggauacgaugcuuucaugaaaaucuauaagaaagacaagucuaaauuucucauguaccggcacgacccgcagaccuucgaaaaggugauugagccuauccuggaaaacuaucccaauaagcagauuaacgagaaaggcaaggaggugccuuguaaucccuuucuuaaauacaaggaggaacauggguauauccgcaaauacuccaagaagggaaacggccccgaaauuaaaagccugaaguauuacgauucuaaacucgggaaccacaucgacauuacaccuaaggauagcaauaacaaagucgugcugcaguccguuagcccguggagagcggacguguacuucaauaagaccacaggcaaguaugagauccugggacuuaaauacgccgaucuccaauuugaaaagggcaccgggacguauaaaaucucucaggagaaguacaacgacauuaaaaagaaggagggagucgauuccgacagcgaguucaaauuuacacuguauaagaaugaucugcuccuggugaaagacaccgaaaccaaggaacagcaacuuuuccgguuucugucccgcacaaugcccaaacagaagcacuacguugagcucaaaccuuaugauaagcagaaguucgaaggcggggaggcucugaucaaagugcugggaaacgucgccaauucuggccagugcaagaaagggcuuggcaagagcaacauuuccaucuacaaagugagaaccgacguucugggaaaucaacauauuaucaagaacgagggcgacaagcccaaacucgauuucuga

SEQ ID NO: 3953 - RNA, 3366 nt, Artificial Sequence
  Cas9 variant
augaacggccuggugcucgggcuggacaucggaauuggcagcgucgggguuggaauccuuaauaaggauaccggcgagauuauccacgccaacuccagaauuuuccccgcugccacagcggacaauaacguggugcggcgcucuagcagacaggggcggcgccugaaucaucggaaaaagcacagauccguccgccucaaagaucuguuugaauacuaugaccuucugacggauuucucuaaggugagcaucaaccucaauccuuacagacugcggguugacggacugaaccaacagcucaccaaugaggaacuguuuaucgcucuuaaaaacauugugaagcgcagaggcaucuccuaucuggaugacgccucugaggauggcggggccgucagcuccgacuacggaaaggcuguggaagagaaucggaaacuccuggccgagcagacaccgggccagauucaacuugaacgcuucgagaaguaugggcagguuagaggagauuuuaccguggucgaaaacggcgagaaacggcgccugaucaauguguucagcacaucugcuuacaagaaagaggccgaacggauucucagaaagcagcaggaguauaacaaucaaaucauggacgaauuuauugcggauuaccugaccauccugacagggaagagaaaauacuaucauggacccggcaacgagaagucccgcaccgacuacggccgguucagaacggacgggaccacacucgauaacaucuuuggcauucugaucggaaaaugcaccuucuauccugaagaguaccgcgccagcaaggcuucuuauacagcccaggaguuuaaucuucugaacgaccucaauaaccugaccgugcccacggaaacaaagaaacuuuccgaggaacagaaaaagaccauugucgaguacgcuaagagcgccaaaacacugggggcgucuacccuccugaaguauaucgccaaaaugauugaugcuuccguugaccagauccggggauacagaguggaugugaauaacaagccugaaaugcacaccuucgaggucuaccgcaaaaugcaacugcucgagacaauccccgugggcgaauuuagccgggagguucuggacgaacuugcccauauucugacgcucaauaccgagagagaagggaucgaggaggcuauuaacacaaagcugauggauguguucucccaggaccagauccuugaacugguccaauuccgcaagaauaacucuagccucuuuuccaaaggauggcacaauuucagccugaagcugaugauugagcucaucccugaacuguaugagaccucugaggaacagauggccauccuuacacggcugggcaaacagaaguuuaaagagaccuccaagagaacgaaguacauugaugaacaggaggugacagaagagaucuauaacccgguuguggccaaaagcguccgccaagcuauuaagaucauuaaugaggcgaccaaaaaguacggcaucuucgacaacauugugaucgaaauggcccgggagaauaacgaagaggaagcuaaaaaggauuauaucaagagacagaaagccaaccacgacgagaagaaugccgcuauggagaaagccgcguuucaguacaacggggaaaaggagcuccccgacucuauuuuccauggacacaaagaacuggcuaccaagguccggcuguggcaucagcaaggcgagaaaugucuuuauacagggaagaauaucccuauuagcgaucucauccacaaccaguacaaguacgaaauugaccacauccugccccugucccucucuuuugaugacagccuguccaauaaagugcuuguucuggccaccgccaaccaggagaagggacgcagaacaccuuuccaggcucucgauagcauggacgaugccuggucuuaucgggaguuuaaauccuacgugaaggacagcaaaucucugggcaauaagaagaaagauuaucugcuuacggaagaggacaucuccaagauugaagucaaacaaaaguucaucgagagaaaccucguggauacccgcuacagcucccggguugugcugaauacacugcaggacuuuuauaaagcucauaaguucgauaccacaauuucugucgugagagggcaguuuaccagccagcuccgcagaaaguggggccuggagaaaucccgggaaacguaccaccaucacgccguggacgcgcuuaucauugccgcuucuagccaacugcgccucuggaagaaacagaacaauccccugaucuccuauaaggagggacaguucguugacagcgaaaccggcgagaucauuucucugacagaugacgaauacaaagagcuugucuucaaggccccguacgaucauuuuguggacacccucagauccaagaaauucgaggauagcauccuguuuucuuaucaaguggacuccaaguucaaccggaaaauuagcgaugcuacaaucuacgccacccgcaaggcgaaacuggacaaggauaaaucugaagagacguauguccucgggaagauuaaggacaucuacagccaguccggauaugaugccuuuaucaaaauuuacaauaaggacaaaagcaaguuccugauguaucacaaagauccucagacauuugaaaaggugaucgaggaaauucuuagaaccuaccccucuaaggaguucaacgagaaaaauaaggaaguuuccugcaacccuuuugagaaauacaagcaggaaaacggccccauccggaaauauagcaagaaggggaauggacccgagauuaaaucccugaaguacuaugacaaaaacaucccugaaucuuucauuaauaucacaccgagcaacuccaagaauaaagugauccuccgccaacugaaccccuggagaaccgacgucuacuuuaaucaccagaccgagaaguaugagcugcuuggccucaaguacgcugaucugcaguucgagaaaaagacagggacguauucuauuaccaucgacaaauacaacgagauuaaggaaaaagagggcgugagcgagcauuccgaauuuaaguucacacuguacaagaaugaucuccugcuuaucaaagacaccgagauuaaggaagaacagaucuuccgguuucugucucgcacaaugccuaaccaaaaacacuauguugaacucaagcccuacuauaaaggaaauuucgagggcaaggagagaaucaaaguguuuaacaccacgagcaaugggcggugucugaagggacugagaaagaaaggccuuuccauuuacaagaucaaaacagauguccuggggaacaagcauuucauuaaaaaggaaggagagaagccuaaacucaaguuuuga

SEQ ID NO: 3954 - RNA, 3369 nt, Artificial Sequence
  Cas9 variant
augaacggcaagauccuggggcucgacauuggaguggccagcgucggcguugggauccuggauaaaaagaccggagaaauuauccacgcuuccucuagaauuuuccccgccgcgacagcugacagcaauguggaacggcgcggcuuuagacaggggcggcgccuuggaagacggaaaaagcaucgcaaagugagacuggccgaucucuucuccgacacgggccugaucaccgauuuuucuaaggucagcaucaaccuuaauccuuacgagcugcggauuaagggccucaacgaaaaacugacaaaugaggaacuguucaucgcccucaagaacauugugaaacgcagagggaucuccuaucuggacgaugcuaaugaggacggagagucuagcuccagcgaauacggcaaggccguugaggaaaaccggaaacuucuggcugauaagaccccggggcaaauucagcucgagcgcuuugagaaguauggacaggugagaggcgacuucacaaucgaagagaauggggaaaaacaccggcugcuuaacgucuuuucuaccuccgccuacaagaaagaggcggaacgcauucugacaaagcagcaagauuauaaucaggacaucaccgaugaguucauccaggccuaccucacgauucugaccggaaaaagaaaguauuaccauggccccggcaacgagaaaagccggacagacuacgggagauuucgcaccgacggaacaacccuggauaauaucuucggcauucucaucgggaagugcacguuuuauccugaagaguaccgggcugccaaggcuucuuauacagcccaggaguucaaccugcuuaaugaccugaacaaccucaccgugcccacagagaccaaaaagcuguccgaagaacaaaagagacagauuaucgaguacgcgaagggagccaaaacccuuggcgcugccacacugcucaaguauaucgcuaagcugguugaugggagcguggaagacauuaaaggauaccgcaucgauaagucugagaaaccugaaaugcacacguuugacauuuaucggaagaugcagacccuggagacagucgauguggaaaaacucuccagagaggugcuggacgagcuugcccauauccugacccucaauacagaacgcgagggcauugaagaggccaucaaggucagcuucaucaagcgggaguucgaacaggaucaaauugcugagcugguuuccuuuagaaaaucuaacagcucccuuuucggcaagggguggcacaauuuuagcaucaaacugaugaccgaacucauucccgagcuguacgaaacgucugaggagcagaugacaauccugacccgccucggaaagcagaaaaccaaggcgcgguccaagagaacaaaauacauugacgaaaaggagcugaccgaugaaaucuauaacccugugguggccaaaagcguccgccaagcuauuaagaucaucaaucuugccacgaaaaaguacggcguguucgacaacauuguuaucgagauggcccgggaaaauaacgaggaggacgcuaaaaaggauuaugugaagagacagaaagccaaugaagacgagaagaacgcggcuauggaaaaagccgcccaccaguacaaugggaagaaagagcugccggauaacgucuuucauggacacaaggaacucgcuacaaagauucggcuguggcaucagcaaggcgagaaaugucuguauaccgggaagaauauccccauuucugaccuuauccacaaccaguacaaauaugagaucgaucacauucucccucugagccuguccuucgacgauucucucgccaauaaggugcugguucuugcuacagccaaccaggaaaaaggccagcgcacccccuuucaagcgcuggacagcauggaugacgccugguccuacagagaguucaaggcuuacgugcggggagccagagcucucagcaacaagaaaaaggauuaucugcugaaugaagaggacaucaacaaaauugaggucaagcagaaauuuaucgaacgcaaucuuguggauacacgguacucuuccagagucgugcucaacgcccugcaggacuucuauaagcugaaugacuuugauaccaagauuagcguugugcgcggccaguucacgucucaacucagacggaaauggcgcaucgacaaguccagagagaccuaccaucaccaugcggucgaugcccugaucauugcugccagcucccagcuucggcuguggaaaaagcaggggaacccucucaucucuuauaaagaaaaucaguuuguggacagcgagacaggagaaauuaucucccugaccgaugacgaguacaaggagcugguuuuccgcgcucccuaugaucacuucguggacacagucucuagcaaaaaguuugaagaucggauucuuuucuccuaccaaguggacagcaaguacaacagaaaaaucucugaugccaccaucuauuccacgcgcaaggccaaacucggcaaggacaaaagcgaggaaacauacgugcuggggaagauuaaggauaucuauacccagacaggauacgacgcuuuuauuaaacuguauaagaaagacaagucuaaauuccucauguaccauaaggauccgaucaccuuugagaagguuauugaagagauccugaaaaccuauccugacaaggagauuaaugaaaaaggcaaggaggucgcgugcaaccccuucgaaaaauacagacaggagaaugggccucuucggaaguacuccaagaaaggcaagggacccgaaaucaaaagccugaaguauuacgauaacaaacucggcaaucacaucgacauuacacccgauaacucugagaaucaagugauccugcagagccugaagccuuggcgcacggacguguauuuuaaccacaagaccaaaauuuacgagcuuauggggcucaaguauuccgaucugagcuucgaaaaaggaucuggcaaguacagaaucucccuggacaaauauaacgucauuaagaaaaaggagggggugcauaaggaaagcgaguuuaaauucacacucuacaagaaugaucugauccuuaucaaagaccuggagaaguccgaacagcagcucuuucgguacaacucuagaaaugauaccagcaaacacuauguugagcugaagccguacgacaaggccaaauucgaaggaaaccaaccccugauggcucuuuuuggcaauguggccaaagggggccagugucugaaaggacucaacaaggccaauauuuccaucuauaaaguccagacagacgugcugggcaacaagcgcuucauuaagaaagagggggaugcuccuaagcucgaguucuga

SEQ ID NO: 3955 - RNA, 3369 nt, Artificial Sequence
  Cas9 variant
augagcgaccuggugcucggccuggauaucgggauuggauccgucggcguugggauccuuaacaaggugaccggagagauuauccacaaaaauucuagaauuuuccccgccgcucaggccgaaaacaaucuggugcggcgcacaaacagacaaggccggcgccucacgagacggaagaaacaucgcaucgucagacugaaucggcuuuuugaggaaagcgggcugaucaccgacuucacaaagauuuccaucaaccucaauccuuaccagcugcgcgugaaaggacugaccgaugagcucucuaacgaggagcuguuuauugcgcuuaagaauaugguuaagcacagaggcaucagcuaucuggacgaugcuuccgacgauggcaacucuagcgugggggacuacgcccagauugucaaagaaaauuccaagcagcucgaaacaaaaaccccgggacaaauccagcuggagcgguaucagacauacggccagcuucgcggggauuucaccguggaaaaggacggaaagaagcauagacugauuaacguuuuucccacgagcgccuaucggucugaggcucuccgcauccugcaaacccagcaggaguucaauucccagaucacagaugaauuuauuaacagauaccuggagauccucaccggcaagcggaaauauuaccacgggccuggaaaugaaaagagcagaacagacuacggccgcuaucggaccaacggcgagacgcuggauaacauuuucgggauccuuauuggaaaaugcacauuuuaccccgacgaguucagagccgcuaaggccucuuauaccgcgcaagaauuuaaucugcucaacgaccugaauaaccuuacagugccuaccgagaccaaaaagcuguccaaagaacagaagaaucagaucaucaacuacgucaagaaugagaaagugaugggccccgccaaacucuucaaauauauugcuaagcugcugagcugugauguggccgacaucaaagggcaucgcauugauaagucuggaaaggcugaaauccacacauuugaggccuaccggaaaaugaagacgcucgaaacccuggacauugagcaaauggauagagagacacuugacaaacuggcguauguccucacccugaacacagaacgcgagggcauccaggaagcccuugagcacgaguucgcugauggguccuucagccagaagcagguugacgaacuggugcaauuucggaaagccaauuccucuaucuucggaaagggcuggcauaacuuuagcgugaagcucaugauggagcugauuccugaacuguacgagaccuccgaggaacagaugacgauccucacaagacugggcaaacagaagaccaccucuagcuccaauaaaacaaaguacauugaugagaaacuucugaccgaagagaucuauaacccggucguggcuaagagcguucgccaggccauuaagaucgugaaugccgcuauuaaagaauacggggacuucgauaacaucgucaucgagauggcgcgggaaacaaaugaggacgacgagaagaaagccauucaaaagauccagaaagcuaacaaggaugaaaaagacgccgccaugcucaaggcugccaaccaguauaauggaaaggcggagcugccccacucuguguuucauggccacaaacagcuggcuacgaagauuagacuuuggcaccaacagggggaacgcugccucuacaccggaaaaacaaucagcauucaugaucugaucaacaauccuaaccaguucgagguugaccacauccugccccucuccauuaccuuugaugacucucuggccaauaaggugcuugucuaugccacagcuaaccaggaaaaaggccaacggaccccuuaccaggcccuggauagcauggacgaugcuugguccuucagagagcucaaggccuuugugcgggagagcaagacgcugucuaauaaaaagaaagaauaucugcuuaccgaggaagacaucuccaaguucgauguccgcaaaaaguuuauugagagaaaccucguggacacacgguacgcgagcagaguugugcugaaugcccugcaggaacauuuccgcgcucacaagaucgauaccaaagucucugugguucgggggcaauuuacaucccagcucagacgccauuggggcauugagaagaccagagacacguaccaccaccaugccguggacgcucugaucaucgccgcgagcucccagcuuaaccuguggaaaaagcagaaaaauacacucgucucuuauagcgaggaacaacugcuggauauugagaccggagaacuuaucuccgacgaugaguacaaggagucuguguucaaggcccccuaucagcacuucguggacacacucaaaagcaaggaauuugaggauuccauucuguucagcuaccagguugacucuaaauuuaaccggaagaucuccgaugcuaccauuuaugccacccgccaggcuaaagucggcaaggacaaaaaggaugaaacauacgugcuggggaagaucaaagacaucuauacgcaagauggauacgacgccuucaugaagauuuacaaaaaggauaaaagcaaguuucucauguauagacaugacccgcagaccuucgagaaggugaucgaaccuauucuggagaauuaccccaacaaagagaugaaugaaaagggcaaagaggucccuuguaaccccuuucuuaaguauaaagaggaacacggguacauccggaaguauucuaagaaaggaaacggccccgaaauuaagucccugaaauacuaugacagcaagcuccuggggaauccuaucgauauuacaccggagaacucuaaaaauaaggugguucugcagagccuuaagcccuggcgcaccgacguguacuucaacaaaaauacaggcaaguacgagauccucggacugaaauaugccgaucugcaguuugaaaagaaaaccggcacguacaagaucucccaagagaaguauaacgggauuaugaaagaagagggagucgacagcgauucugaguucaaguuuacacucuacaaaaaugaccugcuucuggugaaggauaccgaaaccaaagagcagcaacucuucagauuucugucccggacaaugccuaacguuaaguauuacguggaacugaaacccuauagcaaggacaaguucgagaaaaaugaaucccuuaucgagauucugggcucugcugauaagagcgggcgcugcaucaaaggacucggcaaguccaacauuucuaucuacaaagucagaaccgacgugcuggggaaucagcacaucauuaagaacgagggcgauaagccuaaacucgacuucuga

SEQ ID NO: 3956 - RNA, 3369 nt, Artificial Sequence
  Cas9 variant
augagcaacggcaagauccuggggcucgacauuggaaucgccuccgugggcgucgggguuauugaugcucagaccggagagaucauucacgccucuagcagaaucuuccccuccgcgaaugcugccaacaaugccgaacggcgcacauuuagaggcucucggcgccugaucagacggaaaaagcaucgcauuaaaagacuugacgaucuguucaacgacuuucacaucaaucucgauggggagaugagcacggacaacccuuacgugcugcgggugaagggacuuucccaaaaacugaccgucgaagaacucuauauuucuaucaagaauauuaugaagcgcagaggcaucagcuaccuggaugacgcugaauccgauaacgaggccggccggagcgacuaugcuaaagccauugagcgcaauagacagcugcucacaucuaagaccccgggggaaauccagcuggagcggcuugaaaaauacggacagcugcgcggcaacuucacaaucauugaugaggaggggcaaucccagcagaucauuaauguguuuagcaccucugacuauguuaaggaaguggagaaaauccucgauugccagaagauguaccauaaguucauuuccgacgaauuuugugacaaacugaucgagcuucugagagaaaagcggaaauauuacgucggacccggcaacgaaaagagcagaacagauuacgggaucuaucgcaccgacggaacgacccucgagaaucuguucggcauucugaucggcaaaugcacauuuuacccugaucaauaucggucuuccagagcgagcuacaccgcccaggaguucaacuuucucaaugaccugaacaaccuuacagugcccaccgagacgaagaaacugucccaggaacagaaggaguuccucguuaauuaugcuaaggaaacaucugugcugggggccggaaaaauucuucaacagaucgcuaagcuggccgauuguaaagucgaggacauucgcggcuaccggcucgauaacaaggacaaaccugagcugcacaucuuugaaaccuauagagcgaugaaggggcuggugccccucguggauaucggaguccugagccgcgagcagcuugacauucuggccgauauccucacacugaauaccgacuucgaaggcauucgggaggcucuuaagaaacaacugccuaacguuuucgacgaaaaacaggugaaggggcucgccuccuuuagaaagagcaaaucucagcuguucgcuaagggauggcauaaucugucccagaagaucaugcucgaggugauuccggagcuguacgccaccagcgaugaacaaaugacaauccuuacgcgccugggcaaauuugagaagucuagcgucgccgaauaccccuccucuauuaacguggacgagaucaccgaugagaucuauaauccuguuguggcuaaaagcauucggcagacaaucaagauuaucaacgcguccauuaaaaaguggggcgaguucgaccagaucgucaucgagaugcccagagaucgcaaugaagacgaggaaaagaaacggauugccgaugggcagaaggcuaacgccaaagagaaggccgacagcauccucagagcugccgagcuguacugcgcgggaaaagugcugccugauuauguuuacaauggccacaaccaacuugcuaccaagauucggcucugguaucagcagggggaacgcuguaucuacacaggacagcccauuucuauccacgaccugauccauaaucaaaaccaguaugagauugaucacauccugccgcucucccugaccuuugacgauagccuuucuaauaaagugcugguccucgccacggccaaccaggaaaaggcucagagaacaccuuacaacuaccugaaguccgccaccagcgcuugguccuaucgggaguucaaagacuacgugaccaagagaaaaggcauugggaagaaaaagugcgaauaucugacauuugaggaggacaucaauggcuucgaaguccgcucuaaguuuauucaacggaaccuuguggauaccagauacgccagcaaaguuauccucaaugcgcugcaggacuauuucaagaucuccggcauucagacaaaagugucugucgugcgcggacaauuuacgagccagcugagacauaagugggggaucgagaaaacccgggaaacauaccaccaccaugccguugaugcucucauuaucgccgcuuccagccagcugcgccuuuggaagaagcaggagucuccccugguggucgacuaucaagaaggaagacagguggaucucgagaccggcgagauucuggaacugacagacgagcaguacaaagaacuuguguaccagccucccuaucaaggguucguuaacaccaucuccagcucugccuuugauaaugagauucucuucuccuaccaggucgacagcaaggugaaccggaaaaucucugaugcgacgaucuaugccacccgcaaugcucagcugggaaaggacaaaacagagggcauuuacgugcuggggaagaucaaggauauuuauacccaggccggcuacgaggcuuuccucaaaagauauacaaaggacaaaaccagcuuucugauguaccacaaggaucuugacacgugggagaaagucaucgaaauuauccugcgggacuaccgcgaguaugaugaaaagggaaaagagaucggcaaccccuucgagagauaccggcgcgaaaauggguaugugaagaaguacuccagaaaaggaaacggcacagccauuaagagccucaaauauuacgacaauaagcuggggaaccauaucgauauuaccccugaaaauucucggaacgccguugugcugcaaucccuuaaaccguggagaacagacgucuauuuuaauaaggaaaccggaaaguacgaguuccucggcaucaaauacagcgaucuguccuuugaaaaggggaccggcgaguauggaauuucucaggagaaauacgacagcaucaagaucgcugaaggcguggcgaaaaaguccauuuucaaguuuacacuguauaaacaggaucuccuguucaucaaggacauugagaacaacuuugggaaacuucugcgcuucacgucuaagaaugauaccagcaaacacuacguugaacucaagcccuaugacaagaacaaauuuggaacagaggaaccucugcugcccgugcuuggcaaugucgccaaguccgggcaauguaucaaaggacugaacaagucuaauauuagcaucuacaaagugcggaccgauauucucggcuauagacauuucaucaagcaggagggggagcacccucagcugaaguuuaaaaaguga

SEQ ID NO: 3957 - RNA, 3369 nt, Artificial Sequence
  Cas9 variant
augagcaacggcaagauccuggggcucgacauuggaaucgccuccgugggcgucgggguuauugaugcucagaccggagagaucauucacgccucuagcagaaucuuccccuccgcgaaugcugccaacaaugccgaacggcgcacauuuagaggcucucggcgccugaucagacggaaaaagcaucgcauuaaaagacuugacgaucuguucaacgacuuucacaucaaucucgauggggagaugagcacggacaacccuuacgugcugcgggugaagggacuuucccaaaaacugaccgucgaagaacucuauauuucuaucaagaauauuaugaagcgcagaggcaucagcuaccuggaugacgcugaauccgauaacgaggccggccggagcgacuaugcuaaagccauugagcgcaauagacagcugcucacaucuaagaccccgggggaaauccagcuggagcggcuugaaaaauacggacagcugcgcggcaacuucacaaucauugaugaggaggggcaaucccagcagaucauuaauguguuuagcaccucugacuauguuaaggaaguggagaaaauccucgauugccagaagauguaccauaaguucauuuccgacgaauuuugugacaaacugaucgagcuucugagagaaaagcggaaauauuacgucggacccggcaacgaaaagagcagaacagauuacgggaucuaucgcaccgacggaacgacccucgagaaucuguucggcauucugaucggcaaaugcacauuuuacccugaucaauaucggucuuccagagcgagcuacaccgcccaggaguucaacuuucucaaugaccugaacaaccuuacagugcccaccgagacgaagaaacugucccaggaacagaaggaguuccucguuaauuaugcuaaggaaacaucugugcugggggccggaaaaauucuucaacagaucgcuaagcuggccgauuguaaagucgaggacauucgcggcuaccggcucgauaacaaggacaaaccugagcugcacaccuuugaaacauauagagcgaugaaggggcuggugccccucguggauaucggaguccugagccgcgagcagcuugacauccuggccgauauucucacccugaauaccgacuucgaaggcauccgggaggcucuuaagaaacaacugccuaacguuuucgacgaaaaacaggugaaggggcucgccuccuuuagaaagagcaaaucucagcuguucgcuaagggauggcauaaucugucccagaagauuaugcucgaggugaucccggagcuguacgccacaagcgaugaacaaaugacgauucuuacccgccugggcaaauuugagaagucuagcgucgccgaauaccccuccucuaucaacguggacgagauuacagaugagaucuauaauccuguuguggcuaaaagcauccggcagaccauuaagaucauuaacgcguccaucaaaaaguggggcgaguucgaccagauugucaucgagaugcccagagaucgcaaugaagacgaggaaaagaaacggaucgccgaugggcagaaggcuaacgccaaagagaaggccgacagcauucucagagcugccgagcuguacugcgcgggaaaagugcugccugauuauguuuacaauggccacaaccaacuugcuacaaagauccggcucugguaucagcagggggaacgcuguauuuacaccggacagcccaucucuauucacgaccugauccauaaucaaaaccaguaugagaucgaucacauucugccgcucucccugacguuugacgauagccuuucuaauaaagugcugguccucgccacagccaaccaggaaaaggcucagagaaccccuuacaacuaccugaaguccgccaccagcgcuugguccuaucgggaguucaaagacuacgugacaaagagaaaaggcaucgggaagaaaaagugcgaauaucugaccuuugaggaggacauuaauggcuucgaaguccgcucuaaguuuauccaacggaaccuuguggauacaagauacgccagcaaaguuauucucaaugcgcugcaggacuauuucaagaucuccggaauccagacgaaagugucugucgugcgcggccaauuuaccagccagcugagacauaagugggggauugagaaaacacgggaaaccuaccaccaccaugccguugaugcucucaucauugccgcuuccagccagcugcgccuuuggaagaagcaggagucuccccugguggucgacuaucaagaaggaagacagguggaucucgagacaggcgagauccuggaacugaccgacgagcaguacaaagaacuuguguaccagccucccuaucaaggguucguuaacacgauuuccagcucugccuuugauaaugagauccucuucuccuaccaggucgacagcaaggugaaccggaaaauuucugaugcgaccaucuaugccacacgcaaugcucagcugggaaaggacaaaaccgagggcaucuacgugcuggggaagauuaaggauaucuauacacaggccggcuacgaggcuuuccucaaaagauauaccaaggacaaaacgagcuuucugauguaccacaaggaucuugacacaugggagaaagucauugaaaucauucugcgggacuaccgcgaguaugaugaaaagggaaaagagaucggcaaccccuucgagagauaccggcgcgaaaauggguaugugaagaaguacuccagaaaaggaaacggcaccgccaucaagagccucaaauauuacgacaauaagcuggggaaccauauugauaucacaccugaaaauucucggaacgccguugugcugcaaucccuuaaaccguggagaaccgacgucuauuuuaauaaggaaaccggaaaguacgaguuccucggcauuaaauacagcgaucuguccuuugaaaaggggacaggcgaguauggaaucucucaggagaaauacgacagcauuaagaucgcugaaggcguggcgaaaaaguccaucuucaaguuuacgcuguauaaacaggaucuccuguucauuaaggacaucgagaacaacuuugggaaacuucugcgcuucaccucuaagaaugauacaagcaaacacuacguugaacucaagcccuaugacaagaacaaauuuggaaccgaggaaccucugcugcccgugcuuggcaaugucgccaaguccgggcaauguauuaaaggacugaacaagucuaauaucagcauuuacaaagugcggacagauauccucggcuauagacauuucauuaagcaggagggggagcacccucagcugaaguuuaaaaaguga

SEQ ID NO: 3958 - RNA, 3372 nt, Artificial Sequence
  Cas9 variant
auggccaagauccugggccucgaccuggggaccaacagcauuggaugggcucuuaucgaugacgugcagaauaaaauucugggcgucggguccagaaucuuccccaugggaguugagaaccucggcgauggggacggagaaauuucuaagaaugccagccggacaggcacgcgcggcgugagacggcaauuuuuccgcagacggcugcgcaaaaaggugcuucugaaagcgcucuccgagaacaauaugugcccuaugaucaccucugauuuugacaacuggaagaagacaaaacaguucccgagcgaaaagcuggcuuccugguuugcccugaaucccuacgagcucagaaacaaagcccugucugaaaaacuuacccuggaggagaucgggcggauuuucuaucaccucauccagcgcagaggauuucugagcaauucccggaaaggcgggacagaugacggagcuauuuucaagggcaacccuaaggaagggaaaaucggaauuaccgauacacaggagagcauccaagacaagacccuuggcucuuaccuguuugaaauuuaucccaaagagaaucagccuuuccagaacggccucgagcgcaucagaaaucgguacacgguccgcaagauguauguggaugaauuugagaugaucugggaaaaacaggcccaauacuauuccaaccugaaugaggaccugaagacccucuucgggggaagaaaacuggauggcuacaaggaagacgggauucuuuuucaucagcggccccugagaagccagaagcaccucguuggaaacuguguguucgagccuaacaaaacaaagugcccgaucucugcuauucccuucgagcaguuucgcgucuggcaaugggugaauaccguugaauacaacggcaaaaagaucucccagguggagaaagaaaagauugucgaguuccuguaugccaaugacaagacagauuuuaaaaagauccggaaagcgaucgggaaggaaagcaccgaguucaaauuuaacuacaaggacgaugacaagauugugggaacguauacagugucucaucuuuccaauaaaaaguacuucggcaaaaagugguuugaguucagcgaaaaagagcaggaagauaucuggcacauucuguacuuuuucgacuccaagucuaaccucaaggaguaugccaucaaaaauuggaacuuuaccgaggaacaagcugagagcauugccaaguucaaugucaaagauggcuauuccagccugucuagaaaggcuaucuccaacauccugccuuuucucaaacugggguucacauacgacguugccguggugcuuggaggcauuaagaaugucuucgggcaugaaugggagaaacugagcgaugaaaagcgcaacuuucucaucgacaauguggagggaauuguucggucuaagaccaaaggcggguucaucgaugugauuaaggacauccugagaaacgacuacaauauuagcgauaaccagcuucgcaaacuguaucaccacuccgcgaccaucuacgucgccgagcuccuggaaaagcugcccgugggcaaagaggcugacaaggaaauccagucuauucggaacccuaucguuauuacagcccucuuugagcugagaaaacuugugaaugaacugaucgaugacuucggaagcauugaugagaucaaagucgagauggcucgcgaccucaagaucuccaaaagccagcggaacaagauuagacgcgaacaaaaacggcuggagagagaaaaugaucgggugaaggcccgccugcuugaggaaggccagagaaucacgcaugacaacauucuccuguauaagcugugggaggaguguaaaaagaccugccccuacacagggaauccgaucccucucuauaaacuguuuaccggagaaauucagaucgagcacauccaucccuggucucggucccuuaacgauagcuucgccaauaagacacuguguuacgcugacgaaaacagaaagaagggcgauaagaccccuuaugaguuuuacgggaaugacgaaucuaacugguccgcgauuaaagagcgcgcccucaagcuguucagcgauacgaaagaguaccccaaugcuuaucagaaguuuaaacgguucguccaacacaaguuugacgacgauuucuccucuagacagcugaacgacacacgcuacaucagcaaagaagccaagaauuaucuuuccaagauuugcaaaaagguggccguuucucccggacaggcuaccagcaaccucagacagaaauggggcaugaauaacauccugaacgaugagaaugaaaagacccgggaggaccaccgccaucacgccauugaugcgcuggugauggcuuguacaaaaaucuccuacguccaagagcucagcaaguggaacagauauaaucggaacgccgaacugaagaaauuuccucuuccgugggagaccuucuggucugacgccaaucgcgcuguggauaagauccugauuucccauaaaaagguuagcaacgacaucacagggagaacgcacauuucugaaaagaauggcaagaaguacaaaaacgugggagucgccgcucggggccagcuccauaaggagaccguguaugggaaacgcacauucaauggagaagaggccuuucacgugagaaagaccaucgauucccugacaaccgagaaacagcuggaaaagguugucgacgagagcauuaaacuucucaucaagaagcgggugcaggaacugggcggguucgugaaaggagcgauucccgccaacacguuuuucgucguggaugagaauggcaucaagcaaccucagaucuuucugcccaacaaaaauggggcuccuguucccgugcucaagguccgcaugaaggaaaacauuggcggagccgagaaacugaaggagaaugugaaccaguggguuaacccgagaaauaaccaccaugugcuuaucuacaaagacgaaaagggcaaucugaaagaggaagucgugaccuucuggacaguuguggagcggaagagaaccgggcaaucugcuuaccagcucccuuuugauggaaaagaaauugucacaacccugcacaucaacgacauguuccugcuuggccucaaugaggaggaaauuaacugggagaaucccgacuaugaagugcugaaggagcaucuguaccgcgugcagaaguuuacgagcggggauuauuacuuccggaucgccaaaacauccagcauccagaacgcgauugagaagcaacagaucaauucuuuuggauucggcaaaaacgggugguccacccacaauccuauuaaggucaaaaucagcguuuccggcaagauuucuaagguguga

SEQ ID NO: 3959 - RNA, 3372 nt, Artificial Sequence
  Cas9 variant
augaacggccuggugcucgggcuggacaucggaauuggcagcgucgggguuggaauccuuaauaaggauaccggcgagauuauccacacaaacuccagaauuuuccccgccgcuacggccgacaauaacguggaacggcgcaauucuagacaggcgcggcgccugaacagacggaaaaagcaucgcggggcuagacuccacgaucuguuugaggacuacgaucuucugaucgacuucagcaaaguguccaucaaucucaacccuuaucggcugcgcguccaaggacuggauaauccgcucaccacagaagaacuguuuauugcccuuaagaacaucgugaaaagacggggcauuucuuaccuggacgaugccagcgaaaauggcggggcuguuuccucugacuauggaaaggccguggaggagaaccgcaagcuccuggcugaacagacccccggccagauccagcuugagagauucgaaaaauacgggcaaguccggggagauuuuacaguggaggagaagggcgacaaacaucgccugauuaauguuuucagcaccuccgccuauagaaaggaagcggagcggauccucagaaaacagcaggaauuuaacaaucagauuacagauaaguucaucgaggacuaccugaagauccugaccgaaaaacgcaaguauuaccacgggccuggaaacgagaaaagccggacggacuacggcagauuucgcaccgauggcacaacccucgacaacauuuucgggauccugauuggaaagugcacauuuuaucccaaugaguaccgggccucuaaagccuccuauaccgcucaagaguucaaccuucugaaugaucucaacaaucugacggugccuacagagaccaagaaacuuagcgaagaacagaagaagacaaucgucgaauacgcuaaaucugccaagacccugggcgcguccacccuccugaaauauauugccaagaugaucgacgcuagcguggaucagaucagaggguaccgcguggacgucaacaauaaacccgagaugcauacauuugagguuuaucggaagaugcagucucuggaaacgauuccugugggagaguucuccagagaagugcucgaugagcuggcccacauccuuacccugaacacagaacgcgagggcauugaggaagcuaucaauaccaagcucauggacgucuucagccaagaucagauucuggagcuugugcaguuucggaaaaacaauuccucucuguucagcaagggguggcacaacuuuucccucaaacugaugauggaacugaucccggagcucuacgagacaagcgaggagcaaauggccauccugaccagacuuggaaagcagaaauucaaggaaacgucuaagcgcacaaaauacauugacgagaaggaaguuaccgaggagaucuauaaucccguggucgccaaauccgugcggcaggcuauuaagaucauuaacgaagcgaccaaaaaguacggcaucuuugauaauauuguuaucgagauggccagagaaaacaacgaggaagacgcuaagaaagacuauaucaagcggcagaaagccaaucaugaugagaagaacgccgcuauggagaaagccgcguuccaauacaauggcaagaaagaacugccugacagcauuuuucacgggcauaaggagcucgcuacaaagauccgccuguggcaccagcagggagaaaaaugucuguauaccggcaagaacauucccaucucugaucuuauucacaaucaguacaaauaugagaucgaccauauccucccucugagccuguccuucgaugacucucucagcaacaaggugcugguccuugccacagccaaucaagaaaaagggcagagaacgcccuuucaggcucuggauuccauggacgaugccuggagcuaccgggaguucaagucuuacgugaaggacuccaaacuccugggaaacaagaaaaaggauuaucugcuuaccgaggaagacauuagcaaaaucgaggucaagcagaaguuuauugaaagaaaucucguggauacacgcuacucuucccggguugugcugaacacccugcaagacuucuauaaagcucacaaguuugacacaaccaucagcgucgugagaggccaguucacgucccagcuccgcagaaaaugggggcuggagaagucucgggagaccuaccaucaccaugccguugaugcgcuuauuaucgccgcuagcucccagcugcgccucuggaaaaagcaagccaauccgcugaucucuuauaaggaagaccaguucguggauagcgagacaggcgaaauuaucucccugaccgacgauaaauacaaggagcuugucuuuaaagcuccuuaugcccacuucguggacacacucagcucuaagaaauuugaagauuccauucuguucagcuaccagguggacucuaaguacaacagaaaaaucuccgaugcgaccauuuaugccacgcggaagguuaagcuggacaaagauaagagcgaggagacauacguccucggaaaaaucaaggacaucuauucucaagcuggcuacgaugccuuuauuaaaaucuauaauaaggacaagagcaaauuccugauguaccacaaggacccccagaccuuugaaaaagugauugaggaaauccuucgcacauauccuuccaaggaguucaacgagaaaaauaaggaagugcccugcaaccccuuugagaaguacagacaggaaaacgggccuauucggaaauacagcaagaaaggaaauggcccggagaucaagucucugaaauauuacgauaagaacauucccgaauccuucaucaauaucaccccuagcaacuccaagaauaaagucauucuccgccagcugaaccccuggagaaccgacguguauuuuaaucaucaaacagagaaguacgaacugcuugggcucaaauaugcugaucugcaguucgagaagaaaacgggaaccuacucuaucacaauugacaaguauaacgagaucaaggaaaaagagggcguuggggaacagagcgaguuuaaguucacccuguacaaaaaugaucuccugcuuauuaaggacaccaaaaacaaugagaagcagaucuuccgguuucugucccgcacaaugccuaacgugaaacacuacgucgaacucaagcccuaugauaaggccaaauucgacggcaaucaaccgcugaucacgauuuuuggaaacguggccaagggcgggcagugucugaaaggacuuaauaagucuaacaucagcauuuucaaaguuaagacagaugugcugggcaacaagcauuuuaucaccaaagagggggaaaagccuaaacucaaguucuga

SEQ ID NO: 3960 - RNA, 3378 nt, Artificial Sequence
  Cas9 variant
augaacggccuggugcucgggcuggacaucggaauugccagcgucggcguugggauccuuaauaaggagaccggagaaauuauccacgugaacuccagaauuuuccccgcugccacagcggauucuaauguggagcggcgcggcuuuagacaggggcggcgccugggaagacggaaaaagcaucgcagcgcuagacucaacgaccuguucgaagaguuuggcuucaucacggauuuuuccgccgucccucuuaaucugaacccguacgcccuccgggugaaaggccugucugaagaacugaccaaugaggaacucuucaucgcucugaagaacauuaucaaacgcagagggauuagcuaucuugacgaugccuccgaggacggagaaacagcuucuaaugaguacggcaaggccguugaggaaaaccggaagcugcucgcggauaaaacccccgggcaaauccagcuggagcgcuuugaaaaguauggacaggugagaggcgacuucacagucguggagaauggggaaaaccaccggcuuauuaauguuuuuagcaccuccgccuacaaaaaggaggcugagcgcauccugagacggcagcaagaguucaacgugagaauuagcgaugaguuuaucgaagccuaucucacaauccugaccggaaaacgcaaguacuaucauggcccuggcaaugagaagucucggacggacuacgggagauuccgcaccgauggaacaacccuggacaacauuuuuggcauccucauugggaaaugcacauucuaccccgaugaauaucgggcugccaaggcguccuacaccgcccaggaguucaaccugcuuaaugaccugaacaaucucacggucccuacagagaccaaaaagcugagacccgaacagaaacgccagaucguggaguaugcucggacagccaagacccuuggaaccccuacacugcucaaauacauugcuaagcugguggacggcagcaucgaugacaucaagggguauagaauugauaaaucugacaagccggaaaugcacacguuugaugccuaccgcaaaaugcggacccuggagcucgucgacguugauauccuguccagagaaacacuugacgaucuggccuauauucucacccugaacacagagagcgagggaauccuugaagcucucaauucuaagaugcccggcaccuucacgaaagagcaaauugacgaacugauccaguuucgcaagaagaacuccgcgguguucggcaaaggguggcauaauuuuagccugaagcugaugaacgagcucaucccugagcuguacgaaacauccgaggaacagaugaccauucuuacccggcugggaaaacagagaucucgggagaucagcaagcgcacaaaauacauugaugaaaaggagcucaccgacgagaucuauaaucccguggucgccaaguccgugagacaagcuauuaaaaucauuaaccuggccacaaagaaauacggcaucuucgacaauaucguuauugaaauggcccgggagagcaacgaagaugacgagaagaaagcuauccagaaugugcagaaggccaacgaagaugagaagaaagcggcuauggagaaggccgccgaccuguauaaugggaaaaaggaacuuccugauucuauuuuucacggacacaaagagcucgcuacgaagaucagacuguggcaucaacagggcgaacgcugucuguacaccgggaaaaacauuuccauccacgaccucauccauaacccccaccaguaugagauugaucacauccugccgcuuagccugucuuucgacgauggccucgccaauaagguccuggugcuggcuacagccaaccaggaaaagggacaacggaccccuuuucaggcgcuugacagcauggaugacgccugguccuacauugaguucaaacaguauguuagaaauucuaagagccucuccaacaaaaagaaagauuaccugcugacagaggaagacaucagcaagauugaggugaagcagaaauuuaucgaacgcaaucucgucgacaccagauacucuucccgggugguccugaacacgcuucaagaguucuauaagaccaaugauuuugacacaaaaaucagcgugguucgcggccaguucaccucucagcugagacggaaguggaaaauugagaagucccgcgauacauaccaucaccaugcuguggacgcccucaucauugcugccagcucccagcugagacuguggaagaaacaaaacaauccccuuaucucuuaucgggaagggcagcucgucgauccugagaccggagaaauucugagccugacggacgaugaguacaaggaacucgugcugcgcccucccuaugacuacuucguugauacacuuaaauccaagucuuuugaggacagcauccuguucuccuaucagguggauagcaaauacaacagaaagaucucugacgcgaccauuuacggcacacggaaggcccagcucgggaaagauaagcaagaggaaaccuauguccugggaaaaaucaaggacauuuacucccagaaaggcuaugaggacuuuaucaagcgcuacaaaaaggauaccacacaguuccugauguaucacaaggacccccaaacguuugcuaaagugauugaagagauccuuaagaccuacccggauaaagaacucaaugagaaggggaaagagauucccugcaacccuuucgaaaaguauagacaggagaauggccccauccggaaguacagcaaaaagggaaaaggcccugaaaucaagucucugaaauacuaugacaacaagcuggggaaucauauugauaucacacccgugaacucccagaaccagguuguccuccaaagccugaagccguggagaaccgacguguacuuuaauccucagacaucuaaauaugagcuuaugggacugaaguacagcgaucuccgcuucgaaaaaggcuccgggagcuauggaauuucucccgagaaguacaacaaagugaaggccaaggagggcgucgacgaagauuccgaguuuaaauucacccuguauaagaaugaccugauccuuauuaaagauacggaaacaggggagcagcagcuguuucgguacggcagcagaaacgacaccuccaagcacuacguggagcucaaaccuuaugaaaaggcuaaguucgagggaaaucaacagcugaugaaccuccugggcaccguugccaaagggggacagugucuuaagggcaucaauaaacccaaccugucuaucuacaaggugaaaacagacguccucgggaauaaguauuuuauuaaaaaggaaggagaucagccucaacugaacuucaagaaaaagaucuga

SEQ ID NO: 3961 - RNA, 3378 nt, Artificial Sequence
  Cas9 variant
augaccagcaagcaggagaaccugggcgcccucacauucgggcuggacaucggaauugcuuccgugggcugggccguccuuggggaaaauagaaucauugaucugggaguucggugcuuugacaaagcggagacggcuaaggaaggcgagucucucaaccuggcccgcagaauggcccggcuucugcgcagacggcuccgcagacgggcuuggcgccugaccaaacuggccagacuccugaagcgggaagggcuuaucgcugaugccaaucuguucaaaaacaagauugagaagaauacacccgugccuaaaagcuccuggcaacuccgcguggacgcgcuggauagaaagcugaacgccgaggaaugggcucgggucaucuaccaccuguguaaacaucgcggauuucacuggaucucuagagccgaggaaaaggcugccgagagcgacuccaaaggcgagucuggcaaggugaagcaggggcucgcgggaaccaaaaagcugaugcaggaaaagaauuaucggacagccgcugagaugguucuggccgaguucccggaagcucagagaaacaagcaaggcgauuacagcaaagcccucucccgcauucugcuuggggacgaacugaagacccucuuugagcaucagcggaaacuggauagccccuucgccacagagaaacuugaagcugcgauccugggaaauggcgacagaaagucugggcucuuuugggcccagaacccugcucuggccggauccgaucugcucaaaaugcugggcuauugcaccuucgagaagacggaauaccgcgcccccaaagcuagcuuuaccgccgagcggcacguguggcuuacaagacugaauaaccuccgcauugucguggacggcaccacacggccucugaaugaagcggagagacgcaucgcccuucugaugcccuaucagcaagccggggauuucaccuacaagcagcuccggacggcccugacaaaagcuggauuucugccugagucuuucagauauaccggccucuccuacgccagcgggcagaaggcuggagaaaagacaaaagacccggagucugccgcgcugguuaaguuucccgccuggcaggaacuucgcaaaacccuggagaagaaagaacucgcuuccgaguggcaaaagauuagcaccgacgcccuggauggcaagccucagcugcuugaccagaucgcuugggugcucuccgucuacaaagaugacgaugaggugaaggccgaacugucuaaacugaaccuccccaaugcggagaagaugauugacgcccugcuugauauccgguucgacaaauucagcaaccugucccucaaggcucuguguaagaucgugccucugauggaacaagggcagagauaugaugaggccauugcuaacauccccgaguacggacaucacagccagcuucacaaagucggcgccggcgaacauaaguaucucccgccuuuuuacaaagagcgggacaagacagggcgcaugguuuucaaugaugacauggacauucccagaaacccuguggugcugcgggcccugaaucaggcuagaaaagucgugaacgcgcucaucaagaaauaugauucuccccacgaaguucauauugagauggcccgcgaccugucccggccccuugaugaaagacgcgagguggagaagcugcaaaaggaauuuagagacaauaacgagaaaggaaaggcucaguucgcccaggauuuuaauaucgucggcgccgugaaagggaaggaguucgaaaaauaccagcucuaucgggaacaacagggaaagugcgcuuacagcaucgagccuauggacauucaccgccuguuugagcagggcuacguugaaaucgaucacgcccugccguauucucggagcuucgacgauuccaagaacaauagagugcuuguccucgcgaaagagaaccgcgacaaggggaauagaacgcccuuugaauaccugggcggaaaagauaacucugagccuuggcggcaguucguggcuuuugucgaaggcaauaaggccuaucgccuggccaaaagaagccggcuccugcgcaaggacuucggggauaaggaggcuaaagaguuuagagaacggaaccuuaaugacaccagauacauuuguaaguucuucaaaaacuauguggagcaauaccugcagcuccaugaagacuccgaggccaagcgcugcguugugcugagcggacagaugacaucuuuucugcgggcgagauggggccuugucaaagugcgcggggauuccgaccggcaccaugcucucgaugccgccguuguggcugccuguagccacggaauggucaagagacugucugacuauucccgccggaaggagcuggaacaggugagagagggcuucguggauguugacaccggggaaaucgucaaccccgcuauguuucaacaggugcaggagcauuucccuaaucccuggccgcacuuucgcgaugaagugaaacuccggcugagcauggacgauccugcccuucugagauccgagauggagaaguucggcacauacacccccgaagcgcuccaagcccugcacccucuguuugucucucgggcuccccagcgcagaaacagcggagccgcucauaaagacacgauuuacgcccagccuaagcggcuuguggcccagggcgggguuacacaaaaaguggcucugaccucccucacccugaaggaucucgacaaacugaucgauccccaccgcaaugacaaacuuuauacagcgaucagagcccggcuggagcagcauggaggcaagggggacaaggcuuucccgucuagcaacccucucagaaagcccgauuccgaaggaaaucccaccggcccuauuguccgcggggugacaaugguuaucgacaaacugagcggcauuccgauccggggaggcauugccaagaacgauucuauggugagagucgacguguuuacgaaagccaauaaguuccaccugguucccguguacguccaccauaccguggcuaaggcccuuccuaaccgcgcgguggucgcuuuuaaagaugaggacgaauggacacugaucgaugacuccuucgauuuuugcuucagccuccaccccaaugaccugguucaggugcagcaaaaggggaaagccggaaugauuggcuauuacucuuccugucaucgggggaccggaaacaucaaucucugggcccacgauagaaaccuucaggugggcaaggacgggaugaucgagggcauuggagucaaaacagcucuuagccuggagaaguucaauguggacguucucggcaaccgcuauccugcucccccugaaaagcggagagaucuggcguga

SEQ ID NO: 3962 - RNA, 3378 nt, Artificial Sequence
  Cas9 variant
augaccgacagaaucagccugggccucgauauugggguggccuccgucggauucucuguucuggacaucgauaagggcaaagugauugagcuuggggcucggcuguuuaacgccacaguggcggcuggaaaucaggaccgcagagauaugcggggcagccgcagacuccugaaccggaauaagcaacgcagaaaagacgucuccaagcuguuccaggaauacgggcugcucgauaacuuugaccgggauaauuuccacacggccuuuaacaauaacuggaaucccuaugagcugcgcgugaaaggacugaccaagcagcucaacaaggaagaacuggccgacucucuuuaccagaucauuaaaagacggggcaucagcuaugcucugaaggaugccgacgcuaaugaagauggcacagacuacuccucuagccucaaaaucaacucccaagagcugauugagaagaccccugcccagauccagcuucagcgccugaaugacuaugggaaaguuagaggaaaggugauugucggcgaugacaucgaugaccaaaaggugcuccugaacguuuucccgacaaaugcguacgaaaaagaggcccggcagauuaucgcuacccagcagcaauuuuaucccgaaauucugacaggggaguucgugaaggaguacugccagauccucacccgcaaaagagauuacuuugucggaccuggcaacgaaaagagccggacggacuaugggaucuacaaaaccgauggaagaacacuggacaaccuuuucgaggaacugauuggccaugauaagaucuaucccgacgagcuccgcgccucugcugccuccuacaccgcgcagcuguuuaaugugcuuaacgaucugaauaaccuccggauucugagcuaugaagacggcaaacugacacaaaucgacaaggagaagauuaucgccgagaucaaaaauaacaccacgguggucaauaugcucaacguuauuaagaaagugacagggugucagaaggaugacaucaaaggauucagacugaaugaaaaggauaagccugagauuucuuccaugcccaucuaccgcaaagcucacaaggacuuucuuaaagugggcauugauaucaccgacuggccuaucgauuucauugaccggcugagcuucauccucacacugaacaccgaaaauggggagauuagaaagcagaucaacaaacgccuugucccggauuuugacuuccugaaugaugaccucgugcagcugauuaucgauaacaaggacucuuuugacauuaagaccaauaacaaauggcaucgguucucccugaagacaaugaacaaacucauccccacgaugaucgaaagaccuguugagcaaaugacccugcuuacagagaugggacugauuaagaaagauaccaagcgcuuugaaggcaauaaguaucuccccuacaaagagaucgccaacgacauuuucaauccuguggcuagcaaguccguccgggaagcccugaaaaucgugaacgccguucugaagaaauacgggcacauugaguauaucgugaucgaaaugcccagagauaagaaucuugacgaggagcgcaaacagauugcugauuuucagaagaagaacaaaaagaucaaagacgcggccuucaaugcuuuugucaaggccgugggaucuaaaaagaacgucaagauugcccucagcaaaaaucggaagcugcagaugggcaucagacuguggcaucaacagcagggcauugauccguacaacggggaagagaucaaugcuaacgaccucaucuccaauccugauaaauucgaaauugaccacaucauuccccagagcaucucuuuugaugacggaauuaacaauaagacacugugcuucgccuccaugaaccaagugaaaggccagaagaccccuuaugaguuucuuaacgaggggcacggacagggcuacgcgaaguucaaagcuaucguuagcaagaauaaaaacuucucuaaggccaaacgggauaauuaucuguuugaagagaacgugagcaauaucgaaacgcgcaagagauuccucucccggaaccuggucgacacaagauacucuagccgcgugguucuuaauucccuucaggaguuuuuccaugaaaagagcgacgauaccaaagugaccgucauucgggggaaguuuacaucuaacaugagaaaacacuggcauaucgacaagacccgcgauacauuccaccaccaugccauugacgcuuccaucauugccgcuacgcccuuucucagaauguggaaaaagggcagcaccaucuuccccacaaaaauuaaugagaccucuaucgauaucgagacaggagaaauucuggacgauaagaacuuugacaaggugauguaugaggaaccuuacuccggcuucaucagcgagauuaugaaugccgaugaccggaucaaauuuucccaccaaguggauaagaaaaugaaccgcaagguuucugacgcgaccauuuacagcacgagaaucgggaaacuguccaaggacaagaaagaugccgaauaugucguggcuaaggugaaagacaucuacucugucgauggauaugagaauuucaagaaaguguacaagaaggacaaaaccaaguuucuccuguauaaauacgauccgcggacauucagcgagcuugaaaagauuguuaucgacuaucccgauaaaauugagaaggugcagaccaacggcaagaucaaagccgucgacauuuccccuuucgaacuguaccgcagagauaaugggauggugcggaaguacagcaaaaagacaggacccgcuaucaaacagcucaaguaucuggacaagaaacugggcucucauaucgauauuaccccuaagaacgccaacaauaaacacguugugcuucaaucccucaagcccuggcgcacggacgucuaccugaaccaugagacaggggaauaugagaucaugggcauuaaauacagcgaucugaaguuuaauaaaaacgagggauauggcaucaagaaggacaaauaccucaagauuaaaaauaucgaaggggugucugagaacuccgaguucauguuuagccuguauagaaaggaccggauuaaaguucaggauauggagaccaaugagucuguggaacuucuguucuggagccgcaacuuuuccaauaagaaguacgcggagcucaaaccgaucagccagaucgacaacgauaagguccugccuauuuacggaagaggccggcugaucaaaagacuuauucccaagaauuguaaaaucuggaaggugaacacaucuauucucggggacaccuauuaccuggaaaaggaguccaauuauccucagaaaauccuggauuga

SEQ ID NO: 3963 - RNA, 3381 nt, Artificial Sequence
  Cas9 variant
augaacggccuggugcucgggcuggacaucggaauugccagcgucggcguugggauccuuaauaaggagaccggagaaauuauccacgcuaacuccagaauuuuccccgccgcgacagcugauucuaauguggagcggcgcggcuuuagacaggggcggcgccugggaagacggaaaaagcaucgcagcgccagacucaacaaucuguucgaagaguuuggcuucaucacggacuuuuccgccaucccucuuaaccugaauccguacgcucuccgggugaaaggccugucugaagaacugaccaacgaggaacucuucauugcccugaagaauaucauuaaacgcagagggaucagcuaucuugaugacgcuuccgaggauggagaaacagccucuaacgaguacggcaaggcggucgaggaaaaucggaagcugcucgccgacaaaacccccgggcaaauucagcuggagcgcuuugaaaaguauggacaggugagaggcgauuucacaguuguggagaacggggaaaaucaccggcuuaucaacgucuuuagcaccuccgcuuacaaaaaggaggccgagcgcauucugagacggcagcaagaguucaaugugagaaucagcgacgaguuuaucgaggcuuaucucacaauucugaccggaaaacgcaaguacuaucauggcccuggcaacgagaagucucggacggauuacgggagauuccgcaccgacggaacaacccuggauaacaucuuuggcauucucaucgggaaaugcacauucuaccccgacgaauaucgggccgcgaaggccuccuacaccgcucaggaguucaaucugcuuaacgaucugaauaaccucacgguuccuacagagaccaaaaagcugagccccgaacagaaaagacagauuguggaguaugcccgcacagcuaagacccuuggaaccccuacacugcucaaauacaucgccaagcuggucgacggcucuaucgacgauauuaagggguaucggaucgacaaauccgauaagccggaaaugaugcacacguuugacgccuacagaaaaaugcgcacccuggaucucgugaauauugacgcucugagccgggagacacuugaugaccuggcgcauauccucacccugaacacagaaucugagggcauucuugaggcccucaauuccaagaugcccagcaccuucacgaaagaacaaaucgaugagcugauccaguuuagaaagaagaacuccgcuguguucggaaaaggcuggcacaauuuuucucugaagcugaugaacgaacucauuagcgagcuguaugagacauccgaagaacagaugaccauccuuacccgccuggggaaacagcggagcagagaaauuucuaagcggacaaaauacaucgacgagaaggaacucaccgaggagauuuacaauccugucguugccaaguccgugcgccaagccaucaaaauuaucaacgaagcuacaaagagauauggaaucuucgauaauauugugaucgagauggcccgggaaaacaaugaggaagacgcgaaaaaggacuacauuaaaagacagaaggcuaaccaggaugagaagaacgccagcauggagaaagccgcuuuucaauauaauggcaagaaagaacugcccgacucuaucuuccacgggcauaaggagcuggccacgaaaauucgccuuuggcaccagcagggagaacggugucucuacaccggcaagaacaucagcaucagagaucugauucauaauccucaccaguaugagaucgaccacauucugccccucucccugucuuuugaugacgggcuugcuaacaaaguccuggugcucgccacagcgaaucaagaaaagggccagcgcaccccguuccaggccaucgauagcauggacgaugcuugguccuacagagaguuuaagcaguauguucggaacagcaaaucucuguccaauaagaaaaaggacuaccugcuuacagaggaagauauuagcaaaaucgaggugaagcaaaaguucaucgaacgcaaccucgucgacaccagauacucuucccgggugguucugaauacgcugcaggaguuuuauaaaaccaacgauuucgacacaaagauuagcgugguccgcggacaguucaccucccagcucagacggaaauggaagaucgagaaaucucgcgacacauaccaucaccaugccguggaugcucugauuaucgccgcgagcucccaacuuagacuguggaagaagcagaauaacccucucauuucuuauaaagaaggccaguuugucgaccccgagaccggggaaauccugagccugacggaugacgaguacaaggaacuuguguuccggccucccuaugauuacuuuguugacacacucaaauccaagagcuucgaggauucuauccuguuuuccuaucagguggacagcaaauacaaucgcaagauuucugaugccaccaucuacggaacaagaaaggcucaacugggcaaagacaagcaggaggaaaccuauguccucgggaaaauuaaggauaucuacucccagaaaggauaugaggacuucauuaagcgguacaacaaagaugaaacccaauuucugaucuaucacaaggacccccagacauucgagaaggugauugaagagauccuuaaaacguacccugacaaggagcugaaugaaaaaggcaaggagaucccgugcaaccccuuugaaaaauauagacaggagaacgggccuauucgcaaguacagcaagaaaggcaagggacccgaaaucaaaauucucaaguacuaugauaauaaacugggcaaccauaucgacauuaccccuguuaauucucagaaccaagugguccugcagagccuuaagcccuggcggacagauguguacuucaauccgagaaccuccaaguaugagcucauggggcugaaauacagcgaccugcgcuuugagaagggaucuggcuccuaugggaucagcccugaaaaauacaacaaggugaaagccaaggagggaguuaaugaagauuccgaguucaaguuuacacucuauaaaaacgaccugauccuuauuaaggauaccgagacgggcgaacagcagcuguuccgguacgggucuagaaaugacacaagcaaacacuacgucgagcucaagcccuaugaaaaagcuaaguucgagggcaaccaacagcugaugaaucugcuuggaaccguggccaagggcgggcagugucugaaaggaaucaacaagccuaaucucuccauuuacaaagugaagaccgauguccugggcaacaaauauuuuaucaagaaagaaggggaccagccccaacucaauuucaagaagaaauuuuga

SEQ ID NO: 3964 - RNA, 3381 nt, Artificial Sequence
  Cas9 variant
auggccagcaagcacgagaaccugggcgcucucaccuucgggcuggacaucggaauugccuccgugggcugggcgguccuuggggaaaauagaaucauugaucugggaguucggugcuuugacaaagcugagacagccaaggaaggcgagucucucaaccuggcccgcagaacggcucggcuucugcgcagacggcuccgcagacgggccuggcgccugaccaaacuggcuagacuccugaagcgggaagggcuuaucgccgauacaaauguguuccagaaacccuuuaaccugaaggacgcgaaugagaagggacucagcuucuggcagcugcgcguggaugcccuugacagaaaacuguccgcugaggaaugggcccgggucauuuaccaucucuguaagcaccgcggcuuucauuggaucucuagagcugaggaaaaagccgcggagggcgauagcaaguccgaagggggaaaagugaagcagggccuggccgggaccaagaaacugaugcaggaaaagaacuaucggacagcugccgagaugguucucaccgaguucccugaggcucagagaaauaaacaaggagacuacucuaaggcccugagccgcauccuucugggcgaugaaaugacacagcucuuuaaacaccagcgggagcuggggaacccgcaugccaccgagaaacuugaagcugcgauucugggaaauggcgaccacaaauccggccucuucugggcccagaaccccgcucuggccgggaaugaucugcucaagaugcugggacacugcacguuugagaaggccgaauauagagugccuaaagcuagcuucaccgccgagcgccaugucuggcuuacacggcugaacaaucucagaaucgugguugacggcaccacacgcccccugaacgaagcggagcggcaccuugcucugcucaugccuuaccaacaggccggggaucugaccuauaagcagcugagaacggcccucacaaaagcuggauaccugcccgagucuuuucgcuauaccggccuugccuacgcuuccgggcagaaggccgacgaaaaagcgaaggacccugagagcgccccgcuggugaagcuccccgcuuggcaugaacugcggaaaacacuggagaagaaagaacuugccucugaguggcaaaagauuuccagcgaugcucucgacggaaaaccucagcugcuggaucagaucgccuggguccucucuguguacaaggacgauaccgagguggaagcggagcuguguaaacuuaaucugcccaacgccgaaaagaugauugacgcucuccuggauaucagauucgacaaguuuuccaaccugagccuuaaggcccuccgccaaauugucccucugauggagcagggccagcgguaugaugaggcuguugccaauauccccgaauacggccaccacucccagcugcaugaggugggggccggagaacacaaguaucucccgccuuucuacaaagagagagacaagaccggccggaugguguucaacgaugacauggacaucccccgcaauccugucgugcugagagcucuuaaccaagcgcggaagguugugaaugcccugauuaaagaauaugggucuccccaugagguccacaucgagauggcuagagaucucagccgcccccuggacgaacggagagauguggagaagcugcagaaagaauuucgcgacagaaacgagaaggauaaagcccuuuucgcccaggacuuuaauauuguuggagcugugaagggcaaagaguucgaaaaguaccagcucuaucgggagcaacaggggaagugcgccuacuccaucgaaccuauggauauucaucgccuguuugagcagggcuacgucgaaaucgaccacgcgcugccguauagcagaucuuucgaugacuccaaaaacaaucgggugcucguccuggcuaaggagaaccgcgauaaaggaaauagaacacccuuugaauaccuuggcgggaaggacaacagcgagcgguggcgccaguucguggccuuuguugagggaaauaaaucuuauagacuggccaagcggagccgccuccugagaaaggauuucggcaaagacgaagcuaagggguuucgggagagaaaccugaaugacacgcgcuacaucugucgguucuuuaaaaacuauguggaacaauaccuucagcuccacgaggauuccgacgccaagagaugcgucgugcugucuggacagaugaccagcuuccugcgcgcgcgguggggccucguuaaagugagaggggauuccgaccgccaucacgcucuggauggcgccauugucgccgcuuguagccauucuauggugaagcggcuuuccgacuauagcagacgcaaggagcuggaacaggugcgggccggauucguugaugucgacacaggcgagaucgugaacccugcuauguuucaacaggugcaggaacacuuccccaauccuuggccccacuuuagagaugaggucaaacuccggcugaacguggacgauccggcccugcuucauucugaaaugaaucgcuucgggaccuacuccccugaggcgcugaaggcccucagaccccuguuuauuagccgggcuccucaacgcagaaacuccggagccgcucacaaagacacaaucuacgcccagcccgagcggcucguugcccagggcggggugacccagaaggucccucugacgucucuuacacugaaagaucucgacaagcugauugacccccauagaaaugaaaagcuguauagcgcuauccgcauccggcuugagcaacacggaggcaaaggggauaaggcguucccggccuccaacccucugagaaaacccgacucugaaggcaaucccaccggaccuauugugcgcggcguuaccauggugaucgauaagcucagcgggauuccgauccggggaggcauugcuaaaaacgacuccauggucagaguggauguuuuuacaaaggccgggaaauuccaucuggugcccgucuacgugcaccacgccguggcuaagguccucccuaaucgcgccguuguggcguauaaggacgagaccgaauggacacugaucgaugacggauuugauuucugcuuuagcauguaccccaacgaccuucugcggauuaaacucagaaaugcuucucaucugggcuauuacgccuccuguaaccgcagcacgggggccaucaaucuguggucucacgauagaaaccaacaggugggcaaggacggaaugaucgaguccauuggcgucaaaaccgcucuuaauguggagaagcugaacaucgacguucucgggaaccgguauccugcgcccccugaaaaacgcagagaucuggccuga

SEQ ID NO: 3965 - RNA, 3384 nt, Artificial Sequence
  Cas9 variant
augagcgaccuggugcucggccuggauaucgggauuggauccgucggcguugggauccuuaacaaggugaccggagagauuauccacaaaaauucuagaauuuuccccgccgcucaggccgaaaacaauguggagcggcgcaucaacagacaaggccggcgccugacaagacggaagaaacaucgcagaguccggcucaaucaccuguuugaagagagcgggcuuaucacggacuucaccaacguguccauuaaucugaacccuuaccagcuccgcguuaagggacugacagaugaacugucuaaugaggagcucuuuaucgcgcugaaaaacauggugaagcauagaggcauuagcuaucuugacgaugcuuccgacgauggcaauucuagcgucggggacuacgcccagaucgugaaggaaaacuccaaacagcuggagaccaagacaccgggacaaauucagcucgaacgguaucagaaauacggccagcugcgcggggauuucaccguugaggaggacggaaagaaacacagacuuaucaauguguuucccacaagcgccuaucgggcugaagcccugcgcauucuccaaacccagcaggaguucaacccucagaucacggaugaauuuaucaauucuuaccugcaaauucugaccggcaagagaaaguauuaccaugggcccggaaacgagaaaucccggacagacuacggcagauauaccacaaagaaagauagcgaagacgaguacaucacccucgacaacauuuucggcauccugauugggaagugcacguuuuauccugaggaauaccgcgcugccaaagcgucuuauacagcccaggaguucaaucuucugaacgaucucaauaaccugaccguccccacagaaaccaagaaacuuuccgaggaacagaagaaucaaaucaucaccaacgugaagaaugagaaagcuaugggaccugccaagcuguuuaaauacauugcuaagcuccugagcugugacguggccgauaucaaaggcuaucggauugacaagucugauaaggcggagauccacacauucgaagccuacagaaaaaugaagacgcuggcuaccauugacaucgagcagauggaacgcgagaaccucgauaaacuggccuacguccuuacacugaauaccgaaaaggaggggauccaggaggcucucgaacacgaguuugccgacggaacauucucccaggaacaaauugaugagcugguucaguuccggaaagccaacagcuccaucuuuggcaagggguggcauucuuucagcgugaaacuuaugauggagcugauuccggaacucuaugcuaccuccgaggaacagaugacgauccugacaagacugggaaagcagaagaccaccucuagcuccaauaaaacaaaguacauugacgagaaacaacucaccgaagagaucuauaaccccguggcggccaagagcguccgccaggcuauuaagaucgugaaugccgccaucaaagaguacggcgauuuugacaacauuguuaucgaaauggcucgggagacaaaugaagacgaugagaagaaagccauucagaagauccagaaagcgaacaaggacgaaaaagaugcugccaugcugaaggccgcuaaccaauauaauggcaaggccgagcuuccucacucuguguuccaugggcacaaacagcuggcuacgaagauuagacucuggcaccagcagggagagcgcugccuguacaccggcaaaacaaucagcauccaugaccugauuaacaauuccaaccaauuugaaaucgaucacauucuuccccucucuaucaccuucgacgauagccuggccaauaagguccugguguaugcgacagccaaccaggagaaagggcagcggaccccuuaccaagcucucgacuccauggaugacgccuggagcuuuagagaacugaaggcuuucguucgcgauucuaaggcccuuuccaauaaaaagaaagaguaccugcucacggaagaggacauuagcaaguuugaugugcggaaaaaguucaucgagagaaaccuggucgacacccgguaugcgucucgcgugguccugaaugcccuucaggaacauuuuagagugcacaagacagacaccaaaguuuccgugguccggggacaguucacaagccagcucagacgccauuggggcaucgagaagacccgggauacguaccaccaccaugcuguggacgcccugauuaucgcugccuccucucaacugaaccucuggaaaaagcagaaaaauacacugguuagcuauuccgaagaucagcuucuggacauugagaccggggagcucaucucugaugacgaauacaaggagagcguguuuaaggcccccuaucagcacuucgucgauacacugaaauccaaggaguucgaagacagcauucuguuuucuuaccaaguggauuccaaauucaacagaaagaucagcgacgcuaccaucuaugcgacccgccaggccaaagugggcaaggauaaaaaggacgaaacauacguucuuggaaagauuaaagauaucuacucucagacgggcuaugacgcuuuuauuaagaucuacaaaaaggacaaauccaaguuccucauguauagacaugauccgcagaccuuugagaaggucauugagccuauccuggaaaauuaccccaacaaagagcugaaugaaaaggggaaagaggugccuuguaaccccuuccucaaguauaaagaagaccacggauacauucggaaguauagcaagaaaggcaacgggcccgagaucaagucucugaaauacuacgauagcaaacuuggaaaucacaucgacauuacaccuaagaacuccaauaacaaggugguccugcaaagcgugucuccguggcgcgccgauguuuauuuuaauaagaccacaggcaaauacgagauccucgggcugaaguaugccgaccugaaauucgaaaagggcaccggaacguacaaaauuuccgaggaaaaguauaacgauaucaagauuaaagagggcguggacagcgauuccgaauuuaaguucacacuuuacaaaaaugaccuccugcugaucaaggauaccgagaccaaagagcagcagcucuuuagauuccugucucggacaaugcccaacgucaagcauuauguggaacuuaaaccuuacgacaagcaaaaguuugacgauaaugaggaacugaucaaaauucucgggaucguugcuaagggaggccagugcaaaaagggggugagcaaacccaacauuuccaucuacaagauucgcaccgacguccugggaaaucagcacaucaucaagaacgagggcgauaaaccuaagcuggacuucuga

SEQ ID NO: 3966 - RNA, 3384 nt, Artificial Sequence
  Cas9 variant
augaacggccuggugcucgggcuggacaucggaauugccagcgucggcguugggauccuugagaaggauuccggaaaaauuauccacgcuaauucuagaauuuuccccgccgcgaccgcugacaacaauguggaacggcgcacaagcagacaggcccggcgccugaacagacggaagaaacaucgcuccgugagacuccacgaucuguuugaggaauacggccuucugacggacuucucuaaggucagcaucaaucucaacccuuaucaaauccgggugcaggggcuggauaaacgccugaccaaugaggaacucuuuauugcccugaagaacaucguuaagagacggggaauuuccuaccuugacgaugcuucugaggacggcggcgccgugagcuccgauuaugggaaagcugucgaggaaaaucgcaagcugcucgcccagcagacaccgggacaaauccagcuggacagauucgagaaauacggccaggugcggggagauuuuaccguuguggaaaacggagagaagcgcagacuuauuaaugucuucagcacaucugcguaucggaaagaggccgaaagaauccugcgcaagcagcaagaguuuaacaauaagauuaccgaaggcuucaucgaggacuaccucacaauccugaccgggaaacggaaguauuaccauggacccggcaacgaaaaauccagaacggauuacggccgcuauaccacaaagaaagacagccagggggaguacauuacccuggacaauaucuuugggauucucaucggcaagugcacauucuauccugaugaguaccgggcuucuaaagccuccuauaccgcucaggaauuuaaccugcuuaacgaccugaauaaccucacggugcccacagagaccaagaagcugagcguggaacagaaaaagacaauugucgaguacgccaaaaccgcgaagacccuuggggccucuacacugcucaaauauaucgcuaagcugaucggaguuuccguggaucaaauucacggcuacagaaucgacccuaaugaaaagcccgagaugcauacguucgagguguaccgcaaaaugcagagccuggaaaccauucgggucgaggaacucccuagaaaggugaucgaugagcuggcccacauucuuacacugaacaccgaacgcgaggggaucgaggaagcuaucaaugccaaacucaaggacaucuuuucccaggaucaaguucuggagcuugugcaguuccggaaaaacaauucuagccuguucuccaagggauggcacaacuuuagccucaagcugaugauggaacugauuccggagcucuaugagacaucugaagaacagaugaccauucugacgagacuuggcaaacagaaguccaaagaaacaagcaagcgcaccaaauacaucgacgagaaggaacugaccgaggagauuuauaaucccgucguggccaagucuguucggcaagcuaucaaaauuaucaacgaagcgacaaagagauacggcaucuucgauaauauugugaucgagauggcccgggaaaacaaugaggaagacgcuaaaaaggaguauauuaaacgccagaaggccaaccucgaugagaaaaaugccgcuauggaaaaggccgcguuucaguacaacgggaagaaagagcugccugacaacgucuuccauggacacaaggaacuggcuaccaaaaucagacuuuggcaucagcaaggcgagaagugucucuauacagggaaaaauauucccaucagcgaccugauccagaaccgguacaaguacgaaauugaucacauccugccucucucccugucuuuugacgauagccuuuccaauaaggugcugguccucgccacggccaaccaggagaaaggacagagaacccccuuccaagcucuggacagcauggauuaugccuggucuuaccgcgaguuuaaguccuaugugaaagacagcaagcugcuuucuaauaaaaagaaggauuaccuccugacagaagaggacauuuccaaaaucgaaguuaagcagaaauucauugagcggaaccugguggauaccagauauagcucccgcgucgugcucaaugcucugcaggacuuuuacaaggagcaccaguucgauacaaccaucucuguugugagaggccaauuuacgagccagcuucggcgcaaaugggggaucgaaaaguccagagagaccuaucaucaccaugccgucgacgcgcugauuaucgccgcuucuagccagcuccggcuguggaagaaacacaacaauccgcugauuuccuacaaggaggagcaauucguggauagcgaaacaggcgagaucauuucuauguccgacgacgaguacaaagaacuuguguuuaaggccccuuaugaucauuucguugacacccucaaaagcaagaaauucgaggauucuauccuguuuuccuaccaggucgacagcaaguauaaccgcaagaucucugaugcuacaauuuacgccaccagaaaagcgaagcuggacaaagauaagagcgaagagacguaugugcucggaaaaaucaaggacauuuacucccaggccggcuaugauacauucaucaagauuuacaauaaagacaagagccgguuucugauguaccacaaagauccccagaccuucgaaaaggugaucgaggagauucuucgcacauauccuucuaaagaacugaacgagaagaauaaggaaguccccugcaaccccuuugagaaauacagacaagaaaaugggccuauccggaaguauucccgcaaaggaaacggcccggagaucaagagccucaaauacuaugacaacaagcuggggaaucacauugauaucacccccaacgaguccaugaaucaggugguucugcagucucuuaagccuuggagaaccgacguguucuuuaaccaucagacagaaaaauacgagcucaugggacugaaguauagcgaccugaauuucgaaaaaggcuccgggaaguacucuauuagccucgagaaauacaacuccaucaagaugaaugagggcgucucugaagagagcgaauuuaaguucacgcuguauaaaaacgaucuuauucugaucaaggacgcucucaccaaagaggcccaaaucuuucgguacggauccagaaaugauacaagcaagcacuauguggaacugaaacccuacgacaugucuaaguucgagggcgaugagcgccugauuaaaguucuugggaccguggcuaagggaggccgguguaucaaggggcugaacaaaaaggacauuuccaucuuuaaagucaagacagaugugcucggaaauaaacauuucauuaagaaggaaggcgaggaaccuaaacugaaguucuga

SEQ ID NO: 3967 - RNA, 3387 nt, Artificial Sequence
  Cas9 variant
augaccaagcugggcaaacccuacgggaucggaguggacauuggcagcaacuccaucggguucgccgcugucgaugaaaauucucaccucauuagacugaagggaaaaacaguuaucggcgcccggcuuuuugaagaggggaaggcggcugccaaacgcagagccggacggacgacccgcagacggcugagccgcaacagauggcggcucuccuuccugcgcgacuuuuucgaaucucauauuacaccuaccgauccgaacuuuuucaugagacagaaguauagcgagaucucccccaaggacaaagcucgguacaaguaugaaaaacgccuuuuuaaugauagaacagacgccgaguucuaccaacaguauucuaccauguaccaucugcggaaucgccucaugacagauccuagcagagcugacgugcgggagaucuauuuugccauucaccacauccugaaguccagaggccauuuccugacccccggcgaugcgaaagacuuuaacacgaaugauguggcccucgacgaaauuuucccugcucugcaggaugccuacgcucaggucuaccccgaccuugggaucaccuuugacgaggauaaggccaacgaguucaagacaauucugcucaaugagaucgcgaccagcauugacacacaacgcgcccuggugaaacuucugcucgcugaggaagaugacaaggauauccugaaacagcagaagcagguucugaccgaguucgccaaagcuguggucggacucaagacgaaacugaaccuugcccugggcacagaaguggacucuuccgaggccaccgcuuggaauuuuagccucgggcaacuggaugacaagugggcgggaaucgaaucugccaugacagaugagggcaccgagauucuugaccagauccgggaucuguauagagcucgccuccugaacgggauuguuccuaccggaaagacacugucccaggccaaaguggacgacuacacgcagcaccacgaagaucuccaacuguucaaggccuaucuuaaacagcuggaggacgauggcaccgcuaaggccauccggcagcucuacgacagauauauugauggcgacgaugcggcuccguuucugcgcgaaaauuucgucaaagcccuuacaaaggacgugaccgcccaucccaacacaaagagcccugagcugcucgaacggcuggcucaacccgauuuuaugcugaaacagagaaauaaggccaacggggcuaucccugugcagaugcagcaacgcgagcucgaccagaucauuaaaaaccaggccgucuacuaugauuggcuggcggcccccaauccgguugagaagcaccggaaaucuaugccuuaccagcuugacgaacugcucaacuucagaauccccuacuaugugggaccucuggugaccgcuaaggagcaaaaggccgcucagggcggggucuuugccuggauggugcgcaaagaucccgaaggaaauauuacgcccuacaacuucgacgagaagguugaccgggaagcguccgccaauacauuuauccagagaaugaaaaccaccgauacauaucugauuggcgaggacgugcuuccuaagcagagccuccuguaccaacgguaugagguccugaacgaacucaauaacgugcgcguuaauaacgagaaacuguccaucgaacagaagcaacaggugaucagagagcuuuucgagcggcauaauucugucaccauuaagcaauuugcugaaaaccugagagcccacggggauuacgcucacaucccggagauucgcggacucgccgacgaaaaacgguuccugagcucccugagcacauauagacagcuuaagucucuccugcccgaggccaucgaugacccugcuaaacaggcggauauugaaaauaucauugccugguccacgguguuugaggacgcugccaucuucaagaccaaacugaaggagaucagcuggcucggcucugaagccauuacaaaacugagcaacauccgcuacagaggcugggggcaauucucccggaaguuucuuaauggacugacccucggcaacgggcauacaauuauccaggagcugcugcuuucuaccaacaaucucaugcagauucugacggaugaaacccugcagaagaaaaugacagagcucaacgcugacaagcugaaaaccgccaauaucaacgaugcgaucgacaaugcuuacacaagccccuccaacaagaaagcccuucgccaaguccugagagugguugaugacauuaagcgggccgcugacggacaggauccuagcuggcucuauguggaaaccgccgacggcgggggcacgcccggaaagcgcacaagagcgcggcagcaccagcugcaagagaucuacgcuaaugccgcccaugagcugauugauaccgcuguccgcggcgaacuugaggacaaaaucucugauaaggccgacuucaacgauagacucgugcuguauuuuaugcaagggggacgggacauuuacacaggcgcuccgcugaauaucgaucagcucuccagcuaugacaucgaucacauucugccucagucucuuaucaaagacaacucccuggacaaucgcguucucgugcaugccauuaucaacagagaaaagaaugcgaccuucgccagcaccauuuacgcucagaaaaugaacgccacauggcggcaguggcacgaggcugggcugaucuccggaagaaagcugcgcaaucuucagaugcggcccgaucagaucgacaaguaugccucuggcuuugucgccagacagcugguggaaacgcgccagauuaucaaacucaccgagcagauuguggcugcgcaauacccugauacaaagaucauugccguuaaagcugggcugagccaccagcuccgggaggaacuggaguuccccaagaacagagacgucaaccauuaccaccaugccuuugaugccuuccuugcugcccgcaucggcaccuaucugcucaaacgguuuccuaaucugcaggcguucuuuacauacggaaaguucaccaaggcugacgugaaaaagcugagaggcuuuaacuucauucgcgauaucacgcacgccgaagacaaaaucguggccaaggauacaggggaggucgugugggacaaacagcgggauguugacgagcuugauagaauuuauaauuucaagcggaugcugaucacccacgaagugcgcuuugagaccgcugaccucuucaaacaaacagucuacggagccagagacuccaaggaagcgggcgggucuaagcagcugauucccaaaaagaaagauauccagcucauuuuuaugggagcuaucagcgagcggacccgcccgauccugccucuuuga

SEQ ID NO: 3968 - RNA, 3387 nt, Artificial Sequence
  Cas9 variant
auggacgagaagauggauuacagaaucggccuggacauugggaucgccagcgugggaugggcuguccuccagaacaauuccgaugacgaacccguucggauuguggaucugggcgugcgcaucuucgacaccgccgagauuccuaaaacaggggaaucucuugcgggaccgagacgggcugcccgcacgaccagacggcgccugagacggcgcaagcacagacucgaucggaucaaauggcuguuugagaaccaaggccuuaucaauauugacgauuuccugaagcgcuauaacauggccgggcuccccgacgucuaccagcugagauaugaagcucuggaucggaaacucacagacgaggagcuggcccaggugcuucugcauaucgcuaagcaccgcggauuuagaagcacccggaaggccgaaacagcggccaaagagaauggcgcuguucucaaggccaccgaugaaaaccagaaaagaaugcaagagaagggcuaccgcacagugggggagaugauuuaucuggacgaggcuuuccggaucggaugcuccuggucugagaaaggcuacauucuuaccccuagaaauaaggccgaaaacuaucagcauacgaugcugcgcgcgaugcucgucgaggaagugaaggagaucuuuagcucccagcggagacuggggaauaaaaaggccaccgaggaacuggaggaaaaauaccucgagauuaugacaucucagcgcagcuucgaccugggacccggcaugcaaccugaugggaagcccuccccuuacgcuauggaaggauuuagcgaccggguuggcaaauguaccuuccuuggcgaucagggggagcugagaggagccaagggcacauauaccgcugaguacuuuguggcccuccagaaaaucaaccacacgaagcuggucaaucaggacggggaaacacgcaacuucaccgaggaagaacggagagcccuuacacugcuccuguuuacccaaaaggaagugaaauaugcugcggugcgcaagaaacugggacucccggaggauauccuguucuacaaucuuaacuauaagaaagccgcuaccaaggaggaacagcagaaggagaaucaaaacacagaaaaagccaaguuuauuggcaugcccuacuaucaugacuacaaaaagugccuggaggagcgggucaaauaccucacggaaaacgagguuagagaucuguucgacgaaaucgggaugauucuuaccuguuauaagaaugaugacucucggacagagcgccuggccaagcucggacuggugccuaucgaaauggagggccugcucgcuuacacccccacaaaauuccagcaccuguccaugaaggccaugagaaacauuaucccuuuucuugagaaaggcaugaccuaugauaaggcgugcgaagaggcuggguacgacuucaaagccgacagcaagggaacgaagcagaaacugcucacaggcgaaaaugugaaccagaccaucaaugagauuaccaaccccgucgugaagcggucuguuucccaaacagugaaagucaucaaugccauuaucagaaccuaugggagcccgcaggcuauuaacaucgaacuggcccgcgagaugucuaagacauuugaggaacggagaaaaaucaagggagauauggagaaacgccagaagaauaacgaagacgugaagaaacagauucaagagcugggcaaacuuuccccuacggggcaggauauccucaaguacagacuguggcaggaacagcaaggcauuuguauguauagcggaaagaccaucccccuggaggaacucuucaaaccuggcuacgacauugaucacauccugcccuacuccauuacauuugacgauucuuuccggaauaagguucuugugaccagccaggaaaaccgccagaaggggaauagaacacccuaugaguacaugggaaacgacgaacagcgguggaaugaguuugagacccgcgucaaaacgaccaucagagauuauaagaaacaacagaagcugcucaaaaagcauuucuccgaagaggaacggagcgaguuuaaggaacgcaaccugacagacaccaaauacaucacaaccgugauuuauaacaugaucagacagaaucuggagauggcuccucuuaaccggccggagaagaaaaagcaaguccgcgccgugaauggcgcgauuacggccuaccucagaaaacggugggggcugccccagaagaacagagaaacagauacccaccaugcuauggacgccguugugaucgcuugcuguacagauggaaugauucagaagaucucucgcuauaccaaaguccgggagagaugcuacuccaagggcaccgaguucguggacgccgagacaggggaaaucuuucgcccugaggacuacagccgggcggagugggaugaaauuuucggcguucacauccccaaaccuugggagacguuuagagccgaacuggacgugcgcaugggagaugaccccaagggcuuccucgauacccacucugacgucgcucuggagcuugauuauccggaauacauuuaugagaaucugcggccuaucuucgugagcagaaugcccaaccauaaagugacaggggccgcucacgccgacaccauucgcuccccucggcauuuuaaggaugagggaaucguucucacaaaaaccgcccugacggaccugaaacuugauaaggacggcgaaaucgauggguacuauaauccccagucugaccuccugcuguacgaggcucucaagaagcaacugcuucuguauggaaacgacgcgaaaaaggccuucgcucaggauuuucacaaaccuaaggccgacggcacagaagggcccgucgugagaaaggugaaaauucagaagaaacagaccaugggcgucuucguggauagcggaaauggcaucgccgagaacgggggaaugguucggauugacguguuucgcgucaauggcaaguacuacuucgugccgguuuauaccgcugauguggucaaaaaggugcucccuaacagagccuccacagcgaauaagcccuacagcgaguggcggaccauggaagacaaagauuuucuguucucucuguauucccgcgaccuuguucauaucaagagcaaaaaggggauucccaucaaaaacguggauggaucucucggcgaguccaaggaagucuacgcuuauuacaucggggccgacauuagcggcgccaagaucgagggaaaagcucacgauuccagauauacauuucggggcauuggggugcaaaagcuggaacugaucgagaaaugucagguggacauucucggacacaucucuacggucaagaaugagaaaagaaugggcuucagcuga

SEQ ID NO: 3969 - RNA, 3387 nt, Artificial Sequence
  Cas9 variant
augaacgacaagaaucagaaauacagacugggccucgaucuggggaccaacagcaucggauggugcauuuauucccuugacgugaauaacaagcccgagacacugaucgauaugggcguccggauuuucucugacgggcgcgauccuaaaacgaaggaaccgcucgccguugagagacggaccgcucgcggacugagacggauccuucaccgcagaaaacugcggcgcagacaaauguuucggcuccugcaggaacagggccugaugcccaaugacgccagcgaggcggcugcccucaagucccugaacccuuacgaacuucgcgugaaggcccuggauacaaaacucgagcccuaugagcuggggagagcucuuuucaaucugucugugcggcgcggauuuaagagcaacagaaaagaagccguccaggagaaggaaaaagacucccaaaaugaugcuaagucucagaacgagaagugugagcaucucgccaaagcgauuaaggacagcggcugccggacccugggcgaguuccuguggaaacacaagaauacagagacccagcagacagaaaacgaugccagaaauaucgggaugcgcuuugugccuggacgguccaacuacuaucccaccagacgcauguacguugaggaguucgacgcuauccggaaagcccaagaaccuuauuacagcggcgugaauugggaugcucuccaugagaagcuguuuuaccagagaccgcuucgcgcccaggaacgggggaaauguagauauaugcccgacaaggagcgcacguucaaggcgaugccuugcucucagaaaauucggauccugcaagaagucuacaacauggacuauauugaugaguacggaaagaccaucccccucgaagaggcccagacagacucccugauuagccuucuggauaaaagagagaagcucucuuuuaaagcuaugaagaaggaacugggcaucgacgaguccuguaccuucaaccuggaacgcgggggacgggaguaucuccagggcaaugccgcugccgugaaacugagaaacaagaaacgguuuggcgaacuuugggauagccugucucucgccaagcaagacgcuauuguugagaaacugaucacagcggaugaggacgccgaaaucauuuccaugcuugcucaguacaaucugaccgaugagcagaagaagaacaucgccgugacgguccucccuagcgggacagccaugcugugcaaagaagugaccgagaugcuggugcagaagauggagcaaaauaaaauuccccucacagucgcuguucagaugcugggauauaccuacgccgaccaguccgugcgcgaagaggauacccuuccguacuauggcgcgauccugacagggucuacgaugggagcucacccugaagccgacgagagcgaacccgagcucaaguacggcaaaauuuccaacccuaccgugcaugucgcccugaaucagacaagaaccgugguuaacgcucugaucaaggccuaugggaagccccaacagaucguggucgagcuuagccgggaccucaaggcuucuagagaagccaaagcgcgcauucagaaaacaaucaccaugaaucagaagcggaacgagagagauaauaaaaacauuacggacaucacaaagauucccuacccuaaucgcaacgauagacugaaauaucggcugugggaagaacucggauccggcagcaauucuuucagccgcaagugucuguacugcggcaagccgaucuccgggucugaaaucuuuaccgagaacauugagaucgaacacauucuucccuucggaagaacccuguucgacggcgagacaaacaaaaccguggcccacacagauuguaaucgggacaagggggaucgcagcccuuuugaggcuuucggauccagccccaacggcuauaauuggcaugaaaucugcgccagagcuaacucucucaaaaauccugccaagcggacgcuguuugcggaaaacgccauggagaaauucgagaaggacaauuccuuuauucaacgccagcugaccgauaacgcuuaccuuagcagaucugcccuccgguaccugcgcuguaucugcaaggacguuugguccauuaaugggggcaugacaaaacugcucagagauaaguggaacaucgacagcauccugaaacggaagauugaugaccccgaaaucgcucacuucgagcuuaaaaaugaccagauuggacaguauaagaagaacagauacgaucaucgccaccacgcccuggacgccuccgugaucgcucucauugaucgggcgaugguccaagaaaucucucagcugaauaaaaucagacugaagaaccgcauugaggccccgcagaugccugugcuucggagcgagcucaucgaaaaagucaagcauauuaccguguccuuuaaacccgaccacggcagacaagggaagcugucuaaggagacacugcucggaaaaaucaagaaaauugaaaagguugauaucgacagcauccagaccgaugacauugcuuccaucaaagaugacgccauucgcacgcgguucgagaccaagagacgcgaacugggcgauaucacaaaagccaaggcugcccuuaagaccgaguuuccuaaacuggacguguucaagacauauuacgucagccggacccccauugugucucucacggagaaaaauaucaacuccaucguugaugaaaagauuaaagagaagcugaagacauuuaucaaagaacaugcggaccugagcuucgcugagcagcuucagaaguuuucugaaaccgaguggauugggaaaccuuccgccgccggaaagcccggcaaaaaguauagaaucgagaaggugcggugcauuaacugggggcaaacaccgaucaccauuaccagcucugcugucccucgcuaccucugucccgaagacuaucuggccgcggugguguggcagauccccagcaaaaagaaagauacagagccugaauacaaggcuacguuccugagacgggacgaguucgauguuaauaacaaaccgaagaagcucgaaaaaccccacgacgccgcccaguacaucugcaugcuguauaaggaugacuaccuugaguuuaccgaguccggcgcuacacaucugugucgcauugccggacucccugcuagccagaauaacaaaaucgauauuagacccaucuaugccgucucugacugcaaggauuggauuaucgcgaccaaugaaaacaugcuggagccuuguuggaaaccccaaaaggaagagaagcggaucuccgugaaugugcuguucggcaaacacaaggccagaagcgucacagugaacccuauugggcgcguuuuucggaaauga

SEQ ID NO: 3970 - RNA, 3387 nt, Artificial Sequence
  Cas9 variant
augagcgaccuggugcucggccuggauaucgggauuggauccgucggcguugggauccuuaacaaggugaccggagagauuauccacaaaaauucuagaauuuuccccgccgcucaggccgaaaacaauguggagcggcgcacaaacagacaaggccggcgccugacgagacggaagaaacaucgcagaguccggcucaaucaccuguuugaagagagcgggcuuaucaccgacuucacaaagguguccaucaaccugaauccuuaccagcuccgcguuaaaggacugauugaugaacugucuaacgaggagcucuuuaucgcgcugaagaauauggugaagcauagaggcauuagcuaucuugacgaugcuuccgacgauggcaacucuagcgucggggacuacgcccagaucgugaaagaaaauuccaagcagcuggagaccaaaacaccgggacaaauucagcucgaacgguaucagaaguacggccagcugcgcggggauuucaccguugaggaggacggaaagaagcacagacuuaucaacguguuucccacaagcgccuaucggucugaagcucugcgcauucuccaaacccagaaggaguucaauccucagaucacggaugaauuuaucaacagauaccuggagauucugaccggcaaacggaaguauuaccaugggcccggaaaugaaaaauccagaacagacuacggccgcuauaccacaaagaaagauagcgagaacgaguacaucacccucgacaacauuuucggcauccugauugggaagugcacguuuuauccugaagaguaccgggccgcuaaagccucuuauacagcgcaggaguucaaucuucugaacgaccucaauaaccugaccguccccacagaaaccaagaaacuuuccgaggaacagaaaaaucagaucaucaacuacgugaagaaugagaaagccaugggaccugcuaagcuguuuaaauauauugccaagcuccugagcugugauguggcugacaucaagggcuacagaauugauaaaucugacaaggccgaaauccacaccuucgaggcguaccgcaaaaugaagacacuggaaacgauugauuuugagaaaaugucccgggaccagcucgauaagcuggccuauguccuuacccugaacacagaaagagaggggauccaagaggcucucgaccacgaguucgccgauggaaauuucagccaggaacagaucgacgaacugguucaguuucgcaaggcuaacuccucuauuuucggcaaaggguggcauaauuuuagcgugaaacuuaugauggagcugaucccggagcucuacgccaccuccgaggaacaaaugacaauucugacccggcugggaaaacagaagacgacaucuagcuccaacaaaaccaaguauaucgaugaaaagcuccugaccgaggaaauuuacaaucccguggucgccaaaagcgugagacaggcuaucaagauuguuaacgcggccaucaaagaguauggcgacuucgacaauaucgugauugagauggcucgcgaaacaaacgaggaugacgaaaagaaagccauccagaagauucaaaaagccaacaaggaugagaaggacgcugccaugcuuaaagcggcuaaucaguacaacggccgggccgaacugccucacucugucuuucaugggcacaagcagcucgccaccaaaaucagacuguggcaccagcaaggagagcgcugccuguauacaggcaagacgauuagcauccaugaucuuaucaauaaccccaaucaguucgagauugaccacauccucccucuguccauuaccuuugaugacucucuggcuaacaaagugcucguuuacgccacagcuaaucaggaaaaggggcagcggacccccuaccaagcccuggauagcauggacgaugcgugguccuucagagagcuuaaggccuuugugcgggaaagcaaaucucuguccaacaagaaaaaggaguaucuccugacagaagaggacaucagccgcuucgaugucagaaagaaguuuauugagcggaaucugguggacaccagauacgcuucucgcgucgugcuuaacgcccuccaggaacauuuccgggcucacaagacggacaccaaaguuuccguggucagaggacaguuuacaagccaacugcgcagacauuggggcaucgagaagacccgggauacauaucaccaccaugccguggacgcgcugaucauugccgcuuccucucagcucaaucuguggaaaaagcagaaaaacacccuuguuaauuacagcgaaaaccagcugcucgauaucgagacgggggagcugauuuccgacgaugaauauaaggagucuguguucaaggccccguaccaacacuucgucgacacacugaaaagcaaggaauuugaggauuccauccuuuucagcuaucagguggacucuaaauuuaaucgcaagauuuccgaugcuaccaucuacgccacaagacaggccaaagugggcaaggacaaaaaggaugaaaccuacguucucggaaagaucaaagacauuuauagccagaccggcuacgaugcuuucaucaagauuuaucaaaaagacaagucuaaauuucugauguaccggcaugacccucagacauucgagaaggucaucgagcccauucuggaaaacuauccuaacaaggagaugaaugaaaaagggaaggaggugcccuguaaccccuuucucaaauacaaggaggaacacggagauuauauccgcaaauacuccaagaagggcaaugggccugagauuaaaagccugaaguacuaugacucuaaacuuggaaaccacaucgauaucacgccgaaggacagcaauaacaaagugguccugcaguccgugagccccuggagagcggauguuuacuucaauaagaccacaggcaaguaugaaauucucgggcugaaauacgccgaccugcaguuugagaagggcaccggaacauauaaaaucucucaagaaaaguacaacgugauuaaaaagaaggagggcgucgauuccgacagcgaguucaaauuuacccuuuauaagaaugaucuccugcugaucaaagacacggaaacaaaggagcagcaacucuuccgguuucugucccgcaccaaaccuaacgugaagcauuacguugaacuuaaacccuacgauaagcaaaaguucgaggggaaugaaucucugauuaacgugcucggagcugucgccaaaggcgggcagugccagaagggaaucaauaaaccuaacaucagcauuuauaaggugagaaccgacguucugggcaaucagcacaucauuaaaaacgagggggacaagcccaagcuggauuucuga

SEQ ID NO: 3971 - RNA, 3387 nt, Artificial Sequence
  Cas9 variant
auggacgagaagauggauuacagaaucggccuggacauugggaucgccagcgugggaugggcuguccuccagaacaauuccgaugacgaacccguucggauuguggaucugggcgugcgcaucuucgacaccgccgagauuccuaaaacaggggaaucucuugcgggaccgagacgggcugcccgcacgaccagacggcgccugagacggcgcaagcacagacucgaucggaucaaauggcuguuugagaaccaaggccuuaucaauauugacgauuuccugaagcgcuauaacauggccgggcuccccgacgucuaccagcugagauaugaagcucuggaucggaaacucacagacgaggagcuggcccaggugcuucugcauaucgcuaagcaccgcggauuuagaagcacccggaaggccgaaacagcggccaaagagaauggcgcuguucucaaggccaccgaugaaaaccagaaaagaaugcaagagaagggcuaccgcacagugggggagaugauuuaucuggacgaggcuuuccggaccggaugcuccuggucugagaaaggcuacauccuuacgccuagaaauaaggccgaaaacuaucagcauaccaugcugcgcgcgaugcucgucgaggaagugaaggagauuuuuagcucccagcggagacuggggaaugagaaagccacagaagaacuggaagagaaguaccucgaaaucaugaccucucagcgcagcuucgaccugggacccggcaugcaaccugaugggaaacccuccccuuacgcuauggagggauuuagcgaccggguuggcaaguguacauuccuuggcgaucagggggagcugagaggagccaaaggcaccuauacggcugaauacuuuguggcccuccagaagauuaaccacacaaaacuggucaaucaggacggggagacccgcaacuucacagaagaggaacggagagcccuuacccugcuccuguuuacccaaaaggaggugaaguaugcugcggugcgcaaaaagcugggacucccggaggauauccuguucuacaaucuuaacuauaaaaaggccgcuacaaaagaagaacagcagaaggaaaaucaaaacacggagaaggccaaauuuaucggcaugcccuacuaucaugacuacaagaaaugccuggaggaacgggucaaguaccucaccgagaacgaaguuagagaucuguucgacgagauugggacaauccuuaccuguuauaaaaaugaugacucucggacagaacgccuggccaagcucggacuggugccuauugagauggagggccugcucgcuuacacccccacgaaguuccagcaccuguccaugaaagccaugagaaacaucauuccuuuucuugaaaagggcaugacauaugauaaagcgugcgaggaagcuggguacgacuucaaggccgacagcaaaggaaucaagcagaagcugcucaccggcgagaaagugaaucagaccaucaacgaaauuacaaaucccgucgugaagcggucuguuucccaaaccgugaaagucaucaacgccauuaucagaacauaugggagcccgcaggcuauuaauaucgagcuggcccgcgagaugucuaagacguuugaggagcggagaaaaaucaagggagauauggaaaaacgccagaagaacaaugaggacgugaagaaacagauucaagaacugggcaaacuuuccccuaccgggcaggauauccucaaguacagacuguggcaggagcagcaaggcauuuguauguauagcggaaagacaaucccccuggaggaacucuucaaaccuggcuacgacauugaucacauccugcccuacuccauuaccuuugacgauucuuuccggaacaagguucuugugacaagccaggagaaucgccagaaggggaacagaacccccuaugaauacaugggaaaugacgagcagcgguggaacgaguuugaaacgcgcgucaaaaccacaaucagagauuauaagaaacaacagaagcugcucaaaaagcauuucuccgaggaggaacggagcgaauuuaaggagcgcaaucugaccgacacaaaauacaucaccacggugauuuauaacaugaucagacagaaccuggagauggcuccucuuaaucggccggaaaagaaaaagcaaguccgcgccgugaacggcgcgauuacagccuaccucagaaaacggugggggcugccccagaagaauagagagaccgauacacaccaugcuauggacgccguugugaucgcuugcuguaccgauggaaugauucagaagaucucucgcuauaccaaaguccgggaaagaugcuacuccaagggcacagaguucguggacgccgaaacgggggagaucuuucgcccugaggacuacagccgggcggaaugggaugagauuuucggcguucacauccccaaaccuugggaaaccuuuagagccgagcuggacgugcgcaugggagaugaccccaagggcuuccucgauacacacucugacgucgcucuggaacuugauuauccggaguacauuuaugagaaccugcggccuaucuucgugagcagaaugcccaaucauaaagugaccggggccgcucacgccgacacaauucgcuccccucggcauuuuaaggaugaaggaaucguucucaccaaaacggcccugacagaccugaaacuugauaaggacggcgagaucgauggguacuauaacccccagucugaccuccugcuguacgaagcucucaagaagcaacugcuucuguauggaaaugacgcgaaaaaggccuucgcucaggauuuucacaaaccuaaggccgacggcaccgaggggcccgucgugagaaaggugaaaauucagaagaaacagaccaugggcgucuucguggauagcggaaacggcaucgccgagaaugggggaaugguucggauugacguguuucaugucaacggcaaguacuacuucgugccgguuuauacagcugauguggucaaaaaggugcucccuaaucgcgccgcgaccgcucacaagcccuacggggaauggaaaguuauggaggacaaggauuuucuguucucccuguauagcagagaccuuauccacauuaaaucuaagaaagauauccccaucaagauggugaacggaggcauggaagggauuaaggagacauacgccuauuacaucggcgccgacauuuccgcugccaauauccaaggaauugcgcaugauagccgguauaaauuucgcggccucgggauccagucucuggacguccuggaaaagugucagauugacgugcucggacacguguccgucguuagaagcgagaaacggaugggcuucuccuga

SEQ ID NO: 3972 - RNA, 3387 nt, Artificial Sequence
  Cas9 variant
augagcgaccuggugcucggccuggauaucgggauuggauccgucggcguugggauccuuaacaaggugaccggagagauugugcacaaaaaugccagaaucuuccccgcugcccaggcggaaaacaaugucgagcggcgcacaaacagacaaggccggcgccugacgagacggaagaaacaucgcagagugcggcucaaucacauuuuugaagagucugggcugaucaccgacuucacaaagguuagcaucaaccuuaauccuuaccagcugcgcgugaaaggacucaccgaugaacuguccaacgaggagcuguuuauugcucucaagaauauggucaagcauagaggcaucucuuaucuggacgaugccagcgacgauggcaacuccucugugggggacuacgcccagauuguuaaagaaaauagcaagcagcuugagacaaaaaccccgggacaaauccagcuggaacgguaucagaaguacggccagcuccgcggggauuucacaauugaggaggacggcaaaaagcacagacugaucaacguguuucccaccuccgcuuaucgggccgaagcccuucgcauucugcaaacgcagcaggaguucaauccucagaucaccgaugaauuuaucaacagcuaccuccaaauucugacaggaaagagaaaauauuaccaugggcccggaaaugagaagucucggaccgacuacggcagauauacaaccaaaaaggauuccgaagacgaguacaucacgcuggacaacauuuucggcauccucauugggaaaugcacauuuuauccugaggaauaccgcgcugcgaaggccagcuauaccgcucaggaguucaaccugcuuaaugaucugaacaaucucacaguccccaccgaaaccaaaaagcugucugaggaacagaagaaccaaaucaucacauacgugaaaaaugagaaggccaugggaccugcuaaacuuuuuaaguauauugccaaacugcucgcgugugacguggccgauaucaagggcuaccggauugacaaguccgauaaaccggagauccacacguucgaggcuuacagaaagaugaaaacccuggagacaauugacgucgaacagauggagcgcgaaaagcuggauaaacucgccuauguucugacccuuaacacagagcgggaggggauccaggaagcuaucgagcacgaauuuagcgacggaaccuucucucaggagcaaguggaugagcuggugcaguucagaaaguccaauagcuccauuuuuggcaagggguggcauaacuucucugucaaacucaugauggaacugauccccgagcuuuacgccacgagcgaagaacagaugacaauucugacccgccucggaaagcagaaacggaccuccagcucuaauaagacaaaauauaucgacgaaaagagacugaccgaggagauuuacaacccugugguugccaaguccgugcgccaagcuaucaaaauugucaaugcggccaucaaggaauauggcgauuuugacaacaucgugauugagauggcucgggaaaugaaugaggacgaugagaaaaaggccaucaaaaagauucaggaagccaacaaaagcgagaaggacgcugccaugagaaaggcggcuaaucaguacaacggcaaagccgaacugccccacucuguuuuccaugggcacaagcagcucgccacaaaaauccgccuguggcaccaacagggagagcggugccuuuauacgggcaagaccauuagcauccaugaucugaucaacaauccuaaccaguuugaaauugaccacauccucccccuguccauuacauucgaugacucucuggcuaauaaagugcuugucuacgccaccgcuaaccaggagaaggggcaaagaacaccguaccaggcccucgauagcauggacgaugcgugguccuuucgggaacugaaggccuucgugcgcgagagcaaaacccugucuaauaagaaaaaggaguaucuccugacggaagaggacaucuccaaauuugaugucagaaagaaguucauugaacggaaccuuguggacaccagauacgcuagccgcguugugcugaaugcccuccaggagcauuuucgggcuagaaaaaucgauacaaaggucucugugguucgcggacaauucaccucccagcugagacggcacuggggcaucgacaaaacacgcgacaccuaucaucaccacgccguggaugcgcugauuaucgccgcuagcucccagcuuaaccucuggaagaaacagaagaauacgcuggucucuuacagcgaggaccaacugcucgauauugaaacaggggagcugaucuccgacgaugaauauaaggagucuguguuuaaagccccuuaccagcauuucguggacacccuuaagagcaaagaguucgaagauuccauucuguuuagcuaucagguugacucuaaguucaacagaaaaaucuccgaugcuacaaucuacgccacccggcaggccaaggucggcaaagacaagaaggaugagaccuacgugcucggaaaaauuaaggacaucuauagccaagcuggcuacgaugcguuuauuaaaaucuaucagaaggacaaaucuaaguuccugauguaccgccacgacccccagacauuugaaaaggugauugagccuauccuggaaaauuaucccaacaaagagaugaaugaaaaggggaaagagguccccuguaacccuuuccuuaaguacaaagaggaacauggagauuauauuagaaaguacuccaagaaaggcaaugggccggagaucaagagccucaaauacuaugacucuaagcugggaaaccacaucgauauuacgcccaaaaacagcaauaacaaggugguucugcaguccgugagcccuuggcgggccgacgucuacuuuaauaagaccacaggcaaauaugaaauccucgggcugaaguacgcugaucuucaauucgagaaaggcaccggaacauauaagauuucucaggaaaaauacaacgacaucaagaagaaagagggcguggauuccgacagcgaguuuaaguucacccuguauaaaaaugaucuccugcugauuaaggacacggaaacaaaagagcagcaacuuuuucgcuuccucuccagaucuaugcccaacaagaaacacuacguugaacugaagccuuacagcaaggauaaauuugagaagaaugagacccugaucgaaauccucgggcccaccgacaaauccggacggugcauuaagggccuggccaaaucuaaccuuagcaucuucaaggugcgcacagacauucuggggaaucagcauaucauuaagaacgagggagauaaaccgaagcucgacuucuga

SEQ ID NO: 3973 - RNA, 3387 nt, Artificial Sequence
  Cas9 variant
augaccaagauccugggccucgaccuggggacaaacagcauuggaugggccguggucgaugagaaaaaggagaaaauccuuggcaugggguccagaauuuuccccgagggaguugugaauaucggcgaaggggagggacgggaaacgucuaagaacgcuagccgcaccgacgccagaggcacacggcgccaguuuuucagacggcgccugagaaaacgguaccuccugcgcgagcuugcgaagaagggccugugcccuauuaauuauacccucgugaaagaguggaacgaagcucaaaucuuuaagaauaaacagcugcaggagugguucaagcugaacccguacgaacucagauccaaagccauccaggagaagauuucucuggaggaacuugggcggaucuuuuaucacuucauucaacgcagaggauuucagagcaauucccggucugccggcgucgauaacaucgaaaagagcgugauuuucaaaggggacacaaagaccggaaaaaucggcauuuccgaaacacuggagagcaucaagaauaccaaaacgcucgggucuuaccugcauaccaucuaucccaagcagaacaaaccuuacuccggacacaaggaacgcauuagaaaucgguauacaaccagacagauguacaucuacgaguuugagacaauuugggaauaucaaaagcaguucuacagcgagcuuucuaacgaacugaaaaccguucucggcggccgcaagaaagauggguauaaggaggacggaauccuguuucaucagcggccccugagaucccagaaacaccucgugggcuacuguagcuucgaaccuaagaagacgaaaugccaaauuaauacaauccccuuugagcuguuccgcaucuaucagugggucaacaccguggauuguaaugagaagguuacaucugaagaccgggggaaaaugguggagcuucugcucuccaaggaaaaagucagcuucaaggagauuagaaaggugaucaacaaauccgauggauacuaucaguuuaacuacaagaaugacgauaaaauugugggcucuuacaccaucagcaaccuguccaauaagaaauucuuugggaagaagugguucgacuuuagcgauaaagaacaagaggacauuuggcauguccuuucuuucuuugacgaucgcgacaagcugaaacaguaugcuaucaaguacuggggauucaacgaggaaaaagccguuaagaucuccaaauuuaaucucaaggagggcuauagcaaccugucucggaaggcuauucacaauauccugccuuuccucaaacugggcuuuauguacgauguggccguggggcuuggaggcgucaagaacgcgcuggccgacaaauggauugaaaaugagcaguucauccucgauaacgugccgagcguugugagauccaauuuuaaagggggauauauugagccccugaaacagaugcuuaaguacgaguucgacgucucugauaagcaacugcucaaacuguaucaccauagcuccgcuaucgaaaccacagaacugcucaagaaacugccuauuaacagcgaggccgacaaggaaauccagucuaucaaaaaucccgugguuauuacggcucuuuucgagauccgcaagcuggugaacgagauuaucgauaccuacggcaaguuugacgaaauuaaagucgagcucgcccgggaucugaaggcguccaaaagcaagagauacgacacacgccgggaacagcugagacuugagaaagaaaaugaccggaucaagaucgagcucgagaaccuggggcagcgcauuaaccacaucaccauucugaaguauaaacucugggaagagugcgauaagagauguccuuucacaggcaaaaauaucgaagugaacgagcuguuuucuggagaaguccaaauugagcauaucuuccccuggucccggagccuuaaugacuccuuuaugaacaagacccugugcuucgccgaugagaauagagcuaaaggcaacaagacgccguacgaauuuuauucugagcagggggaacagaaaugggaggagaucaagauucaggcccucagcuguuucaagaauaaaccuaacuaccccaaugcuuaucaaaaguuuaaacaguucgugaagaaaaagcacgacgaagauuuuaucucccgccagcugaacgacacacgguacauuucuaaggaggccaaaaauuaucugagcaagaucugcaacaauguucagguggccccuggacaaaugaccgcuacccuuagacacaaauggggccucaacacaauucugaauaaggaugacgauaccaaaacacgcgacgaucauagacaccaugcgaucgacgcccuggucauggcuuguuccacgcggagccaccuccaggaacugucuaagcgcaacagauaccagaaggauuacgaguucaaagacuuucccaugcccuggcaauucuuccggcaggacgccgaaaaguccguggagcagauccuuguuagccauaaaaagcugaacaccauucucacagugcgcacccacaaaacaaagaagaauggggucguguauaaaaacaucggaguggccgcuagaggccagcugcacaaggagaccguuuuugggaaacggacggccccugauggcauugaagcguaccauguccgcaagccgaucgagucucuguccacccacaaacauauuaauaaggugguggacgaaacaaucagacuucucauucugaagcaagucaacaaacugggaggcuucgugaaggggaaaauccccgagggaaccuuuuauaauacagaugaaaacggcaauaagcagccucagaucuuccuccccaacaaaaaugggaacccuguucccauuaagaaaauccggcugcgcgagaauauuggaggcgcugagcagcuuaagagcaccgugaaccaacacgucaauccgagaucuaaccaccaugugcugaucuacaaggacuuugaugacaaucucaaagaaaagguugugacguucuggacagccgucgagcggaaaaagcagaaacaggccguguuucagcugccugaaaacgggaaggagauuguuaccacacugcaaaucaacgauauguuccuucucggccugaaggacgaugaaaucaauugggagcaccccaaauuuacccugcucaaggagcaucuguauagagugcagaaauucaccagcggagacuacuauuuucgcaagcacauugaauccaaccuuaauggcgagcuggggaaggcuuaccaguacaucaagggauucggcgaagggaagacaggauggaaaacguucaacccuauuaagaucaaagucagcgugucuggcaagauugagaaaguguga

SEQ ID NO: 3974 - RNA, 3390 nt, Artificial Sequence
  Cas9 variant
augaacggccuggugcucgggcuggacaucggaauugccagcgucggcgcugggauccuuaagaaagauaccggagagauuauccacgccaauuccagacuguuccccgcggcuacagccgacaacaauguucuccggcgcucuagcagacaggcccggcgcuccacgagacggaagcgccauagagcugugcggcugcacgaucuuuuugaagacuacggccugcucaccgauuucucuaaagugagcauuaaccugaauccuuauaagcugcgcgucgaggggauggacauccaacucacaaccgaagaacuguuuaucgcccuuaaaaacauuaucaagagacggggaauuuccuaccuggaugacgcuucugaagauggcgugacaguuagcuccgacuauggcaaggccguggaggagaaucgcaaacuccugagcgaacagaccccggggcagauccagcuugagagauucgaaaaguacggacaaguccggggcgauuuuacaguggaggagaacggggaaaaacgcagacugauuaauguuuucucuaccuccacguaucggaaggaggcggaaagaauccuccgcaaacagcaggaguuuaacaauaagauuaccgacgauuucaucgacgacuaccugacaauccugaccggaaagcggaaauauuaccauggccccgggaacaagaaaagcagaacagauuacggacgcuauaccacgaagaaagacucugaaggcaaguacauuacacucgauaauaucuuuggcgugcugauugggaaaugcaccuucuauccugacgaguaccgggccuccaaggcuagcuauacagcccaggaguuuaaccuucugaaugaucucaacaaccugaccguccccaccgaaacaaagaaacuuucugagaagcaaaagaagacgaucguggaauacgcuaaaaccgccaagacacugggagcguccacccuccugaaguauauugccaaaaugguggacgcuagcgucgaucagauccacggcuacagaguugacgugaauaagaaaccugagaugcauacauucgauguguaccgcaagaugcagucccuggaaaccuuuaacgucaaugagaugccccgggaggugcucgacgaacuggcccacauccuuacgcugaacacagagagagaagggauugaggaagcuaucaauaccaaacucaagggaaccuucaaccaggaucaaguucuggagcuugugcaguuccgcaagaauaacucuagccuguuuuccaaaggcuggcacaauuucagccucaagcugaugauggagcugauuccugaacucuaugccacaucugaggaacagaugaccauccugacacggcuugggaaacaaaaguccaaagagauuagcaagagaacgaaguacaucgacgagaaagaaaucaccgaggaaauuuauaacccggucguggccaagucuguucgccaggcuaucaaaauuaucaaugaggcgacaaagcaguacggaauuuuugaccauaucgugauugaaauggcccggcugaccaacgaggaggaugcuaaaaaggacuauaucaaaagacagaaggccaaucucgaugaaaagaacgccgcuauggagaaagccgcguuccaauacaauggcaagaaagaacugcccgacagcaucuuucacggccauaaggagcuggcuacaaaaauucggcuuuggcaccagcagggggaaaagugucucuauaccggaaagaacaucccuauuuccgaucugauccagaaccaauacaaauacgagauugaccacauccugccccucucucugagcuucgaugacucccuuagcaauaagguccuggugcucgccacggccaaccaggagaaaggccagcgcaccccuuuucaggcucuggauagaauggacgaugccuggucuuaucgggaguucaaguccuacgucaaagacagcaagcugcuugggaauaagaaaaaggauuaucuccugacagaggaagacaucucuaaaauugaggugaagcaaaaauuuaucgaaagaaaccugguugacacccgcuacuccagccgggugguccucaaugcucugcaggauuucuauaagaaccaucacuuugacacaaccauuuccgugguuagaggacaguucacgucucagcuucgcagaaaguggggccuggagaaaagccgggagacauaccaucaccaugccguggaugcgcucaucauugccgcuuccucucaacugcgccuguggaagaaacagaauaacccccuuaucuuuuauaaggaagggcaguucgucgacagcgagaccggcgaaauccucucccugaaugaugacgaguacaaagagcugguguucaaggccccguacgaucacuuuguggacacacucagaagcaaaaccuucgaagauucuauucuguuuuccuaucaaguugacagcaaguacaaccggaagaucucugaugcuaccauuuaugccacacgcaaagcgaaacuugacaaagauaaguccaaagagacguacguccugagcaagaucaaggacauuuauucucaggccggauacgacgcuuucaucaaaaucuauaauaaggauaaaagcaaguuucucauguaccacaaagacucccagaccuucgaaaaggugauugaggaaauccugagaacauacccuagcaaggaguuuaacgauaaaaauaaggaggugcccugcaacccuuucgaaaaauaucggcaggagaauggccccauucgcaaguacucuaaaaaggggaacggacccgaaaucaagucccugaaauauuacgacaagaacauuccugagagcuuuaucaauauuaccccguccaacucuaaaaauaaggucauccuuagacaacucaaccccuggcggacagauguguauuucaaucaucagaccgaaaaauacgagcugcugggccucaaguaugccgaccugcaguuugagaagaaaacggggacauacagcaucaccauugauaaguacaacgaaaucaaagagaaggaaggaguuggcgagcaguccgaguucaaauuuacccuuuauaagaaugaccugcuccugauuaaagauacaaagaacaaugaaaagcaaaucuuccgcuuccugucuagaaccaugccuaacgugaaacacuacgucgagcuuaagcccuauaauaaagcuaaguuugacgggaaccagccucugauuacaaucuucggcaauguggccaaaggaggccagugucucaaggggcugaacaagcccaauaucagcauuuacaaaaucaagacggauguucucggaaacaaauauuuuauuaagaaagaaggcgacaagccgaagcugaaauucuga

SEQ ID NO: 3975 - RNA, 3390 nt, Artificial Sequence
  Cas9 variant
auggccgacagaaucagccugggccucgauauugggguggcuuccgucggauucucuguucuggacaucgauaagggcaaagugauugagcuugggagccggcuguuuaacgccaccguggcggaaggaaaucaggaccgcagauccaugcggggcgcucgcagacuccugaaccggaauaagcaacgcagacaggauacagggaaacuuuuccagaaguuuggacugcucgacaacuucaauaaagauaacuuuuacgacacguucaaucagaacuggaaucccuaugagcugcgggucaagggccugaccgaacaccucacaaagaaagagcuggccgaaucucuuuaccaaaucgugaagcaucgcggcauuagcuaugcccugaaagaugcugacgccgaugaagggggaaccgacuacuccgcuucucucaagaucaacagccaggagcuggccgagaaaaccccugcgcagauccagcuucaaagacugaaugauuauggcaagguucggggacagguggucauuggggacgacccggauaaccagaaggugcuccugaauguuuuucccacauccgccuacgagaaagaagcuaagcagaucauugccacacaaaaacaguucuauccugagauccugaccgacgaguuuacgaaggaauacugcaaaauucucacccgcaagagagauuacuucgugggccccgggaacgagaaaagccggacagacuauggaaucuacaagaccgauggccgcacacuggacaaucuuuuugaggaacugauuggccacgauaagaucuauccugacgaacucagagcuucugccgcguccuacaccgcccagcuguucaacguccuuaacgaucugaauaaccuccggauccugagcuaugaggacgggaaacugacgaaggaggauaaagaaaagauuaucgcugagauuaaaucuaauacaaccacaaucaacaugcucaaugugauuaagaagguggccggauguuccaaagaagacaucaagggcuuuagagucaacgagaaagacaagcccgaaaucagcucuauggcuguuuaccgcaaagugcauaaggaucugcuuaaggugggggucgacauuuccgauuggccuguggaguucaucgacaaacugagcuucauucucacccugaauaccgagaacggagaaauccggaagcaacuuaauaacagacugguuccggaguuugauuuccucaaugacgaucugauucagcugaucaucgacaacaaagauuccuuugaaauuaagacaaauaacaaauggcaccgcuucucucucaagacgaugaauaagcugaugcccgagaugcuugaacggccuguggagcagaugacccugcucaacgagaugggccuggucaaaaaggacaaaaagagauuugaaaacaauaaauaucugcccuacaaggagaucgccaaagauauuuucaacccuguggccagcaaguccguucgcgaagcucuuaagaucgugaaugcgguccucaaaaaguacgggcauauugacuaucuggugaucgagaugccccgggauaaaaaccugaaggaggaacaggacaauauuaaagaguuucaaaacaagaauaagaaagccaaggacgcugccuucgaagccuuugucaaaagcgugggaucugagcagagaguuaaggaagcucucuccaaaaaccgcaagcugcagaugaagaugcggcuuugguaccagcaacaggagaucgauccguauaauggcgagacaaucgacgccaccgaucugauuaacaauccugacaaauucgaaaucgaucacauuaucccccagagcauuucuuuugacgauagcaucaacaauaagacacucugcuucgcguccaugaaccaggugaaaggccaaaagaccccuuacgaguuuaugcuggaagggcacggacagggcuaugacaaauucaaggcuacgguccuggauaauaagaacuucgacagaaacaaacgcaagaauuaccuuuuugaggaaaacgugucugauaucgagacacggaaaagauuccucagccggaaucugguugacacccgcuauuccagcagagugguccugaacucucuccaggacuuuuuccaugagaaguccgccgauaccaaagugacagugauucgggggaaguuuaccagcaauaugagaaaacacuggcauaucgacaagacacgcgaaacguuccaccaccaugccauugaugcuucuaucauugccgcuacccccuuucugcggauguggaagaaaggaggcacaaucuuccccguuaaggucggggaggaauccaucgacauugagaccggcgaaauccuugaugacaaaaaguuugauaaagugauguacgaggagccuuacaacggauucgugagcgaaauuaugaaugccgacgauagaaucaaguuuucccaccaggucgacaagaaaaugaaccgcaaggugucugaugcgacaauuuauagcaccagaacgggcaaacuggccaaggacaaaaaggaugcugaguacaucguugccaaggugaaagacaucuauuccgucgacggguucaagaaauuuaagaaaguguacgauaaggacaagucuaaauuccuccuguauaaguacgauccgcggaccuucagcgaacuggagcgcauuaucuccgacugucccgauaaaguugagaaggugcaaacaaauggaaaagucaaggcuguggacguuagcccuuuugaaauguauagacgguaccauggcaugauuaagaaauacucuaagaaagggaacggacccgccaucaagcagcuuaaauaucucgauaagaaacugggcucccacauugacaucaccccugcgaaugccaacgggaagcaugugauucugcagagccucaagcccuggcgcacagaugucuaccugaaucacgagaccggcgaauaugagaucaugggaaucaaauacucugaccuuaaguucaacaaaaaugugggcuaugggauuaagaaagauaaguaccuggaaaucaagaaaaacgaggagguguccgaaaagagcgaguuuauguucucucucuauagaaaagaccggguccgcauucaaaacaugaagacgggagaaagcguugagcugcuguuuugguccagaaauuucagcaacaaaaaguacgcugaacuuaagccgaucuuuaaauucgugacagaggaugacgacuggccuguguacggccacgccaagacccagauucucaaacggcugguccccaaggauugcaaaaucuggaaggugaauacaaccauccugggggacccuuauuaccucgagaaggaaucugauaaccccaaagacauucuggauuga

SEQ ID NO: 3976 - RNA, 3390 nt, Artificial Sequence
  Cas9 variant
augaccaacggcaagauccuggggcucgacauuggaaucgccagcgugggcgucgggauuaucgaggcuaaaacaggaaagguugugcacgccaauuccagacuguucucugcggcuaacgccgaaaauaacgccgagcggcgcggcuuuagagggagccggcgccuuaauagacggaaaaagcaucgcgugaaaagaguccgggaucuguucgaaaaguacggaauugugacggacuuucgcaaccucaaucugaaccccuaugagcuuagaguuaagggccugaccgaacagcucacaaaugaggagcuguucgcugcccugcggaccaucuccaaacgcagaggcaucucuuaccucgaugacgcugaagaugacagcacaggguccaccgauuaugccaagucuauugacgagaaccggcgccugcuuaaaacaaagaccccuggacaaauccagcuggaaagacucgagaaauacggccagcugcgggggaauuuuacgguguaugaugagaacggagaagcgcacagacuuauuaaugucuucagcaccuccgacuacgagaaggaagcccgcaagauccuggagacacaggcugauuauaacaaaaagauuaccgccgaauuuaucgacgauuacguggagauucucacacaaaaacggaaguacuaucauggcccggggaaugagaaaagcagaaccgacuacggacgcuuccggacggacggcacaacccuggaaaacaucuuuggcauccugauugggaagugcucuuucuaucccgaugaguacagagcuuccaaagccagcuauacagcgcaggaauacaacuuucucaaugaccugaacaaucuuaagguuccuaccgagaccggaaagcugucuacagaacagaaagaggcccucguggaguucgcuaaguccacggccacccugggccccgcuaaacuucugaaggaaaucgccaaaauucucgauuguaaggucgacgagaucaagggguaucgcgaagaugacaaaggaaagccugaucugcacacauuugagcccuaccggaaacugaaguucaaccucgacagcgugaauauugaugaccugucuagagaagugcuugauaaacuggccgacauccucacccugaacacagagcgcgagggcaucgaagacgcuauuaagcggaaucuuccuaaccaguucaccgaggaacaaaucuccgagauuaucaaugucagaaagagccaguccacggcguuuaacaaaggguggcauucuuucagcgccaagcugaugaaugagcucauuccggaacuguacgcuacauccgaugagcagaugaccauccugacccgccucgaaaaauuuaagguuaaaaagaaaagcucuaaaaacaucaagacaauugacgagaaagaaaucaccgaugagauuuauaaucccgugguggccaaguccguccggcagacaaucaaaauuaucaacgccgcugugaagaaauacggagacuucgauaagauuguuaucgagaugccuagagacaagaaugccgaugacgaaaagaaguuuaucgauaaacggaacaaggagaacaaaaaggaaaaggacgaugcgcugaaacgcgcugccuaucuuuacaauggcacggacaagcugcccgaugagguguuccacgaaaacaaacaacucgagaccaagauuagacugugguaucagcagggcgagcggugccuguacagcgggaaaccuauccccauucaagaacuuguccacaauucuaacaauuuugagaucgaccauauucucccgcugagccuguccuucgacgauucucucgccaacaaggugcugguuuauagcuggacaaaucaggaaaagggacagagaaccccuuaccaggugaucgacuccauggaugcugccuggagcuuucgcgagaugaaagacuacguccuuaagcaaaaaggccuggggaagaaaaagcgggauuaucuccugacaaccgaaaacaucgacaagauugaggugaaaaagaaauucaucgagagaaaucuggucgauacgcgcuacgcuucuagagugguucuuaacucccuccagagcgcccugcgggaacugggaaaggacaccaaagugucugucgugcgcggccaguuuacaucccagcucagacggaaguggaaaauugauaagagccgcgagaccuaucaccaucacgcgguugacgcccugaucauugcugccuccucucaacuuaagcugugggaaaaacaggauaaucccauguucguggacuacgggaacaaucaggucguggauaagcagacaggcgagauccucagcguguccgacgacgaguauaaagaacugguuuuucaaccucccuaccagggauucgucaacaccaucucuagcaagggcuucgaggaugaaauucuguuuuccuaucagguggacagcaaauacaauagaaaggugucugaugcuacgaucuacuccacacggaaggccaaaauugggaaggacaaaaaggaggaaaccuauguccuuggaaaaaucaaggauauuuacagccagaacggcuucgacacauuugugaagaaauauaacaaggauaaaacccaauuccucauguaccagaaggacccccugaccugggagaauguuaucgaggugauccugcgcgauuauccuacaacgaaaaagucugaagacgggaagaacgaugucaaauguaauccguuugaggaauacagacgggagaacggacucauuugcaaguauuccaaaaagggcaaagggacccccaucaagagccugaaguacuacgacaaaaagcugggcaauuguauugacaucacaccucaggaaucuaaaaaccgcgugguucuuagacaaauuagccccuggcgggcggauaucuauuucaauccugagacccucaaguacgagcugaugggacugaaauauuccgaccuuagcuuugaaaagggcacagggaaauaccacauuucucaggagaaguaugaugccaucaaggaaaaagagggagugggcaaggacuccgaguucaaauuuacccucuacagaaacgaucugauccugauuaaggacacgcucaauaacugcgaacgcaugcugcgguucgggagcaaaaaugauacauccaagcauuaugucgagcuuaagccccuggaaaaaggaaccuuugacucugaggaagagauccucccggugcugggcaagguugcuaaaagcgggcaguucauuaagggccugaacaaaccuaauaucuccauuuacaaggugagaaccgauguccuuggaaacaaguacuuugugaaaaaggagggcgacaaacccaagcuggauuucaaaaauaacaagaaguga

SEQ ID NO: 3977 - RNA, 3390 nt, Artificial Sequence
  Cas9 variant
augagcaacggcaagauccuggggcucgacauuggaguggccuccgucggcguugggaucauugauucuaaaaccggaaaugugauccacgcuaacagcagacuguucuccgccgcgaaugcugagaacaaugccgaacggcgcggcuuuagaggggcccggcgccuuacaagacggaagaaacaucgcgugaagagaguccgggaccuguucgagaaauacgauauuucuacggacuuucgcaaccucaaucugaaccccuaugaacuuagagugaagggacugaccgagcagcucacaaaugaggaacuguucgcugcccugcggaccaucgcuaagcgcagaggcaucagcuaccucgaugacgccgaggaugacuccacaggcucuagcgauuaugcgaaauccauugacgaaaaccggcgccugcuuaagaccaaaacaccugggcaaauccagcuggagagacucgaaaaguacggacagcugcggggcaauuuuaccguuuaugaugagaacggggaggcccacagacuuauuaauguguucagcacgucugacuacaaaaacgaagcucgcaagauccuggagacccaguccaauuauaacaagcaaauuacagaugaauuuaucgaggacuacauugaaauccucacccagaaacggaaguacuaucauggaccgggcaacgagaaaagcagaacagacuacgggcgcuuccggaccgauggaacgacacuggagaauaucuuuggcauucugaucggcaagugcucuuucuaucccgaagaguacagagccuccaaagcuagcuauaccgcccaggaauuuaacuuccucaaugaccugaacaaucuuaaggucccuacagagaccgggaaacugucuaccgaacagaaggaguaccucguggauuuugcgaagaaauccaaggcccugggagcuagcaaacuucugaaggagauugccaaaaucguugacuguuccguggaugacauuaagggcuaucgcgucgauaacaaggacaaacccgaucuccacacauucgaaccuuaccggaagcugaaauucaaucugucuagcaucgacaucgaugagcucuccagagaaacgcuggacaaacuugcugacauucugacccucaacacagagcgcgaagggaucgaggaugccauuaagcggaaucugcccagccaauuuaccgaggaacagaucucugagauugugcagaucagaaagaaccaguccagcgccuucaauaagggauggcauucuuuuagcgcuaaacuuaugaacgaacugaucccugagcucuacgugacauccgaggaacaaaugaccauucugacgcgccuggagaaguucaaagucaauaagaaaucuagcaagaacacaaagaccaucgacgaaaaagagauuaccgaugaaaucuauaauccgguuguggcgaaguccgugcggcagacaauuaaaaucauuaacgccgcugucaagaaauacggcgacuuugauaagaucgugaucgagaugcccagagacaaaaacgccgaggaugaaaagaaguucauugacaaaaagcagaaagagaauaagaaagaaaaggaugacagccucaagcgggccgcuuuucuguauaacgggaccgauaaucuuccugacggaguuuuccacggcaacaaagagcugaagacaaaaauccgccucugguaccaacagggcgaaagaugccuguauucugggaagcugauuuccauccacgaucuugugcauaauagcaacaaauuugagauugaccacauccucccccugucucuguccuucgacgauagccucgccaauaagguccugguguacgcguggacgaaccaggagaagggacagaaaaccccuuaucaaguuaucgacuccauggauacagcuuggucuuuucgggaaaugaaggacuacgugcuuaaacagaagggccuggggaaaaagaagugugaguaccuccugaccacagaaaauauugauaaaaucgaggucaagaaaaaguucauugaaagaaaccugguggacacccgcuaugccagccgggucgugcuuaauucccuccagacggcccugaaagagcugggaaaggauaccaaaguuucuguggucagaggccaguuuacaagccaacuccgcagaaaguggaacaucgacaagucccgggagaccuaccaucaccacgcuguggaugcccugauuaucgcugccagcucucagcuuaaacuguggcagaagcaggaaaaucccauguucgaguccuauggggaaaaccaaguugugaauaaagagacaggcgagauccucagcauuucugacgauaaguacaaagaacuggucuuccagccgccuuaucagggauuugugaacaccaucuccagcaagggcuucgaggacgaaauucuguuuucuuaccagguggauagcaaguucaaccgcaaaguuuccgacgcgacgaucuauagcacaagaaaggccaaacuugggaaggacaaaaaggaugagaccuacguccucggaaagauuaaagacaucuacucucaagauggcuuugacacauucaucaagcgguauaaaaaggauaaaacccaguuucugauguaccagaaggacccccugaccugggaaaaugugauugaggugauccuccgcgauuauccuuccgagaagcugagcgaagacgggaaaaagacagucaaaugcaaccccuucgaggaauacagacgggagaauggacuuauuuguaaguauuccaaaaagggcaacgggacgcccaucaagucucugaaauacuaugauaagaaacucggcaauugcauugacaucaccccugaaaagagcaaaaaccgcgugguucugagacaaauuuccccguggcgggcugauaucuacuuuaaucuggagacacuuaaguacgagcucaugggacugaaauauucugaccugagcuucgaaaagggcaccgggaaguaccauaucucccaggagaaauaugacgccauucgcgaaaaggagggaaucggcaaaaagucugaauuuaaauucacacucuacagaaacgaucugauucuuaucaaggacacccugaauaacugugagcggaugcucagauuugggagcaagaaugauacguccaaacacuauguggagcugaagccccuggaaaaaggaacauucgacagcgaggaagagauucuuccuguccugggcaagguggcuaaaucugggcaguucaucaagggccucaacaagcccaauaucuccauuuacaaaguucgcaccgaugugcugggaaacaaguuuuucaucaaaaaggagggcgacaaaccuaagcucgauuuuaagaauaacaacaaauga

SEQ ID NO: 3978 - RNA, 3390 nt, Artificial Sequence
  Cas9 variant
augagcaacggcaagauccuggggcucgacauuggaguggccuccgucggcguugggaucauugaugcuaaaaccggaaaugugauccacgccaacucuagacuguucagcgcggcuaaugccgagaacaaugccgaacggcgcggcuuuagaggggcucggcgccuuacaagacggaagaaacaucgcgugaagagaguccgggaccuguucgagaaauacgauauuuccacggacuuucgcaaccucaaucugaaccccuaugaacuuagagugaagggacugaccgagcagcucacaaaugaggaacuguucgccgcucugcggaccaucgccaagcgcagaggcaucucuuaccucgaugacgcggaggaugacagcacaggcuccucugauuaugccaaaagcauugacgaaaaccggcgccugcuuaagaccaaaacaccugggcaaauccagcuggagagacucgaaaaguacggacagcugcggggcaauuuuaccguuuaugaugagaacggggaggcucacagacuuauuaauguguucuccacgagcgacuacaaaaacgaagcccgcaagauccuggagacccagucuaauuauaacaagcaaauuacagaugaauuuaucgaggacuacauugaaauccucacccagaaacggaaguacuaucauggaccgggcaacgagaaauccagaacagacuacgggcgcuuccggaccgauggaacgacacuggagaauaucuuuggcauucugaucggcaagugcagcuucuaucccgaagaguacagagcuucuaaagccuccuauaccgcgcaggaauuuaacuuccucaaugaccugaacaaucuuaaggucccuacagagaccgggaaacugagcaccgaacagaaggaguaccucguggauuuugccaagaaaucuaaggcucugggagccuccaaacuucugaaggagauugcuaaaaucguugacuguagcguggaugacauuaagggcuaucgcgucgauaacaaggacaaacccgaucuccacacauucgaaccuuaccggaagcugaaauucaaucuguccucuaucgacaucgaugagcucagcagagaaacgcuggacaaacuugccgacauucugacccucaacacagagcgcgaagggaucgaggauaccauuaagcggaaucugcccucccaauuuacagaggaacagaucagcgagauugugcagaucagaaagaaccagucuuccgccuucaauaagggauggcauagcuuuucugcuaaacuuaugaacgaacugaucccugagcucuacgugaccagcgaggaacaaaugacgauucugacacgccuggagaaguucaaagucaauaagaaauccucuaagaacaccaagaccaucgacgaaaaagagauuacagaugaaaucuauaauccgguuguggccaagagcgugcggcagaccauuaaaaucauuaacgcggcugucaagaaauacggcgacuuugauaagaucgugaucgagaugcccagagacaaaaacgccgaggaugaaaagaaguucauugacaaaaaggagaaagaaaauaagaaagagaaggaugacucccucaagcgggccgcuuuucuguauaacgggacagauaaucuuccugacggaguuuuccacggcaacaaagaacugaagacgaaaauccgccucugguaccagcaaggcgagagaugccuguauagcgggaagcugauuucuauccacgaucuugugcauaauuccaacaaauuugagauugaccacauccucccccugagccugucuuucgacgauucccucgccaauaagguccugguguacgcguggaccaaccaggaaaagggacagaaaacaccuuaucagguuaucgacagcauggaugcugccugguccuuucgggagaugaaggacuacgugcuuaaacaaaagggcauugggaaaaagaagagagaauaccugcucaccacagagaauaucgauaaaauugaagucaagaaaaaguucaucgagcgcaaccugguggacacccgguaugccucuagagucgugcugaauagccuucagacggcucucaaagagcugggaaaggauaccaaaguuuccgugguccgcggccaguuuacaucucagcugagacggaaguggaagauugacaaaagccgcgaaaccuaccaucaccacgccguggaugcucucaucaucgccgcguccgggcaacugaaacuuuggcagaagcaugagaaccugauguucgaaaauuauggcgagaaccagguugugaauaaggagacaggagaaauucucagcaucucugacgaugaguacaaagaacuggucuuccagcccccguaucaaggcuuugugaacaccauuuccagcaagacguucgaggacgaaauccuguuuucuuaccagguggauuccaaguucaacagaaaaguuagcgacgccacaauuuauucuacccggaaggcuaaacuugggaaggacaaaaaggaggagacauacguccucggaaagaucaaagauaucuacacccaggacggcuuugauaccuucauuaagcgcuauaaaaaggacaaaacacaguuucugauguaccaaaaggauccucugacgugggaaaaugugaucgaggugauucucagagacuaucccagcgaaaagcuguccgaggaugggaaaaagaccgucaaauguaacccuuucgaagaguaccggcgcgagaauggacuuaucugcaaguauagcaaaaagggcaacgggacacccauuaagucucugaaauacuaugacaagaaacucggcaauuguaucgauauuacccccgaaaaguccaaaaacagagugguucugcggcagaucagcccuuggcgcgccgacaucuacuuuaaucuggagacacuuaaguacgaacucaugggacugaaauauuccgaucugucuuucgagaagggcaccgggaaguaccacauuagccaggaaaaauaugacgcuaucagagagaaggagggaauuggcaaaaaguccgaauuuaaauucacgcucuaccggaacgaccugauccuuauuaaggauacacugaauaacugcgagagaaugcuccgcuuugggucuaagaaugacaccagcaaacauuauguggaacugaagccgcuggagaaaggaaccuucgauuccgaggaagagauccuucccguccugggcaagguggccaaaucugggcaauucaucaagggccucaacaagccuaauauuagcaucuacaaaguucggacagacgugcugggaaacaaguuuuucauuaaaaaggaaggcgauaaacccaagcucgacuuuaagaauaacaacaaauga

SEQ ID NO: 3979 - RNA, 3393 nt, Artificial Sequence
  Cas9 variant
augaacaagauccugggccucgaccuggggaccaauagcauuggaugggcccuuaucgagaacaauauuauccugggcaugggguccagaguguuccccgaaggagucguuaaccucggcgagggggaaggaagagagacaucuaaaaaugcuagccgcacggaagccagaggcgugcggcgccagauuuuuagacggcgccugagaaagcgguaccuucugaaagagcucgcgaagcacaaccugugcccuaucuccccgacccugaucaaagauuggaauggcacagacauuuucaagaacgagcucaucauucaaugguuucagcugaaucccuaugaacuucgcgcuaaggccauccaggaggaaauuacccugaucgagcucgggagaauuuucuaccauaugauccagcggcgcggauuucugucuaacagcagauccgccggcgcugaugugaaagagacaucuaccaucuucaagggggacgccaaaauuggaaagaucggcauuagcgauacacuuaaauccaucgaacaaaauaagacccuggggagcuuucuccacucuauucagccuaaggagaacgaacccuucuccggagagcuggaacggauccgcaauagauauacgacccggcagauguacaucgacgaguuugagacaauuugggaguuccagaaacaauaucauagcgagcugaacucuaaucucaagaccauccugggcggccgcaaaaaggauaacuacaaagaagacgggguccuuuuucaccagagaccucugcggucccagaagcaucucgugggauucuguagcuuugagcccaaaaagacaaagugcaaacugucugcuauuccuuucgaacuuuucagaaucuaucaguggguuaacacccuguccuacgaugugaauggcguccgccaaaagauuacgcaggaggagcggaaaaagaucaucgaccuccugcugagcaaagaaaagccguccuuuaaggagauuagaaaagccaucgggaagcucgauggaucuuaccaguucaacuauaaagacgaugacaagauugugggcagccacacaaucuccaaucugagcaacaaaaaguuuuucgggaauaagugguuugacuucucugaaaaagagcaagaaaacauuuggcacauccuuuccuuuuucgaugaccgcgagaagcugaaagaguacgcgauuaagaauuggagcuuugaugaagaacgggccguuaaaaucucuaaguucaaccucaaggacggauauagcaaucuguccagaaaagcuauccuuaacauucugcccuuucuccagaagggcuucauguacgauguggccgucggccuggcuggggugaaaaauacccugucugugaacugggaagaacaugagcaguuuguccucgacaauguuccugaaaucgugcgcagcaaccugaagggaggcuauauugagccccuuaaaaauaugcugaagaacgaguucaacuguaaugauaaacagcucgagaagcuguaccaccauuccagcgccaucgaaacagagaacauucuggaccggcuuccugugaaucuccacgcggauagagagauccaaaagaucaaaaaccccgucgugauuaccgcccuguucgaaauccgcaagcugguuaaugaggugauugacaccuaugggaaaccgaacgaaaucaaggucgagcucgcucgggaucugaaagccucuaaguccaauagacuugaagcucggaagcgccagaaagaccuggagaagcagaacgacagagugaaacucgagcuggaaaaucugaaccagcggagcaaucacauuaacauccuuaaguacaaacucugggaggaaugcaaucauacauguccuuuuacgggacaaaucauuaccaucucucagcuguucacaggcgagguucagauugaacacaucuuucccugguccagaagccugaacgauuccuucaauaacaagacccucugcuuugccgacgagaaccgcgccaaggggaauaaaacaccuuacgagcuguauucugaacagggcgaucaaaagugggaggcuauuaaacuucaggcgcugagcuguuucaagaccaaagccaacuaccccaauugcuauaacaaguuuaagcauuucgugaaaaagaaacacgacgaagauuuuaucucccggcagcucaaugacacgagauacaucucuaaggaggcuaaaaacuaucugagcaagauuuguuccaauguccugguggcccccggacagaugacagccacccuucgccaucacuggggccucaacagcauccugaaucuggaggaugacaccaaaacaagagaugaccaccggcaucacgcuauugaugcccucgucauggcgugcucuacccgcucccaucugcaagaacuuagcaagagaaaccgguacaauaagaacuaugaccugaaagauuucccugacccguggcagaauuuucgccaggacgcugagaacgccguggcccaaauccucguuucucacaagaaauccaagagccugcugacagugagaacgcacaaaaccauuaagaagggggucgaacauaaaaauaucggaguggcugcccggggccagcuucacaaggagucuguuuacgggcuccgcaaagcucccaacagcaacaaggccuuccauauuagaaaaccucuggaaucccugacaaccgagaagcagcucgagaagaucguggaugacagcauccggcugcuuauucugaaacgcaucaauauuaucggaggcuuuauuaaggggaaaauccccaaggaaacauucuucgucguggaugagaacggcaucaaacagccucaaauuuuucuccccaauagaaacggaaauccggugccuaucaagaagguucggauuagagaaaacaucggcggggcggagaaacugaaggaaaauaccaaccaguacgucaauccccgcucuaaccaccaugugauuguguaugaggacuccaauggaggccugaaagaugacgucgugacguucuggaccgccguugagcggaagagacaggggcaggauguguuuaaacuuccuaacgacggagaaaagaucgucagcacacugcaaaucaaugauauguuccuccugggccucaacgacgaugacauuaucacccugacauccaaggagcuuaaaaagcaccuguuuaaagugcagacccucucuagcuccuucuacgaauuucgccugucuacggauagcacacagaauaagaacaccaauuccacaguuuuccggcggauucagucuuuugggaugggcaaaaccggauggaaggcuuucaaccccaucaaagugaagcugaacagcauuggcgaggucaagaucauuuga

SEQ ID NO: 3980 - RNA, 3393 nt, Artificial Sequence
  Cas9 variant
augaccaacggcaagauccuggggcucgacauuggaaucgccagcgugggcgucgggauuaucgaggcuaaaacaggaaagguugugcacgccaauuccagacuguucucugcggcuaacgccgaaaauaacgccgagcggcgcggcuuuagagggagccggcgccuuaauagacggaaaaagcaucgcgugaaaagaguccgggaucuguucgaaaaguacggaauugugacggacuuucgcaaccucaaucugaaccccuaugagcuuagaguuaagggccugaccgaacagcucacaaaugaggagcuguucgcugcccugcggaccaucuccaaacgcagaggcaucucuuaccucgaugacgcugaagaugacagcacaggguccaccgauuaugccaagucuauugacgagaaccggcgccugcuuaaaacaaagaccccuggacaaauccagcuggaaagacucgagaaauacggccagcugcgggggaauuuuacgguguaugaugagaacggagaagcgcacagacuuauuaaugucuucagcaccuccgacuacgagaaggaagcccgcaagauccuggagacacaggcugauuauaacaaaaagauuaccgccgaauuuaucgacgauuacguggagauucucacacaaaaacggaaguacuaucauggcccggggaaugagaaaagcagaaccgacuacggacgcuuccggacggacggcacaacccuggaaaacaucuuuggcauccugauugggaagugcucuuucuaucccgaugaguacagagcuuccaaagccagcuauacagcgcaggaauacaacuuucucaaugaccugaacaaucuuaagguuccuaccgagaccggaaagcugucuacagaacagaaagaggcccucguggaguucgcuaaguccacggccacccugggccccgcuaaacuucugaaggaaaucgccaaaauucucgauuguaaggucgacgagaucaagggguaucgcgaagaugacaaaggaaagccugaucugcacacauuugagcccuaccggaaacugaaguucaaccucgacagcgugaauauugaugaccugucuagagaagugcuugauaaacuggccgacauccucacccugaacacagagcgcgagggcaucgaagacgcuauuaagcggaaucuuccuaaccaguucaccgaggaacaaaucuccgagauuaucaaugucagaaagagccaguccacggcguuuaacaaaggguggcauucuuucagcgccaagcugaugaaugagcucauuccggaacuguacgcuacauccgaugagcagaugaccauccugacccgccucgaaaaauuuaagguuaaaaagaaaagcucuaaaaacaucaagacaauugacgagaaagaaaucaccgaugagauuuauaaucccgugguggccaaguccguccggcagacaaucaaaauuaucaacgccgcugugaagaaauacggagacuucgauaagauuguuaucgagaugccuagagacaagaaugccgaugacgaaaagaaguuuaucgauaaacggaacaaggagaacaaaaaggaaaaggacgaugcgcugaaacgcgcugccuaucuuuacaauggcacggacaagcugcccgaugagguguuccacggcaacaaacaacucgaaaccaagauuagacugugguaucagcagggggagcggugccuguacagcggaaaaccuauccccauucaagagcuuguccacaauucuaacaauuuugaaaucgaccauauucucccgcugagccuguccuucgacgauucucucgccaacaaggugcugguuuauagcuggacaaaucaggagaagggccagagaaccccuuaccaggugaucgacuccauggaugcugccuggagcuuucgcgaaaugaaagacuacguccuuaagcaaaaagggcugggaaagaaaaagcgggauuaucuccugacaaccgagaacaucgacaagauugaagugaaaaagaaauucaucgagagaaaucuggucgauacgcgcuacgcuucuagagugguucuuaacucccuccagagcgcccugcgggagcugggcaaggacaccaaagugucugucgugcgcgggcaguuuacaucccagcucagacggaaguggaaaauugauaagagccgcgaaaccuaucaccaucacgcgguugacgcccugaucauugcugccuccucucaacuuaagcugugggagaaacaggauaaucccauguucguggacuacggcaacaaucaggucguggauaagcagacaggagaaauccucagcguguccgacaacgaguauaaagagcugguuuuucaaccucccuaccagggcuucgucaauaccaucucuagcaagggguucgaagacgagauucuguuuuccuaucagguggauagcaaauacaacagaaaggugucugacgcuacgaucuacuccacacggaaggccaaaauuggaaaggauaaaaaggaagagaccuauguccuuggcaaaaucaaggacauuuacagccagaacggguucgauacauuugugaagaaauauaauaaggacaaaacccaauuccucauguaccagaaggauccccugaccugggaaaacguuaucgaggugauccugggagacuauccuacaacgaaaaagucugaggauggcaagaaugacgucaaauguaacccguuugaagaguaccgcagagaaaaugggcucauuugcaaguauuccaaaaagggcaaaggaacccccaucaagagccugaaguacuacgauaaaaagcugggcaacuguauugacaucacaccugaggaaucucggaauaaagugauucuucagagcaucaaccccuggcgcgcggacguuuauuucaauccugagacccucaaguacgagcugauggggcugaaauauuccgaucuuagcuuugaaaagggaacaggcaacuaccacauuucucaagagaaauaugacgccaucaaggaaaaggaggggaucggcaaaaaguccgaguucaaauuuacccucuacagaaaugaucugauucugaucaaggacauugcuagcggagaacaggagaucuaucgguuccucuccagaacgaugcccaacgugaaucauuacgucgaacugaaaccguacgauaaggagaaguuugacaacgugcaggaacuuguugaggcccugggggaggcugauaaagugggccgcugcauuaagggacucaauaaaccuaacaucucuaucuauaagguccggacagacgugcugggcaacaaauacuucgugaagaaggaaggggauaaacccaagcuggacuuuaaaaauaacaagaaauga

SEQ ID NO: 3981 - RNA, 3393 nt, Artificial Sequence
  Cas9 variant
augaccaacggcaagauccuggggcucgacauuggaaucgccagcgugggcgucgggauuaucgaggcuaaaacaggaaagguugugcacgccaauuccagacuguucucugcggcuaacgccgaaaauaacgccgagcggcgcggcuuuagagggagccggcgccuuaauagacggaaaaagcaucgcgugaaaagaguccgggaucuguucgaaaaguacgagauugugacggacuuucgcaaccucaaucugaaccccuaugaacuuagaguuaagggacugaccgagcagcucacaaaugaggaacuguucgcugcccugcggaccaucuccaaacgcagaggcaucucuuaccucgaugacgcugaggaugacagcacaggcuccaccgauuaugccaagucuauugacgaaaaccggcgccugcuuaaaacaaagaccccugggcaaauccagcuggagagacucgagaaauacggacagcugcggggcaauuuuacgguguaugaugaaaacggggaggcgcacagacuuauuaaugucuucagcaccuccgacuacgaaaaggaggcccgcaagauccuggaaacacaggcugauuauaacaaaaagauuaccgccgaguuuaucgacgauuacguggagauucucacacaaaaacggaaguacuaucauggaccgggcaaugagaaaagcagaaccgacuacgggcgcuuccggacggacggaacaacccuggaaaacaucuuuggcauccugauuggcaagugcucuuucuaucccgaugaauacagagcuuccaaagccagcuauacagcgcaggaguacaacuuucucaaugaccugaacaaucuuaagguuccuaccgaaaccgggaagcugucuacagagcagaaagaggcccucguggaguucgcuaaguccacggccacccugggacccgcuaaacuucugaaggaaaucgccaaaauucucgauuguaaggucgacgaaaucaagggcuaucgcgaggaugacaaagggaagccugaucugcacacauuugaacccuaccggaaacugaaguucaaccucgacagcgugaauauugaugaccugucuagagaggugcuugauaaacuggccgacauccucacccugaacacagagcgcgaaggaaucgaggacgcuauucggcauaaucuuccuaaccaguucaccgaaggccaaaucuccgagauuaucaaggucagaaagagccaguccacggcguuuaauaaaggguggcacucuuucagcgccaagcugaugaacgagcucauuccggaacuguacgcuacauccgaugagcagaugaccauccugacccgccucgaaaaauuuaagguuaauaaaaagagcucuaagaacacaaaaaccaucgacgagaaggaagugacagaugagauuuauaaucccguggucgccaaauccgugcggcagacgaucaagauuaucaacgccgcuguuaaaaaguacggagacuucgauaaaauugugaucgagaugccuagagacaagaaugccgaugacgaaaagaaauuuauugauaagcggaacaaagagaacaagaaagaaaaggacgaugcgcugaagcgcgcugccuaucuuuacaauggcaccgacaaacugcccgaugaggucuuccacggcaacaagcaacucgaaacaaaaaucagacugugguaucagcagggggagcggugccuguacagcggaaagccuauccccauucaagagcuugugcauaauucuaacaauuuugaaaucgaccacauucucccgcugagccuguccuucgacgauucucucgccaacaaaguucugguguaugcuuggaccaaucaggagaagggccagaagacaccuuaccaggucaucgacagcauggaugccgcuugguccuuuagagaaaugaaagacuacgugcuuaagcaaaaagggcugggaaagaaaaagcgcgauuaucuccugaccacggagaacauugacaagaucgaagucaaaaagaaauucaucgagcggaaucugguggauaccagauacgccagccgcguugugcuuaacucucuccaguccgcgcugagagagcugggcaaggacacaaaaauuagcgucauccgggggcaguuuaccucucagcuccgcagaaaguggaaaauugauaagucccgggaaacauaucaucaccacgccguggacgcucugaucauugccgcuagcucccaacuuaagcugugggagaaacaggauaaucccauguucguugacuacggcaacaaucagguggucgauaagcagaccggagaaauccucucugugagcgacgacgaguauaaagagcugguguuucaaccucccuaccagggcuucguuaacaugaucuccucuaagggguucgaagaugagauucuguuuagcuaucaggucgacuccaaauacaaucgcaaggugagcgaugccacgaucuacucuacaagaaaggcgaaaauuggaaaggacaaaaaggaagagaccuaugugcuuggcaaaaucaaggauauuuacucccagaacggguucgacacauuuaucaagaaauauaacaaggauaaaacccaauuccucauguaccagaaggacccccugaccugggaaaaugucaucgaggugauucugcgggauuauccuacaacgaaaaagagcgaggacggaaagaacgauguuaaauguaauccguuugaagaguaccgcagagaaaacggccucgugugcaaguauucuaaaaaggggaaaggcacccccaucaagucccugaaguacuacgacaaaaagcugggaaauuguauugacaucacaccugagggcagcaaaaacgaagucgugcuucagucucucaaucccuggcgggccgauguuuauuucaacccugagacccugaaguacgagcugcuugggcucaaauauagcgaccuguccuuugaaaagggaacaggcaaauaccauauuagccaagagaaguaugaugugaucaaggaaaaagaggggauuggaaagaaaucugaguucaaguuuacccuguaccgcaaugaccucauccugaucaaagauacggcuuccggcgaacaggagauuuauagauuccuuagccggacaaugcccaacgucaagcacuacgccgaacugaagccguacgacaaagagaaguuugauaaugugcaggaacucguugaggcucugggggaggccgacaaagugggcagaugcaucaagggacugaacaaauccaaucuuucuauuuauaagguccgcaccgaugugcugggcaacaaguacuucgugaaaaaggaaggggacaaaccuaagcucgauuuuaaaaauaacaagaaguga

SEQ ID NO: 3982 - RNA, 3393 nt, Artificial Sequence
  Cas9 variant
augaccaacggcaagauccuggggcucgacauuggaaucgccagcgugggcgucgggauuaucgaggcuaaaacaggaaagguugugcacgccaauuccagacuguucucugcggcuaacgccgaaaauaacgccgagcggcgcggcuuuagagggagccggcgccuuaauagacggaaaaagcaucgcgugaaaagaguccgggaucuguucgaaaaguacggaauugugacggacuuucgcaaccucaaucugaaccccuaugagcuuagaguuaagggccugaccgaacagcucacaaaugaggagcuguucgcugcccugcggaccaucuccaaacgcagaggcaucucuuaccucgaugacgcugaagaugacagcacaggguccaccgauuaugccaagucuauugacgagaaccggcgccugcuuaaaacaaagaccccuggacaaauccagcuggaaagacucgagaaauacggccagcugcgggggaauuuuacgguguaugaugagaacggagaagcgcacagacuuauuaaugucuucagcaccuccgacuacgagaaggaagcccgcaagauccuggagacacaggcugauuauaacaaaaagauuaccgccgaauuuaucgacgauuacguggagauucucacacaaaaacggaaguacuaucauggcccggggaaugagaaaagcagaaccgacuacggacgcuuccggacggacggcacaacccuggaaaacaucuuuggcauccugauugggaagugcaacuucuaucccgaugaguacagagcuucuaaagccuccuauacagcgcaggaauacaauuuucucaacgaccugaauaaccuuaagguuccuaccgagaccggaaagcugagcacagaacagaaagagucucucguggaguucgccaagaauacggcuauccugggccccgccaaacuucugaaggaaauugcuaaaauccucgauuguaaggucgacgagauuaagggguaucgcgaagaugacaaaggaaagccugaucugcacaccuuugagcccuaccggaaacugaaguucaaccucgacuccgugaauaucgauuaccugagcagagaagugcuugacaaacuggccgauauccucacacugaacaccgagcgcgagggcauugaagacgccaucaagcggaaucuuccuaaccaguucacagaggaacaaauuucugagaucauuaaugucagaaagucccagagcaccgcuuuuaacaaaggguggcauuccuucucugcgaagcugaugaaugagcucaucccggaacuguaugccacgagcgacgagcagaugacaauccugacccgccucgaaaaauuuaagguuaaaaagaaguccagcaaaaacauuaagaccaucgaugagaaagaaauuacagacgagaucuacaaucccgugguggcuaagucuguccggcagaccauuaaaaucauuaacgccgccgugaagaaauauggagauuucgacaagaucguuaucgagaugccuagagauaagaacgcugacgaugaaaagaaguuuauuaauaaacggaacaaggagaauaaaaaggaaaaggacgaugcccugaaacgcgcggcuuaccuuuauaacggcacagacaagcugcccgaugagguguuccacggcaauaaacaacucgaaacgaagaucagacugugguaccagcagggggagcggugccuguauuccggaaaaccuauucccauccaagagcuuguccacaacagcaauaacuuugaaauugaccauauccucccgcugucucugagcuucgaugacucccucgccaauaaggugcugguuuacucuuggaccaaccaggagaagggccagaaaacaccuuaccaggugaucgacagcauggaugccgcuugguccuuuagagaaaugaaggaguauguccuuaaacaaaaggggcugggcaaaaagaagcgcgacuaccuccugaccacagaaaauauugauaaaaucgaggugaagaaaaaguucauugagcggaaccuggucgacaccagauaugccagccgcgugguucuuaauucucuccaguccgcucugagagaacugggaaaagauacgaaggugagcgucgugcgggggcaguuuaccucucagcuccgcagaaaauggaagaucgacaagucccgggagacauaccaccaucacgccguugaugcgcugauuaucgccgcuagcucccaacuuaaacugugggaaaagcaggacaaccccauguucguggauuauggcaauaaccaggucguggacaaacagaccggagagauccucucugugagcgauaacgaguacaaggaacugguuuuucaaccucccuaucagggcuucgucaauacaauuuccucuaaaggguucgaggacgaaauccuguuuagcuaccagguggauuccaaguacaaccgcaaggugagcgacgccaccauuuauucuacgagaaaagcuaagaucggaaaagacaagaaagaggaaacauacguccuuggcaagauuaaggauaucuauucccagaauggguucgacaccuuugugaaaaaguacaacaaagauaagacacaauuccucauguaucagaaagacccccugaccugggagaauguuaucgaggugauucugggagauuacccuaccacaaagaaaagcgaagacggcaaaaacgaugucaaguguaauccguuugaggaauaucggcgcgagaacgggcucaucugcaaauacucuaagaaaggcaagggaacgcccauuaagucccugaaauacuaugacaagaaacuuggcaauuguaucgauauuaccccugaagagagcagaaacaaggugauccugcagucuauuaaucccuggcgggccgacguuuacuucaacccugagacacucaaauaugaacugauggggcugaaguacagcgaucuuuccuuugagaaaggaaccggcaauuaucacaucagccaagaaaaguacgacgcgaucaaggagaaagaagggauuggaaagaaaucugaguucaaguuuacacucuaucgcaacgaccugauccugauuaaagauaucgccuccggcgagcaggaaauuuacagauuccucagccggaccaugcccaaugugaaccauuacgucgagcugaagccguaugacaaggaaaaauuugauaacgugcaggagcuuguugaggcucugggggaagccgacaaggugggcagaugcaucaaaucccucaauaagccuaacaucucuauuuacaaaguccgcacggaugugcugggaaauaaguauuucgugaagaaagagggcgacaagcccaaacuggauuuuaagaacaauaaaaaguga

SEQ ID NO: 3983 - RNA, 3393 nt, Artificial Sequence
  Cas9 variant
augagcaacggcaagauccuggggcucgacauuggaguggccuccgucggcguugggaucauugaugcuaaaaccggaaaggugauccacgccucuagcagacuguucuccgcggcuaaugccgagaacaaugccgaacggcgcggcuuuagaggggcucggcgccuuacaagacggaaaaagcaucgcauuaaaagagugcgggaccuguucgagaaguacgaaaucgucacggauuuuucuaaccucaaucugaaccccuaugagcuucgcgugaagggacugaccgaacagcucacaaaugaggagcuguucgccgcucugagaaccaucgccaaacggcgcggcauuagcuaccucgacgaugcggaagacgauuccacaggcucuagcgacuaugccaaguccaucgaggaaaacagacggcugcuuaaaaauaugaccccugggcaaauucagcuggagcgccucgagaaguacggacagcugagaggcaacuuuacaguuuaugaugaaaauggggaggcucaccggcuuaucaacguguucagcaccucugacuacaaaaaugaagccagaaagauucuggagacgcaguccaacuauaauaagcaaaucaccgaugaauuuauugaggacuacaucgagauccucacacagaaacgcaaguacuaucauggaccgggcaacgaaaagagccggaccgauuacgggagauaucgcacagacggaaccacgcuggagaacauuuucggcauccugauuggcaagugcacauuuuaccccgacgaauaucggaccucuaaggcuuccuacacagcccaggaguauaauuuccucaacgaucugaauaaccuuaaggucccuaccgaaaccgggaaacugagcacagagcagaagcacuaccucguggacuuugcgaagucuuccaaagcccugggaguugcuaaacuucugaaagagaucgccaagauuguggaauguagcgucgaugacaucaaaggcuacagagaggauaauaaggggaagcccgaccuccauacguucgaaccuuaucgcaaacugaaguuuaaccugucccucaucgauauugacgagcugucucgggaaacccuugauaaacuggcugacauccucacacugaauaccgagagagagggaauugaagaugccaucaagcgcaaccuucccaaucaauucacagaggaacagauuguggagcuggugaacguccggaaaaaucagagcuccgccuucaacaagggcuggcacagcuuuucuguuaagcucaugaaugagcugaucccugaacuguacgcuuccagcgaggaacagaugaccauccucacgagacuggagaaauucaaggugaacaaaaagucuagcgaaaauacaaaaaccauuaacgagaaggagaucaccgacgaaauuuauaacccgguggucgcgaaguccgugucucaaacaguuaaaaucauuaaugccgcugugaagaaauacggggacuuugauaagaucgucauugagaugccccgcgacaaaaacgccgaugacgaaaagaaauucaucgauaagaagcagaaagagaaugccaaggaaguggaggacgcucuuaaacgggccgcguaucuguacaacggaaccgauaagcucccugacggcguuuuucacggcaauaaacagcugaagacaaagaucagacugugguaucaacagggggagcggugccuuuacagcggaaaacccauuuccauccaggaucucgugcauaacagcaauaacuucgaaauugaccacauccugccucugucucucuccuuugaugacagccuggcuaauaagguccuuguguacgccuggacgaaccaggagaaaggccaaaagacccccuaucaggucauugauucuauggacgccgcuugguccuuccgcgaaaugaaagacuacgugcugaaucagaaggggaucggaaagaaaaagagagaguaucuccugacaaccgaaaacaucgauaaaauugagguuaagaaaaaguuuaucgagcggaaucugguggacacaagauacgccagccgcgucgugcuuaacuccauucaggcugcccucaaggaacuggauaaagacaccaagguuucugugauccggggccaauucacgagccagcugagacgcaaauggaagauugauaaauccagagagaccuaucaucaccacgcggucgacgcccucaucaucgcugccucuagccagcugaaacuuuggcagaaacaagaaaauccgauguuuguggauuacggggagaaccaggugguuaacaaggagacaggcgaaauucuguccgucagcgacgaugacuauaaggagcucguguuccagccucccuaccagggauuugugaauaccaucucuuccaaggcuuucgaagaugagauucuguucagcuaccaagucgacucuaaguauaaccggaaaguguccgaugccacaaucuacagcacccgcaaggcgaaacugggcaaggacaagaaagaagagacguauguucuugggaagauuaaagacaucuacucucaggauggauuugacgccuucaucaagagauauaaaaaggauaagacacaguuucucauguaccaaaaagacccugugaccugggagaaugucauugaagugauccugcgggauuaucccagcgagaagcuguccgaagacggcaaaaagaacguuaaauguaaucccuucgaggaauaccgcagagagaacgggcucauuugcaaguacagcaagaaaggaaagggcacaccuaucaaaucucugaaguauuacgauaaaaagcuggggaauuguauugacaucaccccgaagggcuccaaaaacgaggugguccuucagagccucaaucccuggcgggcugaucuguauuuuaacccugacacccugaaguacgaacuuaugggacucaaauauuccgaucugucuuucgagaagggcacagggaaauaccauauuagccaggaacgcuaugacgagaucaaggugaaagaaggaaucggcaaaaauuccgaguuuaaguucacgcuguacagaaacgaccucauucugaucaaagauaccgagucuggggaagaggaacuuuaccgguuucugagccgcacaaugcccaauguuaagcacuauguggagcucaaaccuuacgacaaggagagauaugauggaggccaggaacugaugaaagucuucgggaacguggccaauggcggacaaugccugaagucccuuaacaagucuaaccugagcauuuacaaagugcggaccgacguccucggcaauaaguuuuucaucaaaaaggagggggauaaacccaagcuggacuuuaagaacaauaaaaaguga

SEQ ID NO: 3984 - RNA, 3393 nt, Artificial Sequence
  Cas9 variant
augaccaacggcaagauccuggggcucgacauuggaaucgccagcgugggcgucgggauuaucgaggcuaaaacaggaaagguugugcacgccaauuccagacuguucucugcggcuaacgccgaaaauaacgccgagcggcgcggcuuuagagggagccggcgccuuaauagacggaaaaagcaucgcgugaaaagaguccgggaucuguucgaaaaguacggaauugugacggacuuucgcaaccucaaucugaaccccuaugagcuuagaguuaagggccugaccgaacagcucaaaaaugaggagcuguucgcugcccugcggacaaucuccaagcgcagaggcaucucuuaccucgaugacgcugaagaugacagcaccggguccacagauuaugccaaaucuauugacgagaaccggcgccugcuuaagaauaaaaccccuggacaaauccagcuggaaagacucgagaaguacggccagcugcgggggaacuuuacaguguaugaugagaauggagaagcgcacagacuuauuaacgucuucagcaccuccgacuacgagaaggaagcccgcaaaauccuggagacgcaggcugauuauaauaagaaaauuaccgccgaauuuaucgacgauuacguggagauucucacacaaaagcggaaauacuaucauggcccggggaacgaaaagagcagaaccgacuacggacgcuuccggacagacggcaccacgcuggaaaacaucuuuggcauccugauugggaaaugcaauuucuaucccgaugaguacagagcuucuaaggccuccuauacagcgcaggaauacaacuuucucaaugaccugaacaaucuuaagguuagcaccgagacaggaaaacugucuaccgaacagaaggagucccucguggaguucgccaaaaacaccgcuacacugggcccugccaagcugcugaaagaaaucgcuaagauucucgauuguaaggucgacgagaucaaaggguaucgcgaagaugacaagggaaaacccgaucugcacacguuugagccuuaccggaagcugaaauucaaucucgaaagcauuaacaucgacgaucugucuagagaggugaucgacaaacuugccgauauucugacccucaauacagagcgcgaaggcaucgaggacgccauuaagcggaaccugcccaaucaguucaccgaggagcaaaucuccgagauuaucaaggugagaaagagccaguccacagcuuuuaacaaaggguggcauucuuucagcgcgaaacuuaugaaugaacugaucccugagcucuacgccaccuccgacgaacagaugacgauucugacacgccuggagaaguuuaaggucaacaagaaaagcucuaagaauaccaaaaccaucgaugaaaaggagguuacagacgagauuuauaacccggugguggcuaaauccguccggcagaccaucaagauuaucaacgccgccgugaaaaaguacggagauuucgacaagauuguuaucgaaaugcccagagauaaaaaugcugacgaugagaagaaauuuaucgacaagcggaacaaagaaaauaagaaggagaaagaugacgcccucaagcgcgcggcuuaucuguacaacagcucugauaaacuuccugacgaaguguuccacggcaauaagcaacuggagacaaaaauuagacucugguaucagcagggcgagcggugccuguacagcgggaagcccaucuccauucaagaacugguccacaacucuaauaacuuugagaucgaucauauucuuccucucagccuguccuucgacgacagccuggccaauaaggugcucguuuaugccuggacgaaccaggaaaaaggacagaagacccccuaccaggugaucgauucuauggacgcugccugguccuuuagagagaugaaagauuacguccugaagcaaaaaggccuugggaagaagaaacgcgacuaucugcucacaaccgaaaauaucgauaagauugaggugaaaaagaaauucaucgagcggaaccuggucgacacaagauacgcuagccgcgugguucuuaauucucuucaguccgcccucagagaacugggaaaggauaccaaagugagcgucgugcggggccaguuuacgucccagcugcgcagaaaguggaagauugacaaaucucgggagaccuaucaccaucacgcgguugaugcccucaucauugcugccagcucccaacugaaacuuugggaaaagcaggacaacccgauguucguggauuacgggaagaaucaggucguggacaaacagacaggcgagauccugucugugagcgaugacgaguauaaggaacucguuuuucaaccucccuaccagggauucgucaacaccaucuccagcaagggcuucgaggacgaaauucuguuuucuuaucagguggauuccaaauacaaccgcaaggugagcgacgcuacaaucuacucuaccagaaaagccaagauugggaaagauaagaaggaggaaacguauguccugggaaaaaucaaggacauuuacucccagaauggcuucgauacauuuaucaaaaaguauaacaaagacaagacccaauuccuuauguaccagaaggauagccucacaugggagaaugugaucgagguuauucugcgggacuauccuaccaccaaaaagucugaagaugggaaaaacgacgugaaguguaaucccuuugaggaauaccgcagagagaacggacugaucugcaaauauagcaagaagggcaaagggacacccauuaagucccucaaauacuacgauaagaaacugggcaauuguaucgacauuacgccugaagagagccggaacaaggucauccuucagucuauuaauccguggcgcgcggacguguauuucaaccccgagacccugaaauacgaacucaugggacugaaguauuccgaucugagcuuugagaagggcacagggaauuaccacaucucccaagaaaaauaugacgccaucaaggagaaagaaggaauuggcaagaaaucugaguucaaguuuacccuuuacagaaacgaucucauccugauuaaggacaucgcuagcggggagcaggaaauuuaucgguuccuguccagaacaaugccuaauguuaaccauuacguggagcucaaacccuacgauaaggaaaaauuugacaauguccaggagcugguggaggcccuuggagaagcugauaagguuggccgcugcaucaaagggcugaacaagccuaacaucucuauuuauaaggugcggaccgacguccucggcaauaaauacuucgugaagaaaaagggagauaaacccaagcuggacuuuaagaacaauaaaaaguga

SEQ ID NO: 3985 - RNA, 3393 nt, Artificial Sequence
  Cas9 variant
augaccaacggcaagauccuggggcucgacauuggaaucgccagcgugggcgucgggauuaucgaggcuaaaacaggaaagguugugcacgccaauuccagacuguucucugcggcuaacgccgaaaauaacgccgagcggcgcggcuuuagagggagccggcgccuuaauagacggaaaaagcaucgcgugaaaagaguccgggaucuguucgaaaaguacggaauugugacggacuuucgcaaccucaaucugaaccccuaugagcuuagaguuaagggccugaccgaacagcucacaaaugaggagcuguucgcugcccugcggaccaucuccaaacgcagaggcaucucuuaccucgaugacgcugaagaugacagcacaggguccaccgauuaugccaagucuauugacgagaaccggcgccugcuuaaaacaaagaccccuggacaaauccagcuggaaagacucgagaaauacggccagcugcgggggaauuuuacgguguaugaugagaacggagaagcgcacagacuuauuaaugucuucagcaccuccgacuacgagaaggaagcccgcaagauccuggagacacaggcugauuauaacaaaaagauuaccgccgaauuuaucgacgauuacguggagauucucacacaaaaacggaaguacuaucauggcccggggaaugagaaaagcagaaccgacuacggacgcuuccggacggacggcacaacccuggaaaacaucuuuggcauccugauugggaagugcucuuucuaucccgaugaguacagagcuuccaaagccagcuauacagcgcaggaauacaacuuucucaaugaccugaacaaucuuaagguuccuaccgagaccggaaagcugucuacagaacagaaagaggcccucguggaguucgcuaaguccacggccacccugggccccgcuaaacuucugaaggaaaucgccaaaauucucgauuguaaggucgacgagaucaagggguaucgcgaagaugacaaaggaaagccugaucugcacacauuugagcccuaccggaaacugaaguucaaccucgacagcgugaauauugauuaccugucuagagaagugcuugacaaacuggccggcauccucacccugaacacagagcgcgaggggaucgaagaugcuauuaagcggaaucuuccuaaccaguucaccgaggaacaaaucuccgagauuaucaaugucagaaagagccaguccacggcguuuaacaaaggauggcauucuuucagcgccaagcugaugaaugagcucauuccggaacuguaugcuacauccgacgagcagaugaccauccugacccgccucgaaaaauuuaagguuaaaaagaaaagcucuaaaaacaucaagacaauugacgagaaagaaaucaccgaugagauuuacaaucccgugguggccaaguccguccggcagacaaucaaaauuaucaacgccgcugugaagaaauauggcgacuucgauaagauuguuaucgagaugccuagagacaagaaugccgaugacgaaaagaaguuuaucaacaaacggaacaaggagaauaaaaaggaaaaggaugacgcgcugaaacgcgcugccuaccuuuauaacggcacggauaagcugcccgacgagguguuccacgggaauaaacaacucgaaaccaagauuagacugugguaccagcagggagagcggugccuguauagcggcaaaccuauccccauucaagagcuuguccacaacucuaauaacuuugaaaucgaucauauucucccgcugagccuguccuucgacgauucucucgccaauaaggugcugguuuacagcuggacaaaccaggagaaggggcagaaaaccccuuaccaggugaucgacuccauggacgcugccuggagcuuuagagaaaugaaggaguauguccuuaaacaaaagggacugggcaaaaagaagcgcgauuaccuccugacaaccgaaaauaucgacaaaauugaggugaagaaaaaguucaucgagcggaaccuggucgauacgagauaugcuucucgcgugguucuuaauucccuccagagcgcccugagagaacuggggaaagacaccaaggugucugucgugcggggccaguuuacaucccagcuccgcagaaaauggaagauugauaagagccgggagaccuaccaccaucacgcgguugacgcccugaucauugcugccuccucucaacuuaaacugugggaaaagcaggauaaccccauguucguggacuauggaaauaaccaggucguggauaaacagacaggcgagauccucagcguguccgacaaugaguacaaggaacugguuuuucaaccucccuaucagggguucgucaacaccaucucuagcaaaggauucgaggaugaaauucuguuuuccuaccagguggacagcaaguacaaccgcaaggugucugaugcuacgaucuauuccacaagaaaagccaagauuggcaaagacaagaaagaggaaaccuacguccuugggaagaucaaggacauuuauagccagaauggauucgauacauuugugaaaaaguacaacaaagacaagacccaauuccucauguaucagaaagauccccugaccugggagaauguuaucgaggugauccugggcgacuacccuacaacgaagaagucugaagaugggaaaaacgacgucaaguguaauccguuugaggaauaucggcgcgagaacggccucauuugcaaauacuccaagaaaggaaagggcacccccaucaagagccugaaauacuaugauaagaaacuugggaauuguauugacaucacaccugaagagucuagaaacaaggugauucugcagagcaucaaucccuggcgggcggauguuuacuucaacccugagacccucaaauaugaacugaugggacugaaguacuccgaccuuagcuuugagaaaggcacagggaauuaucacauuucucaagaaaaguacgaugccaucaaggagaaagaaggaaucggcaagaaauccgaguucaaguuuacccucuaucgcaacgaccugauucugaucaaagacauugcuagcggggagcaggaaaucuacagauuccucucccggacgaugcccaaugugaaccauuacgucgagcugaagccguaugauaaggaaaaauuugacaaugugcaggagcuuguugaggcccugggcgaagcugauaaggugggaagaugcauuaaaggccucaacaagccuaacaucucuaucuacaaaguccgcacagacgugcuggggaauaaguauuucgugaagaaagagggagauaagcccaaacuggacuuuaagaacaauaaaaaguga

SEQ ID NO: 3986 - RNA, 3396 nt, Artificial Sequence
  Cas9 variant
auggcccagcacguguucggccuggacaucgggauugcuagcgucggaugggccauccucggcgagcaaagaauuaucgaucuggggguucggugcuuugacaaggcggaaaccgcuaaagagggagauccccuuaaccugacacgcagacaggcccggcuccugcgcagacggcuuuaccgcagagccuggcggcugacgcagcucucccgccugcugaagagaaaaggccucauugcugacgccaagcuguucgcuaaagccccuucuuauggggauagcgcgugggaacuucggcgccagggacuggacagacuccugaccccgcuugagugggcccgggugaucuaccaucaauguaagcaccgcggcuuucauuggacauccaaggcugaagaggccaaagcugauucugacgccgagggcgggagagugaagcagggacuggcgcacaccaaagcccucaugcaggcuaagaauuaucggagcgccgcugaaaugguccuggccgaguuccccgaugcccagagaaacaaacgcggccaauacgacaaggcucugucccgggugcuccugggggaagaacuugcgcugcucuuugccacacagagacgccugggaaauccucaugcuucugauuucuuugagaagcugauccugggcgacggggaucggaaaagcggacucuucuggcagcagaagcccgcccuguccggcgccgaccugcucaaaaugcugggcaagugcaccuuugaaaaaggggaguauagagcuccuaaggccagcuucucuguugaacgccacguguggcuuacacggcugaacaaucucagaauugucguggacggacgcucccggccccugaacgaggcggaaagacaagcugcccuucugcucccuuaccagaccgagacgagcaaauauaagacccugaagaaugccuuuaucaaagcuggccuguggggagaugggguucgcuucggcgggcucgccuacccgucucaggcucaaauugacgccgagaagacaaaagaucccgaagaccaguuucuggugaaacuuccugcguggcacgagcugcggaaggccuucaaggcugccggacaugaagcucucuggcagcagaucuccacccccgcccuggauggcgacccuacacugcuugaucaaauugcgaccguccucagcguguacaaggacggcgccgaggugguccagcagcugagacagcuggcucuccccgaaccggccgcuucuaucgccguucuggagaaaauuuccuucgauaaguuuagcucccuuucucugaaagcccuccggcgcaucgugccucugaugcaaagcgggcugagauaugacgaggcuguggcgcagauccccgaauacggacaccauucccagcggauugagccuggcgccgcuaagcaccuuuaucucccucccuucuacgaagcccagagaaaauaugccgggaagggagaucacaucggcagcaugcaauuucgcgacgacgcugauauuccccggaacccggucgugcugagagcccugaaucaggcgcgcaagguugugaacgcucucaucagagaguacgggucucccauugccgucaauaucgaaauggcccgggaccugucccgcccucuugaugagagaaacaaagugaagcgggcucaggaggaguuccgcgacagaaaugaucgggcccgcagcgaguuugaaagagacuucggcuauaaacccaaggcggcugccuuugagaaauggaugcuguaccgggagcagcucggacaaugugccuacucucagcagccucuggauauccaacgcguucuggacgaucauaacuaugcucagguggaccacgcccuucccuacagcagauccuaugaugacucuaagaauaacaagguccucgugcugacgcaugaaaaccagaauaaaggcaaccggacagcuuucgaguaccugaccagcuuuccggauggggaagacggagagagauggcgcacauucgucgccugggugcagggcaauaaggcguaucggauggccaaaagaaaccgccuccugcggaagaauuacgggguugacgaauccaaaggauuuauugauagaaaccuuaaugacacccgcuauaucugcaaguucuuuaaaaacuacguggaggagcaccuucaacucgcugcccgggcugauggcgacaccgccagacgcugugucgugguuaaugggcagcugacagccuuccugcgggcuagauggggccuuacgaaggugcggggagauagcgaccgccaucacgcgcucgaugccgcugucguggccgccugcacccacggcauggugaaggcucuggccgacuacucuagacggaaagaaauuuccuuccugcaggagggguuuccugaucccgaaacaggagagauccucaacccugcggcuuucgaccgcgccagacagcauuuucccgaaccuuggacccacuucgcccaugagcugaaggcucggcuuuuuacagaugaccuggccgcgcucagagaggauaugcaacgccugggcagcuauaccacggaagaccuggggcggcuuagaacacuguucguuucucgcgcuccccagcggagauccggaggcgccguccacaaagagaccauuuacgcccagccggaaagccucaagcagcaagggggcgugaucgagaaaauccugcucaccucccugaaacuucaggacuuugauaagcugcucaauccugaaucuaacgaccacuucguggagccccaucgcaaugagcggcuguaugcugccauuagacagcgccuggaacaauuuggaggcagagcugauaaggccuucgggcccgacaaccuuuuucacaagccugauaaaaauaaccagccgacaggacccgucgugcggagcaucaagcugguucgcggcaaacagaccgggauuccuaucagaggaggccucgcgaagaacgacuccaugcugcggguggauauuuucacaaaggccgggaaauuucaucucguccccguguacguucaccaucgcgugacgggccugccuaauagagcuaucgucgccuucaaggacgaggaugaauggacccuuauugacgagucuuucgcuuuucuguucagcguguaucccaacgauuacguuaaagugacacucaagaaagagcagcaauccggauauuacagcggcgccgaccggucuaccggggccaugaaucugugggcucacgacagagcggccuccgucggaaaggauggccugauccgcgggaucggagugaagacagcucuuagcguggaaaaauuuaacgucgacguucugggccggauuuaccucgccccucccgagaccagaucuggccuggccuga

SEQ ID NO: 3987 - RNA, 3399 nt, Artificial Sequence
  Cas9 variant
auggcccaguacguguucggccuggacaucgggauugcuagcgucggaugggccguucucgaugcgcaaagaaucguggaccugggcgugcggugcuuugauaaggcugagaccgccaaagaaggggacccccuuaaccugacacgcagacaggcccggcuccugcgcagacggcuuuaucgcagagcuuggcggcugacgcagcucgcccgccuguucaagagagagggacugauugaugacgcuaaacucuuugccaaggcgccuuccuggaccgaaaaugccugggagcugcggcuucgcggccuggaucaccuccugacaccgcuugaaugggcuagagucaucuaccaucuguguaaacaccggggguuccauuggaccucuaaggccgaggaggcuaaggccgaaagcgacgcggagggaggccgcgugaaacagggccucgcccacacaaaggcucugaugcaaguuaaaaacuauagauccaccgccgaaauggugcuggcugaguuucccggggcccagcggaauaagagaggacaguacgauaaagcccucucucgcguccugcuuggcgaggaacuggcucuccuguucgcgacacagcggagacuugggaacccucaugccagcgagcacuuugaacaacugauucucggacacggcgaccgcaaguccgggcuguucuggcagcagaagcccgcucugucuggagccgaucuccugaaaaugcuuggcaagugcaccuuugagaaaacggaauaucgggccccuaaggcuagcuucuccgccgagagacauguguggcugacccgccucaauaaccugcggaucguuguggacggcagagcgcgcccccuuaaugaugcugagcggcaggccgcccugcuccugccuuaccaaacagaaaccuuuaaauauaagacacugaaagcugccuucgucaagguggggcucuggggagacggcgugagauuugggggacuggcuuacccgagccaggcccaggcggaggccgaaaaggcuaaagaccccgaggaucaauuccuugucaagcugccugccuggcacgaacuccgcaaggcuuucaaagccgcgggccaugaggcccuguggcagcagaucucuaugcccgcucuggaggaagacccuacccuucucgaucagauugccacgguucuguccguguacaaagacgggacagaggugguccaacagcugcggcagcucgcucugcccgaaccggaugccagcaucgccgugcuugagaagauuagauuugacaaguucucuucccugagccucaaagcucugcggcgcaucguuccucugaugcagggaggccuuagauaugaugaagcgguggcccaaauucccgaguacggccaccacucucagcggaucgacccuggggcuaccagacaucucuaucugccucccuuuuacgaggcccagcgcaaguaugccggaaaaggcgaucggauuggguccaugcaguucagagaagacgcugaugucccccgcaacccggugguucugagagcccucaaucaagcgcggaagguggucaacgcucugauccgcgaguacggaagccccguggccgucaauaucgaaauggccagagaccuuucccggccucuggacgagcgcaacaaagugaagagagcucaggaggaauuucgggaucgcaaugacaaggccagaucugaguucgaacgggauuuuggcuauaaacccaagggggcgguuuucgagaaauggaugcucuaccgcgaacagcugggccagugugcuuacagccaacagccucuggacauucagagagugcuugaugaccccaacuaugcccaagucgaucacgcccucccguacucccggagcuaugacgauucuaagaauaacaaagugcugguucugacaagagagaaccagaauaagggaaaccgcaccccuuuugaguaccucaccuccuuccccggcggggaagacggagagcgguggagagcuuuuguggccuggguccagggcaauaaggcuuaucgcauggccaaacggaacagacugcuucgcaagaauuacgggacagaugaaagccggggauucaucgacagaaaccugaaugauacgcgcuauauuugcaaauuuuucaagaacuacguggaggaacaucuccagcuggcggcccggaccgacggcgacacagcuagacggugugugguugucaaugggcaacugaccgccuuccuucgcgcuagauggggccucgccaaagugcggggagauucugaccgccaccaugcccuggaugcugcgguggucgccgcuugcacacacggcauggugaaggcccuggccgacuacagcagacggaaagagaucgcuuuucuccaggagggguucccugaucccgaaaccggagagauucugaaccuugccgcguuugacagagcucgcgaacacuucccugagcccuggccgcauuuugcccacgaacugaaggccagacucuucaucgaugaccugguugcucugcgggaggauaugcagcaucuuggcuccuaugcccaggacgaucuggaccgccuccggacgcuguuugugucuagagcgccucaacgccggaaugggggagcuguccacaagggcacaaucuacgcccagcccgagaaccucaaacagcaggggagcaccauugaaaagauccugcuuaccggccugaaacuccaagauuucgacaagcugcugaaucccgaguccagcgaccacuuuguggaaccucauagaaacgagcgccuuuaugccgcuauuagacggcgccuggaggaguucggaggcaaagccgauaaggcuuuugggccggacaagcccuucuacaaaccugauaagaauggacagcccacaggcccuaucguuagaucuauuaaacucgugcgggggaagcagaccggaauccccauccgcggcgggcuggccaaaaacgacuccaugcucagagucgauguguuuacaaaggcgggcaaguuccaccugguuccuguguauguccaucaccgggugacgggacuucccgacagagccauuguggcuuucaaagaugaagaagaguggacccugaucgacgaaagcuacgccuuucucuucucugucuauccgaacgauuuuguuugugugcaacagcgcggcaagccucugauugagggguacuacgcuggacuggaccgggccaauggcaacaucaaugugugggcccaugauagagcugcguccgucgggaaagacggacuuauucgcggcaucggcgugaagacagcccugagccucgagaaacugaacguugacgugcucgggcggauuuaucccgcuccucccgaaaccagacggggacuggccuga

SEQ ID NO: 3988 - RNA, 3399 nt, Artificial Sequence
  Cas9 variant
augaagaaaauccugggcguggaccucgggauuaccagcuucggauacgccauccugcaggagacaggcaaggaucuuuauagaugccuggacaacuccgucguuaugcggaauaaccccuacgaugaaaaaucuggggagagcucccaaucuauucgcagcacgcagaaguccaugagacggcucaucgaaaaacgcaagaagcggauuagauguguggcucagaccauggagcgcuauggaauccuggacuacucugaaacaaugaaaaucaaugauccuaagaacaauccgauuaaaaacagauggcagcuucgggccguggacgcguggaagcgcccccugagcccucaagagcucuuugcuaucuucgcccacauggccaaacauagaggcuauaaguccauugcuaccgaggaucugaucuacgaacuggagcucgaacuggggcuuaaugaccccgagaaggagagcgagaaaaaggccgaugagcggcgccaggucuauaacgcucugagacaccucgaagaacugcggaaaaaguacggaggcgaaacaauugcccagaccauccaucgcgcgguggaggccggcgaccuuagaucuuaccggaaucacgaugacuaugagaaaaugauuagacgcgaagauaucgaggaagagaucgaaaagguucugcuccggcaggcugagcugggggcccugggacucccugaggaacaaguguccgagcugauugacgaacuuaaagcgugcaucacagaccaggagaugcccaccauugaugaaagccuguuuggcaaguguacguucuacaaggacgagcucgccgcgccugccuauucuuaccuguaugaucuuuacagacuguauaaaaagcucgcugaccugaacaucgauggguacgaggucacccaggaagaccgcgagaaagugauugaauggguugagaagaaaaucgcccagggaaagaaucugaagaaaaucacacauaaggaucuccggaaaauucugggccuugcuccggagcaaaagaucuuugggguggaagacgagagaauugucaaaggaaagaaggaaccccgcaccuucgugcccuuuuucuuucuggccgauaucgccaaauucaaggagcucuuugcuuccauucagaaacacccugacgcgcugcagaucuuccgggaacuugccgagauccugcaaagaagcaagacaccucaggaggcucucgaucgccugcgggcccugauggccggcaaaggcauugacaccgacgauagagaacuccuggagcuuuuuaagaacaagcgcucugggacgcgggaacugucccacagauacauccucgaggcucugccccuguuccuugaaggauaugacgagaaagaggugcagcggauucucggcuucgaugaccgcgaagauuacagcagauauccgaagucccugcggcaucugcaccucagagaggggaaucuguuugaaaaagaggaaaacccuaucaauaaccaugccgucaagucucuugcgagcugggcucugggacucauugccgaccuguccuggcgcuacggccccuucgaugagaucauucuggagacaacccgggacgcccuuccugagaaaaucagaaaggaaaucgauaaagcuaugcgcgaaagagagaaggcccucgacaagauuaucgggaaauauaagaaagaguuucccagcauugauaagcggcuggcucgcaaaauccagcugugggaaagacaaaagggacucgaccuguacucuggcaagguuauuaaccuuucccagcugcucgauggcagcgccgacaucgagcacaucgugccccagucucuugggggacugagcacagacuauaauaccauugugacccugaaauccgucaacgcggccaagggcaaucggcucccuggggauuggcuggcuggaaacccggacuaccgcgaaagaaucggcaugcugucugagaaagggcucauugauuggaagaaacggaagaaucugcuugcccagagccuggacgaaaucuacacagagaacacgcacuccaagggcauucgcgcuaccagcuaucucgaggcccugguggcgcaaguucugaaaagauacuaucccuucccugaucccgaacuucggaagaauggaaucggcgugcgcaugaucccugggaaagucacaucuaagaccagaucccuccugggaauuaaaagcaagucucgggagacaaacuuucaucacgccgaagacgcucugauccucuccacccugacgagaggcuggcagaaucgccuucaucggaugcugagagauaacuacggaaagagcgaggccgaacucaaagagcuguggaagaaauauaugccccacauugaggggcugacacuugcugacuacaucgaugaagccuuccgccgguuuauguccaagggcgaggaaucucuguucuauagagacauguuugauaccauucgcagcaucuccuacuggguggacaaaaagccgcucucugccagcucccauaaagagaccguuuacagcucucggcacgaagugccuacacugagaaagaauauccucgaggcuuucgauucccugaacgucauuaaggaccgccacaaacuuaccacagaggaauuuaugaagcgguaugacaaagagaucagacagaagcuguggcuccaucggauugggaauacgaacgaugaaagcuaccgcgcgguggaggagagagccacccagaucgcucaaauucugacacgguaucagcugauggacgcccagaaugauaaagaaaucgacgagaaguuccagcaagcccuuaaggaacugauuaccucucccaucgaggucacaggcaaacuccugcgcaagaugagauuuguguacgauaaacucaacgcuaugcagaucgaccggggacugguugaaaccgauaagaacaugcuuggcauucacaucuccaaagggccuaaugagaagcugauuuucagacgcauggacgugaacaaugcccaugagcuccagaaggaacggagcggaauccugugcuaucugaacgagaugcuuuucauuuuuaauaaaaagggccugauccacuacgggugucucagaucuuaucuggaaaaaggacaaggcagcaaguacaucgcucucuucaacccccgcuuuccugcuaaucccaaagcccagccguccaaguucacgagcgauucuaagauuaaacaggucgggaucggcuccgccaccggaauuaucaaggcucaccuggaccuugauggccaugugcggagcuacgagguuuuugggacacugccugaaggauccauugagugguucaaagaggaaucuggcuaugggagaguggaggacgacccccaccauuga

SEQ ID NO: 3989 - RNA, 3402 nt, Artificial Sequence
  Cas9 variant
auggaccugaacuacagaaucggccucgauauugggaucgccagcgugggaugggcuguccuggagaauaacuccaaggacgaacccguucggauuguggaucuuggcgugcgccuguucgaggccgcggaagucccuaaaaccggggcugcccucgccgagccgagacgggaagcucgcacaacgagacggcgccugagacggcgcaagcacagacuugagcggaugaaauggcugcuccaggaguauggacugauccaaaccgaagaguuuaugaagcgcuaccauucugccggccugcccgacguguauagacuccgguacgaagggcuggagcgcaaacuuaaggaugaggaacuggcucagauucucauccacaucggaaagcauagaggcuuccggagcacaagaaaagccgagcugaaggacaaaaaugauaaggaaaccggcgcgguucuuuccgccacacgcgagaacgaaaaacugauggaggagcacggguaucggaccgcuggagaaaugauuuacaaggacgauaaguuuagaacaggcugcaccuggaaagaggaaggguaucgccucacgccucggaauaaggagggagacuacaaaaacaccaugcugagagcccugcucgaagaugaggugaaggucaucuucgacugucagcgcaaauuuggcaaucagaaggcuucugaggaacuggagaaagccuaccuugcgauuaugacaagccaacgguccuucgauauggggcccggaaagcagccugacggcucugccagccccuaugcuauggaaggcuuuggggacagagugggacugugcgcccucgagccucgcgaaaagcaggagccgcgggcucccaaagccgccuacaccuccgagcuguucguugcgcuucagaagaucaaccaucugagaauuacagagaaaaauggcaaggggcgcggacucaccagcgaggaacgggagagacugucugaucugcuccacaaaaagaaggagcugacguauggcgcugugcggaaagaacuucaacuggaccuccgcuacagauuuaacacacugaauuauuccagcaagaaaaugaccgaggaagagaagaucaaagaugccgaaaaggcuaaguucgucucuauggugucccacuacgaguaucggaaaagaaugagcgggaugcuugagcagcugucuccugaagaacaggccgaccucauggaugaagugggaaagauucugacacuguacaaaaacgacgauacccgcucccgggaguuucagaagcucggccuggacagcgaaaucaccgaggagcuucuggaacucaaucccagaggcuuccaacaugucucccugaaagccaugaagaagcugaugccuuaccuuaaagaggggcucacauaugauaaggcuugugccgaagcgggauacgacuuucagggcucuguucagaaagagcgcagcagacugcugaaggggaaagaaaucacggauauuaucaacgacauuaauaaccccguggugaagcgguccgucagccaaaccgugaaaguuaucaacgcuauuauccagaaguauggaucuccgcaggccgugaauaucgagcucgcccgcgagauguccagaaacuacgacgaacggcgcaagauggagaaacagaugaaggauagacaaagcgaaaaugagcgggcuaaaaaggagauucaggaacugggcaacgccuucccuacagggcaggacauccuuaaauaucgccuguggcacgaucaggacggcauuugcauguacucugcuaagagaaucccccucgccgagcuguucaccggagcguaugauauugaccauauccugccuuacagcaucacauuugaugacuccuaccggaauaagguccuugugaccucugaagagaaccgccaaaaaggcaaucggauucccuaugaauacuucgggagcgauuccgagagauggagcaaguuugagacgcucguuaacucuagaauccgcgacuaucggaaacagcagaaucugcugaagcaguccuucacagaagaggaaagaaaagaguuuaagcaacgcaaccucaaugauaccaaguacauuacccgggugaucuauaacaugauuagagaaaaucuggcccuugcucccuacaacagcccuggcaaaaagaaacaggucuucgccgugaauggaggggucacagcuuaucugcgcaagcgguggggaaugucugccaaagacagauccaucgauacccaccacgcgcgcgacgccgugguuauugcuuguugcacagacggcaugauccagaagaucagccggaacauucaggggagagagcuccuguacgcccggggcuuuacggcuguggaugucgagaccggagaaaaguucacacgcgacgauuuuaccagagaccaaugggaugagaucuucggcgugcagguuccgaaacccugggaauacuuuaacgaggaacuggacauucggcuuggggagaauccuguggaguucaucgaaacacauuccgaugucucucgcaagcucgacuaucccgccugguuuuacgagaacaauauuaucagaccuguguucgugagccggaugcccaacagaaaaguuaccggagccgcucacgcggauacgauccgcuccccgcggcauuaucaggaaaccggcucuguccugacaaagaccgcccugauugaccucaaacugaauaagaaaacaggggagaucgagaacuacuauaagccugaaagcgauacccuucuguacaaugcucucaaggagagacuggaacuguauggaggcgacgggaaaaaggccuucgaggaacccuuuuacaaaccuaaggccgauggcucccgcggaaaccuugugcggaaagugaagacguacgacaagcucacacugggcgucuaugugaauagccaacacgggauugcugccaacgcgaauggaucuaugguuagaguggacgucuuccgcguguccggcaaauacuauuuuguucccguguacaucgcugaugucgugcggaagagacugccuaugaaagccguugugcaggggaagcaguauauugacuggaaagagauggaggauaaggacuucaucuuuagccucuacacccgcgaucugaucucuuucaaguccaaaaacggaaagaaagucacauguguggacggcaccagcaaggccgugaaugaagagauugucuauuacuacggggcuaacaucucuaccgccagcuuuuccggcaaaagccauaauggaucuuucgaauuuacaucccuuggcauucaggggcuggaguaucucaagaaguaccaaguugaugugcugggaaacgugagcgaagucaaaagagagaagcggaugggcuuccgcuga

SEQ ID NO: 3990 - RNA, 3402 nt, Artificial Sequence
  Cas9 variant
augggcggguucgagguggacagaaagaucagccugggacucgauauuggcgucuccucuguuggguacagcgugaucgacguggauaccggaaaaguccuggaacuuggcucccggcugauuaacgggaagaucggaacagagaaucaggcccgcagagaaaugcggggcacgcgcagacucauuaaccggaaaaagcaacgcagaaaagacaccgugaagcuguuuaaugaguucaaacuuaucgauucuaaaaaggacgaacacuauuuugaucauuucgcuaacaauagcgaccccuacgagcugcggguuaaaggccucuccgagaagcugucucugagcgaaaucgccgaugggcucuaucacauugugaaacgcagaggaaucuccuacgaccugaaggaugcggacgaggaaagcgagggcucugaguaugaaaacgggcuuaagauuaauaacuccgagcugaaaaaucagaccccugcucagauccagcucaagcggcugaacgaauacggagccauucgcggcaaagucgugaucgaugaggaaaagauucuucugaauguuuuuccgacaaaagccuaucucgacgaggcuaagagaaucaucgagaaacaacgggaguucuaccccgggauucugacagaggaauuugaggaaaaguacugccagauccugacccgcaagagagacuauuucgugggaccuggcagcgagaaaucucggacagauuacggcauuuauaaggaggacgggagaacccucaacaaucuguuugaagaacuuaucggacaugauaaaauuuaccccgaggaacugcgcgccuccggcgcuagcuucacggcccagcucuuuaacguccugaaugaccuuaacaaccugcacaucucuuccuaugaagaucagaagcucaccacagagaauaaagagcaaaucauuagcgaacugaaguccaccacaucuaacgugaauaugaugaagcugauccagaaaauugcggggugugaggaaagcgacaucuccggauaccggaccgauaagaacuauaaaccugagauuagcucuaugagaaucuaccgcaaggugcauaaaaagcuccuggaguccgaaaucgacauuacgaauuggcccgaugacuucaucaacaaacuuagcuuuauucugacacucaauaccgagaacggcgaaauccggaaucagcugaagaacagacuucagccugaguacgauuuccugacagacgaacucauucaaaccaucauugacaauaaggagucuuucgauaucaaaagcaacaauaaguggcaccgcuuuuccaucaaaaccauggagcugcugauuccggaaaugaucaagcggcccgucgagcagaugacacucauuaacgaaauggggcugaucaaaaauucuggaaagaaguucagcaacuauaaguaccuuccuuauaagaaaauugccgaggacaucuacaaccccguugcuuccaagagcgugagagaagcccugaaaaucgugaaugcuauucucaaggaguauggccacaucgaguacauugucguggaaaugccucgcgauaagaacgaggacgaagccaaagaucagaucgagaaguuucaaaaagcgaauggccggcugaaggacgccgcucuggaagaguucacggaggccauuggggauaaaucuaccguugacaagaaacuuggagugcauagauccaagcuccuguuuaagauccgccugugguaucagcagcggggcauggaucucuacgaagggaaacccaucagcgcugucgaccugcuuaacaauccggauucuuuccagauugaccacaucauuccucaauccgugagcuuugaugacuccuucaacaauaagacacugugcaacucuggacucaaucagaucaaagacaagaagacccccuuugaguacaugaacgaaggcuaugggcagggcuucgauagcaugaaagccaugguuaugaagaauccuagaauugaccauaacaaacggaagaauuaccuguuuuccgagaacgugucugauaucgagacacgcaaaagauucaucagccggaaucuggucgacaccagauaugccucccgcgugguccuuaacaaccuccaggaauuuuucaaggagaaggaaagcgauacgaaaauuucuaucauucggggaaaguucacauccaaucugagaaaacacuggaagaucaacaaaaaucgcgacaccuaccaccaucacgcuauugaugcgaccaucauugccgcuacacccuuucugaacaucuggaagaaaggcagcucuaucuuccccuccaauguggagagcgaagacuuuuucgauauuaagaccgggaagaucauuggaaacgacgaguuuaauaaauaugccuacgaugagccuuauaacggcuucuacaaugaacucagaaacgccacagaccggaucaaguuuucucaucaaauugauaaaaagaugaaucgcaaaguuagcgacuccacgaucuacagcaccagaguggcuaagucuccgaagaacaaaaaggaguccgaauauaucgucgccaaaauuaagaauaucuacgacgcggaugaguaugcuaaauucaagcggauuuacgacaaggauaaaacaaaguuucugcuuaacaaauaugacccccgcagcuucaaucaccuggaaaagaucaugaacaccuacccugauuccauugagagaacaaugucuaacaauaaagugaagguugugcggaucagccccuuugagcucuaucgccaggaccaugggccugucaagaaauacuccaagaaaaacaauggacccgaaaucaagcagcugaaauaccuggauaagaaggugggcucuagcauugacgugaccccggauaacgccaaaaauaagcacguuauccuuaaaucccucaagccuuggagaacggacauuuaucugaaccacgagaccggggaauacgagaucaugggcauuaaauauucugaucugaaguucaauaaaggagaaggcuacgggaucaagaaggccaaauaucucgagauuaagcaucgggagaaagucagcgacgacuccgaauuuauguucacacuguacaagaaaaaccgcaucaagguggagaauauggaaaccgaugagagcguggagaugcuuuucuggucuagaacaauggacucccagaagggauaugcugaacugaaacccaucuacaaguacaaaaccgaggaugacaacuggccuauuuauggcaaugccaagaaacaaaucauuaagaagcucauccccaaaaacuguaagauuuggaaagucaauacggaugugcuggggaacccuuuuuacguugaaaaggagggagaauaucccaaagacgugcuggauuga

SEQ ID NO: 3991 - RNA, 3405 nt, Artificial Sequence
  Cas9 variant
augaacggccuggugcucgggcuggacaucggaauugccagcgucggcguugggauccuugagaaaaauuccggaaaaauugugcacgcuucuagcagaaucuuccccgccgcgaccgcugauaacaauguggaacggcgcaagaacagacaggcccggcgccugcauagacggaaaaagcaccgcggcgccagacucaaagaccuguuugaguacuaugggcuucugacagauuucuccaaggucucuauuaaucucaacccuuaccggcugcgcguggacggacuggaucaacagcucacgaaugaggaacuguuuaucgcucuuaagaacaucguuaaaagacggggcauuagcuaucuggacgaugccuccgaagacggcgggaccgugucuagcgauuacggaaaggcugucgaggagaaucgcaaacuccuggccgaacagacaccgggccagauccaacuugagagauucgaaaaguaugggcagcugcggggagacuuuaccgugguugagaacuccgagaaaugccgccucauuaauguguucagcacaucugcguacaagaaggaagccgagagaauccugcggaaacagcaggaauuuaacaaucaaauuaccgaugaguucaucgaagacuaucugaagauucucacaggcaaaagaaaguacuaccaugggcccggaaacgagaaaucccgcaccgauuauggccgguuuagaacggacggcgcuacccuggacaauaucuucgggauccuuauuggaaaguguacauuuuacccuaacgaguaucgcgccagcaaggcuucuuacaccgcccaggaguucaaccugcucaaugaucugaacaaucuuacaguccccaccgaaacgaagaagcuguccgaggaacagaaaaagacaaucauugaauaugcgaaaagcgccaagacccucggcgcuucuacacugcugaaauacaucgccaagaugauugacgcuuccguggaucagauccggggguauagaguggacgucaacaauaagccugagaugcacaccuuugagguuuaccgcaaaaugcaaagccucgaaaccaucuccgugggagagcugucucggaacauucuugaugaacuggcccauauccucacacugaauacggagagagaaggcauugaggaggccaucaacaccaaacuucgcgacagcuucucccaggaucaggugcuggaacucguccaauuccggaaaaauaacagcucucuguuuuccaagggguggcacaauuucagccugaaacucaugauggagcugauucccgaacuuuacgagacaucugaggaacagaugaccauccugacaagacucggaaagcaaaagagcaaagagaccuccaagcgcacgaaauauaucgacgaaaaggaggugacagaagagauuuacaacccuguuguggcuaaaucuguccggcaggcgaucaagauuaucaaugaggccaccaagaaacacggcauuuuugauaacaucgugauugaaauggcuagagagaauaacgaagaggacgccaagaaagauuauaucaagcggcagaaagccaaccaggacgaaaaguacgcugccauggagaaagcggcuuuccaguauaauggcaagaaggagcugccggacaacaucuuucaugggcacaaagaacuggccaccaagauucgccuuuggcaucagcaaggagagaaaugccucuacacaggcaagagcauccccauuuccgaucugauccacaaucaguauaaauacgaaauugaccacauccugccucucagccugucuuucgaugacucccuuagcaacaagguucuggugcucgccaccgcuaaucaggagaaggggcagagaacacccuuucaagcccuggauucuauggacgaugcuugguccuaccgggaguucaaaagcuaugucaaggaauccaaacugcuuggaaacaagaaaaaggaguaccuccugacggaagaggacaucucuaagauugaagugaaacagaaguuuaucgagagaaaucuggucgauacccgcuauagcucccgggugguucucaacgcccugcaggacuucuacaaaaaucauaacuuugauacaaccauuucuguggucagaggccaguucacaagccaacuucgcagaaagugggggcuggagaaaucccgggaaaccuaucaccaucacgcgguggacgcccucaucauugcugccagcucucagcugcgccuguggaagaagcagaauaacccucuuaucgcuuacaaagagggccaauuuguugauucccagacgggagaaaucauuagccucaccgacgacgaguauaaggaacugguguucaaagcccccuacgaucauuucgucgacacacugucuuccaagaccuuugaggauagcauccucuucucuuaccagguggacagcaaauuuaauagaaagauuuccgaugcgacaaucuaugccacccggaaagcuaagcuggacaaggagaaaaaggaauacacguauacacuuggcaaaauuaaggauaucuacagccuggggaccaaaacaccgucuaagaccggauucuauaaguuucucgaccuguacaacaaagauaagucccaguuccugauguuucaaaaagaccgcaagaccugggaugaggugaucgaaaagauuauggagcaguauagaccuuucaaggaauacgacaaggccggcaaacuuguugauuuuaaucccuucgagaaguaccggcaggagaacgggccuauccgcaaauauagcaagaaaggaaacggccccgaaauuaagucccucaaguacuaugacauccugcuggggaaacacaagaauauuacacccgagggcucuagaaacacggucgcucuccugagccuuaauccuuggcggaccgacguguacuauaacauggaaaccaaaaaguacgaguuucugggacucaaauaugccgaucugccguucgaagagggcggggccuacggaaucuccacagagacauacaaugaacugcgcgagaaggaaggcauugggaagaacucugaguuuaaauucacccuuuauaagaaugaccugauccucaucaaagauacggagacaaacugucagcaauucuuuagauucuggagccggaccggaaaggacaaucccaaauccuuugaaaagcacaaaauugagcugaagccuuacgaaaaggcuaaauucgagaagggcgaggaacucgaggugcuggggaaagugcccccuucuagcaaccaguuucagaagaauaugcagaucgaaaaccuuuccauuuauaaagucaagaccgauguucugggcaauaagcauuucaucaaaaaggagggagacaaacccaagcucaaauuuuga

SEQ ID NO: 3992 - RNA, 3405 nt, Artificial Sequence
  Cas9 variant
augaacggccuggugcucgggcuggacaucggaauugccagcgucggcguugggauccuugagaaaaauuccggaaaaauuauccacgcuaacucuagacuguuccccgccgcgaccgcugauaauaacguggaacggcgcaagaauagacaggcccggcgccucaacagacggaaaaagcaucgcggcgugagauuucaagaccuguucgaggauuacgggcuucugacagacuuuagcaaagucuccauuaaucucaacccuuaucggcugcgcguggauggacugaaucagcagcucacgaacgaggagcuguucaucgcccuuaagaauaucguuaagagacggggcauuucuuaccuggacgaugcuagcgaagacggcggggccguguccucugauuauggaaaagcugucgaggagaaccgcaagcuccuggccgaacagaccccgggccaaauccagcuugagagauuugaaaaauacgggcaagugcggggagacuucacaguuguggagaauggcgagaagcugcgccucauuaacgucuuuagcaccuccgcguauaaaaaggaagccgagagaauccugcggaagcagcaggaguucaauaaccagauuacagaugaguuuaucgaagacuaccugaaaauucucaccgggaagagaaaauauuaccacggacccggcaacgaaaagagccgcacagauuacggccgguucagaaccgacgggacgacccuggacaauaucuuuggaauccuuauuggcaaaugcacauucuauccugaggaauaccgcgcuucuaaggccuccuauaccgcucaggaguuuaaccugcucaaugaucugaacaaucuuacagugcccaccgaaacgaaaaagcugagcgaggaacagaagaaagugaucgucgaguacgccaaggaggcgaaaacacucggggccucuacccugcugaaguauauugcuaaaaugaucgacgccuccguugaucaaauucggggauacagaguggacgugaacaauaagccugaaaugcauacauucgaggucuaucgcaagaugcagagccucgaaaccaucucugugggcgagcugucccggaacguucuugaugaacuggcucacauccucacccugaauacagagagagaggggauggaagaggccauuaacacgaaacuuaaggacagcuucucccaggaucaagugcuggaacucguccaguuucgcaaaaauaacucuagccuguucuccaagggauggcauaauuuuagccugaaacucaugauggagcugauccccgagcuuuacgaaaccucugaggaacagaugacaauucugacccggcucggcaagcagaaguccaaagagacaagcaagagaaccaaauacaucgacgaaaaggagcugacggaggaaauuuauaacccugugguugccaaaucugugcgccaagcuaucaagaucauuaaugaggcgacaaagaaacacggcaucuucgauaacauugucaucgaaauggcccgggagaacaaugaagaggacgcuaagaaagauuacauuaagagacagaaagccaaccaggacgagaagaaugccgcuauggaaaaagccgcguuucaguauaacgggaagaaggagcugccggacaauaucuuccacggacauaaagaacuugcuaccaagauucggcucuggcaccaacagggcgagaaaugucuguacaccgggaagacaauccccaucagcgaucugauucauaaccaguauaaauacgaaaucgaccacauucucccucugucccuuucuuuugaugacagccuguccaauaaggugcucguccuggccaccgccaaccaggagaagggacaacgcacacccuuccaggcucuggauagcauggacgaugccuggucuuauagagaguuuaaauccuacgugaaggaaagcaaacuucucggcaauaagaaaaaggaguaccugcugacggaagaggacaucucuaagauugagguuaaacagaaguucaucgaacggaaccucaucgauaccagauauuccagccgcgugguccugaaugcccuucaggacuuuuacaaagcucacaaguucgauacaaccauuuccgugguucgggggcaauuuacaucucagcugagacgcaaauggggccucgaaaagagcagagaaaccuaucaucaccaugcgguggacgcccugaucauugcugccuccucucagcugcggcuuuggaagaaacaaaacaauagccucaucuccuacaaggagggacaguucgucgauagcgaaacgggcgagauuaucucucugaccgacgacgaguauaaagaacugguguucaaggcuccuuacgaucacuuuguggacacacuccgcuccaaaaaguucgaggauagcauccuguuuucuuaucagguugacuccaaauucaacagaaagauuagcgaugccaccaucuacgcgacacggaaggccaaacuugacaaggaaaagaaggaguacaccuauacgcuggggaaaauuaaggauaucuacucucucggaacaaaggcucccagcaaaaccggcuuuuauaaguuccuggaccuguacaauaaagauaagucccaguuucuuauguuccaaaaagaccgcaagacaugggaugaagucauugagaagaucauggagcaguauagaccguuuaaagaauacgacaagaccgggaaacucguggauuucaacccuuuugagaaguaucggcaggaaaacggacccauccgcaaauacagcaagaagggcaaugggccugagauuaaaucucugaaguacuaugacauccugcucggcaaacauaagaacauuacccccgaaggauccagaaauacaguggcccugcuuagccugaaccccuggcggacggacgucuacuauaauauggagaccaaaaaguacgaguuccucggccugaaguaugcugaucugccuuuugaagaagggggagccuacggcaucuccacagaaaccuauaacgagcuucgcgagaaagaagggauuggaaagaacucugaguucaaauucacacuguacaagaaugaccucauccugauuaaagauaccgaaacgaauugccagcaaaucuuuagauucuggagccggacaggcaaggacaacccgaaauccuuugagaagcacaagaucgaacucaaacccuacgagaaggccagauucgagaaaggggaggagcugaaggugcuuggcaaaguuccucccucuagcaaucagcugcagaagaacaugcagauugaaaaucucuccaucuauaaggugaaaaccgauguccugggaaacaagcacuuuauuaaaaaggagggcgacgaaccuaaacugaaguucuga

SEQ ID NO: 3993 - RNA, 3405 nt, Artificial Sequence
  Cas9 variant
augaacggccuggugcucgggcuggacaucggaauugccagcgucggcguugggauccuugagaaaaauuccggaaaaauuauccacgaaaacucuagacuguuccccgcugccaccgcggauaauaacguggagcggcgcaagaauagacaggcucggcgccucaacagacggaaaaagcaucgcggcgugagauuucaagaccuguucgaagauuacgggcuucugacagacuuuagcaaagucuccauuaaucucaacccuuaucggcugcgcguggauggacugaaucagcagcucacgaacgaggaacuguucaucgcccuuaagaauaucguuaagagacggggcauuucuuaccuggacgaugccagcgaggacggcgggaccgugccguccgauuauggaaaagcugucaaggagaaccgcaaacuccuggccgaaaagacacccggccagauccaacuugagagauuugaaaaauacgggcagcugcggggagacuucaccguggaggagaauggcgaaaagugccgccucauuaacguguuuucuacaagcgcuuauaagaaagaggccgaaagaauccugcggaagcagcaggaguucaauaaccaaauuaccaacgaauuuaucgaggauuaccugaaaauucucacagggaagagaaaauauuaccacggaccuggcaaugagaagucccgcaccgacuacggccgguucagaacggaugggaccacacuggacaacaucuuuggaauccuuauuggcaaauguaccuucuaucccgaagaguaccgcguuagcaaggcgucuuauacagcccaggaauuuaauauccugaacgaccucaauaaccugaccgucccuacggagacaaagaaacuuuccgaagaacagaagaaagauauuguggaguacgcuaaggaaaccaaaacacugggggccagcacccuccugaaguauaucgcuaagaugauugacgccucuguggaucagauccggggauacagagucgacguuaauaacaaacccgagaugcauaccuucgaaguguaucgcaagaugcaaucccuggagacaaucagcgugggcgaacucucucggaauguccuggaugagcuugcgcacauucugacgcucaacaccgagagagaagggaucgaggaagccauuaauacaaaacugaugggaguguucucccaggaccagguucuugagcuggugcaauuucgcaagaacaauagcucccucuucucuaaaggcuggcauaacuuuagccugaagcugaugauggagcucaucccugaacuguacgagaccuccgaggagcagaugacaauucuuacccggcugggcaagcagaaaagcaaggaaacgucuaaaagaacaaaguacaucgaugagaaagaggucaccgaagagaucuauaauccggugguugcuaaguccgugcgccaggccauuaagaucauuaacgaagcuaccaaaaaguacgggaucuucgacaacauugucaucgagauggcccgggaaaauaacgaggaggaugccaaaaaggacuauauuaaaagacaaaaggcuaaucaggaugaaaagaacgcggccauggagaaggcugccuuucaguacaauggaaagaaagaacuccccgacagcaucuuccacggccacaaggagcuggccacaaaaauccggcuguggcaucagcaaggggaaaagugccuuuauaccggcaaaaacauuccuaucucugaccucauucacaaucaguacaaguaugagaucgaucauauucugccccugagccucuccuuugacgauucucugagcaacaaggugcuuguccuggcuacagccaaucaggagaaaggacagcgcacgccuuuccaagcgcucgacuccauggaugacgcuuggagcuacagagaauuuaagucuuacgugaaagauuccaagcugcugagcaacaaaaagaaggacuaucuucucaccgaggaagauaucucuaaaaucgagguuaagcagaaauucauugagcggaaucugguggacacaagauacuccagccgcgucgugcugaacgcccuccaggauuuuuauaaggcccacaaauucgacaccacaaucuccguugugcgggggcaguuuaccucucaacugagacgcaaguggggccuugaaaagagcagagagacguaccaccaucacgcugucgaugcccugauuaucgcugccuccucucagcuccggcuguggaaaaagcagaauaacccccugauuaccuauaaagaaggacaauucguggacagcgagacaggcgaaaucaucucccuuaccgacgaugaguacaaggagcucguguucaaagcgccguaugaccauuuuguugauacacugcgcagcaagaccuucgaagacucuauucuguuuuccuaccaggucgauagcaaauucaauagaaagaucucugacgccacgauuuacgcuacacggaaggccaaacucgauaaggagaaaaaggaauauaccuacacacuggggaaaaucaaggacauuuauucccuuggaaccaagaccccuagcaaaacaggcuuuuacaaguuccuggaucucuauaacaaagacaagucucaguuucugauguuccagaaagaucgcaagacgugggacgaggugaucgaaaagaucauggagcaauacagacccuuuaaagaguaugauaagaccgggaaacugguggacuucaacccuuuugaaaaguaccggcaggagaauggacccauuuguaaauacagcaagaagggcaacgggcccgaaaucaaaucccuuaaguauuacgacauucuccugggcaaacacaagaauaucacaccugagggaagccgcaacaccgucgcucugcucucucugaauccguggagaacagauguguauuacaacauggaaaccaaaaaguaugaguuccuuggccugaaguacgccgaccuccccuuugagaaagggggagcguauggcauuuccacggaaacauacaauaagcugcgggagaaagaagggaucggaaagaacagcgaguucaaauucacccuguacaagaaugaucuuauucugaucaaagacaccgagacaaacugccagcagaucuuucgcuucugguccagaaccggcaaggauaauccuaagucuuuugaaaaacauaagauugagcucaaacccuaugaaaaggcccgguucgagaaaggggaggaacuggagguucucggcaaggugccucccagcuccaaccaauuucagaagaauaugcagaucgaaaaccugucuauuuacaaagucaagacagacgugcuuggcaaaaagcacaucauuaaaaaggagggagaugaaccgaagcugaaauucuga

SEQ ID NO: 3994 - RNA, 3405 nt, Artificial Sequence
  Cas9 variant
augaaguacaucgagagcguguccauuggcuucgacaucggggucggaucuguuggcuaugccgugauuaacagcaaaaccaagcagauccuggaauccggggugucuauuuuucccgcugccgucgcgcagaaaaauguggagagacgggaaagccgccaguccagacggcuccgcagacggcgcguuaacagacugaaugaucuuaagaaacugcucaagaagaacggauucaucccuucuccgaauaaaaaccccuacgagauccgggugcgcggccuggaacaccagcuuagcagagacgagauugcuaucgccguccugcauauugccaagcggcgcgggaucuccuauagccucgaugacgugguugaugagaaugugacagacuuuaaaggaaagauugcuaaaaaccaggaagcccugaagaauaagacgccuggcgagauccaauacgaaagacugcucaaauauggcaagguccgggggaccgugacaaacuacguggaguaugaugagcagcccgaauacuuccugaaugucuuuccuaacucugcuuacguugacgaggccaaacgcauucuuaccugccagaagcaguauuaccccgaaaucacagaugaccugaucgagaauauugugaaaaucauuuccagaaagcgggcguauuacaucggaccuggcaacgagaaaagcagaaccgauuaugggauuuaccgcacaaauggagaaacccucgagaacaucuucgaaauccugauuggcaaggacucugugaacccggaugagcuucgggcccccgcuaauucccugacggcccaagucuauaaccuccugaaugaccugaccaacaucagauacaaugggagcgaacgccucacaccugagcagaagcaggacauucugucugaacuucugaccacagagaaaaccgugcagaugcucaacguuaucgcuaagaaagugaaugucaagaaagaggaaauuuccggauuucggacgaagaaggaugacaaacccgauuuccacacacuggagguguacagaaagguucgcaaacauaugcuuaacaagggcaucgacaucaaugaauggccuaccgaguguuuugaugaacuggccuucauuuuuaaccucaauacagagaucggcgagauucggaacagaaucagcgaaaaagugguccccaaguaugacuucauuaccaaucaaaucguggaugaccugcuggaggauccgaagauuuuugcgaucuccaccucucagaaauggcaccgcuucagcaucaagacaaugaacguccucauuccugaacugcuuaauggguacaacgagcagaugacgauccugacccggaugggacuccuggaggacuccaaaaacgauuauagcaauauugacaagaucgacauuaaaaacgugacagaaaauaucuacaaccccguugugagaaagucuaucaagaaaugccuuaagauuuucaaugagcuguauaaaaaguacccuaacaucuccgaugucgugauugaacucccccgcgaggacaaucccgaagaugcccggaaacugaucaagaaaaugcaaaaggagaaccugguugagaaggacaccagccucgaggcuuuuagaaaagaagccaaucugucugaaaacggccuuauugauuuccugcggaaggggaaaaaucgcgcucucaagaucagacugugguaucagcaggagggaaaaugucuguacacaggcgaaccuauccuugccgaggaccucugcaagaacgaggccaauuacgauauugaccauaucauuccgaucagcguguccuuugaugacucuauuaacaauaagguccuguguagcucccacuucaaccgguuugaaaaagagaagaaaacccccuucgaauauuuuagcaacaagucuucccaccuggggagauacagcaauuucgaugaguuucgcgcuucugugaacgcgaauaaacggaucuccgacgugaagagaaagaaccuccugagcaaagaacuucuguccgaucucgacacgcgcaagaaauucaucgccagaaaucugguugacacacgguaugcuucucgcgucguguuuaacgagcugacccaguucuuugccagcaagaaagccgauaccaagguggcugucauuagaggaaaguucacaucccaacuucggcgcgccuggcagcucaauaaaucuagagacaccuaccaucaccaugcgguggaugcugcccugaucggcguuacaccuuuccugaagauuuggcggagcggcaaaacgaucuauccccgcaagaugaccgaggcccagacagacuuugaacucaacgagauuaccacaaaugaugaguucaaagaauccuacuaucagcugccuugcccccaauuucuugacuaccugacccagaugcaggagaaccucaagaucaauuucgaaguggauaaaaagaugaacagaaagauuagcgacgcuaugaucuacucuucccggaaaaagaaacugagcaaggauaaaaaggagaaggaauauucucuggggacgaucaaugacauuuacuccgaugccggauauagcaaauuuaagaacaucuacaaaaaggacaaagagaaguuccuuauguaucaccucgaucacaagucuuuugaaauucuggaggacaucauuagccaguacccggacaaagaggaauauaucgauuccgagggcaaggucaaacaacgcgcugugagcccuuucgaaaucuacagacggaaguacggguauauuagaaaauacucuaagaagaauaacggacccaucauuaaaaacaugaaguauuacaaugagaaccugccuaaaaucuauauugacaucacccccaagcaguccaucgauaaaaagguuuaccucacaaauauuagcccuuggcgcaccgacguguauuacaaccggucccaaaauucuuaccauaucaugggcauuaaguauagcgaucugagauacaucgacgggaaauauggcauucccaagaacgucuacgaaaagaucaaacuucgcgagaaaauuccguccgagucugaauuuuguuucagccuguauaagaaugaucgggugaaaaucaucgacccuaacaagaaugaggaaauugagcucagauuuaacucccgcacacugcccucuguucugaauuacguggaguucaagccccuuuuucaggaaagcuauaacucccucacccugcugccugucuucagcaaaacgacaucugagggacggaucauuaagaaauucaccagagaagauaauaucguguacaaggugaacacagacgagcucggcaauccguacuauauucugaaagaaucccaaaaccccaagaauaucaucgauaacagcaacaagaccgaguga

SEQ ID NO: 3995 - RNA, 3405 nt, Artificial Sequence
  Cas9 variant
augaacggccuggugcucgggcuggacaucggaauugccagcgagggcgucgggauccuugaaaagaacuccggaaaaauuauccacgcuaauucuagacuguuccccgccgcgaccgcugauaauaacguugagcggcgcaagaauagacaggcccggcgccucaacagacggaaaaagcaucgcggcgugagauuucaagaccuguucgaagauuacgggcuucugacagacuuuagcaaaguguccauuaaucucaacccuuaucggcugcgcgucgauggacugaaucagcagcucacgaacgaggaacuguucaucgcccuuaagaauaucgugaagagacggggcauuucuuaccuggacgaugcuagcgaggacggcggggccguuuccucugauuauggaaaagcuguggaggaaaaccgcaagcuccuggccgagcagaccccgggccaaauccagcuugaaagauuugagaaauacgggcagguccggggagacuucacagugguugagaauggcgaaaagcugcgccucauuaacguguuuagcaccuccgcguauaaaaaggaggccgaaagaauccugcggaagcagcaagaguucaauaaccagauuacagaugaauuuaucgaggacuaccugaaaauucucaccgggaagagaaaauauuaccacggacccggcaacgaaaagagccgcacagauuacggccgguucagaaccgacgggacgacccuggacaauaucuuuggaauccuuauuggcaaaugcacauucuauccugaagaguaccgcgcuucuaaggccuccuauaccgcucaggaauuuaaccugcucaaugaucugaacaaucuuacaguccccaccgagacgaaaaagcugagcgaggagcagaagaaagugaucguggaguacgccaaggaagcgaaaacacucggggccucuacccugcugaaguauauugcuaaaaugaucgacgccuccgucgaucaaauucggggauacagaguugacgugaacaauaagccugagaugcauacauucgaaguguaucgcaagaugcagagccucgagaccaucucugucggcgaacugucccggaacgugcuugaugagcuggcucacauccucacccugaauacagagagagaagggauggaggaagccauuaacacgaaacuuaaggacagcuucucccaggaucaaguucuggagcucgugcaguuucgcaaaaauaacucuagccuguucuccaagggauggcauaauuuuagccugaaacucaugauggagcugauccccgaacuuuacgagaccucugaggaacagaugacaauucugacccggcucggcaagcagaaguccaaagaaacaagcaagagaaccaaauacaucgacgagaaggagcugacggaagagauuuauaacccugucguggccaaaucuguucgccaagcuaucaagaucauuaaugaagcgacaaagaaacacggcaucuucgauaacauugugaucgagauggcccgggaaaacaaugaggaggacgcuaagaaagauuacauuaagagacagaaagccaaccaggacgaaaagaaugccgcuauggagaaagccgcguuucaguauaacgggaagaaggaacugccggacaauaucuuccacggacauaaagagcuugcuaccaagauucggcucuggcaccaacagggcgaaaaaugucuguacaccgggaagacaauccccaucagcgaucugauuuauaaccaguacaaauaugagaucgaccauauucucccucugucccuuucuuuugaugacagccuguccaauaagguccucgcccuggccaccgcuaaccaggagaagggacaacgcacacccuuccaggcccuggauagcauggacgaugcuuggucuuacagagaauuuaaauccuacgugaaggaccuuaaaagccucucuaauaagaaaaaggauuaucugcugacggaggaagacaucuccaagauugaggucaaacagaaguucaucgagcggaaccucguggauaccagauacagcucccgcguugugcugaaugcccuucaggacuuuuauaaaucucaccaauucgauacaaccaucagcgucgugcggggccaguuuacaucccagcugagacgcaagugggggcucgaaaaaucuagagagaccuaccaccaucacgcgguugacgcccugauuaucgcugccagcucccaacugcggcuuuggaagaagcagaacaauccucucauuacguauaaagaaggccaguucguggacagccagaccggagagaucauuucucugacagaugacgaauacaaggagcuggucuucaaagcucccuaugaucauuuuguggacacccucuccagcaagacauucgaggauucuauccuguuuuccuaccaaguggacagcaaauucaaccgcaagaucucugaugccaccauuuacgcgacgagaaaagccaaacuugacaaggaaaagaaggaguauacauacacccugggcaaaaucaaggauauuuauagccucgggacaaaaaccccguccaagaccggauuuuacaaguuccuggaccuguauaauaaagauaagagccaguuucuuauguuccagaaagaccggaagacaugggaugaaguuaucgagaaaauuauggaacaguaccgcccuuuuaaggaguaugacaagacgggcaaacucgucgacuucaaccccuuugagaaguacagacaagaaaacgagccuauccggaaauacucuaagaaagggaauggacccgaaaucaagucccugaaguauuacgauauucugcucggcaaacacaagaacaucacccccgaggggagccgcaauacaguggcucugcuuucccugaacccuuggagaaccgacguguauuacaauauggaaaccaaaaaguaugaguuccucggccugaaauacgccgaucugccguuugaggaaggaggcgcuuaugggauuucuacagagacguacaacgaacuucgggagaaggagggaaucggcaagaauagcgaguucaaauucacacuguacaagaacgaccucauucugaucaaagauaccgaaaccaauugccagcagauuuuucgcuucugguccagaacagggaaggacaaccccaaaucuuuugaaaagcauaaaaucgagcucaagccuuaugaaaaggcccgguucgagaaaggagaggaacuggagguccuuggcaaggugcccccuagcuccaaucagcugcagaaaaacaugcaaaucgaaaaucucucuauuuacaagguuaaaaccgaugugcuggggaacaagcacuuuaucaagaaagagggcgacaagcccaaacugaaguucuga

SEQ ID NO: 3996 - RNA, 3408 nt, Artificial Sequence
  Cas9 variant
augagcgaccuggugcucggccuggauaucgggauuggauccgucggcguugggauccuuaacaaggugaccggagagauuauccacaaaaauucuagaauuuuccccgccgcucaggccgaaaacaaucuggagcggcgcacaaacagacaaggccggcgccucacgagacggaagaaacaucgcagagugcggcugaaucaccuuuuugaagagagcgggcugaucaccgacuucacaaaggucuccaucaaccucaauccuuaccagcugcgcgugaaaggacugaccgcggaacucucuaacgaggagcuguuuauugcucuuaagaauaugguuaagcauagaggcaucagcuaucuggaugacgccuccgaugacggcaacucuagcgugggggauuacgcccagauugucaaagaaaauuccaagcagcucgagacaaaaaccccgggacaaauccagcuggaacgguaucagaaguacggccagcuucgcggggacuucacaguggaggaggauggaagaaaacaccggcugauuaacguuuuucccaccagcgcuuaucaugccgaagcucuccgcauccugcaaacgcagcaggaguucaauccucagauuaccgacgaauuuaucaacucuuaccuggagauccucacaggcaagagaaaguauuaccacgggcccggaaaugaaaaaucccggaccgauuacggcaaguauacaaccaaaaaggacgcccaaggccaguacauuacgcugaacaacaucuucgggauucuuaucggaaaaugcacauuuuauccugaggaguacagagcggccaaggcuagcuauaccgcccaggaguucaaucugcucaacgaucugaauaaccuuacagugcccaccgagaccaaaaagcugucugaagaacaaaaguaccagauuaucacauaugucaaaaaugaaaaggcuaugggcccugccaaacucuuuaaguacaucgcgaaacugcuggccugugacauugcugacaucaagggguaccgcauugauaaguccgacaaagccgagauccacacguucgaggcuuaucggaagaugaaaacccucgaaacaauugauaucgagcagaucgaaagagagaagcuggacaaacuugccuacgugcugacccucaacacagaacgcgagggcauucaggaggcccuggaucaugaauuugcugacggaaccuucagccaagaacagguggaugaacuuguccaguuccggaaggccaauucuuccaucuuugggaagggauggcacagcuucuccguuaaacugaugauggagcucauuccggagcuguaugcgacgucugaggagcagaugacaauccugaccagacucggcaagcaaaagaccacaagcuccagcaacaagaccaaauacauugacgaaaagcagcugacagaggaaaucuauaaucccgugguggcuaagucuguccgccaggccauuaaaaucgugaacgccgcuaucaagaaauacggcgauuuugacaauauuguuaucgagauggcccgggagacgaacgaagaugacgagaagaaagcgauucagaagauccaaaaagcuaauaaggccgaaaaggacgccgcuaugagaaaagccgcuaaccaguauaaugggaaggccgagcuuccucauuccguguuccacggacacaaacagcuggcgaccaagauucgccucuggcaucagcaaggcgaacggugccuguacacagggaaaaccaucagcauccacgaucugauuaacaaccccaaucaguuugagaucgaccauauucuuccucucucuaucacauucgaugacagccuggccaacaagguccugguguacgcuaccgccaaucaggagaagggacaaagaacgcccuaucaggcucucgauuccauggacgaugccuggucuuuucgcgaacugaaagcguucguucgggagagcaaggcccuuuccaacaaaaagaaagaauaccugcucaccgaggaagacauuagcaaguuugaugugagaaagaaauucaucgagcggaaucuggucgacacacgcuaugcuucuagagugguccugaacgcccuucaggagcacuuuaaggcucauaaaaucgauaccaagguguccguugugcggggccaguucacaagccaacucagacgccacugggggauugacaaaacccgggauacguaccaccaucacgccgucgacgcccugaucauugcugcgucuucccagcugaaucucuggaagaagcagaaaaacacacuggugagcuauuccgaagaccagcuucuggauaucgagaccggcgaacucauuucugacgaugaguacaaggagagcguuuuuaaagccccguaucaacauuucguggacacacugaaguccaaagaguucgaagauucuauccuguuuagcuaccaggucgacuccaaguucaauagaaaaaucagcgaugcuaccauuuacgccacccgccaggccaaggugggaaaggacaaaaaggaugaaacauaugugcuuggcaaaaucaaggacauuuacgcucucgggacgaaaaccccuucuaagacaggauuuuauaaguuccuggaucuguacaacaaagacaagucccaguuucucguuuaucaaaaagauagaaagaccugggacgaggucaucgagaaaauuauggaacaguaccggcccuucaaggagagcgacaagaauggcaaagaaguggauuuuaacccuuucgagaaguaucgcaucgaaaaugggcccauuagaaaauacucucggaagggaaacggccccgagaucaaaucccugaaguacuaugccagcaaacuugggaaucacaucgacauuacaccuaaagauucuaacaacaaggugguccugcagagcguguccccguggcgcgcggacguuuacuuuaauaaaaccacgggcagcuaugaaauccucggacugaaguacgcugaucugcaauucgagaaaggcacagggaccuauagaauuucugaggaaaaguacaacgacaucaagaaaaaggagggaguggauuccgacagcgaauuuaaauucacccuuuauaagaaugaucuccugcugauuaaagacacagagaccaaggaacagcggcucuuucgcuuccuguccagaucuaugcccaacaaaaagcacuacgucgagcuuaagccuuacagcaaagauaaguucgagaaaaaugaaucccugaucgagauccucggcucugccgacaagagcgggcgguguauuaaaggacuggccaaguccaaccugucuaucuuuaaggugcgcacagacguucuuggcaaucagcauauuaucaaaaacgaaggggauaagcccaaacuggacuucuga

SEQ ID NO: 3997 - RNA, 3408 nt, Artificial Sequence
  Cas9 variant
augggcgugaucuuccuguacgagaacauugucaagcccuuuccuagcagauaugacaaagccaucaugaagcggcucaaagggcgccagaccaugggauacauucugucccuugauaucggcauugcuucuugcggguauagcguucuggaaacagacgcccucggagugccguacaagaucaaaacgcuuaauuccaucauuuucaccagagcggagaaccccaagacaggcgcuucucuggccgaaccucggcgcaaguauagaggggcccggcgcagaaaacggcgcaccagcuuuagaaagcaccggacacgccaacuguucaucaccuccggacuccugucuaaacaggauauugcuagauaccugaaucagcaggagccccaugacgauaucugggaacuccgggugaagggccuggacgagccucuuacaaaccugcaacucuuucagguccuguauuacuucgugacccaccgcggcuuuaaaagcaauagaaaggccgagcuuaaggauaaagacauugggcccguucugaacuccaucaaugcuuucaaggaagagaugcagagccaugauuaccggacgauuggagaacucuaugccaacgacccuagauuucgcgaucggaaacacaauaaggacuacaccaacggcuuccuggggacaauccagagaucuuggcugguggaugagaucaaaaugcuccugaccaaucaacaguccuuuggaaacacacagcuuaccagcgaguucauugaacuguaucucaauaucuuuacgucucagcgcaacuucgacgacggcccggcguccgggcccuacagcggagaucugauugacaagauggucggcccugauacauucaaucggucuagaaaacgcgcccccagagcuaccuauacauuucaauacuucuccuuucuuagcaagcugaacucccucagaaucgccccuucuauuagcgcucccuucgagacccugaccguggaccagcgcgcccugaucacaaagcggcucuggggcccggauguuaaauccgcggaccugaaguuuaaacagaucagaauggugcuuagccugccugaaacggcccgcuucaaccucgucaauuaugggaacacccccgagaaggcucuggaaauugaggauaaaacaaccuuuaucucuauuaagccucuucgggagaucgaaaaggcccugacaggaaccacgcuccccgugucccaugaccaacuggaugcuauugccagaauccugacaguguacaaaagcgacucuaaucggaagaccgccuuccacaaccagaccguccucagcgaugagguuaucgaacagcugcuuccccugaauuuuuccaaauucggccaccucucuguggagacaaugcaggaaauuaucccuuaccuggagcaagggaugguguauagcgacgcugcgaccgccgcuggauacgacuuucgcaacaaucagauugauauggaguauaucagagacaacgucacaaauccggugguucggagagccguguccgucgccaacaagcuggugaaagcuguugugcgccgguacggcaagcccgauagcauucauaucgaacuugccagagaccucucucagaauuuccaggagcgcagacaagaugaaguccggcagcagaagaacgcgcgcgacaaugagaaaauugcuaagagacuggaagaacuggggaucccugugaacggagucaauaucacgaaaaugaagcucuaugaugagcagcacggcauugaccuguacgaucuuuccaccaacgccagcauggccgugacagacaucuuuucugaugaccgguaugaaauugaucauaucauucccuacuccguuagcuucgacgacuccuacaccaacaaagugcuggucucugcuaaggccaaucgcgagaagagagaucggaucccuauggaaguguucggcaacgacagcgagcgcagacggcaauuugagaaucgcguuaacacaaauaucaccaaccuccggaaaaagcggaaucugcugaaagaaacguucuccgaugaggacaaggcuaaauggaagucuagaaacauuaaugauacccgcuaucuuaaccggauccucaugaauuaccugagccagaacguggaauuuacagacguccuguccgaugccaaacacgugauugcgcucaauggggccgugaccgcuaagaucagaagccgcuggggaauuacaaagguucgggccgcuggcgaccugcaccaugccgucgaugcgguggugaucgggugugucaccgacgcccuuauccaggcugugacgagauaugccaaauaccaggagcgccgggauaacaaggcugccgccgaacaagaccuggcugagaauaaccccgaggaacucgaugcgaaacaguucagaaagguuuuuaacgacuauccgcugccuuggcccgaguuccgcgaggagcugaugggacgggugucuuccgacccuagccagauuauggccggcagacaauggucucacuacacagcugaagagaucuccgagcuuaaacagcccuuugucgugcggguuccuaaucaucgcauuguggggcccgccacccucgauacagucuauggccagccgaacccugacgauggacugaucacccagagagugcggauuaccgaccugaagccccaaaagaauaaagauggcgaagacaucaucaaggccggggcuaacguuuacgagcucgccgcggauggaggcaauaaacugguguacgaaagcauucuugacgcucugcaggucgccgggggagauggcaagaaagccuuccccacagggcgccuccuggugagaucuccuauccaggacauuccgguggagcgggucagaguuacgagcaaggcuacccugguggugcccgucggcccuaaguccguggccgcgaacggaagcaugguucgcaucgauguguauaaaacacccaagaaauacgucuuugugccuauuuauguucgggacaccgugaaggcugaacuucccgacagagccgucgccccugugaaacccuacucucagugguaucaacuccagccgaaggaucaguuccuguuuucccuguucgcuaaugaccucauccgcuuuaagcacccucggggcguuagcacaaaagagauucugaccgaugggucccaggagaagggaaaaagaacggacguggucggcuacuucacaggggccgauaucgcuaccgccucuaucgcgauugaaggacccgaccgcagcuucuccgcccggggcaucggguuugcuucucuuaagaacguggagaaacugaccgugaauuauuucggcgaacuccauagcguccacgagacacaaccuaugcaguuuagaggacagcgcggcuga

SEQ ID NO: 3998 - RNA, 3411 nt, Artificial Sequence
  Cas9 variant
augaacggccuggugcucgggcuggacaucggaauugccagcgucggcguugggauccuugagaaggauaccggaaaaauuauccacgcuuccucuagacuguuccccgccgcgacagcugacaauaacguggaacggcgcagcaauagacagggccggcgccucaacagacggaagaaacaucgcuccgugagacugcaagaucuuuuugagucuuacgggcugcucacggacuucagcaagcuguccauuaaucugaacccuuaucagcuccggguccagggaauggaaaaucagcugaccaacgaggaacuuuuuaucgcccugaaaaauaucgugaagcgcagaggcauuucuuaccucgaugacgccagcgaggauggcgggacaguuuccagcgacuauggaaaggcuguggaggaaaaccggcgccugcuuaccgagaaaacaccgggccaaauccagcuggaaagauucgagaaguacgggcagcuccggggagauuuuaccgucgaggaaaauggcgagaaacgcagacugauuaacguguucucuacauccgccuaucggaaggaagcugagagaauccugcgcaaacagcaagaauuuaauaacaagauuaccgacgaguucaucgaggauuaccucacgauucugaccgggaagcggaaauauuaccacggacccggcaaugaaaagagcagaacagacuacggccgcuuucggaccgaugggacaacccuugacaacaucuucggaauccugauuggcaaaugcacguuuuauccugaggaauacagagccucuaaggcguccuauacagcccaggaguucaaccuccugaaugaccuuaacaaucugaccguucccacagaaaccaaaaagcucagcgaggagcagaaaaagaccaucauugaauacgcuaagucugccaaaacacugggggcuuccacgcugcucaaguauaucgccaaaaugauugaugcgagcguggaccagauccgcggauaccgggucgaugugaacaauaagccugagaugcauaccuuugaaguguauagaaaaaugcaaucccuggagacaaucaaggucgaagaacuuccccgcaagguucuggacgagcucgcccacauucugacccuuaacacagaacgggagggcaucgaagaggcuauuaauucuaaacugaaggauaccuucaacagagaccaggugcucgagcuggugcaguuccgcaaaaauaacagcucccuguuuagcaagggguggcauaauuucucucucaaacugaugauggaacuuaucccugagcuguacgaaacguccgaggaacaaaugacaauucucacccggcugggaaagcagagaagcaaggagaccucuaaacggacaaaguacaucgaugagaaagaacugaccgaggaaaucuauaacccggucguggccaagagcguucgccaggcuauuaaaaucauuaaugaggccacaaagaaguacggcaucuuugacaacauugugaucgaaauggccagagagaauaacgaggaagaugcuaaaaagaacuauauuaaacagcaaaaggcgaaucaggacgagaaaaacgccgcuauggaaaaggccgccuuccaguacaauggcaaaaaggagcuucccgauaacaucuuucacgggcacauggaacucgcuacgaagauccggcuguggcaucagcaaggagagaaaugucuguauaccggcaagaauauucagaucuccgaccucauucacaaccaguacaaauaugagaucgaccauauucugccucuuucucugagcuucgaugacucccucagcaauaagguccuggugcuggccacagcgaaccaggaaaaagggcaaagaacccccuuucaggcucuugauucuauggacgaugccugguccuaccgcgaguucaagagcuacguuaaggaaucuaaacuccugggaaauaagaaaaaggacuaucugcucacagaggaggauaucuccaaaaucgaagugaagcagaaguuuauugagaaaaaccuggucgacacccgguacagcuccagagugguccuuaaugcccugcaggauuucuauaagaaacaccaauuugacacgaccaucucugugguucgcggccaguucacaagccagcucagacggaaguggaaacuggaaaagucccgcgauaccuaccaccaucacgcuguggacgcccugauuaucgcugccucuagccaacuuagacucuggaagaaacauaacaauccucugauuuccuauaaggaugggcaguuugucgacagcgagacaggcgaaaucgugucucuguccaacgaggaguacaaagaacucguuuucaaggcgcccuaugaccacuucguggauacccugcggagcaaaaaguuugaggacucuauccuuuucuccuaccaggucgauagcaaauacaaucgcaagauuucugacgccacgaucuaugcuacaagaaaggccaaacuggauaaggacaaaaaggaauacaccuauacacucggaaaaauuaaggauaucuacgcucugggcaccaagaccccgagcaaaacaggguuuuauaaguuccuggaccuuuacaaaacggauaagucccaguuucucauguaucaaaaagaccggaagaccugggaugaggugauugaaaagaucaucgagcaguaccgcccuuucaaagaguacgacaagaacggaaaagaaguggauuuuaaccccuucgagaaguauagaauugaaaauggcccuauccggaaauacagccgcaaggggaacggaucuguuauuaaguccaugaaauauuacgacaaucugcugggcaaguuugucgacaucacacccagcgaguccaaaaaccccguggcccuccugucucuuaauccuuggagaaccgauguguauuacaacccggaaacacggaaguaugaguuccuggggcucaaauacgcggaccugugcuuuggcaagggaggcagcuacgggauuuccgaggucaaguauaauaaaaucagagaaaaggagggaauuggcaaagaaucugaguucaaguuuacccuguacaaaaacgaucuuauccugaucaaggacacggagacaaauugucagcaguucuuccgcuuuuggagccggaccgggaaagauaaccccaaguccuucgaaaagcauaaaauugagcucaagccuuaugaaaaagccaaguuugagaaaggagaggagcuggaggugcucggcaagguucccccuucuagcaaucaauuccagaagaacaugcagaucgaaaaucuguccauuuacaaagugaagaccgacguccuugggaacaaacacuuuaucaagaaagagggcgaugaacccaagcugaaguucaaaaaguga

SEQ ID NO: 3999 - RNA, 3411 nt, Artificial Sequence
  Cas9 variant
augaacggccuggugcucgggcuggacaucggaauugccagcgucggcguugggauccuuaagaaagauaccggagagauuauccacacaaauuccagacuguucucugcugccacggcggacagcaacauugaacggcgcagacaucggggcgggaagcgccucaccagacggaaaaagcaccgcuccaucagacugcaugaucuuuuugaggacucuggacugcucacagauuucagcaaaguguccaucaaucugaaccccuaccagcugcgggugcaaggccucgacaaucagcugaccaacgaagaacuuuuuauugcucugaagaauaucgucaagcgcagaggcauuucuuaucucgaugacgccagcgaagaugggggaacaguguccagcgacuacggcaaagccguugaggagaaccggaagcugcuugcugaacagaccccugggcagauccaacuggaucgcuucgagaaauauggacaggugagaggcgacuuuacagucguggaaaauggggagaagcggcgccucauuaacguuuucaccacgucugccuacuccaaagaggcugaaagaauccugcggaagcagcaggaguuuaauaagaaaauuaccgaugaguucaucgagaacuaucugacaauccucaccggaaagagaaaauacuaucacggcccgggcaaugaaaagagccgcacagacuacgggcgguacaccacgaaaaaggaccccgagggaaaauauauuacacuggauaacaucuuuggcauucuuaucgggaagugcaccuucuacccugacgaguauagagccucuaaggcguccuacacagcccaagaauuuaaucugcucaacgaucugaacaaucuuaccgugcccaccgagacgaaaaagcugagcgaggaacagaaaaagacaauuaucaaauaugcuaagaccgccaagacacucggagcuucuacccugcugaaauacaucgccaagcucauuggcgcguccgucgaccagauccauggguaucgcauugauccuaacaaaaagcccgaaaugcacacauucgagaccuaccggaaaaugcagagccuggagacgaucuccguggaagagauuccuagaaaggugcuugacgaacuggcccacauccucacacugaauaccgagcgcgaaggaaucgaggaggcuauuaacgccacccuuaaggauacauuuucucaagaccagguccuggaacucguucaguuccggaaaaauaacagcucccuguucagcaagggcuggcauaauuuuucucugaaacucaugauggagcugaucccggaacuuuacgagaccuccgaggaacaaaugacaauucugacgagacucggcaagcagaaaagcaaggagaccucuaagcgcacaaaauauaucgaugaaaaggagcugaccgaagagauuuacaaccccgugguggcuaaaagcguccggcaggccaucaagauuaucaaugaggccaccaaaaaguaugggaucuucgacaacauugugaucgaaauggcuagagagaauaacgaagaggaugcgaaaaagggauacaaugaacgccagaaggccaaccuggacgagaaaaaguccgcuauggagaaagccgccuuucaauauaauggcaagaaagaacuuccugacaacguuuuccacgggcauaaggagcucgcuacaaagauucggcuguggcaccagcagggagaaaaaugucuguacacgggcaagaacauccccauuucugaucucauccagaaucaauauaaauacgagaucgaccacauucugccucuuagccuguccuuugaugacagccucucuaacaaggugcugguccuggccaccgcgaaucaggaaaaagggcagagaacacccuuccaggcucuugauuccauggacgaugccuggagcuaccgggaguuuaagucuuaugugaaggaccucaaacugcuguccaacaagaaaaaggauuaccuccugaccgaggaagacaucagcaaaauugagguuaagcaaaaguucaucgaacgcaaucuuguggauacaagauauuccucucgggucgugcugaacgcccuccaggacuuuuacaaagagcaucaguucgauaccacgauuagcgucgugagaggccaguuuacaucccaacugcgccggaaguggggacuggagaaaucuagagaaaccuaucaccaucacgcuguugacgcccuuaucaucgcugccagcucccagcuccgccuguggaagaaacagaauaacccgcugauuagcuacaaggagggccaauucguggaccaggaaacaggggagaucauuucucucuccgaugacgaauauaaagagcuggucuuuaaggcgccuuacgaucauuucguggacacccuuaagagcaaaaaguucgaggauucuauccuguuuuccuaccagguugacagcaaauauaauagaaagauuucugaugccaccaucuacgcuacacggaaagccaagcucgacaaggagaaaaaggaauauacguacacccugggaaaaaucaaggauauuuaugcucugggcagcgaaaaacuuaagacaggguucuacaaguuucuccaccuguauaaaaaggacaaaucccaguuccugauguaccaaaaggaucgcaaaaccugggacgaggugaucgaaaagauucucgagcaguacagacccuuuaaggagaaagauaagaacggaaaagaagucgacuucaauccuuuugagaaguaucggaucgaaaacggccccauucacaaauacagccgcaaggggaauggccccgugaucaagucucugaaauauuacgacaagaacauuccugaguccuucaucaauaucacaccgagcaacuccaaaaacaaggugauucuuagacagcugaaucccuggcggaccgauguuuauuuuaaccaucagacggaaaaauacgagcuccugggacugaaguaugcccaccuucaauucgagaaaaagacaggcaauuacucuaucaccauugacaaguacaacgaaaucaaagagaaggaaggggucagcgagcaguccgaguuuaaauucacccugcauaagaaugaucuccugcucauuaaagacacagaaaccaaggagcagcagcuguuucgcuuccuuucuagaacaaagccuaacgugaaacacuauguggaacugaagcccuacagccgggaugaguucgagaaaaaugaacgccucaucgagauccugggauccgucgacaagucuggcagauuugugaaagggcugggaaagagcaaccuuuccauuuauaagguucggacggaugugcugggcaaucaacacaucauuaaaaaggaaggggaggaaccuaaacucaaguucuga

SEQ ID NO: 4000 - RNA, 3411 nt, Artificial Sequence
  Cas9 variant
augaacggccuggugcucgggcuggacaucggaauugccagcgucggcguugggauccuugagaaggauaccggaaaaauuauccacgcuuccucuagacuguuccccgccgcgacagcugacaauaacguggaacggcgcagcaauagacagggccggcgccucaacagacggaagaaacaucgcuccgugagacugcaagaucuuuuugagggguacggacugcucacggacuucucuaaggucagcaugaaucugaacccuuaucagcugcgggugcagggcauggaaaaucagcucaccaacgaggaacuguuuguugcccuuaaaaauauugugaagcgcagaggcaucuccuaccuggaugacgccucugaggaugggggaacagucagcuccgacuauggcaaggcuguggaggaaaaccggaaacuccuggccgagaagaccccggggcaaauccagcuugaacgcuucgagaaauacggacagcugagaggcgauuuuacaguugaggaaaauggggagaagcaccggcucauuaacguguucagcaccucugcuuaucgcaaagaagccgagagaauccugcggaagcagcaagaauuuaauuccaagauuacagacgaguucaucgaggauuaccugauuauccucaccggaaaaagaaaguauuaccauggccccggcaacgaaaagagccgcacggacuacgggcgguuuagaaccgauggaacaacccuggacaauauuuucggcauccuuaucgggaagugcacauuuuauaccgaggaauaccgcgcgucuaaagccuccuauacggcucaggaguucaaccugcucaacgaccugaauaaccuuacagucccuaccgaaacaaagaaacugagcgaggagcagaagaagcucauuaucgaauacgccaaaucugcuaagacccugggagccuccacccugcucaaauauauugcgaagaugaucgaugccagcguggaccagauucggggcuacagaguggaugucaauaacaaacccgagaugcacacauuugaaguuuaucgcaagaugcaaucccuggagacgaucaagguggaggagcuuccucggaaagugcuggacgagcucgcucauauccugacccuuaauacagaaagagaggggauugaagaggccaucaacucuaagcugaaagauauuuucaaucgcgaccagguccucgagcuggugcaguuccggaagaacaauagcucccuguuuagcaaaggauggcacaacuucucuaucaagcucaugauggaacugauucccgagcuuuacgaaaccuccgaggaacaaaugacaauccugaccagacucggcaagcagcgcagcaaagagacgucuaagcggacaaaauacaucgaugagaaggaacugaccgaggaaauuuauaauccuguuguggcuaaaagcgucagacaggccaucaagauuaucaacgaggccaccaagaaauacggcauuuuugacaauaucgugauugaaauggcucgggagaacaaugaggaagaugcgaagaaagacuauaucaagcgccagaaagccaaccaagaugagaagaacgcugccauggaaaaagccgcuuuccaguacaaugggaagaaggagcugccggacaacaucuuucacggacauaaagaacuuacaaccaagauuagacucuggcaccagcagggcgagaaaugucuguauacagggaagaauauccccauuuccgaccugauccauaaccaauacaaauaugagauugaucacauccucccucugucucuuagcuucgacgauucccugagcaauaagguucucgugcuggccacggcgaaccaggaaaagggacagcggacccccuuucaggcucuggacucuauggaugacgccugguccuacagagaguucaaaagcuacgucaaggauucuaaacuucucuccaauaagaaaaaggacuaucugcugacagaagaggauaucagcaagauugaggugaaacaaaaguuuaucgaacgcaaccucgucgacacccgguacuccucuagagugguucugaaugcccuucaggauuucuauaaaagccaccagcuggacacaaccauuuccgugguccgcggccaguuuacgucucaacucagacggaagugggggaucgagaaaagccgcgaaaccuaccaucaccaugcuguggaugcccugauuaucgcugccuccagccagcugagacuuuggaagaagcacucuaacccucucaucgcguauaaagagggccaguucguugacuccgaaacaggagagauugugagccugucugacgaggaauacaaggagcuggucuuuaaagcccccuaugaucauuucguggacacccuccgguccaagaaauucgaagauagcauccuguuuucuuaccaaguggacagcaaguacaaucgcaaaauuuccgaugcuacaaucuaugccaccagaaaggcuaaacuugacaaagagaagaaagaauacacguauacacugggcaagauuaaagauaucuacgcccucgggaccaagacaccgagcaagaccggauucuauaaauuucuggaccuguacaagaccgauaaaucucaguuccuuauguaucagaaggaccggaaaacaugggaugagguuaucgagaagauuaucgaacaguaccgcccuuuuaaggaguacgacaaaaacggcaaggaagucgauuucaaucccuuugagaaauauagaauugggaacggaccuauccggaaguacuccaaaaagggcaaugggcccgaaauuaagagccucaaauauuacgacauccugcugggcaagcacaaaaacauuacgcccgacggaucccgcaacaccguggcgcuccugucucuuaauccuuggagaacagauguguauuacaacagcgagaccaagaaauaugaguuccugggccucaaguacgccgaccugugcuuugaagaagggggagcuuacggcaucuccgaagucaaguauaaaaagauccgggagaaagaggggauuggaaagaacucugaguucaaauuuacacuguacaagaaugaucuuauccugauuaaagacaccgaaacgaauugucaacaguucuuuagauucuggagccgcacaggcaaggauaacccgaaguccuucgaaaaacacaagaucgagcucaaacccuaugaaaaggccaaauuugagaagggggaggaacugaaggugcucggcaaaguuccucccucuagcaaucaguuccagaagaacaugcaaauugagaaucuguccaucuacaaagugaagaccgacauccuuggaaacaaacauuuuauuaagaaggaaggcgaugagccuaaacugaaguucaaaaaguga

SEQ ID NO: 4001 - RNA, 3420 nt, Artificial Sequence
  Cas9 variant
augagcgaccuggugcucggccuggauaucgggauuggauccgucggcguugggauccuuaacaaggugaccggagagauuauccacaaaaauucuagaauuuuccccgccgcucaggccgaaaacaaucuggagcggcgcacaaacagacaaggccggcgccucacgagacggaagaaacaucgcagagugcggcugaaucaccuuuuugaagagagcgggcugaucaccgacuucacaaaggucuccaucaaccucaauccuuaccagcugcgcgugaaaggacugaccgcggaacucucuaacgaggagcuguuuauugcucuuaagaauaugguuaagcauagaggcaucagcuaucuggaugacgccuccgaugacggcaacucuagcgugggggauuacgcccagauugucaaagaaaauuccaagcagcucgagacaaaaaccccgggacaaauccagcuggaacgguaucagaaguacggccagcuucgcggggacuucacaguggaggaggauggaagaaaacaccggcugauuaacguuuuucccaccagcgcuuaucaugccgaagcucuccgcauccugcaaacgcagcaggaguucaauccucagauuaccgacgaauuuaucaacucuuaccuggagauccucacaggcaagagaaaguauuaccacgggcccggaaaugaaaaaucccggaccgauuacggcaaguauacaaccaaaaaggacgcccaaggccaguacauuacgcugaacaacaucuucgggauucuuaucggaaaaugcacauuuuauccugaggaguacagagcggccaaggcuagcuauaccgcccaggaauuuaaucugcucaacgaucugaauaaccuuacagugcccaccgagaccaaaaagcugucugaggaacaaaaguaccagauuaucacauaugucaaaaaugaaaaggcuaugggcccugccaaacucuuuaaguacaucgcgaaacugcuguccugugacguggccgacauuaagggguaccgcaucgauaagagcgacaaagcugagauucacacguucgaggccuaucggaagaugaaaacccucgaaacacuggaugugaagaaaauggcuagagaggaacuugacaagcuggccuacguccucacccugaacacagagcgcgaaggaauccaggaggcccuugaucaugaguuugcugacggcaccuucucucaggaacaaguugaugagcuggugcaguuccggaaggcuaauuccagcauuuuugggaaaggauggcacuccuucucugugaagcucaugauggaacugaucccggagcuguaugccacgagcgaggaacagaugacaauccucaccagacugggcaaacagaagaccacauccagcucuaacaaaaccaaguacauugacgagaagcaacuuacagaagagaucuauaaucccgucguggcuaaauccguucgccaggccauuaagaucgugaacgccgcuauuaaaaaguacggcgauuuugacaauaucgucauugaaauggcccgggagacgaacgaggaugacgagaaaaaggcgauccagaaaauccagaaggcuaauaaggccgaaaaagacgccgcuaugagaaaggccgcuaaccaauauaaugggaaagccgaacugccucauagcguguuccacggacacaagcagcucgcgaccaaaauucgccuguggcaucagcagggcgagcggugccuguacacagggaagaccaucucuauucacgaucuuaucaacaaccccaaucaauuugaaauugaccauauccucccucugagcaucacauucgaugacucccuggccaacaagguucucguguacgcuaccgccaaucaggagaaaggacagagaacgcccuaucaagcucuggauucuauggacgaugccuggagcuuucgcgagcuuaaggcguucguccgggaauccaaagcccugagcaacaagaaaaaggaguaccuccugaccgaagaggacauuucuaaguuugaugugcggaaaaaguucaucgaaagaaaucuggucgacacacgcuaugcuuccagagugguucuuaacgcccuccaggagcacuuucggacccauaaaauugauacaaaggugagcgucgugagaggccaguucaccucucagcugcgccggcacugggggaucgagaaaacgagagacacauaccaccaucacgcuguugaugcccugauuaucgccgcuuccagccaacucaaucuguggaagaagcagaaaaacacccuuguguccuauucugaagaccagcugcucgacaucgagacaggcgaacugauuagcgaugacgaguacaaggaguccgucuuuaaagcgccguaucagcauuucguggauacccugaagucuaaagaguucgaagacagcauccuuuucuccuaccaaguggauagcaaguucaaucgcaaaauuucugacgccaccaucuacgcuacaagaaaggccaagcucgauaaagaaaagaaagaguauacguacacccugggaaagauuaaagacaucuaugcccugggcacaaagaccccuuccaagacaggguuuuacaaauuccucgaucuguauaagaaagacaagagccaguuucuuauguaccagaaagaucggcgcaccugggacgaaguuaucgagaagauucuggagcaguauagacccuucaaggaaaaagauaagaacggaaaagaggucgacuuuaauccuuucgaaaaguaccggaucgagaacggccccauucgcaaauacucuagaaaggggaauggacccgaaaucaagucccucaaauauuacgacaaccugcugggccgguuuguggauauuacgccuagcgagucuaagaauccgguggcgcuucucagccugaaccccuggcgcacagacgucuauuacaacaccgagaccagaaaauaugaguuccuggggcucaaguacgccgaucuguguuuugaaaaaggcggauccuauggcaucagcaaggugaaguacaauaaaauucgggaaaaggaggggaucggcaaaaacucugaguucaaguuuacacuuuacaaaaaugaccugauccucauuaaggauaccgaaacaaaccgccaacagaucuucagauucuggucccggacgggaaaagacaauccuaagagcuuugagaagcacaaacuggaacugaagcccuaugagaaaaccagauucgaaaagggggaggagcuuaaaguucugggaaaggugccucccuccucuaaccgccuccagaagaauaugcaaauugaaaaccugagcaucuacaaaguccggacagaugugcucggcaaucagcacauuaucaagaacgagggggacaaaccgaagcuggauuuuuga

SEQ ID NO: 4002 - RNA, 3420 nt, Artificial Sequence
  Cas9 variant
augaacuacuauaauggcuucaucauuaccgagaacgccauggcuagcaagcacgaaaaucugggggcccucacauuuggacuggacaucggcauugcguccguggggugggcuguccuuggagagaacagaaucauugaucugggcguucggugcuucgacaaagccgaaacggccaaggagggggaaucucucaaucuggcucgcagaaccgcccggcuucugcgcagacggcuccgcagacgggcuuggcgccugacaaaacuggccagacuccugaagcgggagggacuuaucgcggauaccaacguguuucagaaacccuucaaucugaaggacgccaacgagaagggccucagcuuuuggcagcugcgcguggaugcucuugacagaaaacuguccgccgaagagugggcucgggucaucuaccaucucuguaagcaccgcggcuuccauuggauuucuagagccgaagagaaagcggccgagggggauagcaaguccgaaggaggcaaagugaagcaggggcuggcuggaacaaagaaacugaugcaggagaagaauuaucggaccgccgcugaaaugguucucacagaguuuccugaagcccagagaaacaaacaaggcgacuacucuaaggcccugagccgcauccuucugggggaugagaugacccagcuuuucaaacaccagcgggagcugggaaauccgcaugcuacggaaaagcucgaggcggccauucugggcaacggcgaccacaaauccgggcucuuuugggcucagaaucccgcccuggccggaaacgaucugcucaagaugcugggccacugcaccuucgaaaaggcugaguauagagugccuaaagccagcuuuacagcggaacgccaugucuggcuuacccggcugaauaaccucagaaucgugguugacgggacaacccgcccccugaacgaggcugagcggcaccuugcccugcucaugccuuaccaacaggccggagaucugacguauaagcagcugagaacagcucucaccaaagccggcuaccugcccgaaucuuuccgcuacacagggcuugcuuaugccuccggacagaaggcggacgagaaagccaaggacccugaaagcgcuccgcuggugaagcuccccgccuggcaugagcugcggaaaacccuggaaaagaaagagcuugcuucugaguggcaaaagauuuccagcgaugcccucgacggcaaaccucagcugcuggaucagaucgcguggguccucucuguguacaaggacgauaccgaaguggaggccgaacuguguaaacuuaaucugcccaacgcugagaagaugauugacgcccuccuggauaucagauuugacaaguucuccaaucugagccuuaaagcucuccgccaaaucgucccucugauggagcagggccagcgguaugaugaagccguugccaacauucccgaguacgggcaccacucccagcugcaugaagugggagcuggcgagcacaaguaucucccgccuuucuacaaagaaagagacaagacagggcggaugguguuuaaugaugacauggacaucccccgcaacccugucgugcugagagcgcuuaaucaagcccggaagguugugaacgcucugauuaaagaguauggaucuccccaugagguccacaucgaaauggccagagaucucagccgcccccuggacgagcggagagauguggaaaagcugcagaaagaguuccgcgacagaaaugaaaaggauaaagcccuuuuugcucaggacuucaacauuguuggcgccgugaaggggaaagaguuugagaaguaccagcucuaccgggaacaacagggcaagugcgcguauuccaucgagccuauggauauccaucgccuguucgaacagggauacgucgagauugaccacgcucugccguauagcagaucuuuugaugacuccaaaaauaaccgggugcucguccuggccaaggaaaaucgcgauaaaggcaacagaacgcccuucgaguaccuugggggaaaggacaauagcgagcgguggcgccaguuuguggccuucguugaaggcaacaaaucuuauagacuggcuaagcggagccgccuccugagaaaggauuuugggaaagacgaggccaagggauuccgggaaagaaaccugaaugacacccgcuacaucugucgguuuuucaaaaacuauguggagcaauaccuucagcuccacgaggauuccgacgcgaagagaugcgucgugcugucuggccagaugaccagcuuccugcgcgcucggugggggcucguuaaagugagaggcgauuccgaccgccaucacgcccuggauggagccauugucgcugccuguagccauucuauggugaagcggcuuuccgacuacagcagacgcaaggaacuggaacaggugcgggcuggcuuuguugaugucgacacaggggagaucgugaauccugccauguuccaacaggugcaggagcacuuucccaacccuuggccccacuucagagaugaagucaaacuccggcugaauguggacgauccggcgcugcuucauucugagaugaaccgcuuuggaacauauuccccugaggcccugaaggcucucagaccccuguucauuagccgggccccucaacgcagaaauuccggcgcugcccacaaagacaccaucuacgcccagcccgaacggcucguugcucagggaggagugacgcagaaggucccucugacaucucuuacccugaaagaucucgacaagcugaucgacccccauagaaacgagaagcuguauagcgcgauucgcauccggcuugaacaacacggcgggaaaggcgauaaggccuuuccggcuuccaauccucugagaaaacccgacucugagggaaaccccaccggcccuauugugcgcgggguuacaauggugaucgauaagcucagcgggauuccgauccggggcgggauugccaaaaaugacuccauggucagaguggauguuuucaccaaggccggaaaauuucaucuggugcccgucuacgugcaccacgcuguggccaagguccucccuaaccgcgcgguuguggcuuauaaggacgaaacagaguggacgcugaucgaugacggcuucgauuuuugcuucagcauguaccccaaugaccuucugcggaucaaacucagaaacgccucucaucugggguauuacgccuccuguaaucgcagcaccggcgcuauuaaccuguggucucacgauagaaaccaacaggugggaaaggacggcaugaucgaguccauuggggucaaaacagcccuuaauguggaaaagcugaacaucgacguucucggaaaucgguacccugcgcccccugagaaacgcagagaucuggcuuga

SEQ ID NO: 4003 - RNA, 3423 nt, Artificial Sequence
  Cas9 variant
augaagaacaugaccaaagugaaugucggccuggacguugggaucagcuccgccggauggucugugauuaacgcugagacaaaucagauccucgaaagcggcgugagacuguucuccgggucugaugccgacgagaacgucaaucggcgcaaccaaagacagggacggcgccuuuuuagacggcgcaagcugcggauucaggaagcgaaaaaguaccucgagaauguguuccagcugaaagauaucgaacccaaggacgaguggaacccuuaugagauucggguucgcgcucuuaaugaaaaggugagcaaagaggaacuguccaucgcccuccugaacaucgucaagcacagaggcauuucuuacgagcuggaggaugugacggacgaagaggggaccaauacacagagcuuucaauccggacucgauuauaaccggcgccugcuuaaaaccaagacaguuggcgaaauccaguacgacagacugcagaaauauggccaagugcgggggcagauucagaccgaggauggacuccugaucaauauuuucccgacaaagaacuacgucgaagagguggagcgcauccuugaaacccagaagaaauaucaucccgagauugacgauguguuuaucgaaaagaucauuagcuucgucacgagaaaacgggaguacuuuguuggcccugggaaugaaaagucuagaaccgacuacggaaucuaucgcgagaacggcgagacacuggauaaccucuucgaaauucugaucgggaaagacaaguuuuaccccgaggaauaucgggccgcuggauccagcuacaccgcccaaauuuucaaucugcucaacgaccugaauaaccuuagaaucccuacaaccgaggaucaccaucugacgaaagcucagaaggaagagaucauuacagagcucaagaauaccucucgccuguccggcggcaugcuuaaacugaucagcaaggugacaaaagcccccaaggaagagauuucuggguaucggaaagacgaaaaggauaagccugaccuccacucccuggcguacuauagaaaacagaagaacaugcuggagaaagagggaauccaaauugccgauuuuagcgaggaacuccuggacgaacuugcuaccaugaugacccugaauacagagccgggcgaaauccgcaagcagcucaacaaaaucacgaaucaguacgauauucugacccccgaggugaucgagguccuugugaagaaccauacagccuucguugcuaccuccaaucacaaguggcaccgguuuucucugaaacucaugaaggaguucauuccugaacugcuggaaacaagcaaagagcaguccaccauccucugcgaaagaggguucauucaaaaccgcgccagcuaccuggacgagaaucaucacuuuaacuaugcggagcuucgggaaaaucuguacaaccccguggucagaaagucuacgugugagaugcucaaaguguucacagccauccaggaaaaguauccuaacauucagaauguuaucguggagcugccccgcgaaaccaacgaggaugagcagaagcggaaaaucaagaaaauuaaugacaacaaugcuaagagaaagaaggaaauccugaaagaggcccaagcucaguccggacuuagcgaagaggcccucgaggaaaagcugcugaagaccaaaggccucuaccugaaacuuaugcugugguaugagcaggaagggaaaugcgucuacucuggacaggagauuccgcucagcgaucugcugcaaaacaagggcggcuaugaaguggaccauaucauuccuaucuccaucucuuuugacgaucggcuuuguaauaaaguccucgugcgccagcagcugaacagccagaaguccaaucaaacacccuucgaguacaugaccacacacacggacgggcaccugagcuuucaugagcucaaggaacugguuggaaagaacaagagauucucuaaagagaagcgggaacuucugcucgccgagauuuacuccaaugauaucgaaaccagaaaacgcuuuauuaaccggaaucugguggacacaagcuauaccgcuagaaucguccugaacgcgcuucagcaguacaagaaggagaaucaacucucuaugaacguguccguugugcgcggcgccaugacaaacauucugcggaaaaaggucaaacuggauaagaccagagagacguuccaccaucacgcuaucgacgccagccucauggccgugaucccuaauauugaauuuuucaaagagcgcaaggaauggcugcccaaguccgcuaacgaggaagugguugaggucgaggugucugaagaggaaaccaugcccgagaaagaguuuaaggugaaaaugagacuuccugagagcuucauccaggauguccagauucugcagagaaauuccuuugccaaggaagaagugucugggccgcaaacacgcgagagaaaccucaaaaucaaguucagccaucagguugaccagaaaaugaaucggaagguggcggaugacaccauuuauggaacacgccaggcucaacugggcaaggauaaaaaggaagagaccuacgucaucgggaaaaucaaggacauuuauaacuacgaugaguaugugagauucaaaaagcgguacgacaagaauaaagaauccuuucugauguaccaccacgacccccagacguucgagaaacuugaagagauccucgcccaguauccugaauacauugaggaugagaaaggcaagaaaaagaagguuagccccuuugcccuguaucgcgaagagaacggaccugugacaaaauacgcuaagaaaaauaacggccccgucaucaagcagcugaaauauuacgacucuaagcucaauagaaagauugauaucucccauaaauauagcaccaagaaccggcaagugguucugcagucucuuaaaccguacagaacagacguguaccgcaaucaggauaccggggaauauacccuggucggaauugaccaaaacgauggcaaguucgugaaugggcacuacggaaucccuaaaucccgguaugaggaaaucaaggccaacaacaagcucagcgagcaugacgaguuuguguucucucuguacaaaaauagcauggucaagguuauugaugaaaacggcgaguccaucguggugagauaucugagccgcucuaugcccaaucggaaaaacaaugcugaaauuaagccugucgagaaauaccaguuugaggacggggaagugguucccguguauggcaagugcagaaaacagaugcagacagucuucgugaagaagggauggacgcuucugaaaggcaacaccgauauccucgggaauacauacuuuguugagaaggaauccgagaacccuaaaaagaugauugacgauaaauga

SEQ ID NO: 4004 - RNA, 3423 nt, Artificial Sequence
  Cas9 variant
augagagagaacggcagcgacgaacggcgcagaaauauggaugagaagauggacuaccggaucgggcuggauauuggaaucgccuccgugggcugggcuguccuccagaacaauucugacgaugaacccguucgcauuguggaccugggggugagaaucuucgauaccgccgagauuccuaaaacaggagaaagccuugcgggcccgcggcgcgcugccagaacgacccggcgcagacugcggcgcagaaagcaccggcucgaccgcaucaaauggcuguuugagaaccaagggcuuaucaauauugaugacuuccugaagagauauaacauggccggacuccccgaugucuaccagcugcgguaugaggcucuggacagaaaacucacagaugaagaacuggcccaggugcuucugcauaucgcuaagcaccgcggcuuucgguccaccagaaaggccgaaacagcggccaaagagaauggcgcuguucucaaggccaccgacgagaaccagaaacgcaugcaagaaaagggguaccggacagugggagagaugauuuaucuggacgaggcuuucagaaccggcugcucuuggagcgagaaaggguacauccuuacgccucgcaauaaggccgaaaacuaucagcauaccaugcugcgggcgaugcucgucgaggaggugaaggaaaucuuuuccucucagagacgccugggaaaugagaaagccacagaagaacuggaagagaaguaccucgagauuaugaccagccagcgguccuucgaucugggccccgggaugcaaccugacggaaaacccagcccuuacgcuauggaaggcuuuucugauagaguuggcaaguguacauuccuuggggaccagggagagcugcgcggcgccaaagggaccuauacggcugaauacuuuguggcccuccagaagauuaaccacacaaaacuggucaaucaggauggagagacccggaacuucacagaagaggagagacgggcccuuacccugcuccuguuuacccaaaaggaagugaaguaugcugcggugcgcaaaaagcugggccucccggaggacauccuguucuacaaucuuaacuauaaaaaggccgcuacaaaagaagaacagcagaaggagaaccaaaauacggaaaaggccaaauuuaucgggaugcccuacuaucaugauuacaagaaaugccuggaggaaagagucaaguaccucaccgagaacgaaguucgggaccuguucgaugagauuggaaugauccuuacauguuauaaaaaugacgauuccagaaccgagcgccuggccaagcucggccuggugccuauugaaauggagggccugcucgcuuacacacccaccaaguuccagcaccugagcaugaaagccaugcggaacaucauuccuuuucuugaaaaggggaugacguaugacaaagcgugcgaggaagcuggauacgacuucaaggccgauucuaaaggcacaaagcagaagcugcucaccggggagaaugugaaccagaccaucaaugagaucacaaaccccgucgugaaaagauccguuagccaaaccgugaaggucauuaaugccaucauucgcacauauggaucuccgcaggcuaucaacauugaacuggccagagagauguccaaaacguuugaggagcggcgcaagaucaaaggcgacauggaaaagagacagaaaaauaacgaggaugugaagaagcagauccaagagcuggggaaacuuagcccuaccggccaggacauucucaaguaccggcuguggcaggaacagcaaggaaucuguauguauuccggcaaaacaauuccccuggaggaacucuucaagccuggguacgauaucgaccacauucugcccuacucuaucaccuuugaugacagcuuccgcaauaaaguucuugugacaucccaggagaacagacagaagggaaaucggacccccuaugaguacaugggcaacgaugaacagcgcuggaacgaguuugaaacgagagucaagaccacaauucgggacuauaaaaagcaacagaaacugcucaagaaacauuucagcgaggaggagcgcucugaguuuaaggaaagaaaucugaccgauacaaaguacaucaccacggugaucuauaacaugauucggcagaaucuggagauggcuccucuuaacagaccggagaaaaagaaacaaguccgcgccgugaauggggcgaucacagccuaccuccggaagagauggggacugccccagaaaaaccgcgaaaccgacacacaccaugcuauggaugccguugugauugcuugcuguaccgacggcaugauccagaagauuucccgguauaccaaggucagagaacgcugcuacagcaaagggacagaguucguggacgccgagacgggcgaaaucuuucggccugaggauuacucuagagcggaaugggacgagaucuucggaguucacauucccaagccuugggaaaccuuucgcgccgagcuggaugugcggaugggcgacgaucccaaaggguuccucgacacacacagcgaugucgcucuggagcuugacuauccggaauacaucuaugagaaucugagaccuauuuucgugucccggaugcccaaccauaaggugaccggagccgcucacgccgauacaauccgcucuccuagacauuuuaaagacgaaggcauuguucucaccaagacggcccugacagaucugaaacuugacaaggauggggagaucgacggauacuauaauccccagagcgaccuccugcuguacgaggcucucaagaaacaacugcuucuguauggcaacgaugcgaagaaagccuucgcucaggacuuucacaagccuaaagccgaugggaccgaaggccccgucgugcggaaggugaagauccagaaaaagcagaccaugggagucuucguggacuccggcaaugggauugccgagaacggaggcaugguucgcaucgauguguuuagagucaaugggaaauacuacuucgugccgguuuauacagcugacguggucaagaaagugcucccuaaccgggccagcaccgcgcauaagcccuacggagaauggaagguuauggaggauaaagacuuucuguucucucuguauuccagagaucuuauucacaucaagagcaaaaaggacauucccaucaaaauggugaauggcgggauggaaggcaucaaggagacauacgcuuauuacauuggagccgauaucucugccgcuaacauucaaggcaucgcccacgacucccgcuauaaguuucgggggcucggcauucagagccuggacguccuggagaaaugucagaucgaugugcucggacauguguccgucguuagaucugaaaagcgcaugggguucagcuga

SEQ ID NO: 4005 - RNA, 3423 nt, Artificial Sequence
  Cas9 variant
augaacggccuggugcucgggcuggacaucggaauugccagcgucggcguugggauccuugagaaaaauuccggaaaaauugugcacgcuucuagcagaaucuuccccgccgcgaccgcugauaacaauguggaacggcgcaagaacagacaggcccggcgccugaauagacggaaaaagcaucgcggcgucagauuucaagaccucuucgaggauuacgggcugcuuacagacuuuuccaaagugucuauuaaccugaauccuuaucggcuccgcguugauggacugaaccagcagcugacgaaugaagaacucuucaucgcccugaagaacaucgugaagagacggggcauuagcuaccuugacgaugcuuccgaagacggcgggaccgucucuagcgauuauggaaaagccguggaggagaaucgcaagcugcucgcugaaaagacaccgggccagauccaacuggagagauuugaaaaguacgggcagcuucggggagacuucaccguuguggagaacggcgagaaaugccgccugauuaaugucuuuuccacaagcgccuauaagaaggaagcggagagaauccuccggaaacagcaggauuucaacaaucaaauuaccgacgaauuuaucgaggauuaccugaagauucugacagggaaaagaaaguauuaccacggacccggcaacgaaaaaucucgcaccgacuacggccgguauacgacccauaaggacuccaaaggggaguacgugacacucgauaacaucuucggagugcugaucggcaaguguaccuuuuauccuaaugaguacagagccagcaaggcuucuuauacagcccaggaguucaaccuucugaaugaccucaacaaucugaccguccccacggagacaaagaaacuuuccgaggagcagaaaaagaccauuaucgaauacgcuaaaagcgccaagacacugggggcgucuacccuccugaaguauauugccaaaaugaucgauaccuccguugaccagauucgcggauaccggguggaugugaacaauaagccugagauccacacauuugaggucuacagaaaaaugcaaagccuggaaacgaucuccgugggcgagcucucucgcaacguucuggacgaacuugcucauauucugacccucaauacagagcgggaagggaucgaggaggccauuaacaccaagcugaaagauagcuucucccaggaccaggugcuugaacugguccaauucagaaagaauaacagcucucucuuuuccaagggauggcacaauuucagccugaaacugaugauggagcucauccccgaacuguaugagacaucugaggaacagaugaccauucuuacgcgccugggcaagcagaaaagcaaggagacauccaaacggaccaaguacaucgaugaaaaggagcucaccgaagagaucuauaacccugugguugcuaaaucugugagacaggccauuaagaucauuaaugaggccacaaagaagcacggcaucuuugacaacauugucaucgaaauggcucgcgagaacaaugaagaggaugcgaaaaaggacuacauuaaacggcaaaaggccaaccaggacgaaaaguaugcugccauggagaaagccgcuuuccaguacaaugggaagaaagagcugccggauaacaucuuucauggacacaaggaacuggccaccaaaaucagacuuuggcaucagcaaggcgagaagugccucuauacaggaaagagcauucccaucuccgaccugauucacaaucaguacaaauacgaaaucgaucacauucugccucucagccugucuuucgacgauucccuuagcaacaaggugcugguccucgcgacggcuaaucaggagaaaggacagcggacccccuuucaagcccuggacucuauggaugacgccugguccuaucgcgaguucaagagcuacgugaaagaauccaagcugcuuggcaacaagaaaaaggaguaucuccugacagaagaggauaucucuaaaaucgaaguuaagcagaaauuuauugagagaaaucugguggacacccgguacagcuccagagucgugcucaacgcucugcaggauuucuauaagaaucauaacuuugacacaaccaucucuguugugcgcgggcaguucacgagccaacuucggagaaaguggggccuggagaaaucccgcgaaaccuaccaccaucacgccgucgaugcucucauuaucgccgcgagcucucagcugagacuguggaagaaacagaauaacccucuuauugccuauaaggagggacaauuuguggacucccagacaggcgaaaucaucagccucaccgacgaugaguacaaagaacugguguucaaggcucccuacgaccauuucguugauacacugucuuccaaaaccuuugaggacagcauucucuucucuuaucaggucgauagcaaguuuaaucggaagaucuccgacgccacgauuuacgcuacacgcaaagccaagcuggauaaagagaagaaagaauauaccuacacacuugggaagaucaaggacauuuauagccugggaaccaaaaccccgucuaagacaggcuucuacaaauuucucgaucuguauaacaaggacaaaucccaguuccugauguuucaaaaggauagaaagacgugggacgaggugaucgagaaaaucauggaacaguaccggccuuucaaggaauacgauaaagcggggaaacuuguggacuuuaaccccuucgagaaauaucgccaggagaauggaccuauuagaaaguacagcaagaaaggcaacgggcccgaaaucaagucccucaaauauuacgacauucugcugggcaagcacaaaaauaucacccccgagggaucucggaacacagucgcccuccugagccuuaauccuuggcgcaccgauguguauuacaacauggaaacaaagaaguaugaguuucugggccucaaauacgcugaccugccguucgaagaagggggagccuacggcauuuccaccgagacguauaaugaacugagagagaaggaagggaucgggaaaaacucugaguuuaaguucacacuuuacaaaaaugaucugauucucaucaaggacaccgagaccaacugucagcaauucuuucgguucuggagccgcacaggcaaagauaaucccaaguccuuugaaaagcacaaaaucgagcugaagccuuaugaaaaagcuaaguucgagaaaggggaggaacucgagguucugggcaaggugcccccuucuagcaaccaguuucagaagaauaugcagauugaaaaccuuuccaucuacaaagucaagaccgacgugcugggaaauaaacauuucauuaagaaagagggcgauaagcccaagcucaaauuuuga

SEQ ID NO: 4006 - RNA, 3423 nt, Artificial Sequence
  Cas9 variant
augaacggccuggugcucgggcuggacaucggaauugccagcgucggcguugggauccuuaagaaagauauuggagagaucauucacaccaauuccagacuguucucugcugccacagcggacagcaacaucgaacggcgcggccauagagggggaaagcggcucacgcgccggaaaaagcacagauccauccgccugcaugaucuuuuugaggacuucggccugcucaccgauuuuucuaaagugagcauuaaucugaaccccuaccagcugagagugcaaggccucgacaaucagcugacaaacgaagaacuuuucaucgcucugaagaauauugucaagcggcgcgggaucuccuaucucgaugacgccucugaagauggaggcaccgugagcuccgacuacgggaaagccguugaggagaacagaaagcugcuugcugaacagacaccuggacagauucaacuggaucgguuugagaaauauggccaggugcgcggggacuucaaugucguggaaaacggagagaagagacggcucaucaauguuuuuaccacaagcgccuacucuaaagaggcugaacgcauucugagaaagcagcaggaguucaacaagaaaaucaccgaugaauuuaucgaggacuaucugacgauucucaccggcaagcggaaauacuaucacggcccggggaaugaaaaguccagaacagacuacggacgcuacaccaccaaaaaggaucccgagggcaaauauaucacacuggacaacauuuucgggauccuuauuggaaagugcacguuuuacccugaugaguaucgggccagcaaggcgucuuacacagcccaagaguucaaucugcucaacgaccugaacaaucuuaccgugcccacagagaccaaaaagcuguccgaagaacagaaaaagaccaucaucaaauaugcuaagacagccaagacgcucggcgcuagcacccugcugaaauacauugccaagcucaucggggcgucugucgaucagauucauggauauagaaucgacccuaacaaaaagcccgaaaugcacacauuugagaccuaccgcaaaaugcagucccuggagacaauuagcguggaggagcuuccucggaaggugcuggaugaacucgcccacauccugacccuuaauacggagagagaaggcaucgaggaggcuauuaacgccacacugaaggacaccuucucccaagaucagguccucgaacugguucaguuccgcaaaaauaacucuagccuguuuuccaagggcuggcauagcuucucucucaaacugaugauggagcuuaucccggaacuguacgagaccuccgaggaacaaaugacaauucucacccggcuggggaagcagaaaagcaaggagacaucuaagagaacgaaauauaucgacgaaaaggagcugaccgaagagauuuacaaucccgugguggcuaaaagcguccgccaggccaucaagauuaucaacgaggccaccaaaaaguauggaaucuuugauaauauugugaucgaaauggcucgggagaacaaugaagaggacgcgaaaaaggaauacauuaagagacagaaagccaaccuugacgagaagaaugcugccauggagaaagccgcuuuccaauauaacggcaagaaagaacucccugauaauguuuuucacgggcauaaggagcuggccacaaagauccgccuguggcaccagcagggagaaaaaugucucuacacaggcaagaacauucccaucuccgaccugauccagaaccaauauaaauacgagauugaucacauccuuccucugucucucagcuucgacgauucccugagcaauaaggugcugguccuugcgaccgcuaaccaggaaaaagggcagcggacgcccuuucaggcccucgacucuauggaugacgccugguccuacagagaguucaagagcuaugugaaggauucuaaacugcugggcaauaagaaaaaggaguaccuccugaccgaagaggacauuuccaaaaucgaaguuaagcaaaaguuuauugagcggaaccuuguggauacacgcuauagcuccagagucgugcugaaugcucuccaggacuucuacaaagagcaucaguuugauaccacaaucucugucgugcggggacaguucaccagccaacugagacgcaaguggggccuggaaaaaucccgggagacguaucaccaucacgccguugacgcucuuaucauugccgcgucuagccagcucagacuguggaagaaacagaacaauccgcugaucuccuacacagaagggcaauuuguggaccaggucaccggagagauuaucagccucucugaugacgaauauaaggagcugguguucaaagccccuuacgaucauuucguugacacacuuaaguccaagaaauuugaggauagcauucuguucucuuaccagguggacuccaaguauaaccgcaaaaucagcgaugcuaccaucuacgccaccagaaaggcuaaacucgacaaggaaaauaaggaguauacauacacgcugggcaaaauuaaggauaucuaugcccuggggaccaaaucucccagcaagacaggauuuuacaaauuccuugaccucuauaacaaggauaagucccaguuucugauguuccaaaaagaccggaagaccugggaugaagucauugagaaaaucauugaacaguaccgcccuuuuaaggaguacgacgagaauggcaaagaaguggacuucaaccccuuugagaaguauagaaucgaaaaugggcccauucggaaguacagcaaaaagggcaacggaccugagaucaaaucucugaaguauuacgauaaucuccugggcaaauucguggacaucacaccguccgaaagcaagaaccccguugcgcuucugucccucaacccuuggcgcaccgaugucuauuacaauacggagacaucuaaguaugaguuucuggggcugaaauacgccgaccuuugcuucgaaaagggaggcgcuuacgggauuagcgaggugaaauauaacaagaucagagaaaaagagggaauuggcaaggaguccgaauuuaaauucacccuguacaagaaugaucucauccugauuaaggacaccgagacaaacugucagcagaucuuccgguuuuggucucgcaccgggaaagauaaucccaagagcuucgaaaaacacaagaucgagcucaaaccuuaugaaaaggccagauuugagaagggcgaggaacuggaggugcuuggaaaagugcccccguccucuaaccaacugcagaagaauaugcagauugaaaaccucagcaucuacaaagucaagacagacguucugggcaauaaacacuucauuaagaaggagggggaggaaccuaaacugaaguuuuga

SEQ ID NO: 4007 - RNA, 3423 nt, Artificial Sequence
  Cas9 variant
auggaggaaaacuuccaguacagaaucggccuggacauugggaucaccagcgugggaugggccguccuccaaaauaacucccaggaugagcccguucggauuacagaccugggcgugcgcaucuuugauguggcugaaaauccuaagaacggggacgcccuugcggcuccgagacgggaugcccgcacgaccagacggcgccugagacggcgcagacaccggcucgagcgcauuaaauuccugcuucaggaaaauggacugaucgagauggacucuuuuauggagagauauuacaagggcaaccuccccgaugucuaucagcugcgguacgaagggcuggaccgcaaacucaaggaugaggaacuggcccaagugcuuauccauauugcuaaacacagaggauuccggagcacaagaaaggccgagaccaagggcaaagagggcggggcuguucugaaggccacaaccgaaaaucagaaaaucaugcaggagaagggauaucgcacagugggcgaaaugcucuaccuggacgaggcguuucauaccgaaugccuuuggaacgagaaaggguauguccugacgccucggaauagacccgaugacuacaagcacaccauucuccgcuccaugcugguggaggaaguucaugccaucuucgcugcccagcgggcucugggaaacgagaaggccacagaggaacucgaaaaugcguacguggagauuaugaccucucaaagauccuuugauaugggcccugggcugcagcccgacggaaaaccuuccccguaugccauggagggcuucggcgaccgcgucgggaaguguacauuugaaaaagaugaguaccgggcucccaaggccaccuauacggcugaacuuuucguggcccugcagaaaaucaaccacacaaagcucauugacgaguuuggaaccggcagauucuuuacagaagaggagcgcaaaaccaucaucgaucugcuucugucugggaaggaacucaaguacggaaccauucggaaaaagcugaauaucgacccuagccugaaauucaacucccucaauuauagcgccaagaaagagggcgaaacagaggaggaaagagugcgcgauacggagaaggcuaaguucgcgucuauguuuuggaccuacgaauauuccaaaugccugaaggaccggaacgaggaaaugacagucgggcagaaagccgaucuucuggacagaauuggagagauccucaccgcuuacaagaacgaugacagccggucuucccgccuggaggaucuuggccugagcagagaagagauugacggccuccuggaacugucucccgccaaauaccaacggguuucccucaaggccaugagaaagaugcagccuuaucuggaggacgggcuuaucuacgauaaggcuugugaagccgcgggauaugacuuccgcgcucugaaugauggcaacaagaaacaccuccugaagggggaggagaucaaugccauugugaacgacaucacaaaucccguggucaaacggagcgugucccagaccauuaagguuaucaacgccauuauccaaaaguacggaucuccgcaggcugugaauaucgaacuggccagagagaugagcaaaaacuuucaggaucgcacgaaucuugaaaaggagaugaaaaagagacagcaagaaaacgagcgggcuaaacagcagauuaucgagcucggcaagcagaauccuacagggcaagacauucugaaauaucgccuguggaacgaucagggcggauacugccucuauuccggcaagaagaucccccuggaggaacuuuucgggggaggcuacgacauugaucauauccugccuuacagcauuaccuuugacgauucuuauagaaauaaaguccucgugaccgcccaggaaaaccggcagaaggggaaucgcacacccuacgaguauuucggagcggacgagaaacacugggaagauuacgaggccagaguucggcugcuggugcgcgacuauaagaaacaacagaaacuucucaagaaaaacuuuaccgaagaggaaagaaaggaguucaaagagcggaaccugaaugacacaaaguacaucacgcgcgucguguauaacaugaucagacagaaucuggaacucgagcccuuuaaccauccugagaaaaagaagcaggucugggcugugaauggcgccguuaccuccuaccugcggaaaagaugggggcuuaugcaaaaggaucgcagcacagaccggcaccacgcuauggaugccguggucauugcguguugcaccgacggcaugauccauaaaauuucuagauacaugcagggacgcgaacuggccuauagccggaacuucaaguuuccggaugaagagacaggcgagauccucaauagagacaacuucacccgcgaacagugggaugagaaauuuggggugaagguuccccugccuuggaauagcuuccgggacgaacuggauauuagacuucucaacgaggaccccaagaauuuccugcugacgcacgcugaugugcaacgcgaacucgacuacccuggauggauguauggcgaggaggaaucucccaucgaggaagggcgguacaucaacuauauuagaccgcuguuugucagccggaugccuaaucauaaagugaccggauccgcccacgaugcuacaauccgcagcgccagagacuacgagacccggggcgugguuauuacaaaggucccccuuaccgaccugaaacucaacaaggauaaugagaucgaaggguauuacgacaaagauucugaccgccugcuguaccaggcccuugugagacagcuccugcugcauggcaacgauggaaagaaggcuuucgcggaggacuuucacaaaccuaaggccgauggcacggaagggcccgugguccggaaagugaagauugagaaaaagcagacauccggaguuauggugagaggcgggaccggaaucgcugccaacggcgaaaugguccgcaucgacguguuccgggagaaugggaaauauuacuuuguuccuguguauacagccgaugucgugagaaagguucuccccaaccgcgcugccaugaauggcaagauugcgagcgacuggaaaaccauggaggauaacaauuucguguuuucucuguacucccgggaccuuauccacgucaagcgcaaaaaggcuauuccgaccauccugagcuccggagccacauucgaacaagaggaauuuuaugccuacuucacgggcgcugacauuucuaccgugagcaucgccgggaucuccaacgauaauucuuuuaaauucagaggacucggcauucaggggcuggagaucuuugaaaagugucagguggacauucugggaaacaucagcgucguucggcaugagaauagacagggcuuccacuga

SEQ ID NO: 4008 - RNA, 3426 nt, Artificial Sequence
  Cas9 variant
auguacagcaucggccuggacauugggaucgccuccgugggauauucugucauugagaccaacagcggcagaaucguugaacucggggcucggauuuucgaggcccgcaauuccgauaacaauaaggacagacgggauuuucgcggaggcagacggcugauccgcagacggaaaacacgccuugacgaugcgaagagauaccuggacgaucagggguucaaaaacgacaagucucucaucaaugugugccccuauagccugcgggugaaaggacuuacggaggaacuguccaagucugaaauucgcaaggucauccuccacauucugaaaaagagaggcgugagcuaccuguccagcgaggaucucgacaccucuuccguugauaacaaagacagcuuuaagcaagcugugaccaaaaaucugcggcagcuugaugacaagacaccuggccagauccaguaugagcgccugcaagaaucugggagaguccggacaggaauuaaccagaauggccaguaccagcucaacguguucgacguugccuccuaugccaaggagcugaaacuuauccuggaaacccaacagcaguaccaucaggagauugaugaccacuuucucgauuucuuuacaaaggacggguacagagaggaugcuggacugaucuaucgcaaacggccguacuaugacggccccgggaaugccgcucaaaacagcucuuacggaagaugggccaauuaucagguggauggcaagccugcggaaaacaucuucgaccagcugauuggcaaagauuuuaccgggaagauccgcgccuccaaucucggacccagcgcucaaaaauucaaccugcuuaacgaccugaauaaccuccggauuacgaccagagaggaagagaagcugacauuugaagagaagcaggagauccuugaaguccuggagaaugaucgcccuaaaaccuucggcccccggaacauugccaagaugcucaaaguggacauggacgauaucaagggguggagacucaauuccucugacaaaccugaaauccauacaaugaaggaguacaacgauaugcgccuggugcuggaagcuggaggcuuugacauuaaggccaucgaucuggaccacauugaggagaucgcgagccuuauuacccugaauacggaacgggaggccuucgaacucucccugagcaacgagaucgauaauaaccuuaaacaguuccuggucgaaaauuuuaacgcucucagaaaguguaaaccgaauaacucuuggcauuccuucagcaaggagaaucugcagcgccugaucacagagcucgaacacaccucugacgagcaaaacacaauucuggaacggcuugggcugaaauuugaucucagaagcaaguauuccgaccgggauacccugcccauccacgagguucuggaggaaauuuacaacccuaccgugucuaagagcgugcgccagacauucagaguccuuaaugcccucgugaaaaaguacggaaaagagaacaucgacuauguuacgauugaaaugccccgggauaagaaugaggacgaccagaaaaagaccaucagagaaauucagaaggugaacaaaaaucgcaaggauaaauccaaggaguacuuucugaaaaagagcggcuggucugaggaaaaauucgaggaaaagcugcggacauccagacgcuuugcuagcaagcucuauuacuucuaugagcaagacggccugugcgccuacaccgggcagcagauccagccugaagaucuucugacagagagagucgagguggaccauaucauuccccucucuguuucccuggaugacagcaucaacaauaaagugcuggucaccuccgaagccaaccaaaagaaaggacagcggucuccguaugaugcuuuuaugagcggcgacuucuccaaguaccgcacguacgaugaguauaaagcgugggugcuuucuaauaaguacaagaaauauaagaaagcccuccugcuggaagagagaaacauuuuugacccugaacucgcuaagaaauuccggcagcgcaaucugaacgauacaagauacgccagccggaucguccuuaaugccgugcaguccuuuuucuauaagaccgacaccaagacacgcguugugaacggggcuuucacccacacacugcggaaaaaguggaaucucgccgauaaagacagagagacgcaucaccaccaugcgauugacgcuacccuggucgccgugacacccuuuguuaaggccgagcgcuacgaauauuacaaagauagcgagggaaaggcuucuaugguggacaccgucacaggcaccaucaucccuuacuccgaauauaagaaaaagaaccuguacgauagaagcaacuaucuucucauguucgggaaugagucuacgauuaaccaagagaaagaagacaaguccgccgaguuuauccggaaucugauucccgcuaaaaucuaccccgaaauuaaguucagccaccagguggauagaaaaucuaaccgccggcugagcgacgccaccaucuauuccacaagaagcuacaccguggagaagggccgcggaaagaauaaacgggaaguuaucgagagagauauuaucggcaagauuaaagacaucuauacagcggauggguacgccgaguacgucaaguauaaagacucucuccuggugaaggaaauugaugagaagaccuuugaaaaacuugaggcuaucaucgaagaguucuccgacacgguggaggucacagaccagcaaggaaaggugaaaaagguuagcaaauccccuuuucugcaguacugugaaaaguaugaugugccgggcgucaccaaguacucuaaaaagaacaaugggcccgugauucgcagccucaaauaucgguacacaaagcugagaucccauaucgacauuucuccuaaaaacagcaagaauaccguugcccugcuuacccucgcucccuggcgcacagauguguauuacucccaggagacggccucuuaccaucugcugggacucaaguauaucgaccugagcuuccgggauggcggguacggcgucuccagaaaacgguaugaagagauuaagaaaaacgaacgcaucccugaggacggagaguuuaaguucagccuuuacaaaaaggauuauauugaaaucgaguuugacaagaaaauccugcccggccucuaccagucuagagauguguccgcgcggaauaaguucagcaugaaaccgauugacaaggcccaauggaccucuaaagaagauguucugauguuugggaacgugaaggcuuccggagucuucgagaaaacacugaagaagaauuaugugcuucgcaaauaccacguggacguccugggcaacaaguucgagguuaaagaugaaauccucaaggacauucuggaguga

SEQ ID NO: 4009 - RNA, 3429 nt, Artificial Sequence
  Cas9 variant
auguacagcgugggccuggacaucgggauugccuccugcggauauucuaucauuaacgaugucaauggcaacaucguugagcucgggacccugcuuuucaagagcagaaauuccgacaacaaugaagaacggcgcacaaacagaggaucucggcgccugauuaauagacggcgcacgagacucgaugacggcaaaaagcugcuugcugaaaaaggguuuaagcaggauagcaaacugaagcacgugugucccuacgagcuccgggugaagggacugcaugaaaaacugacccaaggcgagaucuauaaggucgugcuccacauccugaaaaagcgcggcauuuccuaccuugacgagucugaugaaaacagcuccgggaucgacggagccagcuauaaagaucagguuaaucugaaccucaaucugcagaaggagcuuacaccuggccagauucaacugaagagacucaaagaaaacgggcggaucaagucuggagugaccuucgagaauggcuaccagcugaacgucuuuuccgugagcgcguaugcuaaugagcugaacaaaauucucacaaagcagucugaauacuacuccgagaucgaccagauuuggaucgaucgcuucaccaaaaacggguauagaaaggaagccggacugguuuaccggaaacgcccguauuacgacggccccggcaaugagaagaacaauagcaucuaugggagaugggccaacuuuaaggaagauggacauccuaaagagaauauuuucgaccaacuuaucggccuggacucuguggauuccacacagguccgggcuagcgccuccacccucacggcucagaaguacaaccugcuuaaugaccugaacaaucucaccauuaucgaggaugacagaaaauuuacaaccgaugaaaaggugucuauuaucaacuaucugaugacacaggacaucacccgcuucgggcccaaagagcuggccaaguuuuaccaacucgaaguggaucagauucggggauggagaaucgacaauaagggcaacccugagauucacagccugaaagucuaccgcgauuggaagaaaaucuucaauacguccagcauugaccuuacaucuauccagaccuggguuguggaugaacuggcgaacgugaucacacucaauaccgagauucccuccacccuggccacacuuaagaucaaaauuccugacaucgaccaacagauucugaacuuugucgagaacaauuucuaugaacucaagaagaaaacgagcaagaacucuuggcauagcuuuucccugaaaacccugaauauccucauuccggagcugcuuaacacaucugaagaacagaauaccauccuggaacggcucaaccugaaguucgaucugaaaaauaaguacgcugagaagaaccagauccccgugaaagagcuucucgaacaaauuuauaauccuacaguuaccaagagcgugcaccaguccaucaaacuguucaacgagauuaucgaaaaguacgggaaaaauaacauuagcuaugucacgaucgagaugcccagagacaagaaugaucaggaccagaaagauacaaucaagcgcauuaacaagcucaauucugagcggaaaaacgacuccgaaaaguacuuucuggagagaagcggaugggauaccauccgcuucgaaucugcccugaaaaagccucgguuugcugagaaacuucuguucuauuacgaacaaaagggcaagugcgccuacuccggccaggacauucucgcggagagccugcugaacgaguccugugaaguggaucacaucauuccccuuucuaucagcuuugacgauuccauccauaauaaaguucucgugaccgccucuagcaaccaggagaaggggcagagaacaccguauauggcuuucauugacggagccaaacugggccaauccugggaugacuuugucgcuugggugaauagcugcggguuccaccgcaagaaaguccagaaccugcucuacgaagagaauaucuuuaacccugacgugcagcggggauucguuucuagaaaucugaacgauacccgguaugccucccgcauugugcuuaaugccauccagagcuuuuucuacaagcaaaaggaccugacaaaagucaaggugguuaacggcucuuuuacgcauacccuccggaaaaaguggggguccagccuggauaaaaauagagacacauaucaccaccaugcuguggaugcgacccugugugccgucacacccuucauuaacaucgugaaguacgaguucuuugaggaggacggcaucaaguauaugguggaucuuaccacgggagaaaaaguugcuuacucugacuacaagaaaaugaaguucuaugauaaaagagccuacgucccuauuugggacggcuuuaucaagcagcucacccccgccaaucuguaucccaaaauuaaguucagccaccagguggauuccaaguggaaccgcaaaaucagcgacgcuacaauuuacucuacccggaagaucguggagacaaaaauuaauaagaaaggggucgccaaggaaaccgugaaggauaucguuaucgacaaaauuaaggacaucuauacgccugagggauggagaaaauuuaaggaaaaacaagauaagcugcucaugaagaacuucgacgagaaaacauacaacaagcugauuaaaaucgcgaaggaguauccggagaaaaaggaggugcagaccuccaauggcaaggucagccuuguggaaguuucccccuuuaaaauguacugcgaggagcagaacgugccugcuauucgcaaguacucuaaaaaggggaauggacccuauaucagaagccugaaauucuacgauaaggaacucggcaagcauaucaacauuacaaaagacuccuaugggaaugauaucgagcggaccauucgcaacaagaaaaucauucugaagaaucagaacucuuggagaaccgacgucuacuauaauagcgugaacaauuguuacgaacugcuuggcaucaaauauugccaccucaaguuuuaccggggaaaauacggcaucccuaaguccauuuaugaugagcugaagaaagaagacgagaucucuagcgaguccguuuucaaguuuagccuguaccgccaugauagagugcgguucgaaaaagacggggaguauauugaagcccucuuuggaucuaagaacgaguccaauaaaaacuaccuggaacuuagccccaucgauaagaauaaguggcugucuaaagagaacgucaaguucuucggcgagguggccgcuuccgggcgcuuuauuaaaggacucaagccgggcaucaaagugauuaagcaaagcacagacuauauggggcacgucuacgccauccaccaggaaaagcugaaauucguucugucugacgcuuga

SEQ ID NO: 4010 - RNA, 3435 nt, Artificial Sequence
  Cas9 variant
augaccagcaagcaggagaaacacggcgcccugacauucgggcucgacaucggaauugcuuccgugggcugggccguccugggggaaucuagaaucguugaucuuggagugcggugcuuugacaaggcggagacggcuaaagaaggcgagagccugaaccucacccgcagaauggcccggcugcuucgcagacggcugcgcagacgggccuggcgccucacaaagcuggcuagacugcucaaacgggaagggcugauugccgaugcuaaucuuuucaagcauaagaucgagaaaaacacccccgugccuaaguccucuuggcaacugcgcgucgacggacucgauagacagcugaaugccgaggaaugggcgcgggugauuuaccaccuuuguaaacaucgcggcuuucacuggaucagcagagccgaggaaaaggcugccgagggcgacuccaaaggggagggaggcaagguuaagcaggggcuggcuggaacgaaaaagcucaugcaggaaaaaucuuaucggaccgccgcggagauggugcuggccgaguucccggaugcucaaagaaacaagcagggcgacuacagcaaagcccugucccgcauccuccugggggaugaacuuaaggcucuguuugaacaucagcggaaacucggaaaucccgucgccacagagaagcuggaggccgcuauucuuggcaacggcgacaagaaaugcgggcuguucugggcgcagaauccugcccucgcuggaaacaagcugcuggaaaugcucggcagauguaccuuugagaaaacagggggagaugacggcaagggggaauaucgcgcccccaaagccagcuucucugcugagcggcacguguggcugacccaccuuaauaaccugagaaucguuguggauggaacaacccgcccucucaaugaagccgagcggagagucgcgcugcccaugccuuaccaacaggcuggcgaccuuuccuauaagcagcugggcggggcccucauuaaggagggauuucugcagaaagacggcuucaaguuugccgggcugccguaccccacaaaacaagcuagcgaagagaaggccaaagauccugaaaccucugugcucugcaagcugcccgcuuggcauacgcuucgcaagacacuggagaaacacggacucgaauccgaguggcagaagcugagcaccgacgcccuggauggcaaaccucagcuucucgacaacaucgcgugggugcugucugucuauaaggaugacgaugagguuaaaacagaacuggggaagcucaaucugcccaacaccgagaagaugauugacgcccuucuggauauccgguucgacaaauuuuccaaucucagccugaaggcucuguccaaaauugugccguucauggaacaaggccagagauacgaugaggccguggcuaacaucccugaguacggacaucacucucagcuucacaaggucggcgccggggaacauaaauaucugcccccuuucuacaaggagcgcgacaaaaccggacggaugguguuuaacgacgauauggacauccccagaaaucccguugugcuccgggcgcugaaccaggcccgcaaggucgugaaugcucucauuaaggaauauggcagcccucacgagguucauaucgaaauggccagagaucugucccggccgcuugacgagagacgcgauauugagaaacugcaaaaggaguucggggaacggaacaaaaaggacaaagaacucuuugcucaggauuucaauaucgugggaacagucaagggcaagcaguuugagaaauaccagcuguauagagaacaacaggggaaguguauuuaccccagcauggacgagaaacagggcaucugcuguuauucucugaagccucuugaucuccaccgcgugcuguacgaggaaggauacgccgagaucgaccaugcccugcccuauucccggagcuucgaugacucuaaaaacaauagaguccucgugcuggcuaaggaaaaccgcgauaagggcaauagaacgccuuuugaguaccuuggggacaaagacaacagcgaacccuggcggcaguucguugcguuuguggagggaaauaaggccuaucgccuggcuaaaagaucccggcuccugcgcaaggauuucggcgacaaagaggccaaggaauuuagagagcggaaccugaaugauacccgcuacauuugcaaguucuuuaaaaacuaugucgaacaauaccuucagcuccacgaggacucugaggccaagagaugugugguucugagcgggcagaugacauccuuccugcgggcuagauggggacucgugaaaguccgcggcgauagcgaccggcaccaugcccuggaugcggcugugguggccgccugcucucacgggaugguuaagagacuuuccgacuauagccgccggaaagaacuggagcaggucagagaaggcuucguggauguggacaccggagagaucgucaauccggcuauguuucaacaggugcaggaacauuucccuaaccccuggccucacuuucgcgaugagguuaagcuccggcugucuauugacgaucccacacugcuuagauccgagauggaaaaauucggcaccuacacgccugagagccuggaagcccuccgcccccuguuugugucccgggcgccgcaaagacggaacucuggggcugcccacaaggacacaaucuacgcccagccuaagcgccucgucgcucagggaggcgugacccagaaaguugcccugagcucccuuacccugaaggaccucgauaaacugauugacccccauagaaaugagcggcuguaugcugccauccgcgcgagacuugaacaacacgggggaaagggcgauaaagccuuccccgcuucuaacccucugcggaagccggacagcgaggggaaucccacaggcccuaucgugagaggagucaccauggugauugauaagcucuccggcauccccauucgcgggggaaucgccaaaaacgacagcaugguucggguggaugucuuuacaaaggcuaauaaauuccaucuggugccuguguacguccaccauucuguucucggccugcccaaccaggccauugucgggggaaaggaggaauccgaguggacgcagaucgacgauagcuuugacuggcacuucucuauuuauccuaaugaucuuaucagagugacccugaaacaggaaggccgcuuuggcuacuaugccgggugugaccgguccacagcugcgauccaccucugggcccaugacagaaaccaacaggugggaaaggauggccugauucgcagcaucggggugaagaccgcucugucuauugagaaauucaauguugacgugcuuggaaaccgguaccccgccccgccugaaaagagacgcgaucuggccuga

SEQ ID NO: 4011 - RNA, 3435 nt, Artificial Sequence
  Cas9 variant
augaccagcaagcaggaaaaccugggcgcccucacauucgggcuggacaucggaauugcuuccgugggcugggccguccuuggggaaaauagaaucauugaucugggaguucggugcuuugacaaagcggagacggcuaaggaaggcgagucucucaaccugacccgcagaauggcccggcuucugcgcagacggcuccgcagacgggccuggcgccugacaaaacuggcuagacuccugaagcgggaagggcuuaucgccgaugcuaaucuguucaaacacaagauugagaagaacacccccgugccuaaaagcuccuggcaacuccgcguggacggacuggauagacagcuuaaugccgaggaaugggcgcgggucaucuaccaucuguguaagcaccgcggcuuucauuggaucucuagagccgaggaaaaagcugccgagggcgacagcaagggggagggaggcaaagugaagcaggggcucgcuggaacaaagaaacugaugcaggaaaaguccuaucggaccgccgcggagaugguucuggccgaguucccggaugcucaaagaaacaaacagggcgacuacucuaaggcccucagccgcauucugcuuggggaugaacugaaagcucucuuugaacaccagcggaagcugggaaaucccguggccacagagaaacuugaggccgcuauccugggcaacggcgacaagaagugcggacucuucugggcgcagaauccugcccuggcugggaacaaacugcucgaaaugcugggcagauguaccuuugagaagacagggggagaugacggcaaaggggaauaucgcgcccccaaggccuccuucagcgcugagcggcaugucuggcuuacccaccugaauaaccucagaauugugguugauggaacaacccgcccucugaaugaagccgagcggagaguggcgcuucccaugccuuaccaacaggcuggcgaccugucuuauaaacagcucggcggggcccugaucaaggagggauuucugcagaaggacggcuucaaauuugccgggcucccguaccccacaaagcaggcuuccgaagagaaagccaaggauccugaaaccagcguccugugcaaacuucccgcuuggcacacgcugcgcaagacacucgagaagcauggacuggaaucugaguggcaaaaacuguccaccgacgcccuugauggcaagccucagcuccuggacaacauugcgugggugcugagcguguauaaagaugacgaugaggucaagacagaacucgggaaacugaaucuucccaacaccgagaagaugaucgacgcccugcucgauauucgguucgacaaguuuucuaaccugucccugaaagcucuuagcaagaucguuccguucauggaacaaggccagagauacgaugaggccguggcuaauaucccugaguacggacaccauucccagcuccacaaagugggcgccggggaacacaaguaucugcccccuuucuacaaagagcgcgacaagaccggacggauggucuuuaacgacgauauggacauucccagaaaucccgugguucugcgggcgcucaaccaggcccgcaaaguggucaaugcucugaucaaggaauauggcucuccucaugaggugcacauugaaauggccagagaucuuagccggccgcuggacgagagacgcgauaucgagaagcuccaaaaagaguucggggaacggaacaagaaagacaaggaacuguuugcucaggauuucaauauuguuggaacagugaaaggcaagcaguuugagaaguaccagcuguauagagaacaacaggggaaauguaucuaccccuccauggacgagaagcagggcaucugcuguuauagccuuaaaccucucgaucugcaucgcguccuguacgaggaaggauacgccgagauugaccacgcccuccccuauucuagauccuucgaugacagcaagaacaaucgggugcugguccuugcuaaagaaaaccgcgauaagggcaauagaacgccuuuugaguaccugggggacaaggacaacucugaacccuggcggcaguucguggcguuuguugagggaaauaaagccuaucgccucgcuaagagaagccggcugcugcgcaaagauuucggcgacaaggaggccaaagaauuuagagagcggaaccuuaaugauacccgcuacaucugcaaguucuuuaagaacuauguggaacaauaccuccagcugcaugaggacuccgaggccaaaagaugugucgugcugucugggcagaugacgagcuuccuccgggcuagauggggacugguuaaggugcgcggcgauuccgaccggcaccacgcccuugaugcggcugucguggccgccugcagccaugggauggugaaaagacugucugacuauucccgccggaaggaacucgagcagguuagagaaggcuucgucgauguggacaccggagagauugugaacccggcuauguuucaacagguccaggaacacuucccuaaucccuggccucauuuucgcgaugaggugaaacugcggcugagcaucgacgaucccacacuucugagaucugagauggaaaaguucggcaccuacacgccugagucccucgaagcccugcgcccccucuuuguuagccgggcgccgcaaagacggaacuccggggcugcccacaaagacacaauuuacgcccagccuaagcgccugguggcucagggaggcgucacccagaagguggcccuuucuagccugacccucaaagaccuggauaagcugaucgacccccacagaaaugagcggcuuuaugcugccauccgcgcgagacuggaacaacaugggggaaaaggcgauaaggccuuccccgcuuccaacccucuccggaaaccggacucugaggggaaucccacaggcccuauuguuagaggagugaccauggucaucgauaagcugagcggcauucccauccgcgggggaauugccaagaacgacuccauggugcggguugauguguuuacaaaagcuaauaaguuccaccucgucccuguguacgugcaucacagcguccugggccuucccaaccaggccaucguugggggaaaagaggaaucugaguggacgcagauugacgauuccuuugacuggcauuucagcaucuauccuaaugaucugaucagagugacccucaagcaggaaggccgcuuuggcuacuaugccgggugugaccggucuacagcugcgauucaccugugggcccacgacagaaaccaacaggugggaaaagauggccugauccgcuccauuggggucaagaccgcucuuagcaucgagaaguucaauguggacguucugggaaaccgguaccccgccccgccugagaaaagacgcgaucucgccuga

SEQ ID NO: 4012 - RNA, 3438 nt, Artificial Sequence
  Cas9 variant
augaagaccauccugggccucgaccuggggacaaacagcauuggaugggcccuugugaaagagacggaaaauuccaacgagaagucugaaaucauuaaacugggcgucagaguuaauccccucaccguggaugagaagacaaacuucgaagcugggcggccucugagcaccaaugccgaccgcacagcgaaaagauccgcucggcgcaaccuucagagauacaagcugcggcgcaagaaucucaucgaucugcugauuaaacacagacucaucgacaaggauaccccgcugacagagaucgggaaaaacaccacgcaucaaacccuugagcugcgggccaaggccgcucgcgaaagaauugagcucgaagaccuggcccggguguuucuugcuaucaauaaaaagcgcggcuauagaucuagccggaaggucaacaaugaggaggaaggacaggugguugauggaauggccguggcgaaaaagcuguacgacgagaaccucacacccggccaguaugccuacgaacugcuguccaaaggcaagaaauaugucccugauuucuaccgcucugaccuccaggcugaguuugauagcauuugggaauaucaaaagcaguucuacgccgacauccuggaugacgagcuuuacaaugcucugaaagggcagggacagcaaaacuccagaaagcgguuucucgccauuaagggcguguauaccgcggagaauaaagggaagagagacgaaguuaaacugcagcacuacaaguggcgcagcgaggccaucacacagaaacuuucuauugaagagguggcuuauguccugguggaaaucaacaacgaucucaauaaguccagcggauaccugggcgccaucucugaccgguccaaggagcuguauuucaacaaagagaccgugggggaaaaucucuggaagcagauucagaaaaacccccauacgagccugaagaaucaagucuuuuacagacaggauuaucuugacgaguucgaacaaaucugggagacacaggcucaguuucacccucagcugacccucgcccugaaagaacaaauucgcgauguugugaucuucuaccagcggaaacuuaagucucagaaaggacugcucuccuuuugccaguucgagagcugggagauugaaagaaaggacgagaacggcaaugugauccugaacaaaacaacccaacugcccaagcgccagaccgucggccggagaguggccccuaaauccucuccgcucuuucaggaguucaagaucuggcagaauauuaacaaucuggaaaucgcuaagauuagcgaugggaacuccaaaaauaagaaagagacagaagcgcuuagcgacgaugagcgcaagcuccuguucgaggaacugaaccugcggggaaaucuuucucaaaaagaaguucuccagauccugggccugaaggacaaagaguacaagacgaacuuucccgaggggcucgaaggaaacagaaccaaugccgcucuguucaacauuuaucagcagaucgccgagaaugaaggcuacggggauuggacaaagaaauccgcccaagagaucaaggaggaacuuaaagcuguguuuccucagauuggaauccaggccgacauucuggacuucaacgcggagcucgauggcaaggaauuugagaaucaagcuagcuaucagcuguggcaucugcuuuacucugccgaagaggacgauaaaaucaacgaagaggaccagauuaucuauggcaauagcgccgucucccucaagaagaaacugugugagaaguucggguuuacccccgaauacgcuaaauggauugccaacgugucucugcaggaugacuauggaaaucucagcacaaaggcuaugcgcaaaaucaucccuuaccugauugauggcaacgacuacuccgaggccugcgcgcuugccggguauaaucacagcaacucucugaccaaggaagagaaugauaaccgggagagacucaauaagcuggaacugcuucccaaaaacucccuccggaacccgguuguggagaagauccugaaucaaauggucaacguggucaaucaggugauugaaacguacggaaaaccugacgagguucgcaucgaacuggcuagagagcucaagaaaagcgccgaggaacgggcugagaugacaaagggcauuaacgaagccaccagacgcaaugaggauaucaagaaacugaucaccaagaacuucgggauucccaauccuaccaaaaacgacgugguccgguauagacuuugggaggaacuggcgccccucgccuacaaggauguguuuacaggccgccagaucaaaaaggaggaccuguucucuuccaaaauugacaucgaacacauuauccccaaggcucugcuuuuugaugacagcuucuccaauaagacacucgccuuuagagagacgaaccugaaaaaggcugaucggaccgccuauggauucaucgaaucugacuacaaugccacacuggaugacuauauucagcgcguugagacccucuacaacaaugcuaaaggcacaaucagcaaggggaaaagaaacaagcugcuuauggcgcaaaagaaucugccugauggauucauugaacgggaccuccgcaacucccaguacaucgccaaaaaggcuaaaucuaugauugagaagguguuuaacgaugucaaugugaccagcggcuccaucacggacagacugcgggaggauugggaccugaucaacgugaugaaagaacuuaauuucccgaaguauaaggcccuggggcucaccgagauugaggaacgcuacgauaucggacaggagaaaacaaagaaaguugaagucauuaccgacuggacaaagagaaacgaccaucggcaccaugccauggaugcucugaccguggccuuuacgacaaaaagccacgugcaguaucucaauaaccugaauaccauccacucucuuaagggcgacgaggucgaucuggaacucuccaagcuguacgggcugaaaaacacaauuaccgaggugguuaauaagaaacgcaaguucauucccccuaugcccaacuuuagagaagaggcgaaaaagcauaucgagaccauccuugugagcaucaagaauaaaaacaaggucuauacaaagaauauuaacaagacgaaaaaggaaucuggcuaccacaccaaagagcaacugacaccucggggacagcuccauaaggaaaccguguauggcaaguccaaaagacccaugaauaagccgacaaaaaucaacaagaauuucagccuggagcaggcucaacucauuaucaacguucaggaaaaagagcuggugcuucgccaccuggcccaguuugacaacaauccugccgucgcuuucgauaccaagacgcucaagaaaugucauuaccugaagauggugaaccuguga

SEQ ID NO: 4013 - RNA, 3441 nt, Artificial Sequence
  Cas9 variant
augagcggcaacacccacgggccccugacauucggauuugacaucggcauugccuccgugggguggugcguccucggagagaauagaaucguuaaccugggcgugcgguguuucgauaaggcugaaacggccaaagagggggaaucucuuaaucuggcgcgcagaaccgcucggcucaugcgcagacggcugcgcagacgggccuggcgccuuacaaagcuggccagacuccugaaacgggagggacugauugcugaagccagccgcauccauauuccuuccccggugucucccuggagacuccgggucgagggcaucgaccgcagacugaccgaugacgagugggcucgggugaucuaccaccuuugcaagcauagaggcuuucacuggauuagccgcgccgaagaacggaaagcggaauccgaugccaaggaagggggaagaguuaagaaaggccugucugacacacagcgccggaugaccgagaagggguauagaagcgcugccgaaauggugcucgcugaguucccugaugcccaacgcaacaaacagggagacuacggcaaggcgcugucccggauccuucugagcgaugaacucgcccugcuguuuagacgccagcgggagcucgggaaucccaacgcuggaaaugaacuggaggccacaauucuuggcaacggcaauagaaaaucugggcuguucugggagcagaagccuccccucgcuggagccgaccugcuuaagaugcugggccgcuguaccuuugagaaaaacgaguaucgggccccuaaggcuuccuucacggcggaaagacaugucuggcucacccggcugaauaaccugcgcgugguuguggaugggacaaccagaagccucgacgaugccgagcaccggcugguccuuccgcugcccuacaaacaagcuggagacuuuacauauaagcagcucagaaccgcccugacgaaagccggccuucugccugaaggguucaaguuugcuggacucucuuaccccacaggccgccagcuggacgauccuaaagccaaggaccccgaguccgagaagcuggugcggcucccggcguggcaggaacugagaaaaacccuuaaggauaaaaaucuggagacagaaugggagggcauggcuggggccgccaccggaggcaacccugaacuccuggacgagaucgcucgcgugcugagcgucuucaaggauggggacgagguuaccgccgaacuuuggaaacucccccugccuggaggcaaggcuaugauugaugcccugucugagaucuccuuugacaaguuccacgcgcucagccugaaagcccuuagaaagauugugccccauauggaauccgggcugcgguaugaugaggcuugcgccguggcuggcuaccaccauucucaacuccacgccgcgggagccggcgagcacaaauuccugcccccuuuuuacagccgcagagacaaggaugggcggauggucuucaaugaggagcuggacgugccgcgcaaccccguugugcuuagagcucucaaccaggcccggaaaguccugaaugcucuggugcgcacauauggauccccuacggccguucauaucgaaauggccagagaccucagccggccccuggaugagcgcaacaaggugaagaaagcucaggacgaauacagagagcggaaugagaaggauaaagcggccuuugcugccgaauauggcaucgccccuaagucuagagaguucgaaaaauuucagcuuuaccgcgagcaacaggggaagugugcuuauucccucaagagccuggaccugcaccggguccugcaugauauuggauacgccgaaguggaccacgcgcuucccuauucuagaagcuacgaugacuccaaaaacaauaagguccucgcucugaccgaggagaaccgcaauaaaggcaaccggacagccuacgaauaucugaccucuuucccgggaggcgagaauggagaaagauggcgcaacuuuagcguggccguugagacaaauaaggcuuaccggcucgccaaaagaacccgccugcuucggaaggauuucuccggcagagcggcugaagaguuucgggagcgcaaccugaaugacacgagauauaucugccgguucuuuaaaaacacaguggaacgcuuccucaagcuggaugccaaggucggggccggagacaccgcugagauuagcgccaaaagaugugugguucugucuggccagaccacagcuuuucuucgggccagaugggggcuccugaaggugcgcggaaauuccgaucggcaucacgcgcuggacgccgcugucguggccgcuugcagccacggcauggugaaaagacucggggacuacucucgcaccaaggaacuggccaaaguucaugauggcuucccugaccccgagacaggagagaucauugauccugucauguuccaacagcuucacgcccauuuucccgacccuuggccccacuuccgggcugaacuggaggcgagacucaacguggaugacacggccgaucugcgcgcucggauggaacuguuuggcaccuaugccccggaggcccuugaaacacugagaccucucuucgugucccgcgcuccccagagacggaacagcggggccgcgcacaaggacaccaucuacgcucagcccgagcgccugaaggagcaaggaggcgucacacagaaagugccucucaccucccugacgcuuaaggaucuggacaaacucaucgauccgcauagaaaugaaaagcuguaugccgccauucgggcucgccuggaggcccacgggggaaaagcggacaaggcuuuucccgccggcaacccucuuagaaagcccgaucgggaagggaauccuaccggccccguugugagaacagucaccauggugaucgacaaacugucugggauuccuguucgcggcgggaucgccaagaacgacacaaugcuccggguggauauuuucagacauaaaaaggacggaaaauuucaccugguccccguguacguuuaccaugcuguggccaaggaguucccgaaucgcgcuaucguccaggccaaggaugaagacgaguggacccucaucgaugacaaauuugauuucuguuuuagcgcgcacccuaacgaccugcuuaagauuacgcagaaauccggcgagacaaucuucggguauuaccggggaugccacucuggcaccgccgcuauuaauaucgcccugcaugauagauaugcuuacgccgaaaagacaaccagccucgccuuuuccaaaaagaaccccggcaaaccuauucccaaugacaagcuggggcugaucgagggaauuggcgugaagauggcugcgaacauggaaaaauuccacguggauacccuugggaauaucuauccggccccucccgagcaacggcgcggacuggcuuga

SEQ ID NO: 4014 - RNA, 3441 nt, Artificial Sequence
  Cas9 variant
auggccuacagacugggccucgacaucgggauuaccagcgugggaugggcugucguugcccuggagaaggaugaauccggccuuaaacccgugcggauccaggaccugggggugcgcauuuucgauaaggcggaggacucuaaaacaggagcuagccucgcccugccuagacgggaagcccgcuccgcuagacggcgcacgagacggcgcagacaccggcuuuggcgcgucaagagacugcucgagcaacauggcauccugucuauggaacagauugaggcccuguaugcucagcggaccagcuccccggauguguacgcccuccgcguugcggggcuggacagaugccuuaucgccgaggaaaucgcucgggugcugauucacaucgcccauagacgcggauuucagucuaaccggaaaagcgagauuaaggauuccgacgcuggcaagcuccugaaagccguccaagaaaaugagaaccuuaugcagagcaagggcuauagaacaguggcggagaugcugguuucugaagccaccaaaacagaugcugaggggaagcucgugcacggaaagaagcauggcuacgucuccaaugugcgcaacaaggccggggaauaucggcacaccgugagcagacaggcuaucgucgacgagguucgcaaaauuuucgccgcccagcgggcucugggaaaugaugugaugucugaagaacuggaggacuccuaccucaagauccuguguagccaaagaaacuuugaugacggccccgggggagacucuccuuauggccacggcuccgugagccccgaugggguccgccaguccauuuacgaacggauggugggaucuugcacauucgagaccggcgagaaaagagcgccucgcagcuccuacagcuuugagcgguuccagcuucugacgaagguugugaaucucagaaucuaucggcagcaagaagacgggggacgcuaccccugugagcugacccagacagagagagcccgggucaucgauugcgcuuaugaacagaccaaaauuacauacggcaaacuuagaaaacugcucgacaugaaggauaccgagucuuuugccgggcugacguauggacugaaccgcucccggaauaagacagaagacaccguguucguugagaugaaauuuuaccaugaagugagaaaggcccuccaacgcgcuggcgucuucauccaggaucugagcauugagacacuugaccagaucggcuggauucugucuguguggaaaagcgaugacaacagacggaagaaacucuccacccuggggcuuucugauaaugucaucgaggaacugcucccucugaacggaagcaaguuuggccaccugucccucaaggccauccgcaaaauucugccguuccuugaggacggguauagcuacgacguggcgugugaacuggcuggauaccaguuucaaggcaagaccgaguauguuaaacagagacuccugcccccucugggggagggcgaagugacaaaucccgucgugcggcgcgcccuuucucaggccaucaagguugugaacgcugucauuagaaaacauggauccccugagagcauccacauugaacucgcccgggagcugucuaagaaucuggaugaacgcagaaagaucgagaaagcucagaaggagaaccagaaaaacaaugaacaaaucaaggacgagauucgggaaauccucggcuccgcccacgugacggggcgcgauauugugaaauacaagcuguucaagcagcagcaagaguucugcauguauagcggagaaaaacuugacguuaccagacuguuugagcccggcuacgcggaggucgaucauaucauuccguaugggaucuccuucgacgauucuuacgacaacaaggugcucgugaaaacagaacagaaucggcagaagggaaacagaaccccucuggaguaucugcgcgauaaacccgaacagaaggccaaauuuauugcucuugucgagagcaucccucucucccaaaagaagaaaaaucaucugcugauggacaagcgggccaucgaucucgaacaggagggcuucagagagcgcaaccugucugacacacgguacauuaccagagcucuuaugaaucacauccaggccuggcugcucuuugaugaaacggcgagcacacgcuccaaacgggugguuugugugaacggggccgucaccgcuuacaugagagcccgcuggggccugaccaaggaccgggacgcuggagauaaacaccaugccgccgacgcugugguuguggcgugcauuggcgauagccugauccaaagagucacaaaguaugacaaguucaaacggaaugcccuugcugaucgcaacagauacgugcagcagguuucuaaguccgaggggauuacccaguauguggacaaagaaacaggagaggucuuuacgugggagagcuucgaugaacggaaguuucuccccaaugagccccuggaaccuuggccguucuuucgcgacgagcugcucgccagacugucugaugaccccuccaaaaacauccgggccaucggccuucugaccuacagcgaaacagagcaaauugauccuaucuucgugucuagaaugcccacccgcaaggugacaggggcugcccacaaggagaccauucggagcccuagaaucgucaaaguugacgauaauaagggaacggaaauucaggugguggucuccaaaguggcgcucaccgagcugaagcugacaaaagacggcgaaaucaaggacuauuuucgccccgaggaugacccgcggcuuuacaacacccucagagaacgccugguucaguucgggggcgaugcuaaggccgccuucaaagagccuguguauaagaucagcaaagacggaucuguccggacacccgugagaaagguuaaaauucaggagaagcugacccucggcgugccuguccacgggggacgcggcaucgcugaaaaugggggaauggugagaauugauguuuuugccaaaggcgggaaguacuacuucgugcccaucuaugucgcggacgugcugaagcgggagcuuccuaaccgccuggcuacggcccauaaacccuacuccgaauggagaguggucgaugacagcuaucaauuuaaguucucccucuacccgaacgaugccguuaugauuaaaccuucucgggagguggacaucacauauaaggaucgcaaagaacccgugggcuguagaaucauguacuuugucagcgcuaauauugccuccgcuucuaucagccugcggacccacgacaacuccggagagcuggagggccuugggauucagggacuggaaguguucgagaaguauguugugggcccccucggggacacacauccugucuacaaggaaagacgcaugccguuucggguggagagaaaaaugaauuga

SEQ ID NO: 4015 - RNA, 3441 nt, Artificial Sequence
  Cas9 variant
auggccuacagacugggccucgacaucgggauuaccagcgugggaugggcugucguugcccuggagaaggaugaauccggccuuaaacccgugcggauccaggaccugggggugcgcauuuucgauaaggcggaggacucuaaaacaggagcuagccucgcccugccuagacgggaagcccgcuccgcuagacggcgcacgagacggcgcagacaccggcuuuggcgcgucaagagacugcucgagcaacauggcauccugucuauggaacagauugaggcccuguaugcucagcggaccagcuccccggauguguacgcccuccgcguugcggggcuggacagaugccuuaucgccgaggaaaucgcucgggugcugauucacaucgcccauagacgcggauuucagucuaaccggaaaagcgagauuaaggauuccgacgcuggcaagcuccugaaagccguccaagaaaaugagaaccuuaugcagagcaagggcuauagaacaguggcggagaugcugguuucugaagccaccaaaacagaugcugaggggaagcucgugcacggaaagaagcauggcuacgucuccaaugugcgcaacaaggccggggaauaucggcacaccgugagcagacaggcuaucgucgacgagguucgcaaaauuuucgccgcccagcgggcucugggaaaugaugugaugucugaagaacuggaggacuccuaccucaagauccuguguagccaaagaaacuuugaugacggccccgggggagacucuccuuauggccacggcuccgugagccccgaugggguccgccaguccauuuacgaacggauggugggaucuugcacauucgagaccggcgagaaaagagcgccucgcagcuccuacagcuuugagcgguuccagcuucugacgaagguugugaaucucagaaucuaucggcagcaagaagacgggggacgcuaccccugugagcugacccagacagagagagcccgggucaucgauugcgcuuaugaacagaccaaaauuacauacggcaaacuuagaaaacugcucgacaugaaggauaccgagucuuuugccgggcugacguauggacugaaccgcucccggaauaagacagaagacaccguguucguugagaugaaauuuuaccaugaagugagaaaggcccuccaacgcgcuggcgucuucauccaggaucugagcauugagacacuugaccagaucggcuggauucugucuguguggaaaagcgaugacaacagacggaagaaacucuccacccuggggcuuucugauaaugucaucgaggaacugcucccucugaacggaagcaaguuuggccaccugucccucaaggccauccgcaaaauucugccguuccuugaggacggguauagcuacgacguggcgugugaacuggcuggauaccaguuucaaggcaagaccgaguauguuaaacagagacuccugcccccucugggggagggcgaagugacaaaucccgucgugcggcgcgcccuuucucaggccaucaagguugugaacgcugucauuagaaaacauggauccccugagagcauccacauugaacucgcccgggagcugucuaagaaucuggaugaacgcagaaagaucgagaaagcucagaaggagaaccagaaaaacaaugaacaaaucaaggacgagauucgggaaauccucggcuccgcccacgugacggggcgcgauauugugaaauacaagcuguucaagcagcagcaagaguucugcauguauagcggagaaaaacuugacguuaccagacuguuugagcccggcuacgcggaggucgaucauaucauuccguaugggaucuccuucgacgauucuuacgacaacaaggugcucgugaaaacagaacagaaucggcagaagggaaacagaaccccucuggaguaucugcgcgauaaacccgaacagaaggccaaauuuauugcucuugucgagagcaucccucucucccaaaagaagaaaaaucaucugcugauggacaagcgggccaucgaucucgaacaggagggcuucagagagcgcaaccugucugacacacgguacauuaccagagcucuuaugaaucacauccaggccuggcugcucuuugaugaaacggcgagcacacgcuccaaacgggugguuugugugaacggggccgucaccgcuuacaugagagcccgcuggggccugaccaaggaccggaaugcuggagacaaacaccaugccgccgaugcugugguuguggcgugcauuggcgacagccugauccaaagagucacaaaguaugauaaguucaaacggaacgcccuugcugaccgcaauagauacgugcagcagguuucuaaguccgaggggauuacccaguauguggauaaagaaacaggagaggucuuuacgugggagagcuucgacgaacggaaguuucuccccaacgagccccuggaaccuuggccguucuuucgcgaugagcugcucgccagacugucugacgaucccuccaaaaauauccgggccaucggccuucugaccuacagcgaaacagagcaaauugacccuaucuucgugucuagaaugcccacccgcaaggugacaggggcugcccacaaggagaccauucggagcccuagaaucgucaaaguugaugacaacaagggaacggaaauucaggugguggucuccaaaguggcgcucaccgagcugaagcugacaaaagauggcgaaaucaaggacuauuuucgccccgaggacgauccgcggcuuuacaauacccucagagaacgccugguucaguucgggggcgacgcuaaggccgccuucaaagagccuguguauaagaucagcaaagauggaucuguccggacacccgugagaaagguuaaaauucaggagaagcugacccucggcgugccuguccacgggggacgcggcaucgcugaaaacgggggaauggugagaauugacguuuuugccaaagauggcaaguacuacuucgugcccaucuaugucgcggacgugcugaagcgggagcuuccuaaccgccuggcuacggcccauaaacccuacuccgaauggagaguggucgaugacagcuaucaauuuaaguucucccucuacccgaaugaugccguuaugauuaaaccuucucgggagguggacaucacauauaaggaucgcaaagaacccguggggcugagacugauguacuuugcuggcgccgacaucagcggagcuacccuuacacugcggacccacgacaacuccggcgagcucaaggggcugggcauucagggacucgaggucuucgaaaaguaugugguugggccccugggagauacccauccuguguacaaagagagacgcaugccguuucgggucgaaagaaagaugaauuga

SEQ ID NO: 4016 - RNA, 3447 nt, Artificial Sequence
  Cas9 variant
augaccaagcugaaccagcccuacggcaucgggcucgacauuggaagcaauuccaucggcuucgccguggucgaugcuaacucucaccuucuuagacugaaaggggagacagccauuggagcgcggcucuuucgcgaaggccaaagcgcugccgacagacgggggucccgcacgaccagacggcgccugucuagaacacgguggcgccuuagcuuccugagagauuucuucgccccucauaucaccaagauugacccggacuuuuuccuccggcagaaauauuccgagaucucucccaaggauaaagaucgcuuuaaguacgaaaagagacuguucaaugaccggacagaugcugaguuuuaugaagccuacccuagcauguaucaucugcgccucagacugaugaccgacgcuucccaggccgauccccgggagaucuuccuugcgauucaccacauccugaaaagcagaggacauuuucucacaccuggcgccgcuaaggacuucaacaccgauaaaguugaccuggaggacauuuuucccgcccuuacggaagccuacgcccagguguauccugaucuggagcucaccuucgaccuggcgaaggccgaugacuucaaagcuaagcugcucgaugaacaagccacaccgucugacacccagaaggcucuggugaaucuucugcucuccagcgauggcgagaaagagaucgucaagaaacgcaaacaggugcugacagaauuugccaaggccauuaccgggcuuaagacgaaauucaaccuggcucucggaacagagguugacgaagcggaugccucuaauuggcaguuuuccaugggccaacuggacgauaaguggagcaacaucgagaccucuaugacagaccaggggaccgaaauuuucgagcagauccaggagcuguaccgggcuagacuccugaauggaaucgugcccgccggcaugucccuuagccaagccaaggucgcugacuacgggcagcacaacgaagaucuggagcucuuuaaaaccuaucugaagaaacuuaaugaccacgaacuggccaagacaauucgcgugaucuacgaucgguauauuaacggagacgaugcgaaaccuuuccucagagaggacuuuguuaaggcucugacgaaggaagugaccgcccaucccaaugaggucuccgagcagcugcucaaccgcaugggccaagccaauuucaugcugaaacagcggacaaaggcuaacggcgccaucccugugcagcuucagcaaagagaacuggaucagauuaucgcuaaccagucuaaauacuaugacuggcucgccaagcccaauccgguggagaaacaccgcgcgagcaagccuuaccagcuggaugaacugcuuaccuuucggauccccuauuacgucgggccucucauuacacccaaggagcaagccaaauccggagaaaacguuuucgcuuggauggugagaaaggaccccagcggcaauaucaccccuuacaacuuugaugagaaaguggaccgcgaggccucugcuaaugucuucauucagcggaugaagacgacagauaccuaucugaucggggaagacgugcugccgaaacagucccuccuguaccagaaguaugagguucuuaacgaacugaauaacgugagagucaauaacgaggcccucggaaccgaccaaaagcagcggcugauucgcgagguguuugaaagacauagcucuguuacaaucaaacagguggcggauaaucuggucgcccacggcgacuucgcucagcggcccgagaucagagggcuugccgaugaaaagcgcuuccucagcucccugucuaccuaccaccaacugaaagagauucuccauggagcuaucgacgauagcacaaagcugcacgacauugaaaacaucauuacgugguccaccguguuugaggaugccgccaucuucaaaacaaagcuggcugagauugacuggcuggaugcggccaccaucaaaaagcucagcaauauccgguauagaggcuggggccaguuuucucgcaagcugcuggacgggcuuaaacucggaaacggccagacagucauucaagaacugaugcuguccaaucauaaccucaugcagauccugaccgaugagacgcuuaagaccacaauggcugaacugaaccaggacaaacucaaggccgaugacauugaggacgugaucaaugaugccuacaccagcccuucuaacaaaaaggcucugagacagguucugcggguggucgaagacauuaagcacgccgcgaaugggcaagaucccuccuggcuuuauaucgagacagcugacggaccuggcaccgccgggaaacgcacgcagagcagacagaagcagauccaaacaguguacgccaacgcugcccaggagcucauugauuccgcgguucggggcgaacuggaggacaaaaucgcugauaaggccucuuucaccgaccgccuggugcucuacuuuaugcagggaggcagagauauuuauacaggggcuccccugaauaucgaccagcuuagccauuacgauauugaccacauccugccgcaaucccucaucaaagacgauucucuggacaaccggguccuggugaaugcuaccauuaaccgcgaaaagaauaacguguucaccagcacacuuuuugccuccaagauggcugccacguggagaaaauggcacgaggcgggacugaucagcggccggaagcuccgcaaucugaugcucagaccugaugaaauugacaaauucgcccauggguuuguugcucggcagcuggucgagaccagacagaucauuaaacuuacagagcaaaucgccgcugcccaguaucccaacaccaagaucauugccgugaaggcuggacugucucaccagcuccgcgaggaacuggauuucccuaagaaucgggacgugaaccauuaccaccacgcguuugaugccuuccuggcugccagaaucggcacauaucuucugaaacgcuacgccaagcucgcucccuuuuucaccuauggggaauuugccaaagucgacgugaagaaauuucgggaguucaauuuuauuggcgcgcugaagcaugcuaaaaagaacaucguugccaaggauacgggagagauugugugggacaaagaaagagauauccaggagcucgaccgcauuuacaacuucaagcggaugcugaucacacacgaagucuacuuugagaccgccgaucuuuucaaacaaaccaucuaugcugccaaggacuccaaagaaagaggcgggagcaagcagcugauuccuaagaaacgcggauaccccacacagguguauggcgggauccauggaaagauucggcucaccuggagauggcugaaacugcuucggcgcaagaaaaugucuaucgagcuguccgagcuccagcugcucaaguga

SEQ ID NO: 4017 - RNA, 3450 nt, Artificial Sequence
  Cas9 variant
auggagagauaccacaucggccuggacauugggaccagcuccaucggaugggccgugauuggcgaugacuucaagaucaaacggaagaaagggaagaaccucauuggaguccgccuguuuaaagaaggcgauacagcugccgagagacggggguuccgcacgcaaagacggcgccuuaauagacggaaguggcgccugaagcuccuggaagagaucuuugaccccuauauggcggaaguugauaaauacuucuuugcuagacuuaaggagucuaaccugagcccuaaagacuccaauaagaaauaucucggaucucugcuguucccggauaucagcgacuccaacuuuuacgauaaguaucccaccauuuaccaucuccggcgcgaccugauggagaaggauaaaaaguucgaccuuagagaaaucuaucuggccauucaccauaucgugaaauaccggggcaauuuucucgagaaggugccugccaaaaacuacaaaaauucuggcgcuagcauuggguuccugcuugaagaggucaacgaucuguauggaaauaucauuggcaacgaggacguggccauccucgacaaugauaaauuugaagacguugagaagaucauucugaacgaugaaauccgcaauauugacaagcaaaagaacguggggagacugcucgucaaggauaaaaaggagaaaaauaucgugacagcuuucuccaaggccauuuuuggauacaaguucaaccuggaagaccuucugcucaucgagagcgaugagaaaaacaagcugaccuucaaugacgaaaacaucgaugacauuuuuaaugagcuuucucacucccugaacgauaaucagauggaccuccugacaaaaacccgggaaaucuauuucaaguuuaaacugaacaugauuguucccacaggcuacaccaucagcgagucuaugauugaaaaguaugagaugcauaaggcgcaccucaaaauguacaaggaguucaucaauacgcugaacgccaaagacagaaagauccuuaaaaaugcuuauuccgauuacauuaacaaugaaaaggccaaggcugccaacgcgcaggagaauuuuuacaaaaccgugaagaaaacaaucaaggaaaacgacagcgauaccgccaaaaagauuaucgggcugauugacgagggaaauuucaugccuaaacagcgcacaggcgaaaacggcgucaucccccaccaacuccaucagauugagcuggaucggaucaucgagaaccaggcuaaguauuacccuuggcuugccgaagagaauccgguggaaaagaacagaaaauuugcuaaguauaaacuggacgagcucgugaccuuccgcguccccuacuauguugggccucugauugauaagacggagucuaauaaaaacgaaaaggagacaaaguuugccuggauggugcggaaagccaagggaaccaucacacccuggaauuucgaaaaccugguggacagaaccgaguccgcuaaucgcuuuauuaaacggaugaccagcaaggauacauacaucauuggcgaagacguccucccugcguccucucugcuuuaugagaaauacaaggugcugaacgagcucaauaacaucaagguuaauaaaaagaaacuggauguggaacagaagcaacacgucuaccuggaccuuuucacgacccgcaaaaacgugacaaaggaugaccucgccaccagccugaauugcgacguugaguccaucacagggcugaccgauaacaagaaauuuaauagcucucucuccagcuauauugaccugaaggcuauccuuggaaacauuguggaugacuacucuaaaaacgaagaucuggagaagaucauugaauauagcacgaucuucgaggacggcaauaucuacaaagagaagcucuccgaaauuucuuggcugacagaugagcagaucgaaaaacugagcaacauucauuucaagggguggggaagacuuuccaagaaacuccugacccagaucaccaaugagaacggcgaacggauuaucgacacacuguggaauaccagcaacaauuuuauccaggucauuucugaugaguccauccaagccaagcucgccgagauuaacggcgaauaugcuaauaaauacaaccuggaggacauccuugaugaagccuauacaagcccccagaauaagaaagcgauuagacaggugaugaaggucguggaggacaucgagaaggcuaugaaaugugaaccgacgucuauugccaucgaguucacccgcgaaaagcggaaauccaagcugacaaacaccagauacaaaaagaucagcgagacauacgaaaagauuaccgaugagcucaucuccgaguaugaacuggggaaacugcaaucugagcuugacagcaagguuaauaacaugcgggaccgcuacuaucucuacuuuaugcagcugggaagagauauguauacgggcgagaaaaugaauauugacgaacugcaccagaaguacgauaucgaccacauucucccucaguccuucaucaaagaugacucucugaacaaccgggugcuuaccagcaaguccgucaauaucaaggagaaaagcgauaagacagccgcugaccuguaugccgcuaaaaugggggauuuuuggagaaagcuccgcaaacaaggacugaugaccgaacagaaguacaagaaccugcuuacacggaccgacucuauuaauaaauacacgaagcaguccuucaucaaaagacagcucguggagacaagccaaguugugaagcuggccgcgaacauucugcaggauaaauaucgcaauaccaagaucauugaaaucagagcccggcucaacucugaccugcgcaaaaaguacgagcuuaucaagaauagagaagucaacgacuaucaucacgcuauugauggcuaccugacaaccuuuguggggcaguaucucuacaaaguguaucccaagcugcgguccuacuucguuuacgacgauuuuaaaaagcuggacagcaauuaucuuaaacauauggauaaguucaacuuuaucuggaagcuggaggacaaaaaggccgaagaugucuacgacaaagugaaugaugaguucgugcucaacgucccugagaugaaggaauauauucgcaaaaucuacaauuauaaguacaugcuggugucuaaggagguuaccacgaaaaacggcgcuuuuuaugaccagacaaaguacaaugccaaaaccauuaaccucauccccauuaagaaagauaagcccacaaauaucuacggaggcuauaaggggaaagugagcuccuacaugaugcuggucaagauccagaaaaagaaagaagugauuuauaaguucguuggagugccuagacuuuggaccgacgagcuggaucggcucaucgacacagacgagaaaaaggcgcugcugaagaaauga

SEQ ID NO: 4018 - RNA, 3459 nt, Artificial Sequence
  Cas9 variant
augaacgccgagcacggcaaggaagggcugcucaucauggaggaaaauuuccaguacagaauuggacuggacaucggcauuaccagcguggggugggcuguccuucaaaacaauucccaggaugagcccguucggaucacagaccugggagugcgcauuuuugauguggccgaaaacccuaaaaauggcgacgcgcucgcugccccgagacgggaugcccgcacgaccagacggcgccugagacggcgcagacaucggcuugagcgcaucaaguuccugcuccaggagaacgggcugaucgaaauggacucuuuuauggagagauauuacaaaggaaaucugcccgaugucuaucagcuccgguacgaaggccuggaccgcaagcugaaagaugaggagcuggcucaagugcucauucacaucgccaagcauagaggcuuccggagcacaagaaaggcugaaaccaaagagaaggaagggggagccguucugaaagcgacaaccgagaaccagaagauuaugcaggaaaaaggcuaucgcacagugggggagaugcuuuaccuggacgaggccuuucacaccgaaugccucuggaaugagaagggauauguccugacgccucggaacagacccgaugacuacaagcauaccauccugcgcuccaugcucguggaagagguucacgcuauuuucgccgcucagcgggcccacggcaaucaaaaagcgacagaagggcuggaggaggccuacguggaaaucaugaccucucagcgcagcuuugauaugggaccuggccuucagcccgacggcaagccuuccccguaugcuauggagggguucggagacagagucggcaaauguacauuugaaaaggaugaguaccgggcccccaaagcuaccuauacggccgaacuguucguggcccuccagaagauuaaccauacaaaacugaucgacgaguuugggaccggaagauucuuuucugaggaagaacgcaagacaaucauuggccuucugcucagcuccaaggaacugaaauacgggaccauccggaagaaacugaauauugauccuagccucaaguucaacucucugaauuauuccgcuaaaaaggagggagagaccgaagaggaaagagugcuugacacagagaaggcgaaauucgccagcauguuuuggacguacgaauauucuaagugccugaaagaucgcaccgaggagaugcccgucggcgaaaaggcugaccucuucgaucggaucggcgagauucugacagccuacaaaaacgacgauuccagaagcucucggcuuaaggaacuggggcucuccggagaggaaaucgacggccugcuggaucucagcccugccaaguaccaacgcguuucccugaaagcuaugagaaagaugcagcccuaucuugaggacgggcugaucuacgacaaagccugugaggcggcuggauaugauuuucgggcccucaacgacggcaauaagaaacaccuucugaagggggaagagauuaacgccaucgugaaugauauuaccaacccgguggucaagagaucugugagccagacaaucaaaguuauuaaugcuaucauccaaaaguacggcuccccucaggccgugaacauugaacuugcucgcgagaugagcaaaaauuuccaggaccggaccaaccucgaaaaggagaugaaaaagagacagcaagagaaugaacgcgccaaacagcagaucauugagcugggaaagcagaaccccacgggccaagauauccugaaguauagacucuggaaugaccaagggggauacugccuguauucuggcaaaaagauuccucuugaggagcuguuugaugggggauacgacaucgaucauauucuccccuacuccaucacauucgacgauagcuaucggaacaaaguccuggugaccgcgcaggagaaucgccagaagggcaacagaacccccuacgaauauuuuggggccgacgagaaacggugggaagauuacgaggcuucuguucgccugcuugugagagacuauaagaagcagcagaaacuccugaagaaaaauuucacagaagaggagcggaaggaauuuaaagagcgcaaccugaacgacaccaaguacaucacaagagucguguauaauaugauucggcagaaccucgaacuggagccuuucaaucacccggaaaagaaaaagcaggucugggccgugaacggcgcuguuacgagcuaccuucgcaaaagauggggacugaugcaaaaggaucgguccaccgacagacaccaugccauggaugcgguggucaucgccuguugcacagacggcaugauucacaaaaucucucgcuacaugcaggggcgggagcucgcuuauagcagaaauuuuaaguuccccgaugaggaaaccggagagauucugaaccgcgacaauuuuacacgggaacagugggaugagaaguucggcgugaaaguuccucugcccuggaacuccuucagagacgaacuugauauccgccuccugaaugaggacccuaagaacuuucugcucacccaugccgaugugcaacgggagcuggacuaccccggguggauguauggagaagaggaaagcccgaucgaggagggcagauacauuaauuauauccgcccucuuuucgucucucggaugcccaaccacaaagugacgggguccgcucaugaugccaccauuagaagcgcccgggacuacgaaacacgcggcgugguuaucaccaaggucccucugacagaccucaaacugaauaaggauaacgagauugaaggauauuacgacaaagauucugacagacugcuuuaccaggcucucgugcggcagcugcugcuccacggcaaugaugggaagaaggcguuugccgaggacuuccacaaacccaaggcugauggaaccgaaggcccugugguccgcaaagugaagaucgagaaaaagcagacguccgggguuauggugagaggaggcacagggaucgccgccaacggcgagaugguccggauugacguguuuagagaaaacggaaaguauuacuucguucccguguauaccgcugaugucgugcgcaaaguucugccgaaucgggccgcgacacauaccaagccuuacagcgaguggagagugauggacgaugcuaacuuugucuucucccuuuauucucgcgaccugauccacgugaaaagcaagaaagacauuaagaccaaucucgugaacggcgggcugcugcuucaaaaggaaaucuuugccuacuauacaggagccgauauugcuacggccuccaucgcgggcuucgcuaaugacucuaacuuuaaauuccgggggcugggaauccagagccucgagauuuuugaaaagugucaggucgauauccugggcaauauuuccguugugagacaugagaaccgccaggaguuccacuga

SEQ ID NO: 4019 - RNA, 3462 nt, Artificial Sequence
  Cas9 variant
augaagaacauccugggccucgaccuggggcuuagcuccauuggauggucugugaucagagagaauagcgaagaacaggaacuggucgccaugggcucccggguugugucucucaccgcugccgagcugagcuccuucacacaagggaacggagugucuauuaauagccagcgcacgcagaaaagaacccagcggaagggcuacgaucgcuaucaacuuagacggacacugcuccgcaacaaacuggacacccuggggaugcuccccgaugacucccugagcuaccuuccuaagcugcagcucuggggacugagagcgaaagcugucacacagcggaucgaacuuaaugagcugggccgcgugcuccugcaccugaaccagaagagaggcuauaagucuauuaaauccgauuuuagcggggacaagaaaaucaccgauuacguuaagacagugaaaacccgguaugacgagcucaaggaaaugcgccugacgaucggagagcuuuucuuuagacggcugaccgaaaaugccuucuuucgcugcaaggagcaagucuacccgagacaggccuauguggaggaguucgauuguauuaugaacugccagcggaaauuuuaccccgacauccucacagaugagaccauuagauguauccgcgacgaaauuaucuacuaucagcggccucugaagucuugcaaauaccuuguuuccagaugugaguucgaaaagcgcuuuuaucugaaugcugccggcaaaaagacagaggcugggcccaaagugagcccucggaccucuccccucuuccaagucugcagacugugggaguccauuaacaauaucguggugaaggaucgccggaacgaaaucgucuuuauuagcgccgagcagagagcggcccuguucgacuuucucaauacgcaugaaaagcugaaaggauccgaccuucugaagcuccugggccuuucuaaaacauacggguaucgccugggagagcaguucaagaccggcauccaaggcaacaaaacacggguugaaauugagagagcucucgggaauuacccugauaagaagcgccugcugcaguucaaccuccaggaggaaagcuccagcauggugaacaccgagaccggagaaaucauuccgaugaucucucuguccuuugagcaggaaccccuuuaucggcuguggcacgugcucuacagcaucgacgauagagagcaacugcagucuguccugcggcagaaauucggcauugacgaugacgaggugcuugaacgccucagcgccaucgaucugguuaaggcuggguuuggaaauaaauccucuaaggccauuagacggauccugccuuuccuccagcugggcaugaacuacgcggaggccugugaagcugccggguauaaucauagcaacaauuacacaaaagcugagaacgaggccagagcccuucuggaccgccuccccgcuauuaagaagaaugaacugcggcaaccuguggucgagaaaauccugaaccagauggugaauguugugaacgcgcuuauggaaaaguauggaagauuugaugagauccgcgucgaacucgccagagagcugaaacaguccaaggaggaacggagcaauacguacaaaucuauuaacaagaaucagcgcgagaacgaacaaaucgcuaagagaauuguggaguauggcguccccacccggucccgcauccagaaauacaagaugugggaagagagcaaacacugcuguauuuauugcggccagccgguggacguuggggauuuccugagaggauuugacguggaggucgaacauaucauuccuaagucucucuacuucgacgauuccuuugccaauaaaguguguagcugccgguccugcaacaaggagaaaaacaaucgcacagccuacgacuauaugaagucuaagggcgaaaaagcucugagcgauuacguugagagagugaacaccauguauacaaauaaccagaucuccaagaccaaauggcaaaaucuucugacgcccgucgacaagaucucuauugauuucaucgaccggcagcuccgcgaaagccaguacauugccagaaaagcgaaggagauccugacauccauuuguuauaacgugaccgcuaccagcgggucugugacauccuuucugcggcacguuuggggaugggauaccguccuucacgaccucaauuucgauagauacaagaaagugggccugacagaggugaucgaagucaaccaucgcgggagcgugauccggagagagcaaauuaaggacuggucuaaacgcuuugaucaccggcaucacgccaucgacgcccugacgauugcuugcaccaagcaggccuauauccagagacucaauaaccugcgcgcugaagagggcccugauuucaauaaaaugucccuugagcgguacauucagagccaaccccacuucucuguugcccaggugagagaagcggucgaccgcauccuggugagcuuucgggccggaaagagagcuguuacacccggcaagcgguacauccgcaaaaacagaaagcggauuuccgugcagagcguccucaucccucgcggggcccugucugaggaauccguguauggaguuauucaugugugggagaaagacgaacagggccacgucauccaaaagcagagagcugugaugaaauacccgauuaccagcaucaaucgggagaugcuggauaaggagaagguggucgacaaaagaauccaucgcauucuuuccgggcggcucgcccaguauaacgauaaucccaaggaagcguucgccaaaccuguuuacaucgacaaggagugucgcauucccaucagaacagugcggugcuuugcuaaaccugccauuaacacccuggugccccugaagaaagaugacaagggaaacccggucgcuugggugaauccuggcaacaaucaccauguugccaucuauagagaugaagacgggaaguacaaagagcgcacggugaccuucugggaagccgucgaucgguguagagugggcauucccgcuaucguuacacagccugacaccaucugggauaacauucuccaacgcaaugacaucucugagaacgugcuggagagccuucccgaugucaaguggcaguuugugcugucccuccagcaaaaugaaauguucauucugggaaugaacgaggaagacuauagauacgcgauggaccagcaggauuacgcccugcuuaauaaauaucuguaccggguucagaagcucucuaaaagcgacuauuccuuucgcuaccacacagagaccucuguggaagauaaguaugacggcaagccuaaccugaaacucagcaugcaaauggggaagcugaaaagagucuccaucaagagccuucugggacucaauccccacaaagugcauauuucugugcugggcgagaucaaggagaucuccuga

SEQ ID NO: 4020 - RNA, 3474 nt, Artificial Sequence
  Cas9 variant
augaacuacuauaauggcuucaucauuaccgagaacgccaugacaagcaagcaggaaaaacacggggcucugacguuuggacucgacaucggcauugccuccguggggugggcgguccugggagagucuagaaucguugaucuuggcgugcggugcuucgacaaggcugaaaccgccaaagagggggaaagccugaaucucacacgcagaauggcccggcugcuucgcagacggcugcgcagacgggcuuggcgccucaccaagcuggccagacugcucaaacgggagggacugauugcugaugccaaccuuuuuaagcauaagaucgagaaaaauacacccgugccuaaguccucuuggcaacugcgcgucgacggccucgauagacagcugaacgcggaagagugggcccgggugaucuaccaccuuuguaaacaucgcggcuuccacuggauuagcagagcugaagagaaggccgcugagggggacuccaaaggagaaggcgggaagguuaagcagggacuggccggcaccaaaaagcucaugcaggagaaaucuuaucggacagcggccgaaauggugcuggcugaguuuccggaugcccaaagaaauaagcagggggacuacagcaaagcucugucccgcauccuccugggagaugaacuuaaggcccuguucgagcaucagcggaaacucggcaaccccgucgccaccgagaagcuggaagcugcgauucuuggcaauggggacaagaaaugcggacuguuuugggcccagaacccugcucucgccggcaauaagcugcuggagaugcucgggagauguacguucgagaaaaccggaggcgaugacgggaagggagaguaucgcgcccccaaagcuagcuuuucugccgaacggcacguguggcugacacaccuuaacaaucugagaaucguuguggauggcaccacacgcccucucaacgaggcggagcggagagucgcucugcccaugccuuaccaacaggccggcgaccuuuccuauaagcagcucgggggagcccucauuaaggaaggcuuccugcagaaagacggguuuaaguucgcuggacugccguaccccaccaaacaagccagcgaggaaaaggcuaaagauccugagacgucugugcucugcaagcugcccgccuggcauacacuucgcaagacccuggaaaaacacggccucgaguccgaguggcagaagcugagcacagacgcgcuggaugggaaaccucagcuucucgacaauaucgccugggugcugucugucuacaaggaugacgaugaaguuaaaaccgagcugggcaagcucaaccugcccaacaccgaaaagaugauugacgcccuucuggauauccgguuugacaaauucuccaaucucagccugaaggcucuguccaaaaucgugccguucauggagcaaggacagagauaugaugaggcuguggccaacauuccugaauacggccaucacucucagcuucacaaggucggggcgggagagcauaaauaucugcccccuuuuuacaaggaacgcgacaaaacaggccggaugguguucaaugacgauauggacauccccagaaaccccguugugcugcgggcccugaaucaggcucgcaaggucgugaacgcccucauuaaggaguaugggagcccucacgaaguucauaucgagauggcuagagaucugucccggccgcuugacgagagacgcgauauugaaaaacugcaaaaggaguuuggagaacggaauaaaaaggacaaagaacucuucgcccaggauuuuaacaucgugggcacggucaaggggaagcaguucgaaaaauaccagcuguauagagagcaacagggcaaguguaucuaccccagcauggacgagaaacagggaauuugcuguuacucucugaagccucuugaucuccaccgcgugcuguaugaagagggcuacgccgaaaucgaccaugcucugcccuauucccggagcuuugaugacucuaaaaauaaccggguccucgugcuggcgaaggagaaucgcgauaaggggaacagaaccccuuucgaauaccuuggagacaaagacaauagcgagcccuggcggcaguuuguugccuucguggagggcaacaaggcuuaucgccuggccaaaagaucccggcuccugcgcaaggauuuuggggacaaagaagccaaggaguucagagaacggaaucugaacgauacacgcuacauuugcaaguuuuucaaaaacuaugucgagcaauaccuucagcuccacgaggacucugaagcuaagagaugugugguucugagcggacagaugaccuccuuccugcgggccagauggggccucgugaaaguccgcggggauagcgaccggcaccaugcgcuggaugcugccgugguggccgcuugcucucacggcaugguuaagagacuuuccgacuacagccgccggaaagagcuggaacaggucagagagggauuuguggauguggacacaggcgaaaucgucaauccggccauguuccaacaggugcaggagcauuuuccuaaccccuggccucacuuccgcgaugagguuaagcuccggcugucuauugacgaucccacccugcuuagauccgaaauggagaaauuugggacguauacaccugaaagccuggaggcgcuccgcccccuguucgugucccgggcuccgcaaagaagaaauucuggagccgcccacaaggacaccaucuacgcucagccuaagcgccucgucgcccagggcggggugacccagaaaguugcucugagcucccuuacacugaaggaccucgauaaacugaucgacccccauagaaacgaacggcuguaugccgcgauucgcgccagacuugagcaacacggaggcaagggggauaaggcuuuucccgccucuaauccucugcggaaaccggacagcgagggcaaccccaccggaccuaucgugagaggcgucacaauggugauugauaagcucuccgggauccccauucgcggaggcaucgcuaaaaaugacagcaugguucggguggaugucuucacgaaggccaacaaauuucaucuggugccuguguacguccaccauucuguucucgggcugcccaaucaggccauugugggaggcaaggaagaguccgaauggacccagaucgacgauagcuucgacuggcacuuuucuaucuauccuaacgaucuuauuagagugacacugaaacaggagggccgcuucggguacuaugcuggaugugaccgguccaccgcggccauccaccucugggcucaugacagaaaucaacaggucggcaaggaugggcugauucgcagcaucggagugaagacagcccugucuauugaaaaauuuaacguugacgugcuuggcaaucgguaccccgccccgccugagaagagacgcgaucuggcuuga

SEQ ID NO: 4021 - RNA, 3486 nt, Artificial Sequence
  Cas9 variant
augaagaaaauccugggccucgaccuggggagcgccuccauuggaugggcucuuguggaggaaaccgagcagaugcaauacaacaucgucucucugggcagcagaauuauccccuauaaugggacagaaggacaggaguucgaaaagggcacgggggagucccggaacucucuccgcaccaaagccagaacagcgcggaagggauacgaucgcuaucagcugagacggaaaaaucuugagaagauucugcuccagaacggcauguacccuaaugaacaaguucgcgcucugcagaagcuggagcucuggaaacugagagccgacgccccgaacgugcagaucagccuucccgaacugggccggcuccuguuuuggcuuaaucagaagcgcggguauaaauccucuagaagcgaugcuaaccuggacaagaaagauaccgaguacguggccacagucaagucccggcaccaaaagaucaaagacgcuggacagaccgugggccaguauuucuacgggcagauucucgagaaugaauaccaucgcaucaaggagcaaguuuuuccuagagaagccuauauugaggaguucgaugcgaucguggcccggcagaaagaauacuaucccacaauucugaagcaggagcugaucgacaaaauucgcaacgaagucaucuacuuucaaagaggacucaagagccagaaaggccuggugucuguuugcgaguucgaagggcgggaguuuaauggacacuucggcggcccuaagguggcucccaaguccagcccuaucuuucagcuugggaaaauuugggaaaacaucaauaacauuaagaucgccgauauugagcugaccgcugagcagaaacucgucuucuuuaauuaucugaacugucaugaaagaaucacggaggccaagauccgcgaacuucugaaacucucuaaggacucccggcugaacggacaacugaagaauggccucaccgggaacaaaacauacagccagauugcgucuugcuucggaaauaagaucggcgaguaugaaagacuguuuaaauucgagcuugaggugauugaauccgagaagcuggaauacaccuaccacccgaaaagccauauccccgugggggagaagcgccggaaguauauuuccgagaacgucgaaaaagagccuuacuauagacucuggcacacaaucuacucuaucaaggauaaagacgaaugucgcgccgcucugauuaagaauuucggaaucgaggaagagauugccgagaaacuugcuagccuggauuuuuccgccggcggcuucgggaacaagugcgccaagguuauccggaaaauucuccccuaucugauggaaggagacaaguacaauguggcuauggacuaugcgggcuacaaccacagcuuuucucagaccaaagaugagaaucugcagagagugcuccuggacuccaucaaccaucuuccuaagaauagccugcgccaacccauugucgaaaagauccucaaccagaugaucaaucuggugaacgagguuauuaagcagugggggcggccggaugaaaucagaguggagcuggcccgcaaacuuaagcagucuaagacggagcggaaugacgaugacaacuucaugagaaaacgggaacgcgagaacgaaauuaucaaggcugaucucgccaaauacggacugaaggccacaagaaauaacgucauuaaauggcggcuguaucacgagaucgacgauaaggacaagaaacucaaugcuagauguaucuacugcggccaaccuauuagccugaccgaagccauccuugggaacaauguggauguugagcauauuauccccaaggacaaacuguuugacgauucccagucuaacaagacacucgcgcaccgcagcuguaauuccggcaaaggaaacaagaccgcuuaugacuucaugaaggauaaaccucaguuugaggaauacguggcccgggucgaggaacuguauaagaaacaccugauuagccuuaccaagaaaagaaaguuccucaugucugaggacaagauccccuccgauuuuaucgaccgccagcugagagagagccaauacauugcccggaaaucucgcgaaauccugcagacagugugcagaaaugucugguccacggauggcggggugaccgcucaucuccggaagcuguggggaugggacgauguuacaaugaaccuucagaugcccaaauauaagggcauugggaugaccgagaucguggaaugggagagcaaucacggcaaaaaccaacauacacaggaagucauuaaggacugguccaaacgcgaugaccacagacaucacgccaucgaugcucuggugguugccuguacccggcagggauacauccagcgcauuaauacgcucaacucuagcgagacaaaggacgagaugcacagaaagguggcggggucccuggucgaguucaaucaaaaacauacccugcuuaacaaguaccucaucaccgaaaaaccuuuuacaaccucugaaguggaggacgugguuagcaagauucuggucuccuucaaagccggcaagaaggcugccacaccgggaaaacggaaggugggcaaacgcgggaacaaacaggugguccaggauggaaucauuauccccagaggcgcucugcacgccgacagcgugucuggguccauuaaacaguaugauccuacgggaaauuuugaaaaccauaauguuaucaaguacaaggugggcgucgggaaaggcuaucucuucgacggaaaggaugacaaaaagaaaaucgauaagaccauugacugcaucguggauaagaaaauucgggaccugaucaagcaaagagcggaggagagcaacuacucucuuaaaaagauguucgaaacacccauucuguuuaaucagcgcgccguuuucuccgugcgguguaaaaccggcaacaaggcugucgugccuaucagaaauggguauguugugcccgauaacaaucaccacacagccaucuacaaguaugacggaggccucaaagagcagugcgucagccugaugcaggcuauugaacgcaagcgguacaaccugccgaucauuaucaaaaauccuaaggagauuuacgauaaaaucaccgaaaucgccaacauuaaucaacuucucuuugacucucugcccaagcuggacugggaguucgugacgacccuccagaaaaacgauauguuuauccuggggauggacuauagcgccacagaggaagcucuugcggauggaaauuacagacugcucuccgaguaucuguacaaggugcagaacauuagcgacggcaucuaucgccugugccaucacaccauuacaaaguucgaucuuucuaaagccaacaagccugacaaacgguuuuacaauauccaaucccugaaggcuuggaacacccucaauccccagaaagucaagauuaacauccuggggcagaucgaaagacaguga

SEQ ID NO: 4022 - RNA, 3501 nt, Artificial Sequence
  Cas9 variant
augcacguggagaucgacuucccccauuuuagcagaggcgauucccaccuggccaugaacaagaaugaaauucuccgggggucuagcguccuguaccgccuuggacuggaccucggcuccaacucucuggggugguucguuacccaucuugagaaaagaggagaucggcacgaaccuguggcucugggccccgggggagugcgcaucuuucccgacggcagagauccucagagcggcacauccaaugccgucgaccggcgcauggcgagaggggcucggaagcgcagagaucgguucguggagcgcagaaaagaacucauugccgcccugaucaaguauaaccugcuccccgacgaugcucgggagcgcagagcccuggagguucuugacccuuacgcucugcggaaaacggcccucaccgauacacugcccgcgcaucacgugggcagagcccuuuuucaccugaaucaacgccggggcuuccagucuaacagaaagaccgacagcaagcaguccgaagauggggcuauuaaacaggccgcuagccgccucgccacagacaagggaaaugagacccugggcgucuuuuucgcggacaugcaucugcggaaaucuuaugaagauagacaaacagccauccgcgcugagcucgugcggcuggggaaggaccaccuuaccggaaacgccagaaagaagaucugggcuaagguucgcaaacggcuguuuggcgaugaggugcucccuagagccgacgccccgcauggcguccgcgcucgggcgacgauuaccgggacaaaggccuccuacgauuauuaccccaccagagacaugcugcgggaugaguucaaugcuaucugggccggacagagcgcccaccacgcuacaauuaccgacgaagcccgcacggaaaucgagcauauuaucuuuuaucagagaccucuuaaacccgcgauugugggcaagugcacacuggauccugcuacccggcccuucaaagaagacccggagggguacagagccccuuggucucacccccucgcccagcgcuuucggauccuguccgaggcuagaaaccuggaaauccgcgauacaggaaagggcagcagacggcucaccaaagagcaaucugaccugguggucgccgcccuucuggcuaaucgcgaaguuaaguucgacaagcucagaacccugcuuaaacugccugcggaggcccgguucaaccucgaauccgaucgcagagcugcccuggacggggaucagacagcugcccggcugagcgacaagaaaggauuuaauaaggcguggcgcggcuucccgcccgagagacagauugccaucguggcucggcucgaggaaacggaggaugaaaacgagcugauugccuggcuugaaaaagagugugcucuggacggcgccgccgcugcgcgcguggccaauaccacacucccugaugggcauugcagacugggacugcgggcuaucaagaagauugucccgaucaugcaggacggccuugaugaggacgggguggccggagccggcuaccacaucgcugccaaaagagcgggguaugaucaugcuaagcuccccaccggcgaacaacugggacgccugccuuacuauggccaguggcuccaggacgccguugugggguccggagaugcccgggaccaaaaagagaagcaguacggccaguuucccaacccuacaguccacauugggcugggacagcuuagacgcgugguuaacgaccugaucgauaaauauggacccccgaccgaaauuucuaucgaguucacgcgggcucucaagcugagcgagcaacagaaggccgaaagacagcgcgagcagcggagaaaucaagacaaaaacaaggcgcgcgcugaggaacuggccaaauuugggcggccugccaaucccagaaaccuucucaagaugcggcugugggaggaacuggcucacgauccucucgaccgcaaauguguguacacaggcgagcagauuuccaucgaaagacugcuuagcgaugaggucgacaucgaucauauucugcccguggccaugacccucgacgauucuccugcuaauaagaucauuugcaugcgguaugccaaccgccacaagagaaaacagacccccuccgaagcguucggaagcucuccgacacugcagggccaucgguacaauugggacgauaucgccgcuagagccaccgggcugccucgcaacaagcgguggagauuugacgcuaaugcccgcgaggaguucgauaaacggggaggcuuucuugccagacaacucaacgaaacaggguggcuggcucgccuggcgaagcaguaccucggagccgucacggaccccaaucagauuugggugguucccggccggcugaccagcaugcuuagagggaaauggggccugaacggacuccugccuuccgacaauuaugcuggcgugcaggauaaggccgaggaguuccuggccucuacagacgauauggaauuuagcggggucaaaaaccgcgcugaccacagacaccaugccaucgauggacuugugaccgcgcucacagaccggucccugcuguggaagauggcuaaugccuacgaugaggaacacgaaaaguucguuauugagccgcccuggccuaccaugcgcgacgaucucaaagccgcucuggagaagaugguggucagccauaaacccgaccacggcaucgaagggaaacuucaugaggauucugccuauggauuugugaaaccucuggacgcgacgggccucaaggaagaggaggcugggaaccugguguacagaaaggccaucgaaucccugaacgagaaugaaguugaccggauucgcgauauccaacuuagaaccauuguccgggaccacgugaacguggagaaaacaaagggcgucgcccuggcugaugcccucagacagcugcaggcucccagcgacgauuauccucaauucaaacacggacuccgccaugugcggauccugaagaaagaaaagggcgacuaccuuguucccauugccaauagagcgucugggguggccuauaaggcuuacuccgccggagagaacuucugugucgagguguuugaaaccgcuggcgggaaaugggauggagaggccguucgccgguucgacgccaauaagaaaaacgcuggcccgaagaucgcgcacgccccucaguggagagaugcuaaugaaggcgccaaacuggugaugcggauccauaagggggaccucauucgccuggaucacgagggcagagcccggaucauggucgugcaucgccuggacgcugccgcgggaagauuuaaacuugcugaucacaacgaaacagggaaucuggacaagcggcacgccaccaacaaugacauugaucccuuccgcuggcucauggccagcuacaacacgcugaagaaacucgcugccguuccugugagagucgacgagcugggacggguguggcgcgugaugcccaauuga

SEQ ID NO: 4023 - RNA, 3507 nt, Artificial Sequence
  Cas9 variant
auggccagacccgcuuuccgggccccucgcagagagcacgugaacggcuggaccccggacccccaucggaucagcaagcccuuuuucauucuggucuccuggcaccuccugucucgcguugugaucgauagcuccucugggugcuuucccggaacaagcagagaccauacggauaaauucgcggaaugggagugugcugugcagccuuaccggcuuuccuuugaccugggcaccaauucuauuggguggggacuccugaaccuugaucgccaaggcaagcccagagaaauccgggcccuggggagccgcauuuucuccgacggaagagauccucaggacaaagccagccucgcugucgcccggcgccuggcuagacagaugcggcgcagacgggauagauaucugacacgccggaccagacucaugggcgcccuggugcgcuuuggccuuaugccggcggaccccgccgcucggaagagacuggagguugccguggauccuuaccucgcucgcgaacgggccacaagagagcgccuggagcccuucgaaaucgggcgggcgcuuuuucaccugaaucagagacgcggauauaaaccuguccggaccgccacaaagcccgacgaggaagcuggcaaggugaaagaggccguugagagacucgaagcugccaucgccgcugcgggggccccgacccugggagcuugguucgccuggcggaagacgcgcggcgagacccugagagcccggcucgcugggaaaggaaaggaagccgcguacccuuuuuaucccgcuagacgcaugcuggaggccgaguucgauacacuuugggccgagcaagcucggcaucacccugaccugcucaccgccgaggcuagagaaauucugcgccacagaaucuuucaucagcggccccuuaaacccccuccggugggccgcugcacacuguaccccgacgauggcagagccccucgggcgcuccccucugcccagcgccugagacuguuccaggagcucgcuucccugcgggucauucaccuugaccugagcgaacgcccucucacccccgccgagagagaucggaucguggcuuucgugcaagggcgcccgccuaaggccggaagaaagcccggcaaaguccagaagucuguuccuuuugaaaaacugcgggggcuucuggagcucccuccuggaacgggcuucucccuggagagcgacaagagacccgaacugcucggggaugagacaggagcgcgcauugccccggcuuuuggcccuggcuggaccgcccugccccuugaagaacaggacgcucugguggaacuccugcugacagaggccgagcccgaacgggccaucgcugcgcuuaccgccagaugggcucucgaugaggccaccgccgcuaaacuggccggggcgacacugccugacuuccauggacgcuauggccggagagcuguggccgaacuccugccgguccuugagcgcgagacgagaggggaucccgacggacgggugcgcccuauucggcuggaugaagccguuaagcuccugagaggcgggaaagaccacucugacuuuucccgggagggcgcucugcuugaugcccuccccuacuacggagcggugcuggaacgccacgucgcuuucggcaccgggaacccugccgaccccgaggaaaagagagugggacggguugccaauccuacagugcauaucgcucugaaccagcuccgccaccuggucaaugccauccuugcuagacauggccggcccgaggagauugugaucgaacuggccagagaucucaagcgcagcgcggaggaccggagacgcgaagauaaacggcaagccgacaaccagaagagaaaugaggaacgcaaacggcugauucugucccuuggggagagaccgaccccucgcaaccuccugaagcugagacucugggaggaacagggacccgucgagaaucggcgcuguccuuauucuggcgaaacaaucagcaugagaaugcugcuuuccgagcaaguggauauugaccacauccugcccuuuagcguuucucucgaugacuccgcugccaacaaaguggucugccugcgggaagcuaaucgcaucaagagaaaccggagcccgugggaggccuucgggcaugauucugagagaugggccggcauucuggcucgcgcggaagcccuuccuaagaauaaacgguggagauuugcucccgacgcccucgagaagcuggaaggagagggcgggcugcgcgcccggcaccucaacgauaccagacaccugagccggcuugcuguggaguaccugcgcuguguuugcccuaaagugagagucucccccggacggcucacggcccugcugcgcagacgguggggcaucgacgcgauucuugcugaagccgacgggcccccuccggaggugcccgccgaaacacuggauccuucucccgcugagaagaaccgcgccgaccauagacaccaugcgcucgaugcugugguuaucggauguauugaccggagcaugguccagcgcgugcagcuggccgccgcuuccgccgaaagagaggcugccgcgcgggaggauaauaucagacgcgugcucgaaggcuucaaagaggaaccuugggacggguuucgggccgagcuggaaagacgcgcucggaccaucgucgugagccacagacccgagcacggcauuggaggcgcccuucauaaggagaccgcuuaugggccuguugauccgcccgaagagggauucaaccuggugguccgcaagccuaucgacggccucucuaaagaugaaauuaauuccgugcgggaccccagacugcgccgggcccugaucgauagacuugccauucgccggagagacgcuaacgauccugcgacagcccuggcuaaggccgccgaggaccucgcugcccagcccgcgagccgcgggaucagacggguucgcgugcugaaaaaggaaucuaauccgauuagagucgagcacggaggcaacccuuccgggccccggagcggcggacccuuucauaaacuccugcuugcuggcgaggugcaccauguugacguggcccugagagccgaugggcggcgcugggucggacacugggugacccucuucgaagcucacggcgggagaggagccgacggcgcggccgcuccuccccggcugggcgauggggagcgcuuccugaugagacuucauaagggagacugccugaagcucgaacacaaaggccgggugcgcgucaugcaaguugugaagcuggagccuuccucuaauagcguggucgugguugagccgcaucaggugaaaacagauagauccaagcacgucaaaaucucuugugaccagcuccgggcccgcggggcuagacgggugacgguugauccccugggacgcgugagaguccaugccccuggcgcucggguggggaucggaggcgacgccggccgcaccgcgauggaacccgccgaggauauuagcuga

SEQ ID NO: 4024 - RNA, 3513 nt, Artificial Sequence
  Cas9 variant
augagcaaguacaacgugggccuggacaucgggauugccuccgucggauggucuaucguugaugcugacaaaaagaaaauuaucgaucucggcagcagaauuuucuccucugggaaugccgcggcuaaccaggagcggcgcggauuuagaggcacccggcgccugaucagacggcgcaagaauagacuuacagacgugaucaacuucuuuggggaaaagaaguucauugauacgaagguggucgacaaaaauggacacgugcauuauaaguuuagcguuaacaauaccgagucccccuacgaacugcgggugaaaggccucucugagauccugacaaagcaagaacuugucauugcccuguaucacaucgugaaacaucgcggcauuagcuacgaucucggggaccuggaggaugacggaaccuccggcguuacagauuauaagaccagcaucaacauuaauagacagcugcucaacgagaagacaguggggcagauccagcuggaacggcuuaaugaguucggaaaaguccgcggccaaguggaagagaacgagaaugugacccugcucaacgucuuuccuucugccgcuuacguuaaggaagccacgcagauccugaccaaacagagagaguucuauccggaaauuacagacgauuuuaucgcuaaguucaugcuuuuuauuacccggaaacgcgacuacuucguggggcccggaaaugagaaguccagaacagacuacggcaucuauaaaaaggauggccggacccuggacaaccucuuugaugaacugauugggaucgacaagaucaacggagagaaaagagccagcgcgucuucccugacggcccagauuuacaauaugcucaacgaucugaauaaccuuacagugccuaauaccgaggacggccgccugacaauccaaaccaagaaagaaauucucgaggcugccaagaccacaaacgggcuguucggaaucgcucagauuugcaaaaucaucggcuguaagaaggaugacauuaaaggguuccggaucgauaagagcgagaaaaagauuaugcacacgcuuucuggauauagaaaauuucgcaaggaacuggccgacgucaauaucgaagcgaacgaucucaauauuaaccuggugaauaagaucgccgacauucugacccucaacacagagaaagcugagauccggaagcagcuggacaaauccaauauggauaucagcaacgaaaugaaggagauuguuaucaauaaaaacaaggaguuccuuguggacggcagagccaccuggcauuccuuuucuuacaagacacugaaccuccugauucccgaacuucugaauaccccugaggaacagaugacgauccucacacgccugggccuggucaaacccaacaauaagaaauaugaggggcucaagaacauuccugcucggagaaucaccgaagagaucuacaauccggugguugcccgcgccacccgggaagcugugaacgucuucaaugcgauuaccaaaaaggugggaagagauaacaucaaagacgucauuaucgagcugccccgcgaggauaaugaaguggacauuaagaagggcaucguuaaacggcaaaagcagaacgagguggaaaaagagacagccgaugcucuugucaagcagcacaugacaaucagcgacuccgcccugauugcccaauauagaaaaauccgggggcucagccagaaggugcgcuacugguaccagcaggauacgauuugcccuuauuguggaaagaaaaucgaagcuguucaacugauuaauaacaaugacucuuuugagguggaucacaucguccccaucuccgugagcuucgacgauucucagaacaauaaggugcugguucauagccagugcaaccaggccaaagagaagcaaaccccucuuggcuggcucaacaaugggggcggauuuggccaguccaaagcggacuacauugcuagagucaagucuaacaagaauuaugccaaaaacaagaucgacaaucugcugaacgaaacagaucucaaugacauugccacccagcggggguucauccagagaaaccugaaugauacacgcuacgcuagccggauugugcuuaacgaguuuuauuccuucuuuagaagcaauaaccugucuaccaaagugaaggucgugcgcggaaaauggacgucccaaaugagaaagaaguggaauggcguugggggacucagcaaaacccgggacacauaccaccaucacgccaucgaugcuuguauuaucgccugcuucccccugcugaaggcguuugacaaagccaucaaacuuauugauguggacggcgaaaccggggagauccuccaggauaaaaaggcuauuaaacuggcccaggaagcugagaucgucgagaagauuucugugaucaagaacaaaaaguucgaaaauaugguuaacgagaucuauaacuucccgcuguuuaaacagguggaacucgccaaugacauuacaaaccuggagaauccugucaaguucucccaccauguggauaaaaaggcgaaccgcgccguugcuaaucaaaccaucuacggcacgagaauuaaggaaaaagaggugacaaagcggggcaaaaaggagaaaauccaggaacgcuacacccuuggaacaauuaagaacaucuaugacaucgauggguuuaugaauuucaagaaacuguacgacaagauuagcaaaaacgacgaugucaaguuucucaugcagaaaaaugaccccaagaccugggagaagcugaucgauauuuucaacuccuauccugacucugaagaggugacccaaguggauggaaaagucaagagaguugccgugagccccuuuaaacuguacuaucgggagaauggcuucaucacaaaguacuccaaacacaacgacgggcccaagguggucucuauuaaguauuacgauagcaaagugggaucccauaucgacauuacgccuaaggaugcucgcaauaaaguuauccuucagagccucaagccguggagaaccgacguguacuuuaacucuaucacacagcaguaugaacugcugggccucaaauacuccgaucugaaguucaccaauggggucuauggcauuacacgggacgccuacgagaaacuuaagcacggagugagcgaagacggcguuaccgccuggaagcccaucucuaaaaacuccgaguuucgcuucagccuguauagaaaugaucgggugagagucauugacgaaaagggggauucuaucgagcuccuguuugcuagccgcacgacauccaacgagggauacguggaacugaaaccuauuuauaaggcgaaauucgacagcaaggaggaaguuggcuucuacgggcuugugucuaacggacggcucaucaagaaaauguccaagggcggguacaaacuguauaaggucaauaccgauauccugggcaaacccuacuaugugaccagagagagcgacgaaccuaagcucucccuguga

SEQ ID NO: 4025 - RNA, 3516 nt, Artificial Sequence
  Cas9 variant
auggccaaguacagcgugggccuggacaucgggauuuccucugucggaugggcuaucauugauaucgagaccaaacagauuguuaaccucggcagcagaaucuuccccuccgggaaugccgcgggaaaccaagaacggcgcggcuuuagagggauccggcgccugauuagacggcgcaagaauagacuuacagaccugaaaaagcuccugggagagacguucuuuucugaucuuaaaaagaucgacagcaacggcuaugaauacuaugauauugacuuccagaucaaugcuaacccuuacgagcugcgggugaagggcauuaccgaaaaacucuccaagaaagagcuggccgugguccugcaccauaucauuaagcaccgcgggaucucuuaugaucucggagaccuggaggaugacggcacaagcgggguguccgauuacaaaaauagcaucaacauuaauagacagcuucugcgggaaaagaccguuggacagauccaacucgagcgccugauugaauuuaaccaggugcauggccaggucaagaaagccgaggacgugucucuucugaauguuuucccguccagcgcuuauagagaugaggccaacaagaucaugauuaaacagcaagaauuuuacucugagaucacaaauuccuucauggaacagguggaccagcucgucagccggaagcgcgacuacuuuaucgggcccggaaacgagaaaucuagaaccgauuauggcauuuacaaguccgacggccggacacuggauaaucuguucgcugaacucaucgggaccgacaaaauuaacggagagaagagagccagcgcguccucucugacggcccagguguauaaccuucugaaugaucucaacaaucugcacgugagcaacaccgaggacggcaagcucacaaccuccacaaagaaggaaaucauuaaagcugccaagaccacggauggggucuuuggaaucagccaaaucugcaaaauuaucggcuguaagaaggaggaaauuacaggguuccgccaggacaaaucugagaagaaaguuauccauacccuggcuggauaccggaagauuagaaaagcccucgcgacaaucaauauugaagccaacgagcugaauccuaccguguuugaucagaucgcugacauccugacccucaacacagagaaggccgaaauucgcaagcaacuggauaaagugcagcuugacaucacggacgagaugaaggaacuggucauugauaaaaauaaggacuuccucguggauggccgggcuaccuggcacuccuucagcuaucagacacugaacaugcuuauccccgagcugcucaauaccucugaggaacagaugacaauucugaccagaaugggccugaugaaaagcgacaacgagaaguaccgcgggcucaagaaaaucccugccgaaaagaucgccuccgagauuuuuaaucccguuguggcuaaaucuacgcgggaagcgaucaaggucuucaacgccauuagcaaagagaucggaaagaauaacauugagcacgugguuaucgaacugccuagagaugacaacgaggaagaugagaaacgcaagauccaaaaacuucagaaagcuaaugaaacagagaaggaggccgccgacaaccuggugaaacauaagcucggcauuuccgauagcgcucugaucgcccacuaucggaaauuuaaggggcugucucagaaggucagauacugguaccagcaagaaaccuauugcccguacuguggaaaaauuaucgaggcgacccagcuuauuaauaacaaugacaacuucgaaguggaucauaucauccccauuuccgucagcuaugacgauucucagaauaacaaggugcucguucacucccagugcaaucaagcuaaagagaagcagacaccucugggcuggaucaacaaugggggcggauuuggccagagcaaaaacgaauacaccaaucgcgugaagaacaauaagaaauauuccaagaacaaagucgacaaccugcucaaugagacagaccugacggauauuaucacccagcggucuuucauucaaagaaaccuuaaugacacacgguacgccgcccgcaccgugcuggaugaguuuuauagcuucuuuaaguccaacgaccuccccacaaaaguuaagguggucagagggaaguggaccucucagaugcggagaaaauggaauaacgugggaggccugcgcaagacgcgggauacccaccaucaccaugcuaucgacgccagcauuaucgcuuccuucccucugcuuagagccuuugaucgcgcgaucaaacucauugacguggauaaggaaacaggggagaucguucaguacggaaaagccagccugaauggcgacgucauugaagagaagucugugauccaagcucccauuaucaaaaacgaaaaguucgagaagcugguggaugagaucuacaauuuuccgcuuuucaaacaggucgaacuggccaacaauauugagaacccugaaaaucccgugaaguucucccaccauguugacaaaaaggcuaacagaaccguggccaaucagacaaucuauagcacccggauuaaaaagacggagaagaucguccgcaaaaaggugacagcgaaagaggaagaguacguuauugggaccaucaaggauaucuaugacgugacaaacuuugaaaaauucaagaaacuuuacgacgagucuuccaaaaaggaugacauuaaauuucugaugcagaagaacgauccuaaaaccugggaaaagcucgucgagaucaugaauaccuaucccgacuacgaggaaauuagccaacuggauggcaaggugaaaagaguuaaggugucucccuucaaacuguauuuucgggagaacggauucaucacaaaguacgccaaacacaauaacggcccuaaggucgugagcauuaaguacuaugacuccaaacuugggaaucacaucgauauuacgccggugaacgcuaauaacaaggucauccuccagagccugaaacccuggcgcaccgacguuuacuauaauaacgaaacacagcaguacgagcugcucggacugaaguauucugaucuuaaauuuaccaagggcguguacgggaucacaagagaagccuaugagaaacugaaguacggauacaccgacggcgugccugcuuggaagcccauuuccaaagagagcgaguucaaguuuucccucuaucggaaugaucgcgucagaaucauuaacgaagccggggaaaagaucgaccugcuguucggcucucggaaugagacgagcgaaggauacguggagaugaagccuauuuuuaaaacaaacuucgacgaugccgaggaggcuuccuuuuauggcaagaccucuaauaagcgccuuaucaaaaagauggcgagaaaaggguaccaaaucuauaagguuaacaccgacauucucggaaaucuguacuauacagccaaagaaagcaacgaacccaagcuggaucucuga

SEQ ID NO: 4026 - RNA, 3519 nt, Artificial Sequence
  Cas9 variant
augagaaagcccuacagcaucggccuggacauugggaccaacuccgugggaugggccgucaucacagaugacuauaaaguuccuucuaagaaaaugcggauucagggcacgaccgaucgcacaagcaucaagaaaaaucucauuggggcucugcuuuucgacaacggagagaccgccgaagcgacaagacugaagcggaccacacgcagacgguacacccgcagaaaguaucggaucaaagagcuccaaaagaucuuuuccucugaaaugaaugagcuggauauugcuuucuuuccgcgccuuagcgaauccuuccuggugucugacgauaaagaguuugagaaccaccccaucuucggcaaucucaaggacgaaauuacguaccauaacgauuauccuaccaucuaccaccugagacagacacuggccgacagcgaucagaaagccgaccuccggcugauuuaucuugcucuggcccauaucauuaaguuucgcgggcacuuccucaucgagggaaaucuggauuccgaaaacaccgacgugcauguccuuuuucugaaucucgugaacaucuacaauaaccuguucgaggaggacauuguugaaacagcuagcaucgaugccgagaagauucugaccucuaaaacguccaagagcagacggcucgaaaaucugaucgcggagauucccaaccagaaacgcaauaugcuuuuuggcaaccuggugucucucgcccugggccuuacaccuaacuucaagaccaauuuugaacugcucgaggacgcuaaacugcaaaucuccaaggauagcuacgaggaagaccuggauaaccuccuggcccagaucggggaccaguaugcugaucuuuucauugccgcgaaaaagcugucugacgccauccuccuguccgauauuaucacagucaagggagcuagcaccaaagcuccccuuuccgccucuauggugcagagauacgaggaacaccaacaggaccuggcccuccugaagaaucugguuaaaaagcagauuccugagaaauauaaggaaaucuucgauaacaaggagaaaaauggcuacgccggguauaucgacggaaagaccagccaggaggaauuuuacaaauauauuaagccgauccuccugaaacuugacggcacagagaagcugauuuccaagcucgaacgggaggauuuccugagaaaacaacgcacguuugacaacgggagcaucccccaccagauucaucugaaugaacuuaaggcuaucauucggagacaggagaaauucuacccuuuucucaaggagaaccaaaagaagaucgaaaagcuguucaccuuuaaaauccccuacuaugugggaccucuggcgaauggccagucuuccuucgccuggcucaagcgccagagcaacgagucuauuacacccuggaauuuugaagaggucguggaucaggaggcuagcgcccgggccuucaucgaaagaaugaccaacuuugacacauaccugccggaggaaaaagugcuuccuaagcacucuccccuguaugagauguucauggucuacaaugaacucaccaaaguuaaguaucaaacggagggcaugaaacgcccuguguuucuguccagcgaggauaaggaagagauugugaaccugcuuuucaagaaagaacggaaggucacagugaaacagcucaaggaggaauacuucuccaaaaugaagugcuuucauaccguuaccauccuggggguggaggacagauucaaugcuagccugggaacauaucacgaucuccugaagauuuuuaaagacaaggccuuccuugaugacgaggcgaaccaggauauccuggaagagaucgucuggacccucacacuguuugaagaccaggcuaugauugagcgccggcuggugaaauacgccgauguuuucgaaaagucugugcuuaaaaagcucaagaaaagacacuacacgggcugggggcgccugucccaaaagcugaucaacggaauuaaagacaagcagaccggcaaaacaauccucggguuucugaaggacgauggagucgccaaucggaacuucaugcagcuuauuaaugacagcucucuggauuuugcuaagaucaucaaaaacgagcaggagaagaccauuaaaaaugaaucccucgaggaaacaaucgccaaccuggcuggcagccccgccauuaagaaaggcauccugcaauccauuaagaucguggacgagaucgucaaaauuauggggcagaaucccgauaacaucgugauugagauggcgagagaaaaucagucuaccaugcagggaaucaagaacagccggcaacgccuuagaaagcucgaggaaguucauaaaaauacgggcuccaagauucugaaagaguauaacgugucuaauacccagcugcagagcgaccggcucuaccuguaucuucugcaagaugggaaggacauguacacaggaaaagaacucgauuaugacaaccugucccaguacgauaucgaccacauuaucccucagagcuucaucaaggauaauucuauugacaacaccguccugacaacccaggccuccaacagaggcaagagcgacaaugugccgaacaucgagacgguuaauaaaaugaagucuuuuugguauaaacaacuuaaguccggggcuauuagccagcgcaaauucgaucaucugacaaaggccgagcggggcgcucucucugacuuugauaaggccggauucaucaaaagacagcugguggaaacccgccagauuacaaagcacgucgcgcaaauccucgacagcagauucaacuccaaucugaccgaggauagcaaaucuaaccggaaugugaagaucauuacccuuaaauccaagauggugagcgacuuucgcaaggauuucggcuuuuacaaacugagagaaguuaacgacuaccaucacgcccaggaugcuuaucucaaugccgucguggggacagcucugcugaagaaauaccccaaacuugaggccgaauuuguguauggagacuacaaacacuaugaucuggccaagcucaugauccagccugacuccucucugggcaaggcuacgacccggauguuuuucuacagcaaccucaugaauuucuucaaaaaggagauuaaacuggcggacgauacaaucuuuacccgcccccagauugaggucaacacagaaaccggggagaucgugugggacaagguuaaagauaugcaaacgaucagaaaggugauguccuauccucaggucaauauugugaugaaaacagaaguucagaccggaggcuucucuaaggagagcaucuggcccaagggggacuccgauaaacuuauugcccggaagaaaucuugggacccgaagaaauacggcggauuugauagcccuaucauugcuuacuccgugcuggucguggccaagaacuguaagcgcaaaaauagcaagaccaaaaacuaucaaagaacaugcggcaacaagaauaacgggacccgguga

SEQ ID NO: 4027 - RNA, 3522 nt, Artificial Sequence
  Cas9 variant
augagacccaucgagccuuggauucugggccucgacaucgggaccgauagccugggaugggccguguucuccugcgaagagaagggcccgcccacagcuaaagaacuucucgggggaggcguccggcuguuugacucugggcgcgaugccaaggaccacacgagcagacaggcggagcggggagcuuuccgcagagcccggcgccaaaccagaacauggccuuggcggcgcgauagacugauugcccuuuuucaggcugccggccugacaccucccgcugccgaaacccggcagaucgcgcucgcccugcgcagagaggcuguuucccggccccuggcccccgacgcucucugggccgcgcugcuucaucuggcccaccaucgcggcuucagaucuaaccggauugauaaaagagagcgcgcugccgcuaaggcccucgccaaagcuaagccggcgaaggccaccgcuaaagccacagcccccgcuaaggaagccgacgaugaggcgggguuuugggaaggagcugaggccgcccugcggcagagaauggcugccagcggcgcuccuaccgugggggcccuucuggcggacgaucucgaccgcggacaacccgugcggaugagauacaaucaguccgaucgcgacggcgucguggccccuacgcgggcucugaucgccgaggaacuggcugagaucguugccagacagucuagcgcguaucccgggcucgacuggccggccgugacccgccugguccuugaucagcggccucugagauccaaaggagcuggccccugugccuuccucccuggcgaagaccgcgcucugcgggcccuucccacagugcaagauuuuauuaucagacagacccuggccaaccuccggcugcccagcacaucugcugacgagccucgcccgcugaccgaugaggaacacgcgaaggcccucgcucugcuuuccacggccagauucguugaguggcccgcccugcggagagcucucgggcugaaacgcggagugaaguuuacagccgaaaccgagcggaauggcgcgaagcaggcugccagagggacagccggaaaccuuaccgaagcuauucuggccccucucauccccggcuggagcgggugggaccuggaucgcaaagacagagucuucucugaucugugggcggcucggcaggaccgcuccgcccuccuggcccuuauuggagauccuagaggccccacccgggugacagaggacgaaacggcugaggccguggcugacgccauccaaauuguccugccgaccggccgcgcgagccucucugccaaggcugccagagcuaucgcccaggccauggcuccugggaucggauacgaugaggcgguuacacuggcccugggccuucaucacucccaccggccccgccaggaaagacucgcucggcugccuuauuacgccgccgcucugcccgacguggggcucgauggagacccugugggacccccgccugccgaggaugacggggcggcugccgaagccuauuacggccgcauuggaaauaucagcguccauauugcucugaacgagaccagaaaaaucgugaaugcccuucugcaccggcauggccccauucucagacugguuaugguggaaacaacccgcgagcugaaggcgggggcugaugagcggaaaagaaugaucgccgaacaagccgagcgcgaacgggagaacgcugagaucgacgucgaacuuagaaaguccgaucgcuggauggccaaugcucgggagagacgccagcgggugagacucgcccggcgccagaacaaucugugccccuauacgucuacaccuauuggacacgcggaccugcucggcgaugccuacgacaucgaucacguuauuccgcuggcuagagggggacgggacagccuugacaacauggugcugugucaguccgaugccaauaaaaccaagggcgacaagacccccugggaggcuuuucaugauaaaccuggguggaucgcccaacgcgacgauuuccucgccagacuggacccccagacagcuaaggcgcuggccuggcgguuugcugaugacgccggcgaaagagucgcccgcaaaagcgcugaagaugaggaccagggauuccuuccucggcagcucaccgauacaggcuacauugccagaguggcgcugcgcuaucugucucucgucacgaacgagcccaaugcugugguugccaccaacgggcggcugacaggacuucugagacucgccugggacaucaccccuggccccgcuccgcgcgaucugcugccuacaccccgggacgcccuuagagacgauaccgcggcccgcagauuccucgacgggcugacgccucccccgcuggcuaaggccguggaaggagcuguccaagcccggcucgcugcccugggccgcuccagaguggcggaugccgggcuugcugacgcccugggccucacccuggcuagccugggaggcgggggcaaaaaccgggccgaucaccgccaucacuuuaucgacgccgcuaugauugcgguuacaaccagaggccuuaucaaucagauuaaccaggccucuggggcuggacggauccuggaucucagaaaguggccucgcacaaauuucgagcccccuuaccccaccuuucgggccgaagugaugaagcagugggaccauauucaccccagcaucagaccugcccaccgcgauggcgggucccugcaugcugccacggucuucggcgugcggaacagaccggacgcgcgggugcucguucaacgcaaacccgucgagaagcuguuucuugaugccaaugcuaaaccucugcccgccgacaagauugcugaaaucaucgacggauucgccucuccuagaauggcgaaacgguuuaaggcccuccuggcucgcuaucaggccgcucaccccgaggugccuccggcccuggcugcccuugcgguggccagagaucccgcuuucggcccucgggggaugacagccaacaccgucauugcuggacgcagcgacggcgauggggaggacgccggacugaucacacccuuuagagccaauccuaaggcggcugugcggaccaugggcaacgccguuuacgaagugugggagauucaggucaaaggccgccccagauggacccaucgggugcucacaagauucgaucgcacgcagccggcuccuccucccccucccgaaaaugcccggcugguuaugagacuccgcagaggggaccugguguauuggccucuugaguccggagaucggcuguuucucgucaagaaaauggccguggacggccgccuggcucuguggccggcccggcuugcgaccgggaaggccacagcucuguacgcccaacucagcugccccaacaucaaucugaacggagaucagggcuauuguguucagucugcugaagggauuagaaaagagaagauccgcaccacauccugcaccgcccucggacggcugagacuuagcaagaaagcgacguga

SEQ ID NO: 4028 - RNA, 3525 nt, Artificial Sequence
  Cas9 variant
augggcaaguacagcaucgggcuggacauuggaaucuccucugugggcuggagcauuaucgauauugagaaaaagaaaaucgucgaccucggguccagaaucuuccccucuggaaacgccgcugccaaucaggaucggcgcggcuauagagggacccggcgccugauuagacggcgcaagaacagacuugcggacguuaucaauuuucugggagaagagaacuucauugauacaaaagugguggaccaaaauggcaacauccacuacaagcuccuggucaauagcacggaauccccuuauaaacuucgggugaagggccugucuaagaugcucaccaaacaggagcugguuauugcucuguaccauaucgugaagcaccgcgggauuagcuaugaucucggagaccuggaagaugacggcacauccggggucaccgauuacaaaacaagcaucaacaucaauagacagcuucugauuaagaagaccgugggacagauccaacucgagcggcugaaagaguuuggcaagguucgcgggcaugugaaaaaggacgaaaacauuacacuucugaaugucuucccgucuuccgccuaugugaaagaggccacccagauccucacgaagcagagagaauuuuaccccgagauuaccgaugacuucaucacaaaauuuaucccuuucauuagccggaagcgcgacuacuuugugggacccggcaacgagaagucuagaaccgauuauggcaucuacaaaaaggacgggcggacacuggauaaucuguucgacgaacucauuggaaucgauaaaauuuccggcgagaagagagcuagcgccucuuccgucaccgcucagaucuauaacaugcugaaugaccuuaacaaccugacgguuacaaauaccgaagaugggaaacucacaacccaaaccaagcgcgagaucauugaagccgacaagacaacgaacggacuguuuggcaucacccagauuugcaaaaucauuggguguaagaaagaugacaucaagggauuccggauugauaaaguggagaagccuaucaugcacacacuuagcggcuacagacgcuuucggaaggagcuggcgaaaaucaauauugaagccaacgaccucgacaucaaucuggugaacaagauugcugauauccugacccucaauacagagaaagccgaaauuagaaagcagcugaacaaauccaauaucgacgucucuaacgagaucaaggaacuuauuaucaauaagaacaaagauuuccugguggacggccgcgcuaccuggcauagcuucuccuauaagacgcucaaucugcuuauucccgagcugaugaacacaagcgaggaacagaucaccauucucacccggcuggggcugguuaaaucuaauuccgagaaguacaaaggacucaagaacaucccugccagacgcaucacagaaggcauuuauaacccgguggucgcgaaagccacccgggaggcugugaauguuuuuaacgccaucgcuaagaagauugggagagauaauaucagcgacguggucauugaacugccccgcgaggauaacgaggccgacaucaaaaagggaaucgugaaacggcaaaagcagaaugaacuugagaaagaagccgcugaugcgcuggucaagcagcaaaugacaauuucugacagcgcccucguggcucacuacagaaagguucggggccugucccagaaagugcgcuacugguaucagcaggggacgugcuguccuuacugcggcaagaacaucgaggccguccaacugauuaauaacaaugauucuuucgagguggaccacaucauucccaucagcguuuccuuugaugacagccagaacaauaaagugcuuguccauucucaguguaaccaggccaagggaaaacaaaccccucucggcuggcugaauaacgggggaggcuucgggcagaauaagacagaauauguggcuaaggugaaaaccaacaagaacuacuccaaaaauaagauggacaaccugcucaaugauauggaccugagcgauauuguuacacagagaggauuuauccagcggaaccuuaaugacaccagauaugccucucgcaucguccuggaugaguucuacuccuuuuucaaaagcaacaaucucuccacgaaggugaagauugugcggggcaaauggaccucucaaaugagaaagaaauggaacggggucggcggacugaagaaaacacgcgacaccuaucaccaucacgcgaucgaugcuagcauuaucgccuccuuuccccugcuuaagguguucgacaaagccauuaagcucaucgauaucgacagagaaacaggcgagauucugcaggauaaggaagcuaucaaaaugucucaggaggccaagcugcucgagaaaauuccgguuauccagaaugaaaaguuugaggaacugauuaacgagcuuuacgacuucccucuguuuaaacaaguggaacucgcuaaugauaucaccaaccccgagaauccugucaaguucagccaccauguggacaagaaagccaaccgguccguugcgaaucagacgaucuacgggacacgcauuaaggagaaagaaaucaacaagagaggaaaaguggagaagguccaggaacgguauauucugggcaccaucaagaacauuuacgacaucgauagcuucacaucuuuuaaaaagauuuaugacaaaauguccaagaccggggaugugaaauuccugaugcaaaagaaggaccccaaaaccuggggaaaacuuguugagauccucaauagcuaccccgauucugaagagaucacacagguggacggcaaggucaagcgcgugaaaguguccccuuuugagcuguauagacgggaaaacgauuucauuacgaaguacgccaagcacaaugacgggccgaaaaucgucagcauuaaguauuacgauucuaaaaucggcagccauauugacaucacccccaucaacgcuaagaauaaaguugugcugcagucccucaagccuuggcgcacagauguguacuuuaacagcgagaccagacaguaugaacugcuuggacugaaauacucugaccucaaguucacaaauggcgucuaugggauuaccuccgaggccuacgagaagcugaaacacggaaucagcgaagacggcacgaagacauggaaacccauugggaagaacuccggauuucgguucucucuguaucgcaauaacagagugaaaaucguugaugagaagggcgaaagccuugagcuccuguuugcuucccggaccaccucuaaugaaggguacguggagcugaagccuauuuauaaaagcaaguucgacuccaaagaggaugucggcuuuuacggacaaaugacacccucuggccaguucgugaagaaaauggccagaguuggguacaagcucuauaaggugaacaccgacguccugggaaauccguacuauaucacaaaagaaagcgaugacccugagcuuucccuguacaagaaauga

SEQ ID NO: 4029 - RNA, 3528 nt, Artificial Sequence
  Cas9 variant
auggaggaaaugaagcagaccggcagaaagaacgaggcccccaagcugacagaccucaauuaccggaucgggcuggauauuggaaucgcuagcgugggcugggccguccuugaaaacaauucccacgacgagccuuuccgcauuaucgaucuggggguuagaauuuuugacacggcggaacaaccgaaaaccggagcuucucucgcccugccccggcgcgaggccagaagcgcucggcgcagaauccggcgcagacgggaucgcaucgagagaauuaagaaacuuuuccaggccgaaggccugaucaacauugacgaguuugaagcucgguauaagaucgccgggcucuccgauguguacaagcugcgcuaugagggacuggacagaaaacucacagaugacgagcuggcgcagguucuucugcauauugccaagcaccggggcuucaaaucuaccagcaaggcugaagaggccgaaaaugagaacgaugcugccaaaaagaaggaagcgggcgcccucaaaaaggggaucuccaauaacaaaaagcugauggaggagaaaggauacagaacagucggcgaaaugauguaucuugacgagaauuuucgcaccgauugcccuuggaacgaaaauggguacauucugacaccccggaacaagucuggagacuauaaacauaccgugcucagagacaugcugguugaugaggugcgcgaaaucuucaagagccagcggucccugggcaauauccacgcuagcgaggagcucgaaaacgccuaccuggacauuaugcuuucucaaagauccuuugauauggggccuggagcucccagcaaguacgccauggagggcuucgaagaccgcgucggccuguguacguuugaggggaaaaauggagaaaagcgggccgcuaaagcggccuauaccucugaacucuucguggcucuggagaagaucaaccauacaaaaauuguuuccgaugacggcgccaccagauuucuuacaaccuacgaacgcaagagcaucauugagcugaugcacaagcagcagacggugaaauaugccgcuguccggaaggccaucgggcucgcggaagaggauaaauucuacaaccugaauuauucuccuaaggcuggauccaaaaagagcccggaggacacagauuuugugaagcuggaaaacuaccacaaaaucagaaaggcccucggcgaggacauuguguccgaacaucugcccgccgagaaaaucaaacuuuaugauucuauugcuaccauccugacacucuucaaaaaugacgacagccgcauuaagcgguucaucgaacuggggaucggagaggagugcuuugauggccuucugucccucagcccuucuaaguuccacaaccugucccuggucgccaugggcaaaauuauccccuuucuccuggacgggaauaccuacgauaaggcuugugaacuugccggauacgacuucaaagcggauaacaagggcgagaaaagcguucugcucaaggggaaaaauauuaccgacauggugaacgauaucacaaauccuguggucagacggucugugagccagacgauuaagguuaucaacgccauuauccuggaauauggaucuccccaagcugugaauaucgagcuggcccgcgaaauguccaagaacuuugacgagagacggaaacuuaagagcgauauggaguccagagaaaaagagaauaacaaugucauuaagcgcgugaaagaauacaagcucaacccgaccggccaggacaucguuaaguuccggcugugggaggaacaggauagacgcugccuguauagcggggagaaaauugacaucaacgaucucuuuucuagagacggcggauacgacguggaucauauucugccuuauuccaucacauucgacgauaccuaccggaauaagguccuugugaaagcuagcgagaaccgccagaagggcaauagaacacccuaugaauacuuuauggccgagaaagacgaugacgaauggaacgucuacgagacccuggugcggaauacgguuaaggauuauaagaaagugcucaagcugcugaaaaagcacaucacagaggacgaaaaaucugaguuccgcgaaagaaaccuuaccgauaccaaguacauuacacggaucauuuauaauaugauccgccaaaaccucguccugaagccuuaccugucccucgagaaagaaagaaagaaacaggugauggcgguuaaugggagcauuacccacuaucuguccaagcgguggggacuugagucuaaagaccgcagaacagauacgcaucacgcccaggacgcuguggucaucgccuguaccacagauggcaugaucaacaagauuagccgguacuccaaagggagagagcugcucuauucucgcggauuuaaguucguggacgaagagaccggcgaaauccugagccgggacaauuuuacaagagaggaaugggaugagaaguacggggugaaaauucccauccccugggagcauuuccgcgacgaacuggauauucggauguccagauacaacggcaccggagacgauagcaucgacaagacgaccccucgcgauuucauccuuucucaccgggacgcucauaaauggauuaauuauccggaguggauguuuguugaaggcagacccgggcgccggggaguccucgauggcaucuucguguccagaaugccuaagcacaaagugagcgggcaagcccacgaggaaacaguccggucugccaaguacuauaacgacggaggcuccguguuugagagcgggggcuacguugugaccaagaaaucuauucaggauaucaagcugaaagacggagagauuaaggaguucuuuaaucccgacagcgaucgccugcucuauaacgcucuggucgacagacuuaacaaauucgagaaugauccuaagaaggcguuugccgaacccuucuacaaaccgaaggcugacggcacacaggggccuaucgugaaaaagauuaaaguuuuugagaagcaguccagcggaguguucguccgggauggcaaggggaucgccgccaacggagcuauggugcgcaucgacguguuuugcgaggaagauaaaggcaagaaaaaguauuacuucgugcccauuuacaccgccgacgucgugaaaaagaagcugccugauagagcggcuacggccaauaaacucaucucugaguggcgggugaugaaggaagagaacuuuauuuucucccuguauagcagagaccugaucuacauugaauccgauaaagggguccaaguuaaggacaucgauggcaaaaucucuaagcccgugaaucuuuucgccuauuaccucggagcugacacaagcaccgccuccauuucuggcaaacugcaugacagcuccgcgaacuuucgcucuaucgggauucagggacugcggagauucgauaagugucagguggacguccucggcaauaucagcuuugugaacaaggagaaacgcaugccuuucaauuga

SEQ ID NO: 4030 - RNA, 3531 nt, Artificial Sequence
  Cas9 variant
augaacaaggugcaggaggacugcuacaaaaagaucaaagaaaagcuggccgauagagaguaucggauuggccucgaccugggggucggaagcaucggcuacgcuguugugucccuuaaaggggauaugcccgaagacgugauucuggccggaucucgcaucuucaagagcuccauuggcgcggcugagagacggcacuuucgcgcccaaagaaauacccaucggcaccaucgcgaaagaaugcgguaucucuggaagcugcuugccgagaaaaaccuggcucuccagcugccugagaaucugucuaagaaagaaaacuucacagauuuugacacgagccgcaagagauucccgaucgagguccuccggaaugaucccuacauccugcgcuauaaagcccuugacgaaaagcugucccucuuucagcugggguacgcucuuuaucacauugccaaccauagaggaaccgcgucugugcggagcuuccuggaggaugacgaggccaagguuaaagaaaauaaggagacagcuaaacucgccaagaacaccaaaaagaucauguacgagaaaaaguaccgcacauuuggcgaauaucuguacagagaacggauugagaaguucagacagaaugagcgcaugaaagugaccaacaagaaugaaaacaaagaguuugcugucacacgggauaucauugaaaaggagguggaaaugauccugggcgcccagaaaagauauaauaccgcgguucucgccgacgauuacauugagcgcaucaagaaggcuaucuucuaugagacggaaaaacugauuccugagcccgaauacuguccuuauuuuaaggacgacaaacggcuucccagaucccacaagcugaacgaguaccgccggaucuacgaagcccucaauaacaccagauauuacauuccugagaucgaggagaaaacaggggaaauucugagccgcaaggaaaaggagcaacuuucuaaagaggaaaaggagaaacuguucaacuuucuccugaagaauaaagaacugaccgaggcuaaggugaagaaacuccugaaccuuuccgaaauggccaagguccagcugcagggacgggauaaaaagaaucagaaaaucaagggcuaugcccucaucacacuggagagccuuccguucuggucuaaacugcccgagcaacagcaggacgaguuccucuacgauuggaacaagcugccugacgaaaagcugaaagauagacuccgcaauuauuacaagcugaccgacgaugaaauugacgagacguuucaaaacaucgugcuucccuccaauuaugcuccucuggggaaaaaggcgauggaaauucuccuggaguacaucaaaaacggacugagcuacauugaggcccuugauaaggcugccgacgaaaauaagaucaaaguggagaagcacgaaaucaacgaucuccugcccuauuacggcaaaauucugcaggagucuacacagaugccgaucgggaaggccuucuccaaacaauuugcugccaagaauuauaagaaaccugacauuaacaagaaugaacaggaguucggacggaucgcgaaccccgucguucaucagacccucaaugagcugagaaaacuuauuaacgaaaucauuacaguguuuggcaagaaaccucuggagaucagccucgaaaccucccgggagcugaagaagucucagaaagagcgcgaacugaucgcuaagcaacaggacauugaugaggagaaaagaaagaaaaucuggaagaccuacauugaaccccaccuucagcagaucaaaagccgguccgacaagcucaagaaacuguucguguuugaacugugggaggaucaaaagcauaacugccccuucugucucgagaaaauuaaugucgacgauaucuauagcagaggcguggacaaggaacaccuguuuccucuuaaaaagucugaggaugacuccgaaaacaaucugguuaucgcccacaacaagugcaaugcccgcaaagcugagcgggccccguucgaugcuuuugggcaugaaagcauuuggaacgacaucuucucuaaugccgagaagaaccuccccagaaaacuguggcgcuuuagacagggcagcuucgagaaguuccuggaaaaaccucccaugcuuaagcgguuugagacagauaauuccuacauuucuaagaucagcgcgcgcuaucucgccugucuguucgacaaaccuuccaagaucuuuugcgugaaacccuuccugacggcucagcucagaauugccuggcagcuggaugaaaucaugauucggcuugcugagaacaucauucuggacagcgaaaaggacucuuuuaauaaaggagggcuccaaaagaagaaacgcaucgauaacagacaccaugcccuggacgcggucgugauugccuacgcuucccggggauaccacaauuuccugaaccgcguucaugccaagggcuauaaaaucaauuacgaugagaagaccuggcuuagcgagacacucagaccgccugggaacaaaaaccuggaagacuuuaagucuggaaucauuaaugugaugaucaacgcuaauauuuccaucaagcacgaucacaacaauaaaggccagcuggucaagagcaaagccuauaagcucuacuauuccgagauuggcaaauacaucauuaccacacugaagucugugagcgaaauccuuuucaaacagaaggagaagccccaggacacccugcggcgcgcccucuguaaauuugaggauagacuguccgacaucaaggauaaaaagcugcggaaaaagcuggaagacaacauuacgaucuauaagucuauugagaaugaaagcgcucuuuccaaagcgaagcaagagcucgaagaguucgaucugaaagccaagaaagaggggaagaagggauacgagaaaaucacagacauucucaucuacaagaaggcuugcagcaugcauggcgggaaauauauccacgucaaaaacagaauugaaaauaaguuuuucgcccugaaggaaccuaccgagaucgaaaccggauuuggcuacgauacagccgacaaccuuucucuggaccucuaucaugauaauaacgggaaacuguguggcgaggugauucgcaagaucgacuucaaucggaacagaguucccaauuacaaaaaggagggauauauucugcuugaacgcaucuaccagggcgauacccuggagguggacaucuccgaugacaaaauuagccucaagaacaaagucgggucugcuccugauaagcggacauucgugaagguucugacguuuaccgaauccgacagauaucucaaaaacaagcgcgaucagauccaaauuuucuuuugcaaucugcuuaaaagcacacugaagcacgacgauucuagcaaacacgacgacuccuucuacgugagcucuaugcagaaguacaacguccggaaggugauccucaccucccugggaauuaucaaauauagaagcaagauucugaaaaauaaggagaucuga

SEQ ID NO: 4031 - RNA, 3531 nt, Artificial Sequence
  Cas9 variant
augcuguuccccaagaaacucagcaaggaggaaguggccuacguccugguugagaucaacuccaaucuuaacaauucuagcaacuaucugggcaauauuuccgacagaucuaaagaacucuacuuuaacaagcagaccaucgggcaauuccuguauacaaaacuuaaggaggaucggcacuacagccugaagaauaaaguguuuuaucgccaggacuaccucgaugaauuugagagaauuugggagacgcaggcuaucuuucauaaggaacugaccgaggaccugaaaaagcagauucgggauacaaucaucuucuaucaacgcagacucaaaucccagaagggacugauuucucuuugcgaauuugagaacaaggagaucaccauugaaaaagagggcaagacagugaccaaacagaucgggguccgggugauuccuaagagcuccccgcuguuccaggaauuuaaaaucuggcaaauucucaauaacguuaucuguaagaaaaagggaacacgcaagaaaaaggccgugacccccgcgccucugcuuuucgagcuguuuggcacgcccagcgaaaccuucuuuucucucgacauggagugcaaacagcugcuguucgaggaacucaaucugaaggggaaccuuaaagcugauaaggucaucagacugcucggauacauuccucaggagugggaaaucaauuacaaccagcuggagggcaaucggacacaaaagucccuuuaugaagccuaccugaaaauuaucgagauugagggcuaugacaucaagaccuuccuccgcaucaaaagcgauaaggaagacugggaucuggaggaaucuccccuguccgccaaagagauuagagaaaacauccagcacauuuuugagacacucgggaucagcaccgcuauucuguacuucgacgccacgcuuccuaucaaggauuuugagaagcaggcuucuuaucaacuguggcaucuccuguacuccuaugaaagcgacaacuccccgucuggaaaugagacacuuuacaaacugcuccaggacaaguucggcuuuaaacgggaacacgccguguuccugagcaacaucuccuuucaggaugacuacgggagccugucugcgaaggccauucgcaaaaucuaucccuacauuaaggagaaucaguauuccaccgcuugugagcucgccggauacagacauagcaagcugucucuuacaaaagaagaacugaacaaucggccucucaaggaucugaucagcccccugaaaaagaacucccuucgcaauccuguuguggaaaaaggccucaaccaaaugauuaaugucgugaacgcucugaucgagaaaaauucugaaaaggacgccgaggggaacauuaucaaguauuuccacuuugaugagaucagaauugaacuggcgcgggagcucaagaaaaaugcccaggaaagagcugagaugacccugaacaucaagaaugccaccauugaacaggagaaaaucaagagcauucuuaucuccgacuucggaaucaaaaaccccacaaagaacgauauuacgcgcuaccggcuguaucaggagcucgcucacaaugacuacaaggaucuguacaccaacacagacaucccgaaagaacugcuuuuuagcaagaauauugauaucgagcauauugugccuaaagccagagucuucgacgacucuuuuuccaacaagacccucgccuaucgcgauuucaaucugaaaaagggcgaaaacacagcuuucgacuuuaucgauagcucucugggcgaggaggagcucaaucaauacaucgcgcggguugagaacgccuucaagaccaaaaauauuuccgcuacgaaguauagaaaccugcuuaaaaaggccacagaaaucaaugacggguuuauuaaccgcgaucugcgggagacccaguacaucgccaaaaaggcuaaggaccuccuguuccagauuaccagaagcgugguguccacaucuggaagcaucaccgaucgccugcgggaagacuggggccuuaucgauauuaugaaagagcucaauaugcccaaguauagagaccuggggcugacagagaucauugaacgccgggauggaagaaaagucgaggugaucaaggacuggacgaaacggaacgaucaccgccaucacgccauggacgcgcucaccguugcuuuuacaaagccuuccuacauucaguaucugaaucaccuuaacgccagaaaagacgaaaacaauaagcuguacgccgauauccucggcauugagcggaaggaaaccacaaaaauccaugacgagaacgggaaugagaagagaguguucaucgaacccauucccggauuucgccaaaucgcuaaaaaguaccuggaggaaauucugaucucucacaaaaccaagaacaaggucgugacgaaaagcauuaauaagaucgccggcaccaacaaaaagcaggagacacuuaccccucggggccagcuccauaaagaaacaaucuaugggaaguaccacuauuacuccaauaaggaggagaaaauuggaaccaaguucgauaaagaaacgaucagcaagguuucuaacccgauuuauagauacgcucugcagaaacgccuggaggccaaugaaaacaaucccaagaaggcguuuacaggcaaaaacgcccucuccaagaauccuaucuaucuggacgaugcuaaaaccaagauucuucccgagaaagugaaccugaucuaccucgaagaggacuucagcaucagaaagaagauugucucugagaauccuacauccaaagaauuugugcccaacagcaucucuauugagaagaucgucgaugaagggauuaaacggauccugaaggagcgccuggagaccuacaacaaugacccgaaaaaggccuucgcugaucuugacaaaaacccuauuuggcugaauaaggaaaagggaaucagcaucaaaagagugaccauuuccggcguuaagaacacacaagcccuccauagcaaaaaggaucaccuggggaaacccauccucgacaaggagggccaggaaauuccuguggauuuugucucuacgggaaauaaccaccauguggcgaucuaucgggaccagaagggcaaucugcaagagcagauuguuuccuucuucgaagccgugguccgcgcucagcaggggcuucccaucaucgacaaaaccuacaagcaagaggagggauggcaguuucuguucacaaugaaacagaacgaaauguuuguguucccuaaugagauuaccggcuuuaaccccagcgaaaucgaucuccuggacccgaagaauaaaaagcugauuuccccuaaccuuuucagagugcagaagaucucuauuaaagauuauuucuuccggcaccaucuggagacaaauguugaaaccaacaauauccucaaggacaucacguggaaacgcgggggacugagccuccugaagggcauuaucaaagucagaauuaaccaccuugggaauaucguguccauuggcgaguacuga

SEQ ID NO: 4032 - RNA, 3534 nt, Artificial Sequence
  Cas9 variant
augaacaaggugcaggagaucgaauacaaaaagauuaaagagaagcuggccgacagagaauaucggaucggccucgaucugggggucggaagcauuggcuacgcuguugugucccuuaaaaaguaugacgaucugucuuaccuccccgaggacaucauucuggccgggagccgcaucuucgcguccucuaucggagcuguggaaagacgggaguuucgccuucaaagaaauagccaccggcaucgcagagagcggaugcgcuuccuguggaagcuccuggccgaaaaacagcuggcccuccagccuuccaaggaucuggagaaaaaggaaaacucugcugacugcgagaccagccagaaaagauuuccgauuaauauccuuaagaacgaucccuauauucugcgguacaaggcccucgacgagaaacugucccuuuuccaacugggcuauguccucuaccacguggcuaaucaucgcgggacagauagcaucagaucuuuucuggaagacacggaugacaagauuaaagagaacaccaagacagccaaacuggcgaccgaaacaaagaaaaucauugauuccaagaaguaccggaccuucggagaguaucucuacaaagaacgcauccagcagaaugagagaaagaaaguuagcaaccggaagacagccggcaauaaaaacaaggaguuugcugugaccagagacaugaucuucaaggaaacggagaaaauucuggccucucagaagcaauauuacaccaauguccuuacagacgaauauaucaaagagauugaaggcgcuaucuuuuaccagaccgagaagcugauuccugaguccggguauugucccuacuucaaagaugaaaagcgccucccuugcagccacaagcugaacgaguaccggagaaucuaugaagcccuuaauaacgcgcgcuacucugcccccgugcuggacgagaaaacaggagaaauccucuccuaucaggagggcgaggaauuuagcuccgaggaaaagaaaauucuguucgaugagguucugcucaaggggaaaaagcugaccgagucugaaaucaagaaacuucugcaucucccugacggaugugagauucagcugcaaggccgggauaagagaacgcagaaaaucaagggguacgcucuuacagcccuggaagcucucccguuuuggagcaaacugucccagcaacagcaggacgaguuccuguaugauuggaauggacuccccgaagagaagcugaaaccuaaacuuauugacugcuacagccugaccgagaacgaaguggaugagacauuccagaagauccgccuccccucuaacuaugccccugucggcaaaaaggccauggaaauccugcugaccuacauuaaagacggcuacuccuauaccgaggcucuugauaaggcggugagcgaagggaaauuuaagguggacaagcaaacaacgaucuacgacucucuccccuauuacggaaaaauucugcaggagagcacccagaagcugaucggcaaagccuucuccaagcaguuugcuaaacggaauuauaagaagccgaacacaaauagaaacgagcgcgaguucgggaaaauugccaauccugucguucaccaaucucucaacgagcugcggaaacuuaucaaugaaauuaucaccguguuuggaaagaagccccuggagaucggccucgaaacagccagagagcugaaaaagagcuccaaggaucgcgagagccuggugaaacagcagaacgaaaaugaguacaaccggaauaagauuuauaaagacuacgucgaaccucaccuuucucagaucaaguccagacaagagaaccccagccgguacauuuucaaauuugagcuguucgaagaacagaagucuaucugucccuuuugccugaaagaaauuaccccugaugacaucaucaauuccaagguggauauugagcauaucuucccgauugaagagagcgaggacgaugcuaagaacaaucugguuaucgcccacaacgaauguaacgcggacaaagggaagaaaucccccuuugaugcuuucggagacaagacgucuggcaaauauguguggaaugauauucuccauaacgccaagaagaaucugccucacaaaaucuggcgcuuuuaccagggcagccuugagaaguuccuggaaaacaaacccaugcucaagagauucgggacagacaauuccuauaucucuaaaauugccgcuaaguaccuggccugccuguuuaacaauagcuccaagaucuucuguauuaaaagcucucuuaccgcucagcuccggaucgccugggagcugaacuccauuaugaucccucuggcgaagaauauccucagcgaaaaagagcuggaggaauuuaagacccuuaaaaacaagaagauuagaauggauaaucgccaccaugcccuggacgcuaucacaauugccuaugcuaaccggggauaccacaauuuccucaacaaaauccaugccaagggcuauaaaauugacuacagagagaagaauuggcugucuaaaauccugcuucccccgcucaaccgcgaucuggaagacuuuaagauuuccgucaagaacagcaucgagaaagcgaaugugucuaucaagcacgaucauaaaaccaacgggagccugguuaagggaacagccuacaaaguguauuacuccggcacggggaaguauauuaucaccacacucaaaaaugucgaagagauuagcuucaaggagaaggaagacccugaggauacccugagacgggcucuuugcggcuuugaagacucuaacaucaaagaugagaagcugauuaaaaagcucaaauacaauuccgaccuguauaagaagauccugaacacaaaacccaaggccaaacaagagcuugaacaggcuaaucaggagaccaaggaagagggaaagaagacgcaaaagaucaccgaugugcugauuuacaaaaaggccuguagccucgucggcgaacaguauauccagugcgccucccgccuggagaacaaauucuuugcugugaaggagccuacagaaauuagaaccgggaucggauacgacacaggcgauaaucucuuccuggaccuuuacuaugauaaaacccggaagcugugcggggagauuauccgcaagaucgacuuuaaccagaauaaaauucccaacuaccaaaaggaaggauauauccucuucgagagaauuuaccagggcgacacgcuggaagcggauacaucugaggacaaaaucagccugaagaauaaaaccggguccgcccuugauaaccggacauuuguuaaggugcugaccuucaccgagucugacaaauauuucgauggcaagaaggacaaaauucagaucuuuuucggaaaucuccucaagagcaacuacaaacaggaugacuccuuuuauauuucuagcaugcaaaaguacaacguccgcaaagugauccucacaucccugggcaucauuaaguacagaagccagauccuuaagaauaaagaaguuuga

SEQ ID NO: 4033 - RNA, 3540 nt, Artificial Sequence
  Cas9 variant
augagcaagaaaguguccagacgguacgaggaacaggcccaagagaucugccagcgccugggcucuagacccuauagcauugggcucgaccugggagucggcuccaucgggguugcuguggccgcguacgauccuauuaagaaacagccgucugaccuuguguucgucagcucccggaucuuuauucccucuaccggagcugccgaacgcagacagaagcggggccaacgcaacagccugagacaccgggccaaucgccucaaauuccuguggaaacuucuggcugagagaaaccucaugcuguccuauagcgaacaggaugugccugaccccgcccggcugcgcuuugaggaugcuguugugagagccaauccuuacgagcuccggcugaaggggcuuaacgaacagcugacacucucugagcugggauaugcgcuuuaccauaucgccaaucaccgcggcuccagcucugucagaacguuccuggacgaagagaaauccagcgaugacaagaaacucgaggaacagcaagcuaugaccgagcagcuggccaaggaaaaaggcaucucuacauuuauugaggugcugaccgcuuucaacacaaaugggcucaucggauaucggaacuccgaaagcguuaaguccaagggcgugcccgucccuaccagagauauuaucucuaaugagauugacgugcugcuucagacacagaaacaauuuuaccaggagauccugagcgaugaauacugugaccgcauuguguccgccauccucuucgagaacgaaaagaucgucccggaggcggggugcugucccuauuuuccugaugaaaagaagcugccccggugccauuuccuuaaugaggagagacgccugugggaagccauuaacaaugcucggaucaaaaugccuaugcaggagggagccgcuaagagauaccaaagcgccucuuuuuccgacgaacagcgccacauucucuuccauaucgcccggagcggcaccgacauuacgcccaaacugguucagaaggaguuuccggcucugaagaccucuaucaucgugcuccaggggaaagaaaaggcgauucagaaaaucgccggauucagauuccgccggcuggaggaaaagagcuuuuggaaaagacuuuccgaggagcaaaaggaugacuucuuuucugcuuggacaaacaccccugaugacaagcgccugagcaaauaucucaugaagcaucugcuucugacagaaaaugagguggucgaugcccucaaaaccgugucccugauuggcgacuacggccccaucgggaagacggccacacagcugcucaugaaacaccuggaggauggacuuaccuauacagaagcucuggagcggggcauggaaaccggggaguuccaggaacucagcguuugggagcaacagucucugcugccuuacuauggacagauucuuaccggcuccacacaggcccucauggggaaguacuggcacagcgcguuuaaggagaaaagagacucugaaggauucuuuaagcccaacacgaacuccgaugaggaaaaauacggccggaucgcuaaucccgugguccaccaaacccugaacgagcugcgcaagcucaugaaugaacugaucacaauucuuggcgccaaaccucaggagaucaccguggagcuggccagagaacucaagguuggggcugagaagcgggaagacauuaucaaacagcagacaaagcaagagaaagaagccgugcuggcuuauagcaaguacugugagccgaacaaucuggauaaaagauauauugagcgcuuccggcuucucgaagaccaggccuuugucugccccuacugucuggagcauaucuccguggcggacauugccgcuggcagagccgaugucgaccacaucuucccucgcgaugacaccgcugauaacucuuauggaaauaaggugguugcccacagacagugcaacgacaucaaagggaagcggacgcccuacgcggccuuuagcaauacauccgcuuggggaccuauuaugcauuaucuggaugaaacccccggcauguggcgcaagagacggaaauucgagaccaacgaggaagaguacgccaaguaccuccaaucuaaaggguuugugagccgcuucgaauccgacaauagcuauaucgcuaaggccgccaaagaguaccugagaugucuuuucaacccgaauaacgucacagcugugggcucucugaagggaauggaaaccuccauucuccggaaggcguggaaucugcagggcaucgaugaccugcuugggagccgccacuggucuaaagaugccgacacauccccuacgaugagaaagaaccgggaugacaaccgccaucacggacucgacgcuauuguugcccuguauugcagcagaucucuggugcagaugaucaauaccaugagcgagcagggcaaacgggccgucgagaucgaagcuaugauucccaucccuggguacgccuccgagcccaaccucagcuuugaagcgcaaagagagcuguuccgcaagaaaauucuugaauuuauggaucugcaugcuuucgugucuaugaagacagacaaugaugccaacggagcccuccugaaggacaccguguauuccauccugggcgcugauacacagggggaggaccuuguuuuugucgugaaaaagaaaauuaaggauaucggcgugaaaaucggagacuacgaggaagucgccagcgcgauucggggcagaaucaccgauaagcagccuaagugguaucccauggagaugaaagacaagauugaacagcuccaauccaaaaaugaggcugcccugcagaaguacaaagaaucucuggugcaggccgcugccguucucgaggagagcaaccgcaagcugaucgaauccgggaaaaagccgauucagcuuucugagaagacgaucagcaaaaaggcucuggaacucgugggaggcuacuauuaccugaucuccaauaacaaacggaccaagacauucgucgugaaagagccuucuaaugagguuaagggguuugccuucgauaccggaagcaaccugugucuugacuuuuaucacgaugcgcaaggcaagcugugcggggaaauuaucagaaaaauucaggccaugaaucccuccuacaagcccgcuuauaugaaacagggcuacagccucuaugugcgccuguaccaaggagacgucugcgagcuccgggccucugaccugacagaagcugaguccaaccuugccaagaccacgcacgugagacugccuaaugccaaaccgggccgcacauucguuaucauuaucaccuuuacagaaauggggagcggauaccagauuuauuucucuaaccucgcuaaguccaagaaaggccaggauaccagcuuuacccugacaacgaucaagaauuacgacgugcggaaaguccagcugucuuccgcggggcuugugagauaugugagcccccugcucgucgauaagaucgagaaagacgagguugcccuguguggagaauga

SEQ ID NO: 4034 - RNA, 3567 nt, Artificial Sequence
  Cas9 variant
augaaguacauccugggccucgacauuggggugagcuccgucggaaucgccguuauuucugaggaaaaccagaaaaagaccaucgagaaucuggcugugagaauugugcccgaagauccugacuuccacggcaaauuuuauagcgggaacacagccuccaagaaucuugagcggacggcgaaacgcggaaacagaaagaauaaccaacgguucaaggcucgcagagauaaacuguaccagucucucaaggaaaauaacauguuuccgaccagcaaucuguucgaccuuuccgccgucgagcuguauggccuccgggccaaagcugugucugagcagguuagccugcaggaacuggggcgcauccucauccugcuuaaccaaagacggggauuucuguccaaucgcaagagcgugucugaggaaaacuccacagaguacaaagagagaauugccggccucgaaaaggcucugggcaauaagaccaucgggcagaaacuuuauagcgagcugcaggaaaacaauaacgucuucgaggugcuccugcgggaacgcacauaccagagaucuuccuauaccgaggaguuugaucggauuugggacgaacaaaagaaauacuaccugauccucacaggaagcucuaacgaggaugacaauaagggcacccuguaugaucuuauucgcaacagaaucauuuacuaucagcggccccugaaaucccagaaggggcucaucagcgaaugccuguucgagaaacaucacaaggccguugcgaaguccucuccuuacuuugaacuuuucagaaucuggcagaaaauuaaugaccugagcuggaagacgcccaacggagagcucuuuaaaccuaccgaugagcaaaagcagaaacugaagaaugcccuguggaacggcgacaaucucaaccccaagcauaaacugacaguguccaagaucaaagaaauucuuggguauaccagccgcgagaagaucuaccugaauuucacagaacucgauggaucucggaccuauuccauucugagaaacgcucuuaucgaggccggcaucgaaaaaccugagcaguaccuguuuuucaauauggagacgaacgacgaaaagggcgggcucuuugagcuguggcacauuacauacagccugccgaucgaaaaggaggucauuaaugcucucaaaaaccgcuuuggauucgacaagaaacaagccgagaucauugcgcggagagugggcuauucuagcgauuacgggucccugucuacccgcgccauccggaaacuucuggugcaucucgaaaaaggacugggcuauacagacgcuugugauaauaucggguacgaccacagcggauauaagaccaagauugaucugcagcccaaacuuaagcagcucaaaagaaacgagcugcgcaacccugucguugaacagauccugaaucaaguggugaacgccgucaaucucauuaucgagaaguacggcaaaauugacgaaauccggguggagcuggcuagagagcuucgcaacaaugccaagacccggaaaaacauuucccugcucaauagcaagaacaagaaaaauaacgauaucaucagaaagaaacugcaggaagaguauggcuuuaaguucguuaaugggcgggacgugacacgcuacauucugugggaagagaacucuaaagaaugccuuuacuguaauaagacgaucaacggauccgauaugcucaccggcaaugccgacauugagcacauccugcccaagagcagaucuuuuaacaacgcuaugaauaacuauauuaucacacaucggaaaugcaauuccgauaaggggcagaaaaccgcguacgacuucaugagcuccaagggagaggucauccugcagcaauauauugaaaaagugaacgaccucuacaaggauggcaaggggucuaucagcaaaacaaaguuugagaaucugcuuuguaaaggcgaagacauuccuuccgauuucguugagagaaugaagaaagacucucaguauaucgccaaggaagcugugaagaugcugaaaaccgucugccccaacguguacacgacaaccggacaggucaccgauuuucuccgcgaggaguggaagcugaaaaaucugcuucaggaacucacauucgagaaguauaaagccauuggccaagugaaggaaaagaucaucaagaccaacaaugggcagacaaagacguuuaaaguuauugccgacuggagcaagcgggaugaccacagacaucacgcuaucgaugcccugauuugugcgcugaccgaccagaaaaucauuuucaagcucaacaaucugaacaaaaucuaccaguacgagcgcaaugcucuuucccaaaaggagaucgaagagauugaagaguuucuggaaggaaaguucagcaucaaagaguucucugcccagcagggcaacauuaucgagugcuccauuccgaauaucagaaaggaugcccaaaaacaccucgaaaacauucugaucagcuuuaagaaagagaacucuaaggugcugacaaugaaucggaaccagccuaagaauuguaaagaacagaucaccugggucccccgcgcuagacuucaugaggacacaauuauggggcgggugaagcgcaucccugaaaagaagaugaaacucaacgauaagguuuccuucgagcagauuaagaugaucgugaaucccgagauuaaagaaauccugcuguauagacucgccaaguuuggagacaaccccaaagucgcuuucgccaccaaggcgcugaaaaaggagccuaucuuuuaccgggaaaaugagcuuaaggaagugagcauuuaugagugggugaacacgaaacgcguugcccugaaugagaacaucaccgacucucaaauugaaaagaucauugaucaggcuagcaaaagagccgucaaggagcggcucaauggcgggaaaaucaaggaaguguucaaaaaccugacagagaauccgauccagcugaagaacggcaugauucuuaagaaugugaccgucacagacgaguccaaaguggaaaagauccgcaacggauuugcuauuaccggcaaaaaucaccaugcccugguuuacaaggaugagaacgggaaauauaacgacaagguggucagcuucugggaagcgguggccaucggacucagaaauguuacggaguacggcaaccccuauccuauuaucaaucggaaccacaaugaugaacugggggaguuuuacuucucuaugcagauuaacgaccucuuuguguucgaucugaagcauuccgagaauccccaagaagagaacgaaaucaauuucuucgacgucgagaacagaaaacagaucagcgauaaacuuuuccgcgugcagaaaauguccaagaaaucuaauggacaguuuguuagcgacuuccggcaccaccuggaaacauccgugauuagaaacgauaugauccucaagaauauuaccuggaucucuauuagcaagaacuccgaccuggagcgccugacaaaaauccgggucaaucaucuuggcgagaucauuaaggugggggaauga

SEQ ID NO: 4035 - RNA, 3585 nt, Artificial Sequence
  Cas9 variant
auggacuucaccgccgaugugagcgagcugaacgaauccuuuaugcagauccacacagagucuaaguucgaaauugacacggcuaaaguccaagagaucagccagcuccugcuugauaauaagauuaccagaauggaccggcagaaacagguugccaacgugcuggcgaagaauagcggcgauaaagaagcugacaagaucaacaagaaaauugccacagaguuuugcaaggccgugcucgggaauaaagcuaaguucaacgucauccugggagaggaugccguggacucugauuggagcuuuaaaauggacgaugaaaauuccgacgaggaaaucgagauucuuaugggccaaaccaacgggcagcagcagaauguucugcgcaucauucaucaaugguacucucagaucacacucaacggaauugugcccgauggccagaugaucagcgaguccaugauugacaaguaugaacugcacagaaagcaucugcuccugcuuaaacagcaaaucaaggucaccaaagacaagaaaaaggcucagcagcugcacgaggccuacgaacaauaugugcaugggacaggagcgaaaaagaagcucacccaggaugacuucuacagcaaaguuacgaagaaucuggagaccucugauuuuuccgacgaaaucaaaaagcagauuaacgccgagacauucaugccuaaacagcggaccagcgcuaauggcgugaucccgcaccaacuucaccagcaggagcuggauaagauuaucgaaaagcaggccaaauauuaccccuuucucgcugagcugaacccugacacaaagcgccaaaauauugccaaauauaagcuggaugaacucaucgcguucaaaauccccuacuacgucggcccucugauuaccacggaggaccagaagaagacaucugggaaauccuuugccuggauggugagaaaggaacccggaaaaaucaccccuuggaacuucgaucagaagguggacaaaauggcuagcgccgaucaguuuauucggcgcaugacaaccaaggacucuuaucuuaucaccgaggacguccugccggcugagucccucauuuaccaaaaguauaaaguucugaacgaacuuaauaugaucagagugaacggcaauaagcugacaaaacaugauaagcagaacaucuaccaacagguguucgagaaauauaagacggucaaugugaaaaagguucaaaacuacuuccucaccgacgggcgguaucagcacgcccccaagauuacaggacugagcgaugacaauaaauuuaacuccaaucugucuaccuacaucgauuucaagaaaauuuuucaggacguggucgaugacccucaaaagcagaaagauuucgaacgcaucauugaguggagcacaaucuuugaagacagacauauuuacgaggugaagcucaaggagaucuccuggcugaacgaugaacagcggaaagagcuuaagaaaaagcgccaccagggcugggggagacugagcgccaaacuccugaccggaaucuucgacgaaaauggcuauucuauuauggaucaacuuuggaacacgcagaagaauuuuaugcagauccaggcugaggagggcuucaacaagaaaauucaagcggaaaauuccaagcaccuggagaaaaacgacuuugaagacauccucgaggaugccuacacaagcccccagaacaagaaagcuauucggcagguuaucaagguggucgaagacauccagaagaccauggggaccgccccucagaaaauuucuaucgaguucacacgcagcgccgauaagaaucccagacgguccauugagagacagcgccagcuggaagagaucuauuacaacgacgcuaaagaaauugugucugagggaaugcaagauaaucugcagaacuuuaccgacaauaagcagacacucacggauaaauauuuccuguacuuuacccagcuuggcaucgacauguauacagggaagaaaaucaacauugaugaaaucggaaauuaccaaauugaccauauccugccgcaggccuucauuaaggaugacagcaucgauaacaagguccucguguccagcgcgaucaauaacggcaaaucugacaauguuccucuguccauguacgcuagcgugcggauuaagucugagguccagaacaaauggaagaauuucgccgagcacgggcugaucucccagagaaaacuuaacaaucucaugaccgaccccgaaagcauugauaaguauaaggcccgcggauuuaucaaacggcaacugguggagacaucccagguuauuagacugguggcugaaauccucaacgagaaguaccagggcgaaaccgagauuaucgagguccgcgccaaaaugaacucucagcugcggaaggacuucgaucuucugaaaaauagaaacgugaaugacuaucaucacgcucucgaugccuaccugacgaccuuuaucggcaacuaucuguaccgccgguauccuaagcugagaagcuacuucacauacgggcauuuuaagaaaauugacgaugcgaagcucaaacaauucaauuuucugcacgacaucgaaaacgauaaggaccccaaauaugugaaugauaacggagagcugcucugggaccgcgaaaaggacauugccuacuucaagaaaaucuauaauuuuaaguacaugcugguuucccacgaggucucuacccggcagggcgcuauguucaaacagacaauuuuucccgccgcugccgaugccaagagcaaacuuaucccuaucaagaacgacaagccgaccgcgauuuaugggggauacacgaauaacaaugaugcuuaucuggccaucauuaaacucgcuaagacaggccaguucaaaguggugggggucccccaaagagccaucgugaagcugaaacaggccuacgacaaggagaccggcgauuacuccaacguucuguauaaagugcuugaaccuaaguuugucaagaaaaaggugaaucggaaaacaggagagauuaccuaccagguugaaaaguucaaaaucgugguccccaaggugccuuaucgccaacucguuaucgacggcgaucagaaguucaugcuggggagcucuaccuacaaauauaacgcuaagcagcuggugcucuccgagaacgcgauuaaaauccuggacaagaaauccuuugaucagucuggauacaaguccagcgaccuugauacagucuaugacgaaauucugucucaaguggauagauacuucagcauguacgacaagaauaaauuucgggagggccuccauaacgggaagaaauauuuccagagacugcccaugaucgacaauguggagaagggaaaaauuaaggaaaacggcaaguuuaaacugcuuaaugagauccucauugggcugcacgccaacccguccuucggcaaucuuaagagccucggaaucucuacgccuuuuggcaugaugcaguucgcuuccgggaucagccuguccgaaaacgccauucuuuguuaccagucucccaccggaaucuuugagcgccgggucgcccugaaagaucucuga

SEQ ID NO: 4036 - RNA, 3588 nt, Artificial Sequence
  Cas9 variant
augcagaagaacaucaauaccaaacaaaaccacauuuacaucaagcaggcccagaaaauuaaggagaaacugggcgacaagcccuauagaaucgggcucgaucugggagugggcagcauuggguucgcuaucgucuccauggaagagaaugacggaaacguucuucugccuaaggaaaucauuauggugggcucucggaucuuuaaagccagcgcgggggcugccgaucgcaagcucuccagaggacagcggaauaaccaucgccacacaagagagcggaugcgcuaccuguggaaagugcuugccgaacaaaagcuggcucucccgguccccgccgaccuggauagaaaagaaaauucuagcgagggcgaaacguccgcuaagcgguuccugggcgacgugcuccagaaggauauuuaugagcugcgcguuaaaucucuugacgaaagacugagccuccaggagcugggguacgugcuuuaucauaucgccggacaccggggcuccagcgcgauucgcaccuuugagaacgauucugaagaggcccagaaggaaaauacagagaacaaaaagaucgcugggaauauuaaaagacugauggccaagaaaaacuaccggaccuauggagaauaccucuacaaggaguucuuugagaauaaggaaaaacauaagcgcgagaaaaucuccaacgcugccaauaaccacaaguucagcccuacaagagaccuggucaucaaagaagcggaggccauucugaagaagcaagcuggcaaagauggguuucacaaggaacucaccgaggaguauaucgaaaaacugacaaaggccauuggauacgagucugaaaaacuuauccccgaguccggcuucugcccuuaucugaaggacgaaaagcggcuccccgcuagccauaaacugaacgaggagagacgccuuugggaaacccugaauaacgcccgguacucugauccuauuguggacaucguuacgggcgagaucaccggguauuacgaaaagcaguuuacaaaagagcagaagcagaaacucuucgacuaucugcugaccggauccgagcucacaccggcccaaaccaagaagcugcuuggccugaaaaauacgaacuuugaagauauuauccuccaggggagagacaagaaagcucagaagauuaaaggauacaagcugaucaaacuugagagcaugcccuucugggcgcgccuguccgaagcccaacaggauucuuuucucuacgacuggaauagcuguccugaugagaagcugcugacagaaaagcucuccaacgaguaucaccugaccgaggaagagauugacaaugcuuucaacgaaaucgugcuuuccucuuccuacgcuccccugggcaaaagcgccaugcucaucauucuggagaagaucaaaaaugaucugucuuauacagaagccgucgaggaggcccuuaaggaagggaaacucaccaaggagaagcaggcgauuaaagaccggcugccuuacuauggagcugugcugcaggaaagcacccaaaagaucauugccaaaggcuucagcccccaguuuaaggauaaaggcuacaagacaccgcauacgaacaaguaugagcucgaauacgggagaaucgccaauccugugguccaccagacccugaacgagcuucgcaaacugguuaaugagauuaucgacauccucggaaagaaacccugcgaaauuggccuggagacagcucgggaacugaagaaaucugccgaggauagaagcaaacuuucccgcgagcagaacgacaaugaaagcaaccggaacagaaucuacgagauuuauauccgcccucaacaacaggugauuaucacccggagagaaaauccccggaacuacauccucaaguucgagcugcuggaggagcagaaaucucagugucccuuuugcgggggacagauuuccccuaaugacaucauuaacaaucaggcugauaucgagcaccucuucccgauugccgaaagcgaggacaacggccgcaauaaccuggugaucucucauuccgcguguaaugccgauaaggcuaaaagaagccccugggccgcuuuugccuccgcggccaaggacucuaaauaugauuacaaccggauccuuagcaaugucaaggaaaacauuccucacaaggcuuggagauucaaucagggggccuuugagaaguucaucgaaaacaagcccauggcugcccgcuuuaaaacagacaauuccuauauuucuaagguggcccauaaauaccuggcuugccucuucgagaagccuaacaucauuuguguuaaaggcagccugaccgcgcaacugcggauggccuggggacuucagggccucaugauccccuuugcuaagcagcugaucacggagaaggaauccgagagcuucaacaaagaugucaauucuaacaagaaaauuagacuggacaaucgccaccaugcccucgaugccaucgugauugcuuaugccuccagaggguacggaaaccugcuuaauaagauggcgggcaaagacuacaagaucaacuauagcgaacggaauuggcugucuaagauucuccugccgccuaacaauaucgugugggagaacauugaugcugaccuggaauccuuugagagcucuguuaaaacagcccuuaagaaugccuucaucagcgugaaacacgaucacuccgacaacggggagcucgucaagggaaccauguacaaaaucuucuauagcgaacgcggcuacacccugacaaccuauaagaagcugucugcucucaaacugacagacccccaaaagaaaaagacgccuaaagauuuucuugagaccgcccugcucaaguucaaggggagagaauccgagaugaaaaaugagaagauuaaaagcgcgaucgaaaacaauaagcggcuguuugacgugauucaggauaaccuggagaaagcuaagaaacuucuggaagaggaaaacgagaaguccaaggccgagggcaaaaaggaaaagaauaucaacgacgccucuauuuaccagaaggcuaucagccucuccggagauaaauauguccagcugucuaagaaggagcccggcaaauucuuugccaucagcaagccuacacccaccacaaccggguacggauacgacacgggcgauucccucugcguggaccuguauuacgauaauaaagggaaacuuuguggagaaauuauccgcaaaauugacgcucaacagaagaacccgcugaaguauaaagagcagggcuucacccucuuugaaagaaucuacgggggcgauauucuggagguugacuucgauauccauucugacaagaauagcuuucggaacaauacaggauccgccccugagaaccgcguguucaucaaagucggcaccuuuacagaaauuaccaauaacaauauccagauuugguucgggaacaucauuaagagcacgggaggccaagacgauucuuuuacaaucaauuccaugcagcaguauaaccccagaaaacugauucuuagcucuugcggguucaucaaguaccggucccccauccugaagaauaaagagggauga

SEQ ID NO: 4037 - RNA, 3594 nt, Artificial Sequence
  Cas9 variant
augagcaagcacgugcugggccucgaccugggggucggauccaucggcuggugccuuauugcccuggaugagcaggaccaacccgcugaaauccucgggaugggaucuagaauuguuccucugaccacagaugaccuuaacgaguucagccagggcaaagccaucuccaagaaucagaaacggacgacccagcgcacaauuagaaaggggcuggaucgguaccaacuccgcagaaaagugcugucugaaaagcuggcgggacauggcaugcucccggacaaggaucugaugcagcuucccgugcuggaccucugggagcugcgggcucgcgccgccagcccuggcgaaaaacuuucccugcccgagaucgggagaguccucuaucacaucaaccagaagcggggauacaaacaugcuaagucugaugaggccgaagaggugaccaaacgcggcaaggaacagggguauguugcuacagugaagggaagauacgccgagcugcaacgggagggcgcgaccgucgggcagcacuuugccuguaaacugaaggaacaucgccaggagagcccuuccggaggcuucuuuuauaauuacagaauuaaagaccagguguauccccgggaggcuuacaucgaagaauuugaucgcauuauggagguucaaagcguguuuuacccugagguccucacaccggccuucauccaggaacugagagacaaggugauuuucuuccagcggccccuuaaaucuugcaagggccugguguccuuuugugaguucgaaaaacaagagagagucguucagcucaagcgcgugaaccgggaagggaaggaggagcugcaggaaagaaaaaucaccauuggaccuaagguggcucccaaaagcucuccuaucgcccagcuuugcaagcugugggaguccauccacaauauucgcaucuauuaccccgauggcaaagaacggccgauuacgcucgaggaaaagagaaagcugcuggcguaucuccaaacccacgacaaacugacauuuaccgcccuuaagaaagagcugaagaucagcgacaaagagcgccucuggugugauaagcugcuuaagggaggaauuaaaggcgacacaacccggguccugcucagaaaggcucuggccggguacaaacgcuaugaaccucugcuccggauggaucuggagcuuagagacuuccaggaaaucgugucuggaaagcgccugauccggcccauuguugaugaguccuaccucagccagccucuguauagacuguggcauauccuuuacuccauugaggaacgggaggcuaugcgcagagcccucaucgaccagcugggcuuucuggaagaggaucucgacggcgggcugcuugauaaacuguaccaaauugacuucgccaagcagggauauucuaacaagagcgcuaaauucaucugcaagcuccugccccaucugcagggcgggcacggauacucccaggcgugugaacuugccggcaaacggcacagcgcugggucucucacgaaggaggagcuggaagagagaccccugcucgaacacaucccucugcuucaaugcaaugagcugcgccagccgauuguggaaaagauccucaaccagaugauuaaucuggucaacgcccugcggcagaaguauggcuccaucgaugaggugagaguugagcuugcccgcgaacucaaaaugagcagagaggaacgggaggaaacaucuaagcgcauuagaagccgggagaaggagaauaaagaaaucgcugagcgcauuaaggaauacgagcuguaucccaccaaauccagaauccaaaaguaccggcuguggcaggaggccggagaacagugucucuauugcggccgcucuaucgacgugguccaauuucugagaggggacggaguggagauugaacauaucauuccuaaaagcauccuuuacgaugacuccagcgcgaacaagacaugugcuugcucucggugcaauaaggauaaaggcaaccgcaccgccuacgaguauauucuggccgaagggagagaggcugaguaccucgaccggcuggaaacccuguuccacgauggaaaacuuuccuauagcaaaagacgccggcuccaguggaagaaagccgacauccccgucgauuuuaucgagagacagcugcgccugacacaguacauugcucggcaagcccaggaaauccucagacagggcauucgccgggugggggcgucugagggcuccguuacggccaagcugagacaucuuuggggauaugacgauauccugcgcgaacucaauuucgagcgguaccagagcaugggcgagaccgaaauugugucccaagaggaaaaggacgggucuaucacaaaaagcgagagaaucaaggauugguccaaacggaaggaccaccgccaucacgcuauugaugcccuggucguggcuuguaccagacagggauauauccagcggcugaacucucuuaacagcgaagaggacucccugcagaugcaagaggacagcaaacagaugcgcgaaaagaugggcgggcagaagagaccuacagccgauaaacacucuauucucgagaauuggcugauccuccaaccccauuuuucccaccaggaaguuaagagcaaaguggcggagauucuggucucuuuccggccgggaaagagaaccguguccacgggccgcaacacauaccuucggagcgggaaaaaggugacccagucuggcguucugaucccuagaggaccccucagcgaggaaucccuguacggccagauccugcgcaauggggagccuaccuaugucaaaaagguggcccuugaaagccugucugaggcucaaauugaacagaucguggaccccaagcuccggagagagauggucgcccgcacacagccuuccgagggagcuaaacugaaccccaagcuccugcuugccaccccguuuuacagcgaugccgcuggcacacagcgggugagauccguucgcguggcgauugaaaaugggaaaaacucuaucgucccucugagauauaaugagagcggaaaggccauuacguucgugaaccccggcaauaaccaucacguugggaucuaccggaccuccgaaggcaaacucguggagucuugcgucacauuuuggcaagcuguggaccgcguuagauaugggauucccaccaucauccggaagccucgcgaagugcuggaucagcugcuucugagagacgauauuccggaggcccuccuggcccaccuccccgcuagcgacugggaguucgucgaauaccugcaggccaaugagauguuucuuaucggccugacagaugaagagauucagaccgcgcuggcugaauccgaccuccugacgcuuucuaaccaucuguaucgggugcaaaagaugagcuccgaguacuacguguucagauaucaccucgagaccgaagucgccgauaauaaaaacaauacagggaucauuccuaaguuuuaccgccugcggggacccaacgacaccuaucucaaagccaacccuagaaagguuaaagugaaucugcuuggcgagaucagccugcccuga

SEQ ID NO: 4038 - RNA, 3615 nt, Artificial Sequence
  Cas9 variant
auggagagaauccugggcauugacaccgggacaaacagccucggaugggccaucguggauaaggacgaaaaucaguaccaccuggucgcuaaaggcacgaacauuuucuccgaggggguuaagaucgaaaaaggaauugagucuagcaaggccgcggaacggaccgagcaucgcuccgugagaaaacacuauuggcggcgcaagaucagaaagauccggcuucugacaauucucucugauaaugaccugugcccccgccuuaaacaugagcaacugagacaguggcggcucaagaaaguguacccuaccgaugacacauuuauggaauggcagcgcaccgaggauaaggcucaggucaacccguauaaauucagauacaucugucugacacaaaagcuggaccucagcgauauuacccagcgguuuauccugggccgcgcccuuuaucaccugaaucagagacggggguuccucuccaaccgcaaggaagccacgaaagagucugagggaaccgugaaggaaggcauuagcucccugagcaaagacaugaaggauucuggcugcgaguaccuuggggaauauuuuuaccagcuguaccaacagggaaagaagaucagaaaucauuauacagcucggaaagagcacuaccucaaggaguucaaggccauuuguuccaaacaggaacuggacgaugcucugaucgagaagcucgaaaaagccaucuuugaccagagaccccugaaaagccaaaaaggccagguugggaccugcacauucgagaagggaaagucucgcuguccuuccagccacccccuuuaugaagacuuucggauguacucuuucauuaacaauaucaaagugcaggucgauacccuguaugacaagggcgagagaucccucacggaugaagagaaacaacugauuaucccucuuuuuaagcgcaaaagcaagcggacauuccccuuugaggacauugcgaagaaaaucgccgggaagaacaauuacugcuauaucaaauccaacgaagagaaggcuuacaaauucaauuaccagauggauacccaggugucuggaagcccuguuaacgcccagcuggaagagauuuucggcgaagacuggcucuccagcgugugugaggucuauacacuggcuaauaacaagucuagauuucaaaucaugaacgauguguggcaugugcuguucuuuuacgacgaugaggacaagcucaaagaguucgccaaggaucgccugcagcuugacgacgaacuggcggaaaaauuuuccaagauuagcaucccgaaugauuaugccgcucucucucugaaagccauucggaagaucaugcccuaccuuagagacuauggccugaucuacagcgaggcugucuuccucgccaaccugguugaugugcugccucagcacgugugggggauuaaagagaugcgcgaagccgcuaucgagaaugucauugacgugaugcauuccuaugauaagaacaauaucgacggaauuacccucgaaggcugcguuaagaccuuucugaaagagcgguaccaggugucugaugacaaccuuaagaaacuguaccaccccagcaugcucgauccuuaucccagacaacgcccgaaugacgaaggggucuuccagcugggauccccucggaucagcucugugaagaaccccauggcgaugcacucccuguuuagacuucggaaaguugugaaucucaugcugaagaagggcuacauuacaccugauacgaaaguccauaucgaguucagccgcgaccugaacgaugccaauaagagaugggcuauccagaccuggcagcgggagaacgaaaaagagagagaacgcugucggaaggagauugaaaaauauaucgccucucccuccgacacagacauucucaaguaccaacugugggaggagcagaaucacaagugccuuuauaccggggaugaaaucagaauuacagacuuucugggagauaaccccaaauacgacaucgagcauaccaucccucgcagcgccggcggcgauuccacgaagaugaaucucacacuguguucuagcagauucaaccgggacgaaaagaagaccaaacugccggcugagcuugugaaccacgaugaaauucucgagcgcaucuccaauuggaaggagaaguaugaagacauugauaaacagaucagaaagauuucuaccaaaggggccacaagcaaggaggacaaagauuccaagauccggcgcagacauuaccugauccugcagcgggacuacuggcgcggaaaauaucaaagauuuaccaugacagaaguccccgagggcuucagccggcgccaggggacggauauuucugugaucuccagauacgcgcggauguaucucaagagcguuuucaaacagguguacauugucaaaggaaucgcuaccucugacuuuagaaagauguggggcauucaagacgaguaugccaaaaaggaacgcgugaaccacguucaccauugcaucgaugccaucacaauugcuugcaucgggaaagccgaguacgacaagcuggcugauuaucggcaccaguacgacgauuaccuuuuccagggcaagaccaaaccuacauuugacaagcccuggccuuccuucgugauugauaucaaacauauucaggacgaacugcucaucgcccacuaugcgaaggauaaucuggagaaauuuaccaagaagaaccugagaggaaaagacggccgcauuauccgggauaaguucgggaauaaacuucaaaugaagggagacacgagcagaaacucucuccacaaugacaaauuuuacggcgccaucaaccaugaaggggagauuaaguaugucuaccgcaccaauaucgaggcucuggaugccaagagcauuggaaacaucguggaccccacagugcgguccauuaucgaaagcgcuaucgccauucacggcucucugaaagcggccaucaauaaggggauuuggaugaacgaggaaaaacauaucccgauuaagaaaguuagagucuuccgcaaugaugugaagaagccuaucgagcucaaagaccagcgggaucuguccgacaaggauuauaaacagcacuacuaugugaccaacgacggcaauuacaugaugcuuaucuuuagcaagcugaacaacaaaggaagagaaauucggcagcaugucgugaucaauucccucgaggcuacagagguuauuaagucucacaaacgcagccaagugggcaaggucgugugggaauccuacuauucuaaggagggguucgaucugaucuacaaacuuaagagcggaaccaugauucugcucuaugaaaacaauagagacgagguuugggaucuggacauccggaaccugcagaaacgccucuacauuaucacgaagaugaaauaugauggcagaaucuacaugaugcaccaucaggaagcccgggagaagaaggaccuggaggaaaaauccgggucuuuuaagauuaaugaggacuauagaccccuuaucgugaacagcuacaaucaguucaacgcucugguccaagaucucgacuuugaaauuaaugaucugggagagauccgccggcugauuuga

SEQ ID NO: 4039 - RNA, 3630 nt, Artificial Sequence
  Cas9 variant
augaagaaagacuacauccugggccucgauauugggaucagcuccgugggauggggccugcuugagcuggacgauaacaauaaccccuauaagauuaucgacgucgggucuagaauuuucaccccuggagaaguugagaaaacaggcgauagccgggccaaggaacgcagagagaaacgcggggcucggagaaucgcccggcgcagagaauuucggcucgaccgcgugaagaaucugcuuuacgagaacggauaucugaagggcaauaucaacuccaauauugugucugagaaaaacgaagaacucagcaucauuuucaauaacaugaucaauaacuacuauaauggcaagaacacgaauccguacauucugaaagucgaagcgcuggauagaaagcucaccgacgaggagcuguccaucauucuugugcacuaugcuaaaaagcggggguacaagucuaaccgcgaagaggccagcgauaaagaauccggaaagguucugacagccaucaaagagaacgaaaagaucaugaaagacaauaacuacagaaccauuagcgagauguauaucaaggaugacaaauuuaagaauaagauuaaaaacucucccaaugauuacaagaucuccgugacaaacgagauguaucucgaagagauuaauaaaguccuggacagccagaucaaguucggccuuaucaccgacgauuuuaaaaaccaauaccuggaaauuuauaauucucggcgcuccuacgcuaaggggccuggaggcaacagccccuaugggggagaccucaucgagagaaugacaggcaagugcaauuucgauggcaacccucgggcccccaaaagagcuuuuucuuccgaaauuuacguggcccugaccaagcugguuaaucucaaauacaaggugaacgacggggaguauaucaaacugagcgagaaggaaauuaagaauaucaucgagaaagcgaaggagaaaaaguccauuucuuacaaagaucuuacgaagaugaucggaaacaacauugacuucaaggaucugacccucagcaaaaaggaguauaucaaacugauugaagaacuuaagaaaaagcugaauaucaaaaaggacacaaagauuaacaucaaugagcucuccagcgaagauaaagagcuguacaacaagcuguguaaugacaaacuccugucuaagacccuuaucgaacugaaaggcuaucauauucucaaggauuccgucaucaaggccuacagcaaagacauuugggacgaggugaaggauaacauguaucugcuugacgaucuggcucucuacugcacaaauuacaaagugaacgaggacauccugaauaagauuaaagaaucugagaacaucgauaauaucuuuaacgacauucacuucgucgaacugcucccuaauuuuaaggaucaucugaugcuuagcaccgagcugauccgcaagcucauuccgaucauguaugggggaaacacguacgacaaagccaugaauauucugggcuauaaccacuccgauaucaacggggacaaggagaaaaaggaucugcuuguucccaucuguguggacgauaauauuacaaaccagcgggugaucagaucucucacccagacacgcaaagucauuaauagcaucauuaagaaguacggaaugccuaaaaucaucaacauugagaccgcucgggagcuggccaaguccagacaggaacgcaaugagaucgcgaaaaacaauguggaaaagcaagccgagaacgagaaaauuaagaaucagcugguugaacucggccuguucgugagcaccgacaaaaucucuuccacagaccuucugaaguauaagcucuggaaagagcagaacgaauuuugcggcuacagcaugaagaaaauuucuaucgaggaucuguucgggaauaacauuguccagaucgaccauauccugcccuauucccggacguacaaugauaacuaccuuaauaagacccucguguauacaaaagaaaaccaagagaagggaaacagaaccccuuacgaaugguucggcaagacagacaaaugggaugaguaugagaccuacauuaauaaccugacgaucagccagaagaaaaaggacaauuaucugcucaaaaagcuggauuuugacacagaacgcgagaugcggucccagaaccuuaaugauaccaaguacauuucuaaagaacugagcucccucaucaaggcuuaucugaacguugagaaagugaauauguaccccggggccauuaccgcuaagcugagagcccgcuggggauucaaccggcuuacacacucuuaccucagcaaaaauuauauccugccgaagaacaucaaggaggacauuaauaaagauagagacaaccaucugcaccacgccauggaugcucucgucaucgcguccauuaccccuagccugcagcaaaagaucacacuuuacgaaaaauuuucucgguauauugacggccugacggagcuccagaucaagaauaucuccuacauuaaaaucgaagacagcgaggggcaguauuacaacgaugacaccgaugaaguggagacaauugacauccgcgaguauauuaagcaacagcuggccgaaaauaacaucuacuacaauagacauaacauuucuaagcuggaguucccccuuccuuaugaaaacuuugauaaagaggcuaagcuccgggucuacgaacaggaccuggauacccugaaauggaaucucaaguccuauaacacauacacccagaaagacaucgauaaugugcacacgcugauccccagcauugccaagaccaaaguuucuggcaagaugcacgaggagacauauuacggaaucaaggaaauuggcaaagacgaggauaagaaaaucuauaagacccuuagaacacccauugaaaaagugaagcgcaaggaccuggacaacaucccugaucggcucgggggaagcaaagacgucuacgagucccugguggaaugguucggcgauuacgagguuggggaggaagugcugaaggccaauggaaacaaauauccggucagcaagucugacaaagagcauaaggaaaucaagaaacuuaagcuguacuccgaguauaaaaauaccggccacaugauuaacaagagcaauguggagaaagggggcaucuacagaauugauguguuuaaguccaaggacaaagaagaugacaagcucuauuucgcugccuacgauauccuggagauuaaaaagaucaacacgcucaaagaaaagaaucgcguugacgauaacuuuaauaucaaacuggacuauggacaaggcaagaacucuaagauuaugagcuacacagauaucauuaauaacuacgaccuuuauaucucccugaacaaaaaugaccucauuaagaucaccacaaacgaugggaaagagucugucgcguacguggugggauguagcuccggcaugcuggaagucaagucuaaacugggggacggauaugauauuaucaagaccgaccuuaaugagaacaauaucuucagcaagcagagagcucaguaccagauuaccguguccacaaucaaagagauuaagaaacugagcaucucuguucucggcgaaauuuccgggcuguga

SEQ ID NO: 4040 - RNA, 3633 nt, Artificial Sequence
  Cas9 variant
augagaaccauccugggccucgaccuggggacaaacagcauuggaugggccgugaucaauuccgucauuaaggagcagacggaacggaucuggauugagauggcuggcucucgcaucauccccauggaugccgcgauucuuggggacuucgauaaaggaaacagcaucucccaaaccgcugaaagaacacgguuucgcggcguuagacggcugcgcgagagacagcuccugcggcgcgaaagacuucacaaggugcugaaaauucucggguuccugccugagcauuaccugaagggaaucgacuuugagaaacacaccggcaaguuccucucuggcagcgaaccgaagcugcccugggugaaagaucggugggggaaguauuccuuucuuuuccagacagccuuuaaugagaugcuggccgacuucgcuaaacaucagccuucucucgucuuugauggaaagaaaauucccuacgacuggaccguguauuaccugcgcaagaaggcccuuacagaaaugaucagcaaagaggagcuggcuuggauucuccugaacuucaaucaaaagagaggcuauuaccagcugcgcggggaagaggaagaggauaacgccggaaaauccguugaauuuuaugcgcucaaggugcugagcgucgaggccaccgacgagaaaaagggccgggauaucugguacaaugugcaccuugaaaacggguggguuuacagacggucuuccaaugugccucuggacugggagggaagagucaaagaguucaucgugacgaccgaucucaaccccgacggcacaccuaagcuggacaaguauggcgaggugaaacgcagcuuucgggcuccgaaggaagaugacuggaugcuuauuaaaaagagaaccgaggccgauaucacagggacccauaaaacgauuggaucuuacaucuaugacgcucugcuccaggagccccagcaaaagauuaucggcaagcuggucaaaacaguugaacgcaaguucuacaaagaggaacugaauuucauccuccagaagcagugcgccuuucacgcggagcugcaggaucgggaccuuuauaugagauguauugaagcccuguacccugggaacgaggugcaacgccggaauaucgcuaacagagauuucauuuaucuccugaucgacgaugugcuguuuuaccagcgcccccugaaaaccaagaagucccucauugccaauugcccuuacgaggaaaacgaguaugucaaccggaaaacaggagaaaucaagaccgcuccccugaaauguaucgccaagagccacccgcuguuccaggaguuuagacucugguacuuccugucuaauauucgcguguaucaaaaagagcgggaaguuaacggcacccuucaucuggacguggaugucacaacggaguuucucaagaccgaagacgacuacguggcccuguucgauuggcuuaauuccagaaaggagaucgaccagaaagcguuucuucgguauccugcuuucgggcucaagaaagaaauuaacaauuaccgcuggaacuauguugaggauaaguuuuaccccugcaaugagacaagacacgccauccugagccggcuggaaaaagcuggaauuggcaucgacuuccucuccgaugagaaggaaaccgcccuguggcauauucuuuacucugugagcgacaaacaggagaucgaaaaggcccuggcuacauuugccgucaagaacggccucaaugaguccuucguggaggucuucaaaaaguuuccucccuucaaaagcgaauauggggcguacucugcuaaggccaucaaaaagcugcugccccuuaugagauguggaaaguauugggauaugucccucauugacggcaccacgaaagagcgcaucgaacggauuaucgccggggagugcgaugaaagcauuggagcuaaggugagagagaaagccaugaaccugucugacaucagcuguuuuaagcgccugccucucuggcuggcuugcuacguuguguauaauagacacuccgaggauaaagaaaucacaaagugggagaccccggccgacauugaugcguaccuugccgcuuucaagcagcacucucugcggaaccccaucgucgaacaagugauuaccgagacacuccgcguugugagagacaucuggaaacaggucggcaagauugacgagauccggaucgaacuggggcgcgagaugaaaaauccugccgauaagagaaaacggaugaccacacagauucuggaaaacgagaaugcuaaccuucgcaucaaggcccuccuggcggaauuugugaaccccgaguauggcguggagaauguuagaccuuacagccccucccagcaagaaauucugcggaucuacgaggacgccguccucaagggagaagaacagauuccggaagauaucgacgugauccugaaaaaguucaacacgagcaaacuuccuaccaagucugaguuucugcgcuauaaacucuggcuggagcagaaguacagaucccccuauacaggcgaacugauuccucuugcuaaacucuucaccgccgcuuacgagaucgaacaugugauuccccagagccgguauuuugaugacucuuucuccaauaaggucaucugugagagcgccgugaacaagcugaaagauaaucaacugggguacgaauuuauuaagaaccaccauggacagaaaguugaggugggcuucgggaagacagucgagaucuuuuccguggacucuuaugaaagauucguuaaagagcaguacgccaagagcggaauuaagaugaaaaagcuccugauggaugacaucccugaacaguucaucgagcgccaacuuaaugauucccgguacauuucuaaaguggucaagggccugcucagcaacaucgugagagagaaaaaugacuccggggaauaugagcccgaagcuguuagcaagaacauucuggugugcaccggcucugucacggaucgccugaagaaagacuggggaaugaaugacguguggaacuccaucgugagcccgcgguuugagagacuuaaugcgcugaccgaaacacaguguuucggccacugggagaacaaggaugggaaaaaggucuuucagaccgccguuccucucgaguaccaaaaaggauucucuaagaagcgcauugaccaucggcaccacgcuauggaugccaucgugaucgccugcgcuacaagaaaucaugugaacuaucugaacaaugaauccgccagccgcaacgcgaaaauuucucgguacgaccuccagagacugcuuugcgauaagagccggggcgacgggaauggaaacuaucgcuggaucauuaaaaagcccuggaccacguuuacacaggaugcuagagaggcccuguccggcaucauugucagccucaaacagaaucugcggaucaucaacaagaccacaaauauuuaccaacacuucgacgccaacgggacccgcguguaugaaaagcagaaaaucggcgauucuugggcuauuagaaagcccaugcauaaagacaccguuuuuggagccgugaaucugcggaaggcgcuuaucccucagcacuacaaccugacacucuucauuuccagcuga

SEQ ID NO: 4041 - RNA, 3642 nt, Artificial Sequence
  Cas9 variant
auggagaagagacugggcaucgacguggggaccaacagccucggaugggccauugucgaaguugaugacgagggcugcacacugcuugauagagggguggacaucuuccaggaaggaguggcucgcgagaaaaaucaagaaaagcccgccguccaggauagaacggacgcgcgggcucugcgcagacacuacuuucggcgcagacuccggaaaauugcccugcuucgcgugcugguuagacaugaucucuguccugcccuguccgaggagcagcugaacgcuuggcagggcaaggggaucuauccgcucgacgaugccuucauucgguggcaacgcaccgacgauaaugcugacagaaaccccuaccgggaucgcuuuagaugccugacagaagaacuugaccuggccugucgggaagagagauaugugcucggacgcgcgcuguaccaccuuugccagcggagaggcuuccugucuaaucgcaaagacgccggcaacgaggcugaagaggggaaggucaagcaggaaaucaaaacccucagcgccgauauggcugccgcgggaugugaguaucugggcgaauacuuuuaucggcuguaccagagaaaggagaaaauccgcaagcauuacacagcccggaaugagcacuaucucgcugaguucagagccauuugccgcaaacaacggcuggacgaggaacuuagacaggcucuggagaaggccaucuuuuaccagcgcccucucaagucccagaaagggcuggugggaaaguguaccuucgaaaaagauaagucucggugccccguuagccauccuagauuugaggaguuccggaugcuucaauuuauuaacaaugugcgcgucacaggccccggggacgccgaaccuagaccgcugucccccgaggaaguggagaucgugcggccucucuuccugagaaaaucuaagccccacuuugauuucgaagacauugcuaaaaagaucgcgggaaagggcaacuaugccugucgcggcgagcugcuccaggcuccuuaccgguucaauugcgccgggaaaagcaccgucacgggaucccccguuagcgcccuguuugcuucuguguucggcgaugacuggcagagagagauuuguucccuuuauacccugggggccggaaagaacgaagaacaaauccucaaugauguguggcacguccuguuugcguucgaagacgaggagcgccuucaggcuuggcugcaggaaaaacuccagcugagcgccgaugacgccaagacacuggcugccuuuagacucccgcaaggcuacgcuucucugucccuuaacgugaucaauaaaauucugccuuaucuccggcgcggguacagauacgacgaggccguuuucuuugcgaaccugggaaaggugcugcccgccgaagucuaugcugauccugcccggcgcagagagguggaacagggcaucagcgcucagauggacgaucuuggcgacggggagaagacccggaaagaggaacgcauuagagauuaccuccggcgcuauuggggaguugaggaaaagagacuggagcggcuguaccaucccucuaugaucgaagccuaucccuccgcgagcccuaacggccaggggcuccugcaacuuggauccccgcggauucccgccgugcgcaauccuauggcuaugcgggcccuguucagacuccgcguccugcugaacgagcuucuccgggagggcaaaaucgacagagggacaaagaucaauauugaacuggcucgcgagcugaacgaugccaauaaacggaaggccaucgaaagauaccagcgcgagcgggaagcugagaacagaaaguaugcggaggaaauucggcagcaguacguggaggccaccggccacucuaucgaacccagcgaggaggacauucucaaauaccgccugugggucgaacaaggacauugcucccuuuauacgggcaagacaaucgggaucagcgaguuucugggagauggcagacgguacgacauugaacacaccgugccucgcucuagagggggagaggaugcucaguauaauaaaacacucugcgaagaggaguucaaccgggacaucaagagagauaaacugcccuccgaacuggccaaucacaccgccauucuugcuuguguugagagcugcggcugguuugaacgcaucgaggggcucgaacaucggguguggggcgccgacagacgcgcgaagucugcuaccacaaagagcgccaaagacuucgccauucaggaucggcacuacuggagaaugcaucuggacuauuggcgccggaagugugaggcuuuuacgaugaccgaggucccggaaggauucuccaacagacagggcguggauguugggaucauuggacgcuacgccagacuguaucuccaaacaguguucgaccgggucuacaccgugaaaggcgcgacaaccgcugccuuucgcagaaugugggggcugcaggaggaauacgccgcuaaggagcgggugaaucacguucaucacugcaucgaugccaucacgauugcuuguaucggaucucgcgaauaugcccuuugggcgcaguacgucagacaagacgagcuguaucgguggggcgaggccgauaaaccuagaugcgggaagcccuggccuacauucaccgaagacgugcgcgcuaccgccgaugagcuccugauuagccaccauacacccgacaacaugccuaaacagucccggaagagacugcgcgugcggggcaagguccagagaaaugaucggggagaagugaaauacaugcagggcgacaccgcucgcggggcccuucaccaacagacauuuuauggagccaucgagagagauggcgagauucgguacguugugcgcaagagccucgaccagcugcugcccgcugacgucgagaaaaucguggaugaggcgguuagacagaaggugcgggaagccgucgaggcuuauggguucaaagaagccacggacccgaccaagcauacaguguggaugaacgaggagaagcaaaucccuauucgcaaaguuagaauccucaccggagugaagaaucccauucugcuuaaaccccaccgggaugucucugugaaggaauacaaacgcuacuaucacguggucaacgacggcaacuacuguauggccaucuaugaggggagagaucggcagggcagacugaagcgcacauuugaaauuguuaauaagcucgaggcugcccgguacuucaaaagauccgcggaccgcgaaagccggccugaucuggugccgcugucugacgugaacggauauucccuuaaguaccugcucaaaaccggcacgaugguccuguuuuaugagaauagccccgaugagcucuacgaaugcuccgugggggagcuggcuaagagacuuuacaaaguugugggaauggcccaggacggccgcguccaguuccuguuucaucaagaagcccgggaucagaaggcugugaccgccgagugugggaugggaaucucuguuuucgacgcgagacacccugcucccaagcuccgcauccgggugagcaacuuuaaaauguucgucgaaggcuaugacuuugagcugacagugaccggcgagguuaaguucaaaagauga

SEQ ID NO: 4042 - RNA, 3642 nt, Artificial Sequence
  Cas9 variant
auggagaagagacugggcaucgacguggggaccaacagccucggaugggccauugucgaaguugaugacgagggcugcacacugcuugauagagggguggacaucuuccaggaaggaguggcucgcgagaaaaaucaagaaaagcccgccguccaggauagaacggacgcgcgggcucugcgcagacacuacuuucggcgcagacuccggaaaauugcccugcuucgcgugcugguuagacaugaucucuguccugcccuguccgaggagcagcugaacgcuuggcagggcaaggggaucuauccgcucgacgaugccuucauucgguggcaacgcaccgacgauaaugcugacagaaaccccuaccgggaucgcuuuagaugccugacagaagaacuugaccuggccugucgggaagagagauaugugcucggacgcgcgcuguaccaccuuugccagcggagaggcuuccugucuaaucgcaaagacgccggcaacgaggcugaagaggggaaggucaagcaggaaaucaaaacccucagcgccgauauggcugccgcgggaugugaguaucugggcgaauacuuuuaucggcuguaccagagaaaggagaaaauccgcaagcauuacacagcccggaaugagcacuaucucgcugaguucagagccauuugccgcaaacaacggcuggacgaggaacuuagacaggcucuggagaaggccaucuuuuaccagcgcccucucaagucccagaaagggcuggugggaaaguguaccuucgaaaaagauaagucucggugccccguuagccauccuagauuugaggaguuccggaugcuucaauuuauuaacaaugugcgcgucacaggccccggggacgccgaaccuagaccgcugucccccgaggaaguggagaucgugcggccucucuuccugagaaaaucuaagcugcacuuugauuucgaagacauugcuaaaaagaucgcgggaaagggcaacuaugccugucgcggcgagcuccugcaggcucccuaccgguucaauugcgccgggaaaagcaccgucacgggauccccuguuagcgcccuuuuugcuucuguguucggcgaugacuggcagagagagauuuguucccuguauacccucggggccggaaagaacgaagaacaaauccugaaugauguguggcacguccuuuuugcguucgaagacgaggagcgccugcagacauggcuccaggaaaaacugcagcugagcgcugaugacgccaagacccucgccgcuuuuagacugccccaaggcuacgccucucuuucccugaacgugaucaauaaaauucucccguaucugcggcgcggguacagauacgacgaggcuguuuucuuugccaaccugggaaaggugcuuccugcggaagucuaugccgaucccgcucggcgcagagagguggaacagggcaucagcgcccagauggacgaucucggcgacggggagcagacacggaaggaggaacgcauuagagauuaccugcggcgcuauuggggaguugaggagaaaagacuggagcggcucuaccauccuucuaugaucgaggcuuaucccuccgccagccccaacggccaagggcugcuucagcugggauccccucggauuccggcggugcgcaaucccauggccaugcgggcucucuucagacugcgcguccugcuuaacgaacuccugcgggagggcaagaucgacagagggaccaaaaucaauauugaacuggcccgcgagcucaacgaugcuaauaagcggaaagccaucgaaagauaccagcgcgagcgggaagccgagaacagaaaguaugcugaggaaauucggcagcaauacguggaggcgacgggccacucuaucgaaccuagcgaggaggacauucugaaguaccgccuuugggucgaacagggacauugcucccuguauacaggcaaaaccaucgggaucagcgaguuucucggagauggcagacgguacgacauugaacacacagugccccgcucuagagggggagaggaugcccaguauaauaagacccugugcgaagaggaguucaaccgggacaucaaaagagauaagcugccuuccgaacuugcuaaucacaccgccauucucgccuguguugagagcugcggcugguuugaacgcaucgaggggcuggaacaucggguguggggcgcugacagacgcgccaaaucugcgacaaccaagagcgcuaaggacuucgccauucaggaucggcacuacuggagaaugcaucuggacuauuggcgccggaaaugugaggccuuuacgaugacagagguccccgaaggauucuccaacagacaaggcguggauguugggaucauuggacgcuacgcuagacucuaucugcagaccguguucgaccgggucuacacagugaagggcgccaccacggcggcuuuucgcagaaugugggggcuucaggaggaauacgccgccaaagagcgggugaaucacguucaucacugcaucgaugcuaucacaauugccuguaucggaucucgcgaauaugcucugugggcccaauacgucagacaggacgagcucuaucggagaggcgaggcggauaagccgcgcugcgggaaaccuuggcccaccuucaccgaagacgugcgggccacagcugaugagcugcugauuagccaccauaccccugacaacaugcccaagcaguccagaaaacgccuucgggugagaggcaagguccagcggaaugaucgcggagaagugaaguacaugcaaggcgacacagccagaggggcucuccaccagcagacguuuuauggagccaucgagcgggauggcgagauucgcuacguugugagaaaaagccuggaccagcugcucccugccgacgucgaaaagaucguggaugaggcuguucggcaaaaagugcgcgaagcggucgaggccuauggguucaaggaagcuaccgaccccacaaaacauaccguguggaugaacgaggagaagcagaucccgauuagaaagguucggauccugacaggagugaaaaauccuauucuucugaagccccaccgcgaugucucugugaaagaauacaagagauacuaucacguggucaacgacggcaacuacuguauggccaucuaugaggggcgggauagacagggccgccucaaacggaccuuugaaauuguuaauaagcuggaggccgcuagauacuucaagcgcuccgccgaccgggaaagcagacccgaucuggugccucuuucugacgugaacggauauucccugaaauaccuccugaagacgggcaccaugguccucuuuuaugagaauagcccggaugagcuguacgaaugcuccgugggggagcuugcgaaacgccuguacaagguugugggaauggcucaggacggccggguccaauuccucuuucaucaggaagccagagaucagaaagccgugacagcugagugugggaugggaaucucuguuuucgacgcccgccaccccgcgccuaagcugcggaucagagugagcaacuuuaagauguucgucgaaggcuaugacuuugagcugaccgugacaggcgagguuaaauucaagcgcuga

SEQ ID NO: 4043 - RNA, 3651 nt, Artificial Sequence
  Cas9 variant
augaccaagauccugggcauugacacagggacgaacagccucggaugggccaucguggauaaaaccgcugacaauuacaaccugcuugauaagggcgucaauauuuuccaggaggggguuaaaaucgaaaagggaauugaguccucuaaagccgcggaaagaacagagcaccgggcuacccgcgugagauauuaccggaucaagcugcgcaagaucagacuccugcggauucuuagcgacaaccaucugugucccccucucucccaagaagaacugucuacauggcgccugaaaaagguguauccgaaaaaugagcucuuuaugcaguggcagagaaccgaugacgauacagaaaagacccccuacgccuaucggcacaaaugcauccaugagaagcuggaccuuagcgaugucacggaccgcuacauucugggcagagccuucuaucacaucauucagcggcgcggguuucucuccaacagaaaggaacaaggaggcgaggauucuggcaaagugaaggaggggaucagcacccugacacaugaaaugaaugaggcuggauacgaauaccuuggcgacuauuucuacgcccuguauaacaaaggggagaagauucggaaacacuacaccgcucgcaaugaacacuuucucuccgaguucaaggccaucugcgagaaacaggaucuggaaaaggagcugggaagcgaaguugugagaaacaucgagaaggcgauuuuugaccagcggccucucaaaucucagaagggccaagucgggaaauguguguucgaaaagaauaaaacaaagugccccuccagccauccuauguaugaggaguuuagaaugcugaccuucaucaacaauauuaagaucaaaacgcccaacgacgauguucuucgcccucugaauacaggagaacgggagaagauuaugccgcucuuuuucagaaaaucuaagaaacaguuugacuucgaagauaucaccaagaagcuggcccccaaaaagauguacggcuucuauaaaaaggaggaagacgcugagaugccuuuucuuuucaacuaccccauggauacauccgugagcggcuguccugucaccgccgcucugaaagacguguuuggggaugacuggaucaccgccauuugcgagacauacacgcucggagaaggcaagucucgcuucgauaucgugaacgacauuuggcacgcgcuguauuuuuacuccgauaaggacaaacuggccgaguucgcuaucaaucggcuccagcugagcgaagacgaggccaagaucuuuuccgagauuucucuucccgcugauuaugccagccugucccucaaagccaucuguaagauucugccguaccuuagacgcgggcugaucuauagccaugcugucuuccucggaaaccugugcgaaguuaugccuaaauacgaguggucuauuaaggaaaugcgggagaccaucauugacaauaucauuauggaaauggauaaaugugacacaaaggauaagagaaccuuugaggugugcaucaaagacuaucugaagggccaguacaacguguccgauaauagccucaaaaagcuguaccaccccucuaugaucgagacauauccucgcguccaauacaccaacgaacacgggguguaucagcuuggaagcccccggauugacuccguuagaaaucccauggcgaugcgcucuauguuccggcugagaaaacucgugaaccggcugcuggucgagggcaagaucgaucagaauacggaagugcauauugaguuugcccgcgaacuuaacgacgcuaauaagagaaacgccaucgcccucuucguuaaagagaaucaaagcgcuaacgaugaggcccggaagcagauuaucacacuguuuaaaaaggaaaccggcaccgacaucgagccuacagauaaagacauucugaaguacgugcucugggaggagcagaaucacaucugucuguauaccgggaagcagauuagaaucuccgacuucauuggagcgaacccgaaauucgauaucgaacauacaaucccccgcagcgucggcggggacucuacgaagaugaaccuuacccugugcgauucccgguuuaauagagaggugaaaaagacaaaacucccugucgagcugcccaaccacgacgaaauuauggagcgcaucaaggaauggaagaaaaauuacgagcugcuugauauucaaaucagaaagaacaaaaagcucagcaaaggagcuaccacaaaggagcagaaagacaccauuauccggaagcgccaucugcuggaacucagacgggauuauuggcgcggcaaguacgagagauucacgauggaaucugugccugagggguuuucccggcgccagggcaccgacaucagcguuauuuccaaauacgccagacuguaucuuaagucucuguucaaucggguguacacagucaaaggaaucgccaccagcgauuuucgcaagauuuggggcauccaggacauuuauuccaaaaaggaaagaaucaaccacgugcaccauugcauugaugcuaucguuaucgccuguauugggcucgacgaguacaauaagcugggagcuuauuaccacgaugaggaaaacaauaaaugguauggcaugucuaaggccagcuucaaaaagcccugggcgacauuuguggaggacaucaaaaagauucaagacgaaauccuggucuaccauuacaccccggauaacaugccuaagcaggggcggagacgcauuaaaaucgacggaaagaaaauccuuugcaagggcgaugccgcucgggggucccuccacaaugacacguauuacggcgccauugagaacgauggagcugugaaauaugugaagagaaucgaccuggccagccuggaagagaaggauguuaaaaauauugucgacgauacagugcgcucuaucauugaggcggccaucaaggaaaaaggcuucaaggacgcuauggccuccaccaucuggaugaacgaggaaaaacgggugcccauuaagaaggucagauguuuuacaccuagcaucaccaaaccccucaauauucgcaagcagcgggaugugucuaucaaagaguacaagcagcaauaucacguugcuaacgacuccaacuaccugcuugcccuguauauugggaccgacaauaaaggaaaggaaaagagagaguucgagaucgugaacauucuccaggccgcucaguacuaccgcacaagcaaugauaaagaagucguggaccggcauaucguuccuaucaagucugagcacgauuaucccuuugcguacacgcugaaaauuggcaccauggugcugcuuuaugaaaagagcccgaacgaggucugggacgccacaaucaaagagagaaaucggcgccucuacaaggugaccgggcuguccacaaugagaaugaaaggacggaacggcgaauaugcuuacgccaccguuaagcugauucauaaugaggaagcccgcccuagcaaggauaucaaagcuaagaacggggaguaugaacagggcgaggaguucagacccgccauuaucaugcuccacacgcaacugaaugcgcuugugcagggauacgacuuugaaaucaacgagcugggcgaaauucggagacuccgcuga

SEQ ID NO: 4044 - RNA, 3654 nt, Artificial Sequence
  Cas9 variant
auggagaagcagagaauccugggccucgaccccgggaccaacagccugggaugggccgugcuugauuucgacaauuccaaacaagaauacaaccugguccggaagggcgagguuauuuuugaagagggggugggaaaaucugaacgcggcgaguucagcaaggcugccuauagaacauuuuacaaauccacgcggaagcacuauuuccgcagacggcuccgcaagaucgaggugcugaaaguccuugugaaguacgauuuuugcccuuaucugucugacgaucuccugaaacaguggcaugaaaagaaaauuuacccggcgguuaaggaguucauggacuggcagagaaccagcgaugcugaagggaagaaucccuauuacgaccggcacuguugccugaacgagaaacucgaucugucccuuaagucugaccgcuacauccugggcagagcccucuaucaucugacacagcggcgcggauuuaaaagcaauagacuuauucaaaacaaugaugagaacgaagagggcaaggugaaaaaggggaucuccgaacugagcaccgagaugcaggaagccaauuguaacuaccucggagacuauuucuacaaacuguauacagagaagggcaauaccguccagauccggaagcgcuacacagauagagagaaacacuauaagaacgaauuuaaugcuauuugcgagaaacaggaacugaacgagaccaucgugaaggaacucgacaaagccauuuucuuucaacggaagcugaagccucagagacaugggguuggaaaauguacguucgagcccaauaaccgccggugcgcuaucucucacccugacuuugagagauuccgcaugcuuuguuucauuaacaauaucaagauuaaaacccccuuugaagagaaccugcggccucucaauaacgaagagaaggcccugaucgaaccgcuuuucuacagaaaauccaucaagaauuuugauuucgaggagauugcgaagaaacuggccggcaagaacaauuacugcuauaucaaagacgauagcucuaagcaguacaaauuuaacuaucgcaugucccagggggcuagcacaugucaaaccauugccaagcucaagucuaucuucggagaagaguggaaaaauggcauugcugaaacauacaccaaccggagaaagaaagagggccugaagaaacaggccgagaugguggacgauaucuggaauguccuguauuccgugagcgaaugcgacgugcucaaggauuuugcgaucaacaaacugcagcuugacgagaagacggccgauaauuucuccaagacaaaacuggcucaaggguuugccacccucucucugaaggcuauucgcaaaauccuucccuuccuggaacagggauuuggcuacacagaggccgucuuccucgccaacauuccuaccguuguggggaaggaauauuggaauaacgaggacauccggaacgauauuauggaggaaaucaaaaccaucuuuuaccacaauacacugaagacgaacgacagccauaauaccauucuguucuguaucaaggacauucucuccaacaauuucgaucuggcucccggagcgaucgacaaacuuuaccacccuagcaugauuaacguguauaaggaugucauccccaaugaggacggcauucugcagcucgggucuccgaaaaucgaugccgugaagaacccuauggcuaugagaucccugcauaucauucgcaaaguugugaaugaacugcuucgggagggaaucauuaacagcgacacagaagucagaaucgaguacgcccgggagcucaaugaugccaacaagcgccacgcuauugccgacuggcagaagaaacaauauggcaagcaccagaaauacagaaaggaaaucaaagagcuguuuaaggcggaaaccggcuucgagaucgaacccaaugagacagauauucugaaguuugagcucugggaggaacagaaccauaucugccuguauaccgggcaggaaauuggaaucucugaguucgugggcgagaauccuaaauacgacauugaacacacguuuccccggagccuugggggagauuccacaaagaugaacaugacccugugcgagaacaaauucaauagagaaaacaagcagaaaaagcuccccucugagcuggcuaaucauagcgaaauccuggagcgcaucgacgauuggaaaaagaagauuuauauccuucagaaaaaguacgacuccauucggacccacaacggcauggacaaagagaauaaggauaaaaagaucguuagcagacauaagauuaaacucgaacuggacuacuggaaggggaaauauaaccgcuuuacaaugaccgagaucccugaaggcuucucuagacggcagggaaugggcaucgggcugauuucccgcuacgccggacucuaucugaagacaaucuuucacaaaaaggauaauccgcaaaagagcaacguguacauugucaaaggcucuaucacggccgaguucagacggauuuggaauauccaagacgauuaugaaaagaaaugucgcgacaaccacauucaucacugcaucgaugcuaucguggucggguguauuggaaagagagaguacgaccuuauggcccaguuuuaucgggaugaggaaaaauaccgcugggagaagaagaaaaagcccuucuuuaaaaagccuugggaaaccuucacacaggacaugcugucccucaaagaugaggugcugaccguucauuucaaucccagcaacuuuacaaagaaggcucacaaaaagguguucaccccuaaaggcaucuuugucgcccagggggacugcgcgagagugaagcugcacaaaggcuccuacuucggagccauugaacaaaagggcgagaucaaauauguuaugcggaaggagcuuucugcucucaagauugaagauaucaaaaauaucguggacgccgucgugaaggagaaagugcuggcuguugucaagaaaaagggguuuaagcaggccauggcggaacccauuuacaugaacgaggacaaacgcauccugauuaagaaagugagacucuucgugagccaggccaauccgcugaucgucaagaaacaucgggaucuuuccucuaaggaguauaagcaaaacuacuauguggacaacgaaggaaaucugaugauugcuauguacgagggcguuaaaaagaacgggaaaaucgauagagaaaucacgguggucaauaaccucgaggccgcuaaguuuuuccgccagagccagaaaaauaacgccgaaaagcagcugauuucccaccugagcccuaagaauggauauccccuuaaaaccgugcucacacaaaagcagcugguucugauguacgaggacucuccuaaagagaucaagcuccgggauaccaaaaacauggugaagagacuguaccaggucuuuggcauugaaaaagacgggcgcgugaaacuuaaguuccaucaggaggcccgguccgaaggccugaauaucaacagcgcugcguuuaagauucaagauacacccgagucucucuauagacacaccaaguccaaucugaaaguucuggugaacggagucgacuucaagaucaauauucuuggcgaaaucagccugaucuga

SEQ ID NO: 4045 - RNA, 3654 nt, Artificial Sequence
  Cas9 variant
auggagaagcagagaauccugggccucgaccccgggaccaacagccugggaugggccgugcuugauuucgacaauuccaaacaagaauacaaccugguccggaagggcgagguuauuuuugaagagggggugggaaaaucugaacgcggcgaguucagcaaggcugccuauagaacauuuuacaaauccacgcggaagcacuauuuccgcagacggcuccgcaagaucgaggugcugaaaguccuugugaaguacgauuuuugcccuuaucugucugacgaucuccugaaacaguggcaugaaaagaaaauuuacccggcgguuaaggaguucauggacuggcagagaaccagcgaugcugaagggaagaaucccuauuacgaccggcacuguugccugaacgagaaacucgaucugucccuuaagucugaccgcuacgugcugggcagagcccucuaucaucugacacagcggcgcggauuuaaaagcaauagacuuauccaaaacaaugaugagaacgaagagggcaaggucaaaaaggggauuuccgaacugagcaccgagaugcaggaagccaauuguaacuaccucggagacuauuucuacaaacuguauacagagaagggcaauaccgugcagauccggaagcgcuacacagauagagagaaacacuauaagaacgaauuuaaugcuaucugcgagaaacaggaacugaacgagaccauuguuaaggaacucgacaaagccaucuucuuucaacggaagcugaagccucagagacauggggugggaaaauguacguucgagcccaauaaccgccggugcgcuauuucucacccugacuuugagagauuccgcaugcuuuguuucaucaacaauauuaagaucaaaacccccuuugaagagaaccugcggccucucaauaacgaagagaaggcccugauugaaccgcuuuucuacagaaaauccaucaagaauuuugauuucgaggagaucgcgaagaaacuggccggcaagaacaauuacugcuauauuaaagacgauagcucuaagcaguacaaauuuaacuaucgcaugucccagggggcuagcacaugucaaaccaucgccaagcucaagucuauuuucggagaagaguggaaaaauggcaucgcugaaacauacaccaaccggagaaagaaagagggccugaagaaucaggccgagauggucgacgauauuuggaacgugcuguauuccgugagcgaaugcgacguccucaaagauuuugcgaucaauaagcugcagcuugacgagaaaacggccgauaacuucuccaagacaaagcuggcucaaggguuugccacccucucucugaaagcuauccgcaagauucuucccuuccuggaacagggauuuggcuacacagaggccguuuuccucgccaauaucccuaccgugguggggaaagaauauuggaacaacgaggacauucggaaugauaucauggaggaaauuaagaccaucuuuuaccacaacacacugaaaacgaaugacagccauaacaccauccuguucuguauuaaggacauccucuccaauaacuucgaucuggcucccggagcgauugacaaacuuuaccacccuagcaugaucaaugucuauaaagaugugauucccaacgaggacggcauccugcagcucgggucuccgaagauugaugccguuaaaaauccuauggcuaugagaucccugcauaucauccgcaagguggucaacgaacugcuucgggagggaauuaucaauagcgacacagaagugagaauugaguacgcccgggagcucaacgaugccaauaaacgccacgcuaucgccgacuggcagaagaagcaauauggcaaacaccagaaguacagaaaagaaauuaaggagcuguuuaaagcggaaaccggcuucgagaucgaacccaacgagacagauauccugaaguuugagcucugggaagaacagaaucauauuugccuguauaccgggcaggaaaucggaauuucugaguucguuggcgagaacccuaaguacgacaucgaacacacgauuccccggagccuugggggagauuccacaaaaaugaacaugacccugugcgagaauaaguuuaacagagaaaauaaacaaaagaaacuccccucugagcuggcuaaccauagcgaaauccuggagcgcaucgacgauuggaagaaaaagauuuauauccuucagaagaaauacgacuccauucggacccacaauggcauggacaaggagaacaaagauaagaaaaucgugagcagacauaagauuaagcucgaacuggacuacuggaaagggaaguauaaucgcuucacaaugaccgagaucccugaaggcuuuucuagacggcagggaaugggcaucgggcugauuucccgcuacgccggacucuaucugaaaacaaucuuccacaagaaagauaacccgcaaaagagcaaugucuacauugugaagggcucuaucacggccgaguuuagacggauuuggaacauccaggacgauuaugagaaaaagugucgcgacaaucacauucaucacugcaucgaugcuaucgucgugggguguauuggaaaaagagaguacgaccuuauggcccaguucuaucgggaugaggaaaaguaccgcugggagaaaaagaagaaacccuuuuucaagaaaccuugggaaaccuuuacacaggacaugcugucccucaaggaugagguucugaccgugcauuucaaccccagcaauuucacaaagaaggcucacaagaaagucuuuaccccuaagggcaucuucguggcccagggggacugcgcgagaguuaaacugcacaagggcuccuacuuuggagccauugaacaaaaaggcgagaucaaguaugugaugcggaaaaagcucucugcucuuaagauugaggauaucgaacauaucgucgacgccguggugaaagagaagguucuggcugucgugaaaaagaaaggguucaagcaggccauggcggaacccauuuacaugaacgaggacaagcgcauccugauuaaaaaggugagacucuuugucagccagacgaauccgcugaucgugaaaaagcaccgggaucuuuccucuaaagaguauaagcaaaacuacuauguugacaacgaaggaaaucugaugauugccauguacgagggcgugaagaaaaacgggaagaucgauagagaaaucaccgucgugaauaaccucgaggcugccaaauucuuucgccagagccagaagaauaacgcugaaaaacagcugauuucccaucugagcccuaagaauggauauccccuuaagacaguucucacccaaaaacagcuggugcugauguacgaggacucuccuaaggagaucaaacuccgggauacaaagaacauggucaaaagacuguaccagguguucggcauugaaaaggacgggcgcguugagcuuaaauuucaccaggaagcccgguccgagggccugaauaagaacagcgccgcuuucaagauccaagauacccccgaaucucucuauagacauacgaaauccaaucugaaggugcuggucaacggaguggacuuuaaaauuaauauccuuggcgagauuagccugaucuga

SEQ ID NO: 4046 - RNA, 3654 nt, Artificial Sequence
  Cas9 variant
augaaguacaacuaugugcugggccucgacaucgggauuagcuccgucggauggggccugcuugcccuggaugagaauaacaaucccuacaaaaucauugacguugggucuagaaucuucagcccuggagaaguggagaagaccggcgauuccaaagcuaaggaacggcgcgagaaaagagggacacggcgcgugauuagacggcgcgaauuuagacucgaccggguccgcaaccugcuuuaugagaagggauaccugaagggcaauaucacgucuaacaucgugagcguuaaaaaugaggaacucaccauuaucuucaacgauauggugaauaacuauuacaaguccaaagacacaaauccguauaagcugaaagucgaggcccuggauagaaagcucaccaacgacgaacugucuauuauccuugugcacuacgcgaagaaacggggcuacaagagcaaucgcgaggaguccagcgauaacgacaaugggaaaguuaaggaagcuauuaaagagaacacaaaccugauggaagagaagaaauauagaaccaucucugaaauguacauuaagaaugagaaguuuaaaaacaagaucaaaaauggacccgaugacuauaagcucuccgugacaaacgagauguaccuggaagagaucaauaaaguccuugauagccagauuggcuucgggcugaucgacgacaacuuuaagaaugaauaucucgagauuuacaacucucggcgccauuauuccgaaggaccuggcuacuacuaugccaaggaugccaaugggaacaaagugaaggugagaagccccuacggaggcgaccugaucaaaaagaugaccggcgucugcucuuucgauaaaaaggcucgggccccuaaguaugcuuuuuccagcgagcuguucguuuccauuucuaaacucgugaaucugagauacaagaucgacgaugacagcuauaaacaacuuacgaaggagcagaucaacgaacugauugaugaggccaaaaauaagaacaaggugaccuacaaaucccucaucaagauucuggggaucaaaaauauuaaggucaaagaccuuaaccugagcaagucugaauauaucaaagugaucgaugagcucaagaagaaacugaacauuuccaaggaagagaaaaucgacauuuacagccuggaugaggaaaauaagaaaaucuacgacgacauuuauaacgagaagcucuuuucuaagacacugaucgaguucaaaggauacaaucuucugaagaaagcgauuacccucagcuauaacuccggcacauggaaugauguuaaggacaacaucgaauuucuggaugagcuugcccuguacuguaccgacuauaaagugaauaacgaaauccaggagcacauucauaauucucucaucauugauagccgcuucgacgauuccaacuuugucgaaaaucugcccaacuucaaggaccaccugaugcucagcacggauaucauucggaagcugaucccuaucaugcuugaggggauuacauacgacaaagcuauggauaagaucggauauaaucauucuaaccuguacaaagacaccauuaaggaagaucuccuggugccgguuuacguguccaaaaauaucacaaaccagagagucauucgcagccugacccaagcccggaaggugaucaacgcuaucauuaagaaauauggcucucccaagaucauuaauaucgagaccgccagagagcuugcgaaaacacagaaggaacgccggauuaucgagaaaaaccagcaggacaagcaauacgaaaaugagagaaucaaaaagcaccucgucgaacuggagcuguucuccgacgagagcaagauuacggggaacgaucuccugaaauauaaacuuuggcaggaacagaaagaguuuugcggauacuccaugaagaaaaucaagcuggaagaccucuucucuaauaacauugugcagaucgaucacauucugccuuauagccgcaccuacaaugacaacuaucugaauaagacacuuguuuacaccaaauacaaccaagauaagggcaauaaaacacccuaugagugguuuggcaagaccgacaaauggcaggaauacgaggccuucaucaacucccucucuauuagccagaauaagaaggauaacuaucugcugaaaaaucucgaccaagaugcugagcgggaaaugagagagcagaaccugaacgacacgaaguacaucucccgcgaacuucugagccucaucaaagccuaucugaauguggaugaggucaacgcuuuuccuggggccauuacagccaagcugcgggcuagauggggauucaaucggcuuacccauucuuacaucuccaaaaccuauauuaugcccgaggacaugaagaagggcaucaacaaagaucgcgacaaucaccuccaucacgcgauggacgcccuggugauugcuagcaucacaaagucucugcagcagaaaaucacccucuacgaaaaguuuuccagauacguugaugggauuacaaagaacgagcugggaaagaucagcacgggcaauauuaacgacgaucuuuauaauuacuaugacgaagagaccggggaaaucaaggagcuggagcuccggcaauacauuaaaaaccagguggcccagaauaacaucuauuucucuaagcacaaugucagcaaacugaucuuuccgacaccuuacaacaauuucguggaagaggccaagcugagaguguaugaacgcgaucuugagguucucaaauggaaccugaagaaucugggcaccuacacauccagcgaacucaaccggauucauguccugauccccucuguggcuaaaaacaagauuuccggaagacuucacgaggagaccuacuauggccugaaggaaguggggaucggagaggacaaagucacguacaagacccucaaaacaccuauuagcaaggugaaaaagaaggaucuggacaauauccccgauuguaaaggcggguccaaggacauuuauaacgcccugguuaaaugguuuggaaauugcgaaaccggcgaggaagcgcuuaagaugcaugaugggaaauaccccgugaacccuaaugacaaggagcagaaggagauccgcaaaaucaaggucuauacaaaauacaacgcuaccggccacgugguuaauaacggaaauguggaaaagggcgggauuuauagaaucgacgucuucaaaucuaagaacaaggaggauaauaaacuguacuuuacgagcuacgacauuuucgaaaucgagcaaauuaaggccuaugagaaaggaaagaacaucaauuucuccaucaaacucgaauacggccaggggaagaacaauaaaauucugcucuauaaggaugugaagaacgaguacgaccugaucaugucuauuuauaaaaacgaucuuauccggauuaagacaaaaaccggaaauaagagcacagccuacguugugggcuuuuccgggggcaaacuggaaaucaagucuaccaucggagacggcuaugauauuaucgggaacaauaacauuuucgacaagagcauggagcgcuacagagucaccuccagcacaaucgugaaaauugauaagcucucuaucuccauucugggagaagugagcggccuguga

SEQ ID NO: 4047 - RNA, 3657 nt, Artificial Sequence
  Cas9 variant
augaacaagagaauccugggccucgacaccgggacaaauagccugggaugggccguggucgauugggacgagcacgcucaguccuacgaacuuauuaaauauggcgauguuaucuuccaagagggggugaagauugaaaaaggaaucgagucuagcaaggccgcggaacgguccggcuacaaagcuauucgcaagcaguauuuuagacggcgccugagaaagauccaggugcucaaaguccuggugaaguaccaucuuugccccuaucugucugacgaugaccuccggcaguggcaucugcaaaaacaguacccuaagagcgaugagcugaugcucuggcagcgcacguccgacgaggaagggaaaaacccguauuacgauagacaccggugucugcacgagaagcuggaccugaccguugaagccgaucgcuacacacucgggagagcccuguaucaucuuacccagcggcgcggcuuccugucuaauagacucgacacaagcgcugauaacaaggaggacggcguggucaaauccgggaucagccaacugucuaccgagauggaagaggccggaugcgaauaccugggcgacuauuuuuacaagcucuaucacgagcaggggaauaaagugcggauucgccagagauacacagaucggaagaaacacuaucagcaugaguucgacgcuaucugugaaaagcaagagcuguccagcgaacuuauugaggaucugcagagagccaucuuuuuccagcucccccugaaaucucaacgccacggaguuggccggugcaccuuugaaagagggaagccucgcugugcggacucccaucccgauuacgaggaguuccggaugcuuugcuuugugaacaauauucaggucaagggaccucacgaccuggaacucagaccccugacguacgaggaacgcgagaaaaucgaacaccuguucuuuagaaagagcaaaccuaacuucgauuuugaggacauugccaaggaacucgcuggcaaaaagaauuaugccuggauccaugauaaggaggagcgggcuuacaaauucaacuaucgcaugacccagggcgugccggggugucccacaaccgcccagcugaagucuaucuucggagacgauuggaaaacaggcauugcggaaaccuacacgcuuauccaaaagaaaaauggguccaagagccugcaggagaugguggacgacgucuggaacguucucuauuccuuuucuagcguggaaaagcugaaagaguucgcccaccauaaacuucagcuggaugaggaaaaugcugagaaauuugccaagauuaaacucucccacagcuucgcugcccugucucugaaggccauccggaaguuucucccuuuccugagaaaaggaauguacuauacacaugcuuccuuuuucgcgaacauucccaccaucgugggcaaggaaaucuggaauaacgagcagagccgcaaauacauuauggaaaacgucggggagcuuguguuuaauuaccaaccuaagcaccgggacguucagggaacaaucgagaugcugauuaaagauuuccucgccaacaauuuugaacugcccgcuggcgccaccgacaagcuguaucacccgucuaugaucgagaccuacccucaugcccuuagaaacgaguucggcauucuccagcuggggagcccccggacaaaugcuauccgcaacccuauggccaugagaucccugcacgugcuccggagagucgugaaucagcugcuuaaagaaucuaucauugaugaaaacacggagguucauguggaguaugcgcgcgaacugaaugacgcuaacaagcggagagccaucgccgaucgccaaaaggagcaggacaaacagcacaagaaauacggagaugaaauuagaaagcucuauaaagaggaaaccggcaaggacaucgagcccacacagaccgauguccugaaguuucaacugugggaggaacagaaucacuacugccuuuauacaggggagcagauuggaaucaccgacuucauuggcagcaaccccaaauucgauaucgaacauacgaucccucaauccgugggaggcgacagcacacagaugaaucucacccugugugacaaccgguuuaaucgcgaggucaagaaagcuaagcugccgaccgagcucgccaaccacgaagagauucugacaagaaucgaacccuggaaaaacaaguacgagcagcuugugaaggaacgggauaaacagcgcaccuucgcuggaauggacaaggccguuaaagauauuagaauccaaaagcggcauaaacugcagauggagauugacuacuggcgcggcaaguaugagagauuuacaaugacggaagugccugagggguucucucggcgccagggaaccggcaucgggcucaucuccagauacgcgggacuguaucuuaagagccuuuuucaccaggccgauucucggaauaaauccaacgucuacgugguuaagggcguggcuacagccgaguucagaaaaaugugggggcuccaaagcgaauaugaaaagaaaugccgcgacaaucauucccaccacuguauggaugcuauuaccaucgccugcauuggcaagcgggaguacgaccugauggcggaguauuaccauauggaagagacauuuagacagggacgcggcucuaaacccaaguucagcaagccuugggccaccuuuacggaagauguccugaacaucuacaaaaaucuccugguggugcacgacacccccaacaauaugccgaagcauacaaagaaguauguucagaccuccaaagggaagguccuugcucagggagauacagcccggggcucucugcaccucgacaccuacuauggggcuauugagagagauggagaaauccgcuacguggugcggagaccucugagcuccuucacgaaccccaaggagcuggagaauaucgucgacgaaacagugaaacgcaccauuaaggaggccaucgccgacaaaaacuuuaagcaagcuauugcggaaccuaucuauaugaaugaggauaaaggcauucuuaucaagaagguucggugcuucgccaacagcgugaaacagcccaucaauauuagacagcaucgggaccucucuaagaaagaguacaagcaacaguaucacgucaugaacgaaaauaacuaccugcuggcuaucuacgaggggcucgugaaaaacaagguugugcgcgaauuugagauugucuccuauaucgaagccgccaaguacuauaaaagaagccaggaucggaauauuuucucuuccaucgugccuacacacagcaccaaguacggccugccccuuaaaaccaagcugcucaugggacagcaaguucugauguucgaggagaacccggacgaaauucagguggauaauacaaaagaccuggucaagcgccuuuauaagguggugggcaucgagaaagaugggagaaucaaguuuaaacaucaccaggaagcucggaaggagggacugacgauuuacucuaccccuuauaaaaacaaugacgauuacguccccaucuucagacagagcauuaagaacaucaauauucucguugacggcaucgauuuuaacaucgacauucuggggaaagugacacucaaggaauga

SEQ ID NO: 4048 - RNA, 3657 nt, Artificial Sequence
  Cas9 variant
augaacaagagaauccugggccucgacaccgggacaaauagccugggaugggccguggucgauugggacgagcacgcucaguccuacgaacuuauuaaauauggcgauguuaucuuccaagagggggugaagauugaaaaaggaaucgagucuagcaaggccgcggaacgguccggcuacaaagcuauucgcaagcaguauuuuagacggcgccugagaaagauccaggugcucaaaguccuggugaaguaccaucuuugccccuaucugucugacgaugaccuccggcaguggcaccuucaaaaacaguacccuaagagcgaugagcugaugcucuggcagcgcacguccgacgaggaagggaaaaacccguauuacgauagacaucggugucugcacgagaagcuggaccugaccguugaagccgaucgcuacacacucggcagagcccuguaucaucuuacccagcggcgcggauuccugucuaauagacucgacacaagcgcugauaacaaggaggacggcguggucaaauccgggaucagccaacugucuaccgagauggaagaggccggaugcgaauaccugggcgacuauuuuuacaagcucuaugaugcucaggggaauaaagugcggauucgccagagauacacagaccggaacaagcacuaucagcacgaguucgaugccaucugugaaaaacaagagcuguccagcgagcuuauugaagaccugcagagagcgaucuuuuuccagcucccccugaagucucaacgccauggaguuggccggugcaccuuugagagagggaaaccucgcugugccgauucccaccccgacuacgaagaguuccggaugcuuugcuuugugaauaacauucaggucaagggaccucaugaucuggaacucagaccccugacguacgaggagcgcgaaaagaucgagccucuguucuuucggaaaagcaagccgaauuucgacuuugaagauauugcuaaagcccucgcuggcaagaaaaacuaugccuggauccacgacaaggaggaaagagcguacaaguucaauuaucgcaugacccagggcgugcccggguguccuacaaucgcccagcugaaaucuauuuucggagaugacuggaagaccggcaucgcugagacauacacccuuauucaaaagaagaacggguccaaaagccugcaggagaugguggacgaugucuggaauguucucuauuccuuuucuagcguggaaaagcugaaggaguucgcccaccauaaacuucagcuggacgaagaguccgcugagaaguuugccaaaaucaagcucagccacucuuucgccgcucugucccugaaagcgauucggaaguuucuccccuuccugagaaagggaauguacuauacgcaugccagcuuuuucgcuaacaucccuacaaucgugggcaaagaaauuuggaauaaggagcagaaccgcaaauacaucauggaaaacgucggggagcuuguguuuaauuaccaacccaagcaccgggaaguucagggaaccauugagaugcugaucaaagauuuccucgccaacaauuuugagcugccggccggcgcuacagacaagcuguaucauccuucuaugauugaaaccuaccccaacgcccagagaaaugaguucggcauccuucagcucgggagcccucggaccaacgcgauccgcaaucccauggcuaugagaucccugcacauucugcggagaguggucaaccaacuccugaaagaaucuaucauugaugagaauacagaagugcacguugaguaugcccgcgagcuuaacgacgccaauaagcggagagcuaucgccgaucgccagaaggaacaggacaaacagcauaagaaauacggagaugagauuagaaagcuguauaaagaagagacgggcaaggacaucgaacccacccaaacagaugugcucaaguuucagcugugggaggagcagaaccaccauugccuguacaccggggaacaaauuggaaucacagacuucaucggcagcaauccuaaauucgauauugagcacaccaucccgcaguccgucgggggcgacagcacgcagaugaaccuuacacucugugacaaucgguuuaaccgcgaagugaagaaagcuaagcugcccaccgagcuggccaaccacgaggaaauucucaccagaaucgagccuuggaaaaauaaguaugaacagcuggucaaggagcgggauaaacaacgcacauucgcgggaauggacaaggccgugaaagauauuagaauccagaagcggcauaaacuucagauggaaaucgacuacuggcgcggcaaguacgagagauuuaccaugacagagguucccgaaggguucucucggcgccagggaacgggcauugggcugaucuccagauaugcuggacucuaccugaaaagccuguuucaccaagccgauucucggaacaaauccaauguguaugucgugaagggcguugcuaccgccgaguucagaaaaaugugggggcuucagagcgaauacgagaagaaaugccgcgacaaccauucccaccauuguauggaugcgauuacaaucgccugcauuggcaagcgggaauaugaccucauggcugaguacuauagaauggaggaaaccuuuaaacagggacgcggcucuaagccuaaguucagcaaacccugggccacauuuaccgaggaugugcugaauaucuacaagaaccugcucgucgugcacgacacgccgaauaacaugccuaaacacaccaagaaauacgugcagacauccaucgggaagguucuggcucaaggagauaccgcccggggcucucuucaucuggacacauauuacggggccauugaaagagauggagagauccgcuaugucgugcggagaccccucagcuccuucaccaagccugaggaacuggagaauauuguggacgaaacggucaaacgcacaaucaaggaggcuauugcggacaaaaacuuuaagcaggccaucgcugaacccaucuacaugaaugaggagaaaggcauucugaucaagaaggugcggugcuucgccaaaagcguuaagcagccuauuaacaucagacaacaccgggaucuuucuaaaaaggaauauaaacagcaguaccaugugaugaaugagaacaauuaucuccuggccauuuacgaagggcuggucaagaacaaggugguucgcgaguuugaaaucguguccuacauugaggcugccaaauauuacaagagaagccaggaccggaacaucuucucuuccaucguccccacccacagcacaaaauauggccucccgcugaagaccaaacuucugaugggacaacucgugcugauguucgaggaaaauccugaugagauucagguugacaacaccaaggaucuggugaagcgccuuuacaaagucgugggcaucgaaaaggacgggagaauuaaauuuaaguaucaucaggaggcgcggaaagaaggacugcccaucuucucuacacccuacaagaauaacgaugacuaugcuccuauuuuuagacagagcaucaauaacaucaauauucucguggauggcaucgacuucacgauugauauccuggggaaagucacccucaaggaguga

SEQ ID NO: 4049 - RNA, 3657 nt, Artificial Sequence
  Cas9 variant
augaacaagagaauccugggccucgacaccgggacaaauagccugggaugggccguggucgauugggacgagcacgcucaguccuacgaguucauuaaauauggcgauguuaucuuucaagagggggugaagauugaaaaaggaaucgagucuagcaaggccgcggaacgguccggcuacaaagcuauucgcaagcaguauuucagacggcgccuuagaaagauccaggugcugaaaguccucgugaaguaccaucugugccccuaucuuucugacgaugaccugcggcaguggcaccuccaaaaacaguacccuaagagcgaugagcugaugcuguggcagcgcacguccgacaaaaaggggaagaacccguauuacgauagacaucggugucuccacgagaaacuggaccuuaccguugaagccgaucgcuacacacugggcagagcccucuaucaucugacccagcggcgcggauuucuuucuaauagacuggacacaagcgcugauaacaaggaggacggcguggucaaauccgggaucagccaacucucuaccgaaauggaggaggccggaugcgaauaccugggcgacuauuucuacaagcuguaugaugagcaggggaauaaagugcggauucgccagagauacacagaccggaacaagcacuaucagcacgaauuugaugcuaucugugagaaacaagaacucuccagcgagcugauugaggaccuucagagagccaucuucuuucagcugccccucaagucucaacgccauggaguuggccggugcaccuucgaaagagggaagccucgcugugcggauucccaccccgacuacgaggaauuucggaugcugugcuucgugaauaacauucaggucaaaggaccucaugaucuugagcugagaccccucacguacgaagaacgcgagaagaucgaaccucuguuuuuccggaaaagcaagccgaauuuugacuucgaggauauugccaaagcucuggccggcaagaagaacuaugcuuggauccacgacaaagaagagagagccuacaaguucaauuaucgcaugacccagggcgugcccggguguccuacaaccgcgcagcucaaaucuaucuuuggagaugacuggaagacaggcauugccgaaaccuacacgcugauccagaaaaagaacggguccaagagccuucaagagauggaggacgauguguggaauguccuguauuccuucucuagcguugaaaaacucaaggaguuugcucaccauaaacugcagcuugacgaagaguccgccgagaaguucgcuaaaauuaagcugagccacucuuuugccgcccucucccugaaggcuauccggaaauuccugcccuuucucagaaagggaauguacuauacacaugcgagcuucuuugccaacauuccuaccaucgugggcaaagaaaucuggaauaacgagcagaaccgcaaguacauuauggaaaaugugggggagcuggucuucaacuaccaacccaaacaccgggaagugcagggaacaaucgagaugcuuauuaaggauuuucuggcuaauaacuucgagcucccggccggcgccaccgacaaacuguaucauccuucuaugaucgaaaccuacccccacgcucagagaaaugaguuuggcauucugcagcuugggagcccucggacaaacgccauccgcaaucccauggcgaugagaucccuccacauccugcggagaguugugaaccaacugcucaaggaaucuauuaucgaugagaauacggaaguccauguggaguaugcucgcgagcugaacgacgccaauaagcggagagccauugcuggauggcagaaagaacaggauaagcagcacaaaaaguacguugacgagauccgcaaacuuuauaaggaagagaccggcaaggauauugaacccacacaaaccgacgugcugaaauuccagcucugggaggagcaggaucaucacugccuguacacaggggaacaaaucggaauuaccgacuucaucggcagcaacccuaaguuugauaucgagcacacgauuccgcaguccgucgggggcgacagcacacagaugaaucugacccuuugugacaacagauucaaucgggaaaucaaaaaggccaaacuccccgcucagcugucuaaccaugaggagauucuggcccgcaucgaaccuuggaagaacaaguaugagcagaaaauuaaggaaagagauaaacaacggaccuuugcgggaauggacaaggccgugaaagaucuccgcauccagaagagacacaagcugcagauggacaucgauuacuggcggggcaaauacgagcgcuucacaaugaccgaaguccccgagggguuuuccagacggcaaggaacaggcauugggcuuaucagccgcuaugcuggacuguaccucaagucucuguuccaucaggccgacuccagaaauaaaagcaacguguauguugugaagggcgucgcuacggccgaguuucggaaaaugugggggcugcaguccgaauacgagaagaaaugcagagauaaucacucucaucacuguauggacgcgauuaccaucgccugcauuggcaagcgcgaauaugaucuuauggcugaguacuaucggauggaagagacauucagacagggacgcggcagcaagccuaaauuuuccaagcccugggccaccuucacagaggacgugcucaacaucuacaaaaaucugcugguugugcacgauaccccgaacaauaugccuaagcauacgaaaaaguacguccaaaccucuaaggggaaagugcucgcucagggagacacagcccggggcagccugcaccuugauaccuauuacggggccaucgaaagagacggagagauucgcuaugugguucggagaccccuguccagcuuuacaaagccuaaagaacucgagaacaucgucgacgaaaccgugaagcgcacgauuaaagaggcuaucgcggauaagaauuucaagcaggccauugcugagcccaucuacaugaacgaagacaaaggcauccugauuaagaaagugcggugcuuugccaagucugucaaacaaccuaucaauauuagacagcaucgggaucuguccaagaaggaguauaaacagcaguaccacgugguuaacgaaaauaacuauaugcuugugaucuacgaggggcucgucaagaauaaagugguucgcgaguucgaaauugugagcuacaucgaggccgcuaaguauuacaaaagaucucaagaccggaacauuuucuccagcaucguccccacacauucugccaaguauggccugccgcugaagaccaaacuccugaugggacagcuugugcugauguuugaagagaacccugaugaaauccagguugacaauacaaaggaucucgugaaacgccuguacaaggucgugggcauuaaaaaggacgggagagugaaauucaaguuucaccaggaggcgcggaaggauggacugcuuaucuucagcacccccuauaaaaacaauaacggcuacguccccauuuuuagacacuccaagaaaaauaucaacauucugguugacgggaaggauuucaccaucgacauccucggaaaagugacacugaaggaguga

SEQ ID NO: 4050 - RNA, 3660 nt, Artificial Sequence
  Cas9 variant
augaaggaggaagugagaggcaaaaaccggagccagaccugggccauccuggcuaaguucuuugucugguccgagaaagaaucuguuuggaaugagaaggaagcccgcacagaggagagagugaaagaauacaagcucguggggcugaagcgggacacgaaaggaaacgagcuuaagcuggaaaauuaucgcuggagaguccaagcgcucagcgagcagcugaaccccgagauuguggcuaucguucuucaggaaauuaauggccagaucuccgccucuagcggguaccugggagccauuuccgaucggucuaaacaacucuauuucaaccgccagaccgugggccaguaccugaugagcgagcuggaaaaggacccuaaugucucccucagaaaccggguguuuuaucgccaggauuaccuggacgaguucgauagaaucugggaaaaacaagcugaguuucacgaggaacuuacaguugagcugaagaaggaaauccgggacauuaucauuuucuaucagcgcagacucaaaagccagaaggggcugaucucuuuuugcgaguucgaaaaacgggagguggucguggaggaagauggacgcaagaaaaauaagaccgugggcuguagagucauuccgcggucccauccccuuuuucaggaguucaaaaucuggcaaacacugaacgacauugaaguuuuugccugggauaagcagagcaagagaaagaaggcugacaaaucuuccauccucuucgauaauagcgaggacgcccugcugguggaaggcaagcgcuuucucuaccaggaggagaaagaacugcuugcgaaggagcuguucgugaaggaaucuaugaaaaaggccgagguccucaaacugcuuuucgagaacuaccaagaacuggaucucaauuuuaagcagaucgacgggaaccacaccggauucgcucuguuuuccgccuauagcaaaaugauugagaaguacggcuaugaaccuguggacuucaagcgguccgcugaugagaucauugaaaaacuggagacaaucuuuaccaaucucggguggaacacggagcugcuuucuauugaccugagcaaggaagauaaagagcucgaaagacaguccuacuuccgccuguggcaucuucuguauagcuuugagggagacaacacccccacaggcaaugggaagcuccuggagaaaaucaugcagcugugcgauguugagaaggaguacgccguggaacucgcgaacgucucuuuccaagaggacuauggaucccugagcgccaaggcuaucaaaaagauucuuccuuaccugaaagaaggcaaucaguacgauguggccugugacuaugcuggcuaccggcacucuagaagcucccucaccaaggaugagaucgaaaacaaaauucugaaggacaaacuggagauccuucccaaaaauucucuccgcaacccuguuguggagaagauucugaaucagauggucaaccugaucaauacacucaucgauaccuaugggaaaccggacgaaauucggguggagcuggccagagaacuuaagaaaaacgccaaggagcgcgaggaacugacgaaaagcaucgcucggaauacaagagagcaugacgaaauucgccagcuccugcggaccgaguuuggaaugaugaacgucuccagaaaugauaucauucgguacaagcuguaugaagaacuuaaggacaacggcuacaaaacacucuauagcaaugaguacaucccccgcgaaaagauuuucucuaaagagaucgauaucgaacacgugauuccucaagcgagacuguuugacgauucccugagcaacaagacccucgaguaccgggccaucaacauugaaaaagggaauaagaccgcuuaugacuucguuaaggagaaauacggaaacgauggccuggagaaguuucuuaauagaugcgaaacacuguucaaagacaagcgcacgaaacuccggaagcugaagauggaggaaaaagauauccccgagggguucauugacagagaucugcgcaacacccaguauaucucuaagaaagccuuugccaugcuuaaugaaaucuccagacggguggucgcuacaaccggaagcauuacagacaagcuccgcgaggauuggcagcugguggaccugaugaaagagcucaaccugccuaaguacgaaaaacuuggcaugguugagauguucgaagacaaggauggcagaaagaucaaaaagauuaccgacuggacgaaacggaaugaucaccgccaucacgccguggacgcgcugacagucgcuuuuaccaaggauguguucauccaguuuuauaacaauaaaaacgccgccuggaugcccgcuuccaaggagcaugccaauauuaccgggaucaaggcuagauacuucgagaacggaaaagcccucgcgccgaugccucuggcccaauuucgggcugaagccaagcgccaccuggagaaucuucucgugucuaucaaagcuaagaacaaaguuauuacaagcaaugucaacagaaccaagaacaagaauggcgaaaaccggaaacugcagcagacaccccgcgggcagcugcaccucgagacgguguauggaucccauagacaauacgccaccaagaucgaaaaagugaaugcggccuucgacgucacaaagauugcuaccgugucuaaacuggccuaccggaacgcccuucugaagagacucgaggcuuuuggcaaugauccuaagaaagccuucacagggaagaacacccuggagaaaaauccccuguaucuugacgaaaaccagacggagaugguucccgaaaaggugcagaccgucgaguuugaaacaguguacaccauccgcaaaccuauugauccgaaucugagcaucgacaagguuguggaugucaagauccgguccgugcucgagaaaagacugaaggaguauggcggagacgcuaaaaaggcguucguuaaccucgaugaaaaucccauuuggcugaacgaggccaaaggcaucagcauuaagcgcgugucuauccgggggauuuccaaugcucaaagccuucacgagaaaaaggacaaggacggaaaccugauccucggcaaagaagggagaaagauuccugucgauuuugugaauacaggaaacaaccaucacguggccaucuacaaaaagcccguccuggacaaaguuggccagguggugcuggaugaagaggggaauccuaaguaugagcuugacgaagucgugguuucuuucuucgaugccgugacccgcgcuaaccugggccagcccaucauugacaaggauuaccggagauccgagggauggcaguuucucuucagcaugaaacaaaaugaauauuuugucuucccgaacgacaagacgggcuuuaauccuaaagagguggaucugcucaaccccgagaauuacgcccugaucucuccuaaccuuuuccgcguucagaaguuugcguacaaaaauuauguguuccggcaucaccuggaaacaaccauuaaggacacaagcuccacccucaaggggaucaccuggacagauuuuagaagcucuaaaggacuggacaagauugucaaagugcggguugaccacaucggccagaucguguccauuggggaguacuga

SEQ ID NO: 4051 - RNA, 3663 nt, Artificial Sequence
  Cas9 variant
augaagagaauccugggccucgaccuggggagcgccuccauuggaugggcucuuaucgaggaagaugagaaaggcauucggaucauugcccuggggucucgcaucauccccuacaacggaaccgaaggccaggacuucgcgaagggggcuggagagagcagaaauucccuccggacacaagcccgcacgaccagaaaaggcuaugaucgguaccagcugcgcagaaaguaucuuauuaacgugcuggagaaaaaucucaugaugccuucugaagaccugcggaagaugccgaagaugaaccuguggcagcuccgcagcaaagccgucacagaguacaucuccagacaggaacugggccggcuucugcucuggcugaaucaaaagcgcggguauaaaucuagcagauccgaugcuaaccuugacaagaaagauaccgacuacguuaaggaggucaagagccgguuugauaaaauuaaggagaaaaaucagacaaucggacaguauuucuacgaaucucugcagugcgacgaguacuuucgcgugaaggaaaacguguuccccagagaggccuauauugcugaauuugaugccaucuguucccggcaaaaagaccaccucggccugagcgaggaacugauugcggagaucagaaaugagaucauuuacuaucagcgcccucucaagucucagaaagggcugguguccguuuacgauuucgaaggaaaguggaugaaccagaauggcaaggagcuuuuuaucgggcccaaaguggcccauaagagcucuccucuguuccaacucgcuaaaauuugggaauccgucaacaauaucaagcugagcaccaaauauggagacacaauugagcuuacccuggaagagaagaagcagcucguggaguuucuggacaacaaugaaaaacugacgaccgccgcucucuucaagauccugcggaaagauaagaaagaguacauccuucccaagcagcuggaaaagggccuccaaggcaacauuacaaaaugcaagaucgccgacauucugggguccaaauauaaccagcuucugcagcucaaucuggagaagcaggaaguuggaaccccuuguuaccuguacacaaaaucuaccggcgaggugcucggggagaagccgcugcaauauaucgauaagagcgucgaaaaagagcuguuuuaccagcuuuggcacacgauuuauuccaucagcgacgaagaugagugcuguaaggcgcuccagaaaagauucgacaucgaugccgagacagcuggacgccuggccaagauugacuuuucuaaauacggcuucgggaacaaguccgcuaaagccauccggaagauucugcccuaucuuauggaaggagauaaguacagcgacgccaugugcuaugcuggcuacaaucauucuaacagccucaccaaagaggaaaaucacgagagaaagcugaacgauaaacugaagcuccugaccaaaaauucccuucgccagccuaucguggaaaagauuaugaaccaaaugauccagcuggugaauacaauuaucgacaaguacggcaaacccgacgagauccggcucgagcuggcgagagaacugaagcagucuaaagaggaacgcaacgaugccgacaaggcuaugagcaaacggcagagagagaauaaggaagccgagaagaaacuugaggaacaugggauucgcgccacccacaacaauauccucaaguaucggcuguucgaggaaaugggagagaaaaagcacgaagcuauuuguaucuacugcggcaacccuauuuccuuuagcgccgcgaugaauggggaugaggucgacguugagcauaucauccccagaucuaaacuguucgaugacucccaaagcaacaagacacucgcucaccggaaguguaacgccaauaaaaacgauaugacggccuaugacuuuaugaagaccaaaucuaagcaggauuucgacaaauacguggaacgcgugaaucagcuguaugcugauagaauuaucucccggagcaaguacaacaaacuucugauguccgaggacgauauuccgucuaauuuuaucgacagacagcuccgcgaaagccaauauauugccacaaaggcucgggagauccugcagaccaucugcuacaacgucugguccacaucuggaaccgugacggccgagcugagacaucuuuggggcugggacgauauuacaaugaaucuccagaugccuaaguacaaagaacuggggcugaccgagaugguugaauggaccagcgaccacggcaagaacgugcacuccaaagaggucaucaagggauggacaaaacgcgaugaccauagacaccaugcgauugaugcccucaccaucgcuuguacaaagcaaggcuucauucagcgguuuaauacgcugucuagcuccaagacccgcgacgauaugcagaaagaacuugagaagugcagcauccaguucagagagaaacggucucugcucgaaaaguauaucauuucccaacgccccaucagcgugucugacguugccgaggcugugagccggauucugaucuccuuuaaagccgggaagaaggucgcgacaauuggaaaaagaaaggugaaaggcaaggucgugcagcaggggaucguugugccucgcggagcccugagcgaaggcucugucuacgggaaaauuagaaccaucgugcggaagaugcccguuaaguaucuuuucgagaaccccgaucucaucuuuaaaccuuacauuaaggcucuggugaaagaacgccuggccgaguucgacaaugauaacaagcaggcucucgccucccugaaaaagaauccggucuaucuugacaaggagaaaacaaagcugcucgaauacggaaccugcuuuaaagaugaguaugugaagaaauacgacgugaaccccaauuucacgaagaucgccgacguuauugauggcaaagucaagcaaauccuggaagacagacugagcaaguucggcgggaaaccuaaggaggcuuuuaaagauguggugaaggacggaaaaacccuuaagugguacgaagaugagggccuggagcggcccauuagauccguccgcugucucacagggcugucugcggugguuccugugaagaaagacgaaaacggaauggauaucggcuucgucaagcccgggaacaaucaccauguggccaucuauguuggcgcugacggaaaaggccaggagcacgugugcaccuuuuggaacgccgucgaacggaagaaauacgggcucccgauuaucauuaaggaugccaaugaggugugggacaagaucacaauggcuggagaugacguuuauccucagagcuuccugucccuucugcccaaaccugacuggacccucaagcugucuaugcagcaaaacgagauguuuauucugggcauggaagaggaugaagugaaauucgccaucgagagcaaggacuacaaacuucuguccgaucaccucuauagaguccagaagcugucuagcuccgacuacaauuuuauccaucaccucgaaacggaugugcagaagaaaacaaugaccuaucgcgugcggagccugucugggcuuuucgcgcugagacccuuuaagguccgcauugacugucucggaaacaucauuccuuccuga

SEQ ID NO: 4052 - RNA, 3669 nt, Artificial Sequence
  Cas9 variant
augaagaaaagaauccugggccucgacagcgggaccaacucccugggaugggccguggucgaucgggacgagaauaaccaguacucucuuauuaaguauggcgaucugaucuucgaagaggggguuaaaauugaaaagggaguggagagcuccaaagcugccgaacgcacaucucacagagcgcuccggaagcuguacuuucgcagacggcuucgcaagaucgaggugcugaaaguccucgugaaguauaaucugugcccccaaguuagcgaggaggaacugcaucucuggcacacgagaaaacuguacccucagaacaaggaccuucugcaguggcagcggaccgaugaaaaagcuggcaagaauccguauauuuaccgcuauagaugucuccaugaggagcuggacauguccgugucugccaaccggaugacagucgggcgcgccauguaccaccuugcucaaagacggggauuccugagcaaucgccucgauaacgaagaggacgaaaaucagaucggcgccgugaagugcggcaucuccaaccugaccgaggaaauucagagcucuggguguaaauaccugggagaguauuuuuacaagcucuauaaugagcauggcaacacaguuagacugcggaccagauacacaucccgcgaguuccacuauaaaaaggaauuuuacgcuaucugcgaaaaacagaagcuggauaaaaagcugauugaggaacucgccagcgcgcuguauuuccaacggccccuuaagucucagagacacaccguggggcgcuguacguuugagccuaauaaaccccggugcgccgacucccauccugcuuacgaggaguucagaaugcugagcuuuaucaacaccauuaagguccagggacccuacgauacagaacuccgcgugcugaauaccgaggaacgggacucuaucacaaaacuguucuguagaaaguccaaaccuaacuuugauuucgaagacauugccaaggagcucgcuggccgcaacaauuauugcuacaucggggacguggucgauaaggccuauaaauuuaacuaccggaugagccagggaguuuccggcuguccgaccacgacauaucugaucaauguguucggccaagacuggcagaccgggauugcggagucuuaccaggccaucgauacaaaacuuggacaaaagagcguggacgcuaugauugaugacgucuggaacgugcuguauuccuucagcucuaaggauaaacucagagacuuuggccgcaagaagcugcagcuuggggauaaagaagccgacaccuucgcuaauaucaagcugacccacaaauuugccucccucagccugaaggccauucggaaaaucaacaucuuccugagaaugggacucguuuacucucaugcugugacacuggcgaauauucccacgaucgucggcaccgauauuuggcagcggaagcgcaacuuuauccuugccgagcugcucccucugauugaaaauuucaaccccaaggagacaaaacugcaggagacccuugacuuuugcgugaaggacuuccuccaaaauaacuuugaacugaaaaauggggcuguugauaagcuguaccacccuagcaugaucgaggccuaucccgacgccggacucaacuccaauggcauccugcagcuuggcucuccgagaacaaacgcuauucggaacccuauggccaugagaagccugcacgaaauccgcaaagugauuaaucagcuccugaaggauaaaaucauuaaccaggacaccgagauccaugucgaauacgcgcgggagcugaaugaugcuaacaagagaaaggccauuuccaucuggcaaaagagccaggagaaacuucacaaaaaguauguggaagagaucacgaaucucuacaaagaagagacagggaaggccauuguccccaccgacaccgauauccugaaguucaaacugugggaggaacagaaccauauuugucucuauacaggacagcaaaucggcauugcugaguuucugggggccaccccuaaguacgacaucgaacacacaaucccccagucugugggaggcgauuccacggacaugaaucuuacccugugcgauagccgcuucaacagagagauuaaaaaggcucagcuccccacacagcuggggaaucaugccgacauccugguucggauugcgggcuggaaaaacucuuaugaaaaacuuuccaaggauaucgaccgcauuagaacccacagcggaauggccaaggacaucaaggaucggcucauccaaaaacgccaucugcugaagcucgagagagacuacuggcggggcaaauacgaacgcuuuacaaugaaugagauuccugagggguucuccagacggcagggagugggcaucgggcugauuucuaaguaugcuggacuuuaccuuaagagccucuuccacgauaaaaacgaacgcaauaagggccacgucuuugugguuaaagggaccacgaccgccgaguucagaaagauguggggccugcagaacgaauaugagaaaaagucccggaauaaccaugugcaccacugcaucgacgcuauuacaaucgccuguaucggaaaacaugaguacgcgcaaauggcccaguauuaccacgaugaagcugaguaucuguaccaucacggcauuaagccgaucuuucccaagccuuggaaaaccuucacagaagaccuucucgaucuggagcauucucuguuugucgugcaccacagccccaacaauauggccaagcaggcuagaaaacgcauuaucaccuccacggggcagcauugggcccaaggagacagcgcccacggcucucuccauaacgauacauacuauggggcuauugaacgggacggagagaucaaguacgugguuagacgcgcggucuccagcuucgagcagaugucugauguggacuccauuguggaugacgucgugaaagaaaccguucggaaggcccuggagggcaagaauuuuaaagaagcugugaacgccccuaucuauaugaauaaggagaaagggguccuuaucaagaaagugagaugcuacgccaagagcauuaagaaacccaucgacauucgcacacaccgggauucuagcuccaaggaauauaaaagaaaguuccauguuagcaacgacaucaauuaccugauugcuaucuaugagggcaccgugaaaggaaaggucaagcgcgauuuugaggugguuaaaaacaucgaagccgcgaauuucuuuaagcggucucaggacagacgggauuacccgaccauugugccugagaaauccaucaagcacggcuucccccucaaaacaacgcugaccaacgggacaauggucauucuguacgaagagaauaaggaagagaucgacuuuaccaagaaagaggauauuugucgcagacuuuauaagcuggugggaaugagcuccaugaucgugucuggcugcgaauacgggguccucagccugcggcaccaucaggaggcucgcccuuccaaagacaucaagucuaaaaacggagccuucaagaauggcgaagcccucagacccgcuauuacaaugcugcacacccaauucaacgcccuuguugagaauaucgauuuuaacauugacgugacggggaacaucgagcugauuuga

SEQ ID NO: 4053 - RNA, 3669 nt, Artificial Sequence
  Cas9 variant
augaagaaaagaauccugggccucgacagcgggaccaacucccugggaugggccguggucgaucgggacgagaauaaccaguacucucuuauuaaguauggcgaucugaucuucgaagaggggguuaaaauugaaaagggaguggagagcuccaaagcugccgaacgcacaucucacagagcgcuccggaagcuguacuuucgcagacggcuucgcaagaucgaggugcugaaaguccucgugaaguauaaucugugcccccaaguuagcgaggaggaacugcaucucuggcacacgagaaaacuguacccucagaacaaggaccuucugcaguggcagcggaccgaugaaaaagagggcaagaauccguauauuuaccgcuauagaugucuccaugaggaacuggacauguccgugucugcuaaccggaugacagucgggcgcgccauguaccaccuugcccaaagacggggauuccugagcaaucgccucgauaacgaggaagacgagaaucagaucggcgcugugaagugcggcaucuccaaccugaccgaagagauucagagcucuggguguaaauaccugggagaguauuuuuacaagcucuauaaugaacauggcaacacaguuagacugcggaccagauacacaucccgcgaguuccacuauaaaaaggaauuuuacgccaucugcgagaaacagaagcuggauaaaaagcugauugaggaacucgcuagcgcccuguauuuccaacggccccuuaagucucagagacacaccguggggcgcuguacguuugagccuaauaaaccccggugcgcggacucccauccugccuacgaagaguucagaaugcugagcuuuaucaacaccauuaagguccagggacccuacgauacagaacuccgcgugcugaauaccgaggaacgggacucuaucacaaaacuguucuguagaaaguccaaaccuaacuuugauuucgaggacauugcuaaggagcucgccggccgcaacaauuauugcuacaucggggacguggucgauaaggcuuauaaauuuaacuaccggaugagccagggaguuuccggcuguccgaccacgacauaucugaucaauguguucggccaagacuggcagaccgggauugccgaaucuuaccaggcgaucgauacaaaacuuggacaaaagagcguggacgccaugauugaugacgucuggaacgugcuguauuccuucagcucuaaggauaaacucagagacuuuggccgcaagaagcugcagcuuggggauaaagaggcugacaccuucgccaauaucaagcugacccacaaauuugcuucccucagccugaaggccauucggaaaaucaacaucuuccugagaaugggacucguuuacucucaugccgugacacuggcuaauauucccacgaucgucggcaccgauauuuggcagcggaagcgcaacuuuauccuugcggaacugcucccucugauugagaauuucaaccccaaggagacaaaacugcaggaaacccuugacuuuugcgugaaggacuuccuccaaaauaacuuugagcugaaaaauggggccguugauaagcuguaccacccuagcaugaucgaggcuuaucccgacgccggacucaacuccaauggcauccugcagcuuggcucuccgagaacaaacgccauucggaacccuauggcuaugagaagccugcacgaaauccgcaaagugauuaaucagcuccugaaggauaaaaucauuaaccaggacaccgaaauccaugucgaguacgcccgggagcugaaugaugcgaacaagagaaaggcuauuuccaucuggcaaaagagccaggaaaaacuucacaaaaaguauguggaggaaaucacgaaucucuacaaagaggaaacagggaaggccauuguccccaccgacaccgauauccugaaguucaaacugugggaggagcagaaccauauuugucucuauacaggacagcaaaucggcauugccgaauuucugggggcuaccccuaaguacgacaucgagcacacaaucccccagucugugggaggcgauuccacggacaugaaucuuacccugugcgauagccgcuucaacagagaaauuaaaaaggcccagcuccccacacagcuggggaaucaugcugacauccugguucggauugccggcuggaaaaacucuuaugagaaacuuuccaaggauaucgaccgcauuagaacccacagcggaauggcgaaggacaucaaggaucggcucauccaaaaacgccaucugcugaagcucgaaagagacuacuggcggggcaaauacgagcgcuuuacaaugaaugagauuccugaaggguucuccagacggcagggagugggcaucgggcugauuucuaaguaugccggacuuuaccuuaagagccucuuccacgauaaaaacgagcgcaauaagggccacgucuuugugguuaaagggaccacgaccgcugaguucagaaagauguggggccugcagaacgaauaugagaaaaagucccggaauaaccaugugcaccacugcaucgacgccauuacaaucgcuuguaucggaaaacaugaauacgcccaaauggcgcaguauuaccacgaugaggccgaauaucuguaccaucacggcauuaagccgaucuuucccaagccuuggaaaaccuucacagaggaccuucucgaucuggaacauucucuguuugucgugcaccacagccccaacaauauggcuaagcaggccagaaaacgcauuaucaccuccacggggcagcauugggcucaaggagacagcgcccacggcucucuccauaacgauacauacuauggggccauugagcgggacggagagaucaaguacgugguuagacgcgcugucuccagcuucgaacagaugucugauguggacuccauuguggaugacgucgugaaagagaccguucggaaggcgcuggaaggcaagaauuuuaaagaggccgugaacgcuccuaucuauaugaauaaggaaaaagggguccuuaucaagaaagugagaugcuacgccaagagcauuaagaaacccaucgacauucgcacacaccgggauucuagcuccaaggaguauaaaagaaaguuccauguuagcaacgacaucaauuaccugauugccaucuaugagggcaccgugaaaggaaaggucaagcgcgauuuugaagugguuaaaaacaucgaggcugccaauuucuuuaagcggucucaggacagacgggauuacccgaccauugugccugaaaaauccaucaagcacggcuucccccucaaaacaacgcugaccaacgggacaauggucauucuguacgaggaaaauaaggaggagaucgacuuuaccaagaaagaagauauuugucgcagacuuuauaagcuggugggaaugagcuccaugaucgugucuggcugcgaguacgggguccucagccugcggcaccaucaggaagcgcgcccuuccaaagacaucaagucuaaaaacggagcuuucaagaauggcgaggcccucagacccgccauuacaaugcugcacacccaauucaacgcucuuguugagaauaucgauuuuaacauugacgugacggggaacaucgaacugauuuga

SEQ ID NO: 4054 - RNA, 3678 nt, Artificial Sequence
  Cas9 variant
augagcaagagaauccugggcauugacguggggaccaacucccucggaugggccgucguugaucggacagacugcgauaauuacacgcuggugaaacgcggcgacgugaucuuccaggagggggucaacauugaaaagggaaauaucgagaaaucuagagcuagcgaacggaccggccaccgcuccacaagaaagcauuauuuucggcgcagaaugcuuaaaauuaaggugcuggagauccucguugaacaccaacugugucccuaccuuucucaugaggagcugcaccaguggaugacccggaagguguauccuacaaacgaagauuuccgccucuggcugagaaccaaugacgccaacgaucagaauccguaccaugaccggcacgucugccugcacgagcgccucgaucugagacuucaggaaaaccgguaucgccuggggagagcgcucuaccaucuggcucaacggagaggauuucuuagcaaucgccuggagcagaacuccaaaacagacgagaccggcgccgugaagucugauaucagccagcucaaugaagagaugaaaaaggccggcucccaguaucugggggacuacuucuacuggcuguaucaagaauacggaaaccagguuacgcuccggauuagauauaccgaucgcaaacagcacuaccagaaggaguuugaagcuaucugucaacggcagcagcugagcgacgaccuuguggauaagcugagacgcgccauuuauuuccaacggucucucaaaucccagagagcuggcgucgggaagugcacauuugagcccgacaaaccucgcugugcccugagccauccccgguacgaggaguucagaaugcuuucuuuucugaauaacgugaaggugaaaggaccuuccgaugacagccuccgcccccugucuccuuccgagaaggaaaagaucaagccgcuguuccucagaaagagcaaagcgaauuuugauuucgaggacauugccaaggcuaucgccggcaaagggaaguaugcuugcauucgggauaaagaaggagcccagaagcccuaccaguuuaacuacgcgcugucccaaggcgucucuggcuguccuguuaccgccaaacuuaucgcuguguucggggagagcugggagcggaaccuggugaaugccuaucgcuccagaaacgacaugcggaaaagcgaugaagagaucgucaaugaaguguggaacguucucuacucuuucuccagcaaggagaaacugagagcuuggggaauggaaaaacuuggccuggacgaggccugcgccggggaguuugcugauauuacacuccccaccgcguucgccgcucugucucugaaggccgugaauaagauccucccuuuucugcgccagggauucauuuauagccacgccgucaugcuugcuaacauccccuacauuaucggcauggaccgguggaaugaaccgagacagcgccaguuuaucauggacaaccugcaagagcuccuggauaauuucacggccuccgacaaggcgcugcagcagacacuugauuuuuguauuaaagacuuccuccugaacaauuaugaacuggcuccugggaaggccgauagacucuaccaccccucuaugaucgagaccuauccugacgccaaagcugauggacagggcauuuaccaacugggcagccccgccacaaacgcuauccggaaucccauggccaugcgcucccuucauauucugagacgggugguuaaccagcuccugaaggagaaaaccaucgacagcgaaaccgaggugcacaucgaauacgcgcgcgagcugaaugaugccaacagacggugggcuauuaaccaguggcagcgcaagcaagaaacacagagaaaggacuaugccgagaaaauccggaaggucuacgcugaugaguuugaaaaagugauugagccuacgcaggaagaacuucucaaguaucaacugugggaggaacagcagcaucugugccucuacaccggggagcagaucggacugacagacuucauuggcccgaauccccgcuaugauaucgaacacaccauuccucaaucuaugggaggggacuccacaagaaugaaccuuacccugugugagcggacguacaauagaacagucaaaggcaaccgcaugcccagccagcucgccgaacaugagucuauccugacccggaucaagccuuggaaagacaaguaugaggaacugaccgugaagauuaauaaacuuagaacacaccccgggauggauaaggcguccaaagacaacaucauucgcaagcggcaccuccuggagcuggaaagagauuacugguuucagaaauaccagcgcuucaccaugacagagguuccggaaggcuuuagccuccggcaaggaacgggcaucgggcugauuggaaaguaugccggccuuuuccugaagucccucuuccaucacgugaaagagagaaaucgcaagcaggucuacgugaucaaagggccuaucaccgcugaguuucggagacuguggggacugcagaaccuuuaugaacagaagucucgggacaaucaugcccaccacugcauugaugcuaucguuauugccugcaucaaccccgccgaguacgcucgcauggcgagcuauuacagacaagaagaggacuuccggcucaauaaaggcaacaagccuguguuucccaagccuuggacaaccuucacacaggaucugcaggcccuggaagcugagcuccuggucgugcaugagacccgcaauaaccuuacgaaaaaggccagaaaacgggugagaaccaaagggggcaauguucuguccgaaucugacagcgcccgcggaucccuccacaacgauacauauuacggcgcuauucaaaaggacggggucauccgguacguggugagaaaggcccugagcucucuguccgagaaggaugucaaagacaucguggauaagaccguucgcgaaaaagugcaggcggcuauucaggagaagggagccaaagaagcccuugcuggcacaaucuauaugaacgaggagaaggggauuaccaucaaaaagguccgguguuuuacgaagauugccagcccccuggcgaucagacgccaucgggacgcuucugccaaagaauacaagagaccguauuacgugacaaaugaguccaacuauguuaugggaaucuacgaaggcugcauuaaagagaagaccaaacgcgaguucauccucgugaauaaccuggaagccgucagacagcucaaggcugcccggaagcaaggggugguuagcucuauucugccucccgugagcgcuaaaucccaguuuccccuuaaguaucgccuguacacaggcacccucguccugcuguacgagaauagcccugaagagaucgacuucaccaaccagguggauauuuguaaaagacuuuauaaggugacaggacugucuuccaugacggucaccggcaaucaguacgggacaauccaacuccgguaucaccaggaagcccgccaggcgaaagaccugaaggcccagaacggagcuuacaaggagggcgaggaacauagaccggccauuaugaugcuccacacccaauuuaaagcucugguugaggggacagauuuccggaugaauauccuuggagaaaucgagccccugagaaaguga

SEQ ID NO: 4055 - RNA, 3690 nt, Artificial Sequence
  Cas9 variant
augggcgacagaaaguacaaccuggggcucgauaucggaaccagcuccauuggcuucgccgcuguggacgagaauaaccagcccauccgggucaaagggaagacagccauuggaguucgccuguuugaagagggcaaaacggcggcugauagacggggguuccgcaccacaagacggcgccuuucuagacggcgcuggagaaucaaucugcucaacgaaauuuuugacgcccaccuggccgagguggauccuaccuuccuugcucggcugaaggaaagcaaucgcuccaaccucgacccgaaaaagucuuuucaaggaagccugcuguuccccgagagaaaggauuaucaguuuuacgaggaauauccuacaaucuaccaucuccggaaagcccugauggagaaggaccgcaaauucgauaucagagaaauuuaucuugcugugcaccauaucauuaaguaccggggcaauuuucugaacggcacccccaugagauccuucaaagucgagaauaucgagcucaacacacuguuugaccagcuuaaucagcuguaugccgaaauugugccugauaacgagcucgcguucgaccuggcccaaguugcugaugugaaggacguccugucuagcaccacgaucuacaagauggacaaaaagaaacagcucgugaagaugaugcugcuucccgccuccaauaaagcucugcagagcgaaaacaagaaaauuguuacccaguuugugaaugccauccucaacuacaaguucaagcuggauguccuucugcaaguggagacagacgcggauuggucucucaaacugaacgacgaaggggccgaugacaagcuggaggaguucaccggagaucucgacgaaaaucgccuggagaucauugaucuucugcagcggcuccacaacugguuuucccugaaugaaaucacaaaagacggcaacagccuuucugcugccaugguggagaaguaugaaaaucaucaccaccaucuggggcuccugaaaaaggucauugagaaccacccugaugcuaagaaagccaaggcccugaaagagaccuacacggcuuauguuggaaagacagacgacaaaacccagaaucaggaugacuucuacaaggcgguggaaaagaaccucgaugacuccccggaugccaaaggcaucaagagacugauucaacuugaccaguuuaugcccaaacagcgcacagggcaaaauggagcuaucccucaucagcugcaccagcaggagcucgaucaaaucauugaaaagcagagcaaauauuaccccuuccuggccgagccuaaccccaaugugaagcggagaaaggacgccccguauaaacuggaugaacuuaucgcuuuuaagauuccuuacuacgucggcccccucgugaccccugaggagcaggcccagaacaaagaaaauguuuucgcguggaugaagcgcaaagcugccggccccaucacccccuggaacuuugacgagaagguggaucggauggaaucugccaauagauucauucgccggaugacaacgaaagacaccuaucuguuuggggaggauguccugccugcugaguccaugaucuaccaaaaguucgugguucucaacgaacugaacaaucuuaagaucaacggaagacaccugagccucaaagacaagcaggacguguauaaugaucuguuuaaacagcagaagacagucuccauuaaagcccugcaaaacuacuaugugaccaagaagaaagcugccacagcgccgaccgucggcgggcuugccgaccccaagaaauuccucucuagccuguccacguacaucgauuuuaagaauauguucggagagcgcgugaacgacccucaguuccaggaagaucuggagcagauuguugaauggagcacaaucuuugaggaccggggcauuuucaaagcuaagcuccaagcccugggguggcuuucugagaagcagauccagcaacugguggcuaaaagauauaagggauggggccggcucuccaaaaagcugcugaccggccuuaaaaaugccgaaggguacagcauucucgaugagauguggcgcucuaccgaaaacuuuaugcagauccagagcagacccgaguucgcggcccugauccagcaagcuaaugaaaagcaguuugagggaaacgacccugauaaugucugggagaacauugaaaauauccugggcgacgccuacacaucuccccagaacaagaaagcuauuagacaggugguuaaggugguccaagauaucgagaaagccguggggaauccgccugaaaagauugccaucgaguucacccgggaagcugcggccaacccccagcgcacacagucccggcucagaacgcuggagaaacuuuaugagagcgcugaagaggugguugacgccggacugaccgccgaacucgcugaguuuaaggagaacaaacauguccuguccgauaaguacuaucuguacuucacacagcuuggccgcgacguguauaccggggacacaaucagccucgauaagcugaaugacuacgauguggaccacauucugccucaaucuuuuaucaaagaugacucccucgauaacagaguccugaccauucgggccgugaauaacggcaagagcgacaauguucccgcgaaaauguucggaaagaaaaugggcucuuuuuggcgccaucuucuggauaacgggaugaucuccaagagaaaguauaauaaccucauuacggacccugauaauaucagcaaauacgcucagaagggauucaucaaccggcagcugguggaaaccucccaagucauuaaacugacagccaauauccuuaacggcauuuacgacaaggacaccgagaucauugaagugcccgccaaaaugaacucucagaugcgcaagauguuugaucugguuaaggugagagaggucaaugacuaucaccaugcuuucgaugccuaccucacaaucuucaucgggaauuaucuguacaaaugcuauccgaagcuccggccuuacuuuguguaugacaacuucaaaaaguuuggaaacaaagaagauauuggccacaagcgcuucaauuuucuggggaagaucgagagagagaaaaagguuguggcgcccgaaaccggcgagauucuuuggagcaacgucgcucccaaugaaacgaucaaacagauuaagaaaguguacaacuacaaguucaugaucgugucccgggagauuacaacccgcagagccgaacuguuuaaucagacagucuauccuaagaacuaccggggaaaacucaucccgaucaaggaggacagacccaccgaucuguauggcggguacucuggaaauaccgacgccuaucuggcuauuguugcccuugaggauaaaaagaaaggcaaguacuucaaagugguggggaucccuacacgcgcugccgcgaagcuggaaaagcucaaacaacaggacagccagcaguaucugcaagcccuccacgaggucauugcuccccaguuuacgaaguccaccaaaaagggaaucaaaaagacagaguucgaaauugugcuggauaagguucauuaccggcagcuugugcaggacggcccugucaaaaugaugcuggggagcucuaccuacaaguauaacgccaaacaacucgugcuguccgaaaaggcucuguga

SEQ ID NO: 4056 - RNA, 3696 nt, Artificial Sequence
  Cas9 variant
augaucacccggauucugggccucgacacagggacgaacagccuggccugggcuguggucgauagagacgccaauggaaacuacacccuuguuaagcgcggcgaugugaucuucacagagggggugaaaauugaaaagggaaucgaguccucuaaagcggcugaaagaaccgcccacaaggcccugcggguccauuauagccgcagacggcuccacaaaauugacacacugaaggugcuuguugagcuggaucucugccccuaccuguccaaugaacagcugaaccucuggaaggcuaaaaagaccuauccucugacagacgauuuuaugcuuuggcaacgcucuggcagcgccgaggagaauaacccguacuauuguagacaucggugccugacccagaaacucgaccugacggaucagucccagcgcuuccuucuggggagagcuuuuuaccaccucgcccaacggcgcggauuccugucuaauagacuggacaccagcgcggauuccgacgaaagcggcaaggugaaaucuggcaucgccgagcucuccgucgaaauggagaaggcugggugugaguuucugggagaauauuucuaccagcuuuacaagcagcauggcaacacaaucaaacugcggagccgcuauaccgauagagaggaacacuacaagaaagaguuucucgccauuugcgaaaagcaggagcuggaccccaaauggguggaggcucuccaacgggccaucuauuuccagagaccucugaagucucagcgcaaagggguuggaaaguguacauuugaacccaagaaaccucggugcgcggagucccaccccgacuacgaagccuucagaaugcucuguuuucugaauaacgugaagauucagaccccuaaugauacgagccugcgcccgcucaacgaggacgaacgggagaaaaucuggccccuguucuuuagaaagucuaaaccuaauuucgauuucgaggacauugcuaaggcccuugcuggcaagaacaauuaugccugguacaaagaugccggggaaaagcccuuuaaauucaacuaucgcaugcaacagggagucuccggcugcccugugacagcucagcugaucgacauuuuuggcagcgauuggcaaaccgcgaucgccgagacauacaccgcuguggaaaagaaaaacgggaccaagacaaucgacgagauggccgaugacgucuggaauguucucuacuccuucucuagcaaggauaaacugaaggccuuugcuacggaaaaacuucagcuggacgaggccuccgcgaccaaguucgcuaacgccaaacucccccauggauuugccagccugucucugaaggcuauucggaauauccucccguuccugagacagggcuuuauuuaugcccacgcugugcaucuugccaagaucccugacauugugacaaaagcggucuggaacgaugccgacaagcgcgagaugauccuguccgggcucauggaaaucauugagaauuacaaccccaaagaucggggaguggaaggcaccaucgacuucuguauuaagagccaucugcaggauguuaucgaccugagaccuggggcugccgaugcucuuuaucaccccucuaugauugagacauaccccgacgccaaacucaauaagaugggaguguuucaacugggcagcccucgcaccaacgcgauccggaauccgauggccaugagaucccugcacauccuccggucugucgugaaccagcugcuucgcgauggcauuaucgacagaaauacggagguucacguggaauaugcucgggagcugaacgaugccaauaaaagaaaggcuauugccgacuaccagcgcgaacaggagaagaaacggaagcaauauagagaugacaucauugcccucuacaaaagcgaaugccauaaggagaucgagcccacagacaccgauauucugaaauuccagcugugggaagaacaggaccaccuuugucucuacaccgggacacagaucggaaucugcgauuuucugggcgacaacccuaaguucgauauugaacauaccgucccccgcuccgugggaggagacagcacacaaaugaaucugacgcucugcgaugcuaccuucaacagacaggucaagggcgcgcagcugccuucucagcuuuccaaccacgccgacauccuggugcggauugaucacuggaaaagcaagugugaggaccuccgcaaacaacuggauaagaucagaacauaugggggcauggaaaaagcuaugaaggaccggcugauucagaagcgccauagacuuaaaauggaucucgacuacuggcagggaaaguauucucgguuuaccaugacagagguucccgagggcuucucccgcagacaaggggccggaaucggccuggugagcaaauacgccgggcuguuucucaagucccuguuccacaaugaacagaacccgaauaaaucuaacgucuaugugguuaagggagugaccacggcugaguuucggcgcauguggggccuucagggggaauacgagaagaaaagcagacugaaucauugccaccacuguaucgacgccauuaccaucgcgugcauuggcaaggcugaauaugauaaaauggcccaguacuaccaugacgaggagcuuuuccaauggcggggaacaaccacaaagccucacuuuaacaaacccuggccuaccuucacggaagauguccuggccaucgagcagucccugcuugugaagcaucucacaaaagacaauaugcccaagcaggcuaagaaaagagugcgcaccgccacaggcaaguaucuggcgcagggggauaccgcucggggaucucugcacaaagacaccuacuauggcgccauugaacaagauggggagaucagauacguucuccgcaagccucugaacaaauuugagaaugaagccgagcuugaaaagaucgucgaccaggcugugaaggagaaaauuaaggaagccaucgcugggaaaaacuucaagacagccauuacggagcccaucuuuaugaauaaagagaagggcauucggaucaacaaggugagauauuacgucaaagcgcaggaacgccugaagauccggcagcaaagagaucucagcuccaaagaguauaagcaguucuuuuguguggaaaaugagagcaacuaccugcuggccauuuacgaaggggagcuuaaaggcaagaaggagcgcgacuucugcguugugaauaaccuggaaucugcugccugucucaaacgguccaacaagggaaaagcugccccgcuggucccugagagaagcgaggagcggaaucucccccugcuugccgugcugaagcgcggcacccagguucucuucuaugaaaacucucccgaggagauccuguuugauaauccucaagaccuggugagacggcuuuacaaagucacagggauuaacaccaagaaggacgugaaaaauggaaagacauaucuguacggcaacaucgaacuccgcuuccaucagaaugcucagaaaaaggaugacguuaaaaugcaguccgggguguauaagaacaaugagguccugagacaaggaauugugcucagccacaaacaguuuaaggcgcugguggaaggcgucgauuucgaguuuaacguucuuggggagaucaagaaaaaggaacggcacgccuga

SEQ ID NO: 4057 - RNA, 3699 nt, Artificial Sequence
  Cas9 variant
augaccaagacaagaauccugggccucgacacggggaccaacagccugggaugggccauuguggaucgggacgaggucuccggccaguacgaacuuguugaucgcggggaccugaucuucacagagggagugaaaauugaaaagggcaucgagucuagcaaggcuuccgaaagaacccaacaccgggcccuccgcaagcaguauuuuagacggcgccugagaaaaauugaggugcuucggguccugacauucuaccaucucugucccccugugucugaggaagaacugcaccuguggcauguuaagaagaucuauccgguggaaaaucacgaguuuaugaucuggcagcgcaccaacgauaaugaggggaaaaaccccuacuauuacagacauauuugccuccacacaaagcugaaucuuacccugaugaaagaccgguauauccucggacgcgcgcuguaccaccuuagccagagacggggcuuccuguccaaccgccucgaucaaucucaggacgaagaugacaagggcacggucaaaaccgggauuagcucccugagcaaggauaugaaugacgcuggaugcacauaccugggcgauuauuuuuacaagcucuauucugagaacgggaauagagugcggaucagaaaccauuacaccgcccgcaaugaacacuaucuggccgaguucgaagcuauuugucagguucagaaacuugagccugagcugguggaagcccuccggagagcuaucuuuuuccaacgcccccugaagucccagcggaaaggagucggcaagugcacauuugagccuagaaaaccccgcugugccgacagccauccugacuacgaagaguuccggaaacuuugcuuuauuaacaauaucaaaauccagaccucugaugacgauacgaugagaccgcugaacaaggaagaacgccagcggauuaauucccucuucuauagagugagcaaggcgaacuuuuacuucgaggaaaucgccaaacugcucgggggacgcaacaauuacuguuauuucaaggacgaggugcaaaaagauuuuaaguucaacuaccggaugucucaguccgucagcggcugccccacaaccgcucagcugagaaauauuuuuggcgaagacuggaaaacagggaucgccgagaccuaucaacacuccgcuaagaaggauggaucucugaaaaccguugacgaaauggccgaugacauuuggaacgugcuuuacagcuucuccagcaaggauugucuguauaauuuugcggugaacaaacuccagcuggaggaggacaaggccaaaaaguucucuaagaucaaacuuucccacggcuuugcuagcaucucucugaaugccauucauaagauccucccuuuccugcggauggggaugauuuacagccacgcuguccuguuugccaacauccccacaauugugggaauggacguuuggaaugaugaauccaaacgccagcauaucaugacggagcucucugaccugguguucaacuaugauccuaagaauagagaagucgagggcaccaucgagaugugcauuaaagacuuucuucugaacaauuacgaucuccccgccggggcugugugucggcuguaccacccgagcaugaucgacacauauccugaugcgaaggccaacaaguacggaguucugcagcuuggcucccccgcuaccaaugccauuagaaacccuauggccaugcgcagccuccaugaacugcggcacguggucaaccugcuccugagaaaaggcaagaucgaccaaaauacagaggugcacgucgaauaugcucgcgagcuuaacgaugccaauaaaagaaaggcgauugcugaccggcagcgcgaacuggauaaacuccauaagaaauaccacgacgauaucauuacccuguauaaggaggagacggggaaggacaucaaccccacacaggccgacauccugaaauuccagcuuugggaggagcaagaacaugugugccucuacaccggaagacagauuggcaucucuaaguuucuggggcccgauccugaguucgacauugaacacaccguuccgcgguccgugggaggcgauagcacacagaugaauaugacccugugcgaccgcagauucaaccgggaugucaaaaaggccaugcuccccucucagcugccuaauuaucaagagauccuuccccgcauugagaaauggaagaagaaauacgaaaagcugacaaaagacaucgaucacuguaucacgcauuccgggaugaccaaggaggcuaaagacagcauuauccagaagagacaccggcucacacuggaacaugauuacuggcgcaacaaguauuccagauuuaccaugacagaggugccugaaggcuucucucggagacagggagccggcauugggcugguuagcaaauacgcuggacuuuuucucaagucccuguuccacgaccccaccgaucgccggagaucucauguguaugucgugaaaggcacgaccacagccgaguuucgcaagaugugggggcugcagagcgaguacgagaaaaagucccgggacaaucacgugcaccauugcguugaugcgaucaccauugccuguaucggaaagaacgaguauaauaaaauggcuagcuucuaccacgacgaagaggccuuugagagaggcgaaugcgagaagccgcauuucgacaaaccuuggcccacauuuacccaagauguccucgggcuggaaaagcgccuuaucguggugcacucuacgcaggacaacaugccuaaacaugcuaagaaauauguccggacacccagaggcaaguucauugccaagggagauugugcgcgcggcucccugcaccucgacaccuacuacggggccaucaaacacaaggaugacacagagccucgguaugugcugagacgggaacugagcucuuuugauuccguuaaugaccuugauauuaucguggacgaugcuguccgcgagaaaauuaaggaggccgugaaaggaaagagcggcaaggcuuucaaagaagcccucgccaacguuuacaugaauaaggagaaagacaucagaaucaagaaagugcggugcuauguccccucugugaagcgcccgauugacaucagacaucagcgggauaugagcagauuugacuacaagcgccaauuccacguugcuaacgaugggaacuauaugauggcgauuuacgaaggaguggucaaaggcaagcugaaacgggacuucgagcuggugaagaauaucgaagccgcuuccuauuuuaaagugagccaggauaacgagucuuucuccagcauugucccugagaaguccucuaauggguuuccccucaaggccguucugaaaaucggcacccaugugcuucuguacgaaaacaccgccagcgagauugacuucuccgaucccguggaccucacaagacgccuguacaaggucgugggacugucuagcgcuaucaucaauaacuguuccuauggcuuuauuacgcuucgguuccaccaggaagccagacaggcgaaaaaucugaagcucaccaaagggguuuuuaagaacguggauaauuaccgcggagcuaucauucuguaucacacacaacucaaggcccuggucgagggcuacgacuucgauaucaacauucuuggggaaaucaccucuaaacaguga

SEQ ID NO: 4058 - RNA, 3705 nt, Artificial Sequence
  Cas9 variant
augcccaacuucuggagcaucuuuaccgagaaucugcagacauaccucaugaagacgcgcauucugggccuugacaccgggacaaacucccugggaugggccguggucgaucgggacgaaaauaaccaauauaccccuaucugccgcggcgaucucauuuucacagaggggguuaaacaggaaaagggaaucgaguuuucucuggcugccgaaagaaccagcuaccgggcgucccgcagacacuauuuccggcgcagacuucggaaaguggaggugcugaagguccucgugaaacauaagcuguguccgccccugucugacgaggcucucaaucgcuggcacacaaagaaagaauacccucuggaugaggacuuuauucuuuggcagagaaccaacgaagccgauaauaagaaccccuaucaugaccggcacaucugccugcaucgcaaacucaaucugaaggauagccagacggacagauacacccuuggccgggcccuguaucaccucacacaacgcagaggguuccuguccaaccggcuggaucagaaugaggaggcugaagagaccggaaaaguuaagucugccaucagcgaacucuccaaggagaugaaagaagcuggcugugaguuucugggcgacuacuucuaccuucuguauagaacagaggggaaccgcgugcggauuagaagccgcuacaccgaucgggaaaagcacuaucuccaggaguuuaaagaaaucugcagaguccaggagcuggacgaagaccuugccaaggcgcuggagaaaacgauuuucuuucaacgcccucucaagucucagcggcagggagugggcaaauguacaauggagaaggggcauuccagaugcgccguuagccacccccuguacgaagaguaucgccugcucuguuaccugaauaacauccggauuaagaccccuucugaugacagacuucgcccgcugaaugcugaagaacgggagaaaaucacaccccucuucuauaaggagaaaaacuuugauuucgagaagauugccaaaaagcuggcuggaaagaccccuuucggcuggaucagagacgccgaagauuggcccuaccaguuuaacuaccggaugacccaagaggcgccugccugccccacaacggcucagcuuaucaaaguguucggggaagacuggaaggccgcucuggccgagaccuauacaauguccgccaaacaggauggaacccucaagacagaggacgaaauuuguaccgauaucuggaauguccuguacagcuuuucuuccaaagagaagcugaaggaauuuggccucaaaaagcugcaacuugacgaggugcaggcuaaagcguuuagcgaaauucgccugacgagagauuucgccucccucucucugaaggcuauccggaaaauucuguuuuuccuuagaacaggcgaggacuauagcaaggccaucuuucucgccaacaucccgaccauugugggggaggaaaucuggaaugacauugagcgccgguccagacugcuguacaaggucgaucucgcucugcgcccucaggaagagagagacgccgaggaacaucggaccaucgcggagcgcauuaaagcugccguugccgcugaagugcccgaugccccuaucgaccuucuguaucaccccagcaugaucgaggcuuaccccgaugccaagagaaacgaacgguucgacugcuaucagcucggaucuccuaaaacaaaugcggugcgcaacccgauggccaugagaucccugcacaugguccggaaggugauuaaucaucugcuucgcaaacacaucauugaugagaagaccgaaauccauauugaguacgcuagagagcucaacgacgccaauaaacggcaagcuaucgccgauuggcagcgcgaacugagcaagagacacacagcguacgcccagaacauucggcagcuguauaaggcugagacgggccucguuaucgaacccaccaaagccgacauccugaaguaccaacuuugggaggagcagcagcaugugugucuguauacagggaaaaagauuggaaucgcugauuuucucggcgccaauccuaaauucgacauugaacacaccauccccagaucucgcgggggagauagcacacaggagaaccugacccugugcgaauccaaguuuaaucgggacauuaagagagacaaacuuccuacggagcucgccaacuacgaagagauccuggcucgcaucgagcacuggaagaaacaaugcuaugcgcugaagcucaaacgggauggcauuagaacccauucuggccuggaaaagagcaucaaggacucccgcauucggagacgccaccuugucgggcuggaguacggauaucucaaaggcaaguacgaucgguucacaaugaaagaagugcccgagggguucagcagacggcagggagccggcaucgggcugauuucuaaguacgcuggccuguuucuuaaaucccucuucaaggacccgaagaauccuaaccgcagcaacguuuauguggucaaaggagccaucaccgccgaauuuagaaagcuguggggccugcagcaggcugaugaggccaaaucucgggagaaucauacacaccacuguaucgacgcguacaccauugcuugcaucgggcccugugaauaugccgcccucgcugccuacuaucgcuccgaugaggaguucaaguacggaagacggagagaaaaaccucaauuugaaaagcccuggccuacguucacagaggaccugcuuaaacugcaggaggaacuccugauugugcaucagaccacagauaagcugggcaagcgcgaccggagaaaagucaagacccccagagggaaauuucuuaccggaggcgauagcgcgcgggggagacugcaccaagagacauauuacggcgcuaucaacuacgacggaaauauuaaguaugugguucgcaaaccgcucgauucccugacggaaaaggaccucgacaagaucguggaugagaccgucaugggcaucgugaaaggggccguugaggccaagggaucucugaaagaagcucuugccgacggcauuuacaugaacaaggagaaagggauccugauuaagcgggugagaaucuucagcgaugucuccgaaccuauuaaucucaagcagcugcgcgacgugucuacaaaagaguauaagagacauauccaucugcggaaagaugaaaacuaccuuuuugcuauuuaugagggaaucgacaagaaaaagaauaagaaacagaccgagacagccaccguggauuaccuggacgcggccaaguucuauaaagauagcaagcgcagagacaaagcuaacucccucguuggcgauuacagcaagaagaauaaacugccccucaagugcauccugaaaaagcggcagaugguccuuuucuacgaacacucucccgaggaaauucgcuucaaagacaagaaagaccuguccagacggcucuauaucgugacgagcauugccaaggaugggagagugaaguuucugcaccaccaagcugccacagccaccggcauccagucuuccccuagcccguucaccaacgacggagagcaucagcccuacuaucgccugucugcuagcaauauuaaaguccuuguggcgggcaucgauuucgacaucaacauucugggggaaaucacaccuaagcucuga

SEQ ID NO: 4059 - RNA, 3711 nt, Artificial Sequence
  Cas9 variant
auguacuucuauaagaacaaagagaauaagcugaacaaaaaggugguccucggccuggaccuugggaucgccagcguuggauggugccugaccgauauuucccagaaagaagacaauaaguuucccaucauucuccacggcgugagacuguucgagacaguggaugacucugaugacaagcuccugaacgaaacgcggcgcaaaaagagagggcaacggcgcagaaaucggcgccucuuuaccagaaaacgggauuucaucaaguaccugauugacaacaauaucaucgagcuggaauuugauaaaaacccuaagauucucguccgcaauuucaucgagaaguauauuaacccguuuagcaaaaaucuggagcuuaaguacaaauccgugacaaaccugcccaucggauuccauaaucucagaaaggcugccauuaacgaaaaauauaagcuggacaaaucugagcuuaucguucugcucuacuuuuaucugagccugcggggcgcguucuuugauaauccugaagacaccaaguccaaggagaugaacaaaaacgagauugaaaucuucgauaagaaugagucuaucaaaaacgcugaauuucccauugacaagaucauugaguucuacaaaaucagcgggaagauucgcuccacaaucaaucucaaguucggacaccaggacuaccugaaagaaaucaaacagguguuugagaaacagaacauugauuucaugaauuaugagaaguuugccauggaagagaaaucuuucuuuagcagaauccggaacuacuccgaaggcccuggcaaugaaaagagcuucucuaaguaugggcuuuacgccaacgaaaauggaaaccccgagcugauuaucaaugagaaaggccaaaagauuuauaccaaaaucuuuaagacacucugggaauccaaaaucgggaaguguagcuacgacaagaaacuguaucgcgcuccuaagaacucuuucuccgccaaagucuuugauauuaccaauaaacuuacggacuggaagcauaagaacgaguacaucagcgaaagacugaaacggaagauucuccuguccagauuccugaauaaggauucuaaaagcgcuguggagaagauccucaaagaagagaacauuaaguuugagaaccuguccgaaaucgccuacaauaaagacgauaacaagauuaaucuuccgaucaucaacgcguaucacagccugaccacaauuuucaagaaacaucucaucaauuuugagaacuaccugauuucuaaugaaaacgaccuuuccaagcugaugagcuucuauaaacagcagucugagaaacucuucguucccaaugagaagggaagcuacgaaaucaaccagaauaacaaugugcugcacauuuuugaugccaucuccaacauccugaauaaguucucuaccauucaagaccgcauccggauucucgagggcuauuuugaguucagcaaccugaagaaagaugucaaguccagcgagaucuacucugaaauugcuaaacuuagagaguuuuccgggacaagcucucuguccuucggagccuauuacaaguuuaucccuaaccucaucagcgagggcuccaaaaauuacucuaccauuagcuaugaagagaaggcucugcagaaccagaagaauaacuucucccacucuaaucuguuugaaaagacguggguggaggaccuuaucgccagccccacagugaagcgcucccuccggcagaccaugaaccugcugaaagaaauuuucaaguacagcgagaaaaauaaccucgagaucgaaaagauugucguugaggugacaagaucuuccaauaacaaacaugaacgcaagaagaucgagggcaucaauaaauaucggaaggaaaaauacgaggagcugaagaaaguguaugaccuuccuaacgaaaauaccacccugcucaagaagcuguggcugcuuagacaacagcagggguacgaugcguauagccuccgcaaaauugaggccaacgacgucaucaauaagcccuggaacuacgauauugaccacaucgugccgcggucuauuuccuuugaugacagcuucucuaaccugguuaucgugaauaaacuggauaacgcuaagaaaagcaaugaccucuccgccaagcaauuuauugaaaagaucuacggaaucgagaaacugaaggaggcuaaagaaaacuggggcaauugguaucuuagaaacgccaaugggaaggccuucaacgauaaaggaaaguucauuaagcuguacacaaucgacaaucucgaugaguuugacaacagcgauuucauuaaucgcaaccugucugacacguccuauaucaccaaugcucuggucaaccaucuuacauuuagcaauuccaaauacaaguauucugugguuagcgugaacggcaaacagaccuccaaucuccggaaccagauugcguucgucgggaucaagaacaauaaagaaacagagagagaauggaagcggccugagggauuuaagucuaucaacagcaaugacuuccugauucgcgaggaaggcaaaaacgaugugaaggacgauguccugaucaaagacagauccuuuaauggccaccacgccgaggaugcuuacuucauuaccaucauuucucaguauuuucggagcuucaagagaaucgaacgccucaacgugaauuaccggaaagagacgagagaacuggacgaucuugagaagaacaauaucaaauuuaaggagaaggccuccuucgacaacuuccugcucauuaaugcccuggaugaacugaacgagaaacuuaaucaaaugcgcuuuagcagaaugguuaucacaaagaaaaacacccagcuuuucaaugaaacccuguacucugggaaguaugacaaaggaaagaacacaauuaagaaaguggagaagcugaaccuccuggauaaucggaccgacaaaaucaagaaaauugaagaguuuuucgaugaggacaaacuuaaggaaaacgagcugacaaagcuccauaucuuuaaucacgacaagaaccuguacgaaacgcugaaaauuaucuggaaugaggucaagaucgagauuaaaaacaagaaucuuaacgaaaagaauuauuucaaauacuuugugaacaagaaacugcaggagggcaagaucuccuucaaugaauggguucccauucucgauaacgacuuuaaaaucauucgcaagaucagauauaucaaauucagcucugaggaaaaggagaccgaugagauuaucuuuucccagagcaauuuccugaagauugaccaacggcagaacuuuucuuuccauaauacacucuacugggugcagaucugggucuauaaaaaccagaaggaucaauacugcuucauuuccaucgacgcucgcaacagcaaauuugaaaaggaugagaucaaaauuaauuacgaaaagcugaagacccagaaagagaaacuucagaucauuaacgaggaaccuauccugaagauuaauaagggggaccucuucgagaacgaagagaaagaacuguuuuauaucgugggaagagaugagaagccccagaagcuggaaauuaaauacauccuuggcaagaaaaucaaggaccaaaaacagauucagaagcccgugaagaaauauuucccuaauuggaagaaaguuaaccugacauacaugggggagaucuuuaagaaauga

SEQ ID NO: 4060 - RNA, 3717 nt, Artificial Sequence
  Cas9 variant
augaccaaggugcugggccucgaccugggggccgcuagcgucggaugggccaugaucgaggaagaggaaaaaucccacaagauucuuggccuggggucuagaaucauucccuacgagggaacagaaggcaacgauuucgcgaaagggacgggagagagccggaaugcucuccgcaccaaggccagaacagcccggaaaggcuaugaccgcuaccagcugagacggaaguaucuuguugauacccuggugaagaacgagaugaugccugacgaauaccuccgcaaacugccgaagaugcaacugugggagcucagauccaaagcugugacaaccgaaaucacaaagcaggagcugggccggcuuuuucuguggcucaaucagaaacgcggguauaagucuagcagauccgaugccaaccuggacaagaaagauaccgaguacgucguggaaguuaagucucggcaugagaaaauuaaggaaagcggauucacgaucggccaguauuuuuacuccgagcuuaaaagcaaugaauacuuccgcgugaaggagaacaucuuucccagagaggcuuauauugaagaguucgacgccaucugcaaacaacagaagcggcaccugaccgauaagcucauuucucgcaucagaaaugaaauuaucuacuaucagcggccucugaaaucccagaaggggcuggucagcguguguagauuugagggauucuuuaaaaagggcauuaacgggaaagaauacuucguuggacccaagguggcgccuaagucuagcccccucuuucaaacagucaaaaucugggagaauaucaacuccauucgccugucugaccggaauggcaaggagaucaugcuuucccuggaacagaaaaagugcauuuucaaccaucucgauaauaacgagaaacugaccccuaaggaccuuuuuaucauuaucggcgugaagaaagaaaauuguuucgugaacaagcagcuggagaaagggauccagggaaacgucacaaagagcaccauucucaaaugcuucggcgaaaauaacgauuaugacaaguggcugaagcuggaccucaauaucauuguuaaaaaggauacguuuggguaccuguaugacaaaaagacaggagagaucauuggcgagaaacuuaucaagcacguggauuccgccguggaaagagagccgcuguaccaacucuggcauaccaucuacucuauuaacaauacagacgaauguagcgcugcccugcagaacaaauucggguuugauuccgagaccgcugacaaacuuagcaauaucgauuucggaaaggccggcuuuggcaacaagucugcgaaggucauucgcaaaauccugcccuaucucauggagggggacgauuacucccagagcaugucuuaugccggauucaaucacagcgacucccugaccaaggaugaaaaccugaaacggaagcuccuggacaagcugagaccuauugagaaaaauucucuucgccaacccaucguggaaaagauucucaaccagaugguuaauguggucaacgcuaucaucgacaaauacggcaagccugaugagauucggaucgaacuggccagagagcugaaacagaauaaggaggaacgcaacaagacagacaaagauaugagcaagcggcagagagagaacggggaaauuuccaaacgccuugcugaguauggacuccgggccacgagaaauaacaucauuaaguggcggcuguacgaagagaucgacaaucaagauaaaaagcugaacgccaucugcguguauuguggccagcccauuagccucaccgaggcuaucaaggggaaugaaguugacguggagcacauuaucccgaaaucuaagcuguuugaugacucccagagcaacaaaacacuugcgcaucgcagaugcaauucuaccaagggcgauaugacagccuacgacuucauggaaaacaaaccugcucaggucuuuaaugccuacauugagcgggugaacaugcuguaugauaauaagaucaucagaaaagucaagcgcgacaagcuccugaugcccgaauccaaaauuccugauaacuucaucgaccggcaacugagagagagccaguacauugccuccaaggcucgcgagauccuucagaccauuuguuauaauguguggucuacgagcggaacaguuaccgccagacuccggcaccuguggggcugggacgaugcgaccaugucccugcagcuccccaaauaccgcgaacuggggcuuacagagaugguggaaugggagucugagcauggaaagcaaaaacacagcaaggaagucaucuccgacuggagcaagagagaugaccaccggcaucacgcuguggaugcccugaccaucgccugcacaaaacagggcuuuauucagcgcuucaacacgcucaauucuuccaagaccaaagaggacauggaauuugagaucgcuaaguguagcauugaauauagagagaaccugucuaaacuggagaaguacaucauugcccuucggcccaucccuguuuccgaaguggaggaugcugucgccaacauucucaucagcuucaagucugggaaaaagguggcggugaaaggaaagcgcaaaaucggcaagagagggaauaagaaaauuauccagacagacauuaucauuccgcauggcagccuguccgaagagagcguuuauggaaagaucaaaaccaucgaacgggagaagccccugaaauaccucuuccaaaacucucagcugauuuuuaauaacaagaucaagauucuugucgaggaacgccuggccacauucgagaaugauaccaaaaaggcucucgccucccugaaaaaggugccuguguaccuggacgaagagaaaacgaucguccuugaauaugcuaccugcuuuaaggaggaguacgugaaaaaguaugauguugacacaaacuucagcaagaccgauaaagugauugacgacaagaucaaagaaauccuccagcacagacugggcaaguuugggggaaaagccaaggagaaggaagcguucaaagauguccaacagggcgacaagacaauuaaaugguacgaggaugaggggcuggaacggcccauccauuccgugagaugcuuuaccggacucucugccauuguuccugugaagaaagacgagaauggcaucgauauuggguucgucaagcccggcaacaaucaccacaucgcuauuuauagcgacaaggauggaaaccgcuacgaacauaucuguacguuuuggcacgccguggagcggaaaaaguaugacaucccgguugugauuaaagauuccaaugaaaucuggaacaagauuuggucuaaaccugagggcagcuacccccaguccuuccuggacaaacuuccucaggagaaucugacacucgaucugucuaugcaacagaacgaaaugcugauccuugggaugagcuacgaggacauuaagaccgcuaucgacaauuccgauuauaagcagcugagcucuaaccucuacagacugcagaagcucgccaacgccaauuauauguuucgccaucaccuggaaacacaaaucauugacgauaacaauuccaaagcuagccggagauucaucaacauucacucucuuaaggcgcuguuugccuggaaucccuacaaagucaacaucaauugccucggagacauucagaccaacucccgcuga

SEQ ID NO: 4061 - RNA, 3720 nt, Artificial Sequence
  Cas9 variant
augaccgagaagagaaaauucgacauccgggaaguguaccuggccauucaccauaucgucaaguaucgcggcaacuuucucaauagcgcuacaguugauuccuucaaaacgucuaacauugacuuuaccagccaguucgauagacugaaugagcuuuaccggcaagugauccuggaggaacccuuucagauuaacaugaaucagguggacaagaugacaaacaaacuccuggauaaugacgcccuuaagcuggauacccagaagcaagucgcgaaacuccugccugugaucuauaacgacaagccgguugauaaacaguacacacgccuggcuaccgaguucuccaaggccauccucggguauaaaacaaagcuggacgugauucuuaaucuggauacccagaacgccaaggacugggcuaucagacucgaugacgaagacauugaugacaaacugcccgcccuugucgagaaucuggaugaaucucggcaggagaucgugacgauuauccgcgaccucuacgcucaaauuacccugaacgccaucguuccuaagggaaaaagccuguccgaaucuaugguggauaaguauaaugaccacaaagaucaucucgaccugcuuaugggccugauccacgagcucggggaugacagcgcgaagggaauuaaacugagagaggccuacacacaguacgucggcaaguccggggauaagacccuuaaccaggacgacuuuuaugcugccaucaaaaagaaucuggaugaagacagcaaacggucucccaagauucagcgccucaucgagcaggcuuccuucaugccuaaacaaagaacaagcgccaacggagugauuccccaucagcugcaccaacuggaacucgaucggaucaucgagaaccagggccgcuacuauccuuuucugaaggaacccaauucuaacacccacaagcccaauggcgggaaauacaaacuugacgagcugguggcguuccggauuccuuauuacgucggaccccucaucacgaaacaggaucaggagaagacauccggcgccgacuuugcuuggaugauuagaaaaccugggcaaggaggcgaaaucacccccuggaacuucgaucaggagguugaccgcauggccagcgcuaauacauuuauuagacggaugaccaccaaggauucuuaucugguggccgaagacgugcuuccggauuccagccugaucuacgagaaguucaaaguccucaacgaacugaauaugcugaaggugaacgacagacgccucuccaucucucagaaacaggaucuguucaauaaccuuuuuaagaaacaaaagacaauucggacgaagaaacugcagaccuacaucagaacaaagugggagcucccuagcguuaugauuuccgggcugagcgaccccgacaaauucaauucuucccuggccaccuauaucgauuuucgcgacguguucggagagaaggucgaugacccuaaccggcaggcugauuacgaaaagauuaucgaguggagcacaguguuugaagacagaaagauuuaucaggcgaaacuuaaucaacucgauuggcugaccgagucucagagcaaggcccugcucacgaagcauuacacaggcuggggccgccuguccaaaaagcugcuuaccgggcucaaagaccagaacggagauucuauccuggaccagcuguggaagaccaaugauaacuucaugcaaauccagagccgggacgaauuugcuaaacagauucacgaugagaacgccaagcaauuccaugaggccaauaacguugacgacauccuugaugacgcuuuuacauccccgcagaauaagaaagccauuagacagguggauaaggucgugcaggacgucgugaaagcgguuggcuaugcucccgauaagaucgccauugaguucacccgcagcccucaagaccggccgcagagaacauuuucucgccagcggcagcuccaauccacguaccugaacguggccaaagcucugaugaaaagcaaucucaaccaggaacugaagucugucaucgauucccagcagacccuuacagacaagcuguaucucuacuucacccaacuggggcaggauauguacacaggaaaggaaaucaauuuugacgagcuggugaacuaucagauugaucacauccuuccccaagccuucauuaaagacgacagccucgauaauagaguucugguguccgcuccuaucaacaaugccaagucugacaacguccccgugaaaaaguucggcgcgaagaugggguacuuuuggaaacagcuggccgagaaucaccucauuagcaagcggaaacugaacaaucuuaccacggauccugacaagaucggaaaauucaccgcucagggcuuuauccaucgccagcugguggaaacaucccaaguuauuagacucgucgccaacauccugggcaacgaguaugggcacgauggaaccacaauuaucgaagugaccgcuaagaugaaucaucagaugcggaaagacuucgaucugauuaagaucagagacgugaacgauuaccaccaugccauggacgcguaucuuacggccuacgucggcgauuaucucuaccugcgcuaccccaagcugcggucuuauuuuguguacggggacuucaaaaagcucaaagaucagagccugaagaucagaaauuuuaacuuccuucacgaccugacaaaugacgaggcuggagauaaaauuguugaccaggaaaccggcgagaucauuugggauaagcacgaguccgugaagcaacucaaaaaggucuaucauuacaaauuuaugcuggugagccaggaaguuuauacacgccaggacgcccuguucaaccagaccaucuacccggcuucugaugccgacaagagaaaacuuauuccuaucaagaauaacaagcccguggaugucuaugggggcuacuccggaaauguggacgccuacauggcuauuguucggauccacggcaaaaaggaggauaaauauaagguggucggggugccuaugcgcgcgguggccgaccugaaaaaggcugaaagcaagggaagagauaacuaccucaaugccguccaugagguucugaaaccccaauuuaccaagaaaaagaaagaccggaagacaggcgaaaucacggagaugauggaugacuucgacgugcuccuggggaagguguauuaccgccagcuuauugucgauggaaacaaaaaguuuaugcuggggucuuccaccuaucaguacaaugccaaacagcucgugcugagcgacaaggcuaugcaaguucugucuaaagaugacaaacuuaagaaccaggaugagaaucagaaccugaucgacguguaugaugaaauucucgagaaggucgaccaauacuucgaacuguacgauaucaacaaguucagacagaaacuccacgacgggcggaagaaauuuauugagcugccuguggauaaugacuucaacggcaagaaacuuaucagcuauggaaagcgcgccacaaucauuuccauccugaauggccuccacgcgaacgcuaccaugagcaaucugaaguaccuggggauuucuucccccuuuggaaugcuucagguuccgaacggcaucauucugagcccugccuccagaaucugcuaucagucucccacaggccucuucgaacggaaagugaagcugagcgaccucuga

SEQ ID NO: 4062 - RNA, 3738 nt, Artificial Sequence
  Cas9 variant
augaucauuuacuucaucuuugagaagauugugaacaccauccuggucaugaaaaagauuguuggccucgaccuggggacaaauagcaucggaugggcccuuaucaacgcuuauauugaugaauacaauaaagagcaccuguauggcaucgaagccugcggguccagaauuauccccauggacgcggcuauucucggaaacuucgauaagggcaauucuaucagccagacggccgaccggaccuccuaccgcgggauuagacggcugcgcgagagacaucuucugcggcgcgaaagacuccaccggauccuggaucugcucggauuucugccuaaacauuauucugacagccuuaaccgcuacggcaaguuccugaaugauaucgaguguaagcucccgugggugaaagacgagacaggcuccuauaaguuuauuuuccaagaaucuuuuaaagagaugcuggccgauuucaccgaacaccaucccaaacuuaucgcuaacaauaagaaggugccuuacgacuggacaauuuacuaucugagaaagaaagcccucacccagaagaucagcaaagaggagcuggcuuggauucugcucaacuuuaaucagaagcggggguacuaucagcugcgcggagaagaggaagagacacccaacaaacuugucgaauacuauucccugaagguggagaaaguugaggauagcggcgaaagaaaggggaaggacaccugguacaaugugcaccucgagaacggaaugaucuaucggcgcacgucuaauaucccucuggauugggaaggcaaaaccaaggaguucauugucacaaccgaccuugaagccgacgggucccccaaaaaggauaaagagggaaacaucaagcggagcuuucgggcgccuaaggacgaugacuggacacugauuaaaaagaaaaccgaggccgauaucgacaagauuaaaaugacggugggcgcuuacaucuacgauacacuccugcaaaagccggaccagaagaucagaggcaaacugguucgcaccauugaacggaaguauuacaaaaacgagcucuaucagauccugaagacacagucugaguuccacgaagaacuuagagauaaacaacuguacauugccugccucaaugagcuguaucccaacaaugagccucgccggaacuccaucagcaccagagacuuuugucaucuuuucauugaagauaucauuuucuaccagcgcccccugaagucuaagaaaucccucaucgacaauugcccuuaugaggaaaaccgguacaucgacaaggagagcggggagauuaaacacgcuuccaucaaguguauugccaaaucucauccccuguaccaggaauuuagacuguggcaguucaucgugaaucuccgcauuuaucggaaggagaccgaugucgacgugacacaagaacugcuuccgacggaggcggauuacgugacccuguuugaauggcucaacgagaaaaaggagaucgaccagaaggccuucuuuaaauauccucccuucggauuuaagaaaacaaccagcaauuacagauggaacuaugucgaagauaagccuuaccccugcaaugagacacacgcucagaucauuacccgccugggcaaagcccacauccccaaggcuuuccuguccaaggaaaaagaggaaacgcuuuggcauauucucuauagcaucgaggacaagcaagagauugaaaaagcccugcacucuuuugccaacaagaauaaccuguccgaggaguucaucgaacaguuuaaaaauuucccuccguuuaagaaggaauacgggagcuacucugcuaaagcgaucaagaaacuccugccccuuaugcggaugggaaaguauuggagcauugagaacaucgauaacggcacaagaauuagaaucaauaaaauuaucgacggggaguacgaugaaaacauccgcgagagaguucggcagaaggccauuaaucugaccgacaucacccauuucagagcucucccucuguggcuggccuguuaucuuguguacgaucgccacuccgaagugaaggacauugucaaauggaagacacccaaagauaucgaccucuaucugaagucuuucaaacagcauagccugcggaacccuauuguggagcaaguuaucaccgagacacucagaacggugcgcgacauuuggcagcaggucggacacaucgaugaaauccacauugagcugggcagagaaaugaagaaucccgccgacaaacgggcucgcaugucccagcaaaugaucaagaacgagaauaccaaccuuagaauuaaggcccugcucacagaauuucugaauccggaguucggcaucgagaacgugcggccuuacagccccucucagcaggaucugcuucgcauuuaugaagaggggguucucaauuccauccuggaacugccugaggacaucggaauuauccucggcaaauuuaaccagaccgauacacugaagagacccacccggagcgaaauucuucgcuacaaacuguggcucgagcaaaaguacagaucuccuuauacgggggagaugaucccccuguccaaacuguucaccccggcguacgaaauugagcauaucaucccucagagccgguauuuugacgauucccuuucuaauaaggugauuugcgaaagcgagaucaacaagcucaaagaccgcucccugggauacgaguucauuaagaaucaccauggcgaaaaagucgagcuggcuuuugauaagcccguggaaguccucucuguggaggccuaugaaaaacugguucacgagagcuacucccacaacagaagcaagaugaagaaacuucugauggaggacauccccgaucaguucauugaacggcagcucaacgacucuagauauaucuccaagguggucaaaagccugcugucuaauauugugcgcgaggaaaacgagcaagaagccaucuccaagaauguuaucccuuguacagggggcauuaccgaucggcuuaaaaaggacuggggaaucaacgacguguggaauaagauuguccugccgagauuuauccgccucaacgagcugacagagagcacccgguucacgucuauuaauacaaacaauaccaugauccccagcaugccucucgaacugcagaaaggcuuuaacaagaaaagaaucgaucaucgccaccaugcuauggacgccauuaucauugcuugcgccaaucggaacaucgugaauuaccuuaacaauguguccgcgagcaagaacacaaaaauuaccagacgcgaucugcagacccuccugugucacaaggacaagacagauaacaaugggaacuacaaauggguuaucgacaagcccugggagacguucacccaagauacacugaccgcccuucagaaaaucacagucucuuuuaagcagaaucugcgggugauuaacaaaaccacgaaucauuaucagcacuacgaaaacggaaagaaaaucguguccaaucaaagcaagggcgacuccugggcuauuagaaagucuaugcacaaagagacaguccauggggaagugaaccuccggaugaucaagaccguuagccugaaugaggcccucaaaaagccucaggcuauuguggagauggaucugaaaaagaagauccuugccaugcuggaacucggauaugacaccaaacgcauuaagaacuacuucgaggaaaauaaagauacauggcaguga

SEQ ID NO: 4063 - RNA, 3741 nt, Artificial Sequence
  Cas9 variant
augagacugguguaccucgcccuggcucacaugaucaaguuccggggccauuuucuuuaugagggggaccugaaagccgaaaacaccgauguccaggcucucuucaaggacuuuguugaggaauacgauaaaacaauugaggaaagccaccuguccgagaucacgguggacgcucuuucuauucugaccgagaaggugagcaaauccucucgccucgaaaaucugaucgcccauuaucccacagagaagaagaacacccuguucggaaaucucauugcccugagccuuggccugcaagcuaacuuuaaaacaaauuuccagcucuccgaagaugccaagcugcaguuuucuaaagacaccuacgaggaggaucuugaagggcugcucggagaggucggcgacgaauaugcugaucuguucgugagcgccaagaaccuguacgacgcgauccuccuguccgggauccuuacaguugaugacaauagcaccaaagccccucugucugcuuccauggugaagagauauaaggagcacaaagaggagcucgccgcuuuuaagcgguucauuaaagagaagcugccgaaaaaguacgaagagaucuuuaaagaugacacgaagaacggauacgccggcuaugucggcgcggacaagaaacuucgcaagagaagcgggaaacuggccaccgaagaggaauuuuacaaguaugugaaaggcauucucaauaagguugagggagcugauuacuuucuggacaagaucgaucgggaggacuuccugcgcaaacagagaacauucgauaacgggucuauuccccaucaaauccaccuccaggaaaugcacgccauucugcggcgccagggagagcauuauccuuuucuuaaggaaaaucaggacaaaaucgagaagauccugaccuuccggauucccuacuaugugggcccucucgcuagaaaagggucccgcuuugccugggccgaauacaaggcugaugagaagaucacacccuggaacuucgacgauauucuggacaaagaaaagagcgcggaaaaauuuaucaccagaaugacgcuuaaugaucuguaccucccugaggaaaagguccugccgaaacacucuccccuguaugagacauucaccguguacaacgagcucacaaaggugaaguaugucaaugaacaaggagaggccaaauuuuucgacaccaacaugaagcaggaaauuuuugaccauguuuucaaagagaaccggaaggugaccaaagauaagcugcuuaauuaccugaacaaagaauuugaggaguuccgcaucgugaaucucacaggccuggacaaggaaaacaaggcuuuuaaugccucccugggcacguaucacgaucuuagaaaaauccucgacaagagcuuccuggaugacaaagucaacgagaagauuaucgaagauauuauccagacccugacacucuucgaggaccgggaaaugauuagacagcgccugcaaaaauacuccgauaucuuuaccacacagcagcuuaaggagcuggagcggagacacuauaccggguggggacgccucucuuacaagcugaucaauggcauucggaacaaagaaaauaagaaaacgauccuggacuaccuuauugaugacggguaugccaacagaaauuucaugcaacucaucaacgaugacgcucugagcuuuaaggaggaaauugcccgcgcgcagaucauuggagacguggaugacaucgcuaauguugugcaugaucugccuggcucccccgccaucaaaaaggggauucuccagagcgucaagaucguggacgagcugguuaaagugaugggacacaacccuacaaauauuaucauugaaauggcccgggagaaccagaccaccgauaagggcagacgcaacucucaacagcggcuuaaacugcuccaggacucccugaagaaucuggauaaccccgucaauaucaaaaacguggagaaucagcaacuucagaacgacagacucuuccuguacuauauccagaauggcaaggauauguacacaggggaaacccuggacauuaacaaucucagccaguaugauaucgaccauauuaucccgcaagcguuuauuaaggauaacucucuggacaaucgcguccuuacacggagcgacaaaaacagaggaaaguccgaugacgugccuucuaucgagguugugcacgaaaugaaauccuucuggagcaagcugcucagcgucaaacugaucacgcagcggaaguuugauaaucugaccaaagccgagcgcggcgggcuuacagagaacgacaaggcuggauucauuaagagacagcucguggaaacccggcagaucacaaaacauguugcccaagugcuggaugcgagauuuaaugccaagcacgacgagaacaaaaaggucauucgcgaugugaaaaucauuacccugaagucuaaccucgugucccaguuccggaaggacuuuaaauucuacaagguuagagaaaucaaugauuaucaccaugcucacgacgccuaccugaacgcugucaucggcacggcccuucugaaaaaguaccccaaacucgcgagcgaguuuguguauggggaguucaagaaguacgaugugcgcaaauucauugccaagucugacaaagaaaucggcaaggcuaccgccaaauauuucuucuacuccaaucugaugaacuuuuucaagaaggaggucaaauuugcugacggaacagugguugaaagaccugauauugagaccagcgaagacggcgagaucgccuggaauaagcagacagauuucaaaauugugcggaagguccuguccuauccccaagugaacaucguuaaaaagaccgaagugcagacgcaugggcuugaccgcggaaagcccagaggccuguuuaaugccaacccuucuccgaaacccaagccugauagcuccgagaaucucgucgggauuaaacggaaccuggaccccaagaaauacggaggcuaugcugggaucucuaauagcuacgcggugcucguuaaggccaucauugagaaaggcgugaagaagaaagaaacaaugguccuggaguuccagggaaucuccauucuugaucgcaucaccuuugaaaaggacaaaagagcuuuccugcucggcaagggguacaaagauauuaagaagaucaucgagcugccuaaauauagccuguuugaacuuaaggacggaucucggcgcaugcuggccuccauucucagcacaaacaauaaaagaggcgagauccacaaggggaacgagcuguucgugccccagaaauucaccacccuccuguaccacgccaagcggauuaauaacccgaucaacaaggaucauauugaauaugugaaaaagcaccgcgacgauuuuaaagagcuucugaauuacguccucgaguucaacgaaaaguauguuggagcuacaaagaauggcgagagacugaaagaagccguggcggacuuugacucuaaguccaacgaggaaaucugcacgagcuuccugggggcugucaauucuaaaaacgccggccuuuuugagcugaccagccucggauccgccagcgauuucgaauuucugggcgugaagaucccucgguacagagacuauacacccucuucccuccugaaagauagcauucuuauccaucaauccauuaccgggcuguacgagacacgcaucgaccugucuaagcucggagaggauuga

SEQ ID NO: 4064 - RNA, 3747 nt, Artificial Sequence
  Cas9 variant
augaagaaaauccugggccucgaccuggggagcgccuccauuggaugggcugugaucaccgagaacgucgaaaauggcauuacaaagugcgauauccuugggaugggaucuagaauuauccccuacgagggcacggaagggaaagacuucaccaagggaacaggcgagagccggaacucccugcgcaccaaagccaagacagcgagaaagggcuaugaucgguaccagcuccgcagaaaauaucugguugacacccuuaucaagaaucaaauguacccugaugaagcuacacggaaccugccgaaaaugaagcucugggagcugcgcgacaaagccgugcacucucccgugagccugauggagcucgggagacugcuucuguggcucaaucagaagcggggauauaaguccucucgcagcgaugccaaccugggcaaaaaggacaccgaauacgucgcuacggugaaauccagacaugagaagaugaaagaacuugauguuaccauugggcaguauuuuuaccgggagcugagcgccaaugaguucuuuaaggugaaagaaaacaucuucccucgcgaggcuuacauugaagaguuugacgccaucuguaagacacagcaaauugcgcaccccaugauccucagaucugaacugauugauaagauccggaaugaggucaucuauuaccagcgcccucugaaaucccagaagggacucgugagcguuugcgaguucgaaggcuuuuggagaauugggaaagacggaaaggaguauuucgugggccccaaagucgccccuaagucuuccccgcuguuucagcuugcuaagaugugggaaaacaucaauaacauuaaaaucggcagccggaccggggaggaucugaagcucacaaccgaacaaaaaugggccauuuuccagcaucuggacaauaacgagaaacuuacgcccacagaccugcucaaaauccugaaucugaagaaggagaacuguuacgugaacaaacagaugggaaagggccucaaugggaacaucaccaaacacgcuauucugcagugccuuggaggcucugauaaguaugaaaaucugcucaaacuggagcuuaagaugguggacggggauaaggaaggauaccuguaugacagaaaaacaggcgagguccucaacuccaagaugaucaaauuuauugauccuaugguugaacaagagcccuucuaccagcuguggcauaucauuuacagcauccacgaccaggaggaauguucccgcgugcugcaagccaaguuugauaucgagcagccuauugcggacaaacucgccgcuaucgauuucucuaagcacgccuucggcagcaaauccgcuaaggugauucggaagauccugcccuaucuuauggacggggauggauacagcgaagccaugucuuaugccggcuacgaccauuccaauagccagaccaaagaggagaaccugcagagaaagcuccuggaccugcuuaaaccgauuccuaaaaauucucuccgccaacccaucgucgaaaagauucugaaccagauggugaauguugugaacgcuaucaucgagaaguaugggaauccugaugaaauucgggucgagcuggcgagagaacucaagcagagcaaggaggagcgcaacgacgccgauaaggcuauguccaaacggcagagagaaaaugacgccaucaccaagcgccuggaggaauuuggacuucgggccacaagaaacaauauuaucaaauggcgccuguacgaggaaauugauaaccaagagaagaagcucaacgcuaugugcguguauuguggccagcccaucucucugacggaggcccugcgggggaaugacguugauaucgaacacauuauccccaaaagcaaacuuuucgacgauucccagagcaacaagacccucgcgcauagacacugcaauaagaacaaaaaugaccugacagcuuacgauuuuaugaagggcaagccugaggccguguucaacgaauacgucgagcgggugaaucugcucuaugacaaccacauuauccgcaaagccaagagagauaaacugcuuaugaccgaaucuaagauuccggacaauuuuaucgaccggcagcugagagagucccaauacaucgcuaaaaaggcccgcgagauucuccagacaaucugucaugaugucuggagcaccucuggaacggugacagcugaacugcggcaccuguggggcugggacgauguuaccaugaaccuucagauggccaaauauagagagcucgggcugacccaucagguggaaugggaguccgagcacggaaagaauaagcaugaaaaagaggucauuacagacuggaccaagcgcgaugaccacagacaccaugcgguggaugcccugacaaucgcuugcacgaaacaaggcuucauucagcgguuuaacacccucagcgccgcuaagacacgcgaagacaugauguucgauaucgagcagagaucccacgaauuuaaagagaagcggucucugcuugagaaguacaucauuagcgaacaaccccugaaaguugacgagguggaaaaggccgucuccaauauccucauuucuuucaaaagcgggaagaaaguggcgguguggggaacccgcaagaucggcaagagaggguccaaaaagguuauucagaaaaagaucauugucccucggggcagccugucugaggaauccguguauggaaaaaucaagaagcaggaggagaaagauuacaaguaucuguuugaaaacccccagcuuaucuucaauccuacaauuaaagccaagguggaggaacgccuccugauguuugacggcgaugucaaaaaggcuaucaccagccugaagaaaauucccaucuaccucgacaacaacaagacggugguucuggagaaagccauuugucuuaaggacgaguucgugaucaaauacucugucgauaucaauuucaacaagguggacaaaguuguggauccgaagauuaaggaaauccugcaaaauagacucaaaaaguuugggggaaaagagaaggaggcuuucaaagacguccagcuggaagauaagaugauuaucaagugguaugaagacgagggccuggagcggccuauuaaauccgugcgcugcuuuaccgggcuuagcgccguugugcccgucaagaaagaugaaaacggaaaugacaucggcuucgugaagccugggaacaaucaucacaucgccauuuacacagauaccgaggaaaacaaacagcagcacgugugcacauuuuggcaugcugucgagagaaagaaguaugacauccccguuauuaucaaaaauaccaacgaagugugggauaagauucaaucucagccugacggcacguaccccgacagcuuccuggagaugcucccgccucccaaucugaaccuccuggugaauaugcagcagaacgagauguuuauccuuggaacaaccacagaagauauuaaacuggcgaucgacaagcgggauuauaaaaucauuggcgacaagcucuacagacugcaaaagauguccaucaaacccagcucugggcagauugauaucgucuuccgccaccaucuggagacccagcuuauugacgaugaaaauuccaagaaaagcaagcgguuuuauaacgugcaaucccugggagcccucuucgcucugaacccuuuuaaaguuagaaucgacaaucucggcaaccuggugaaggagaaauga

SEQ ID NO: 4065 - RNA, 3762 nt, Artificial Sequence
  Cas9 variant
augaaggccagaggcaacuuccugcaccaggacacccccgggcucacagcugccaaugcgaacaugggagaugcuguggagaaacugugcgucgcccuugaagacugguguacgcugcggaaucucgagugcaacauccgcaagaaucagaaaaacauucaaaaucugcuugaaggcaagaccguugaggugagcgccgaaaacgcucugaaagaguccuuugauucuagcagagccucccggaaggacaaggcuacaauccucucuaccuggauugccauccagccuggggaguaccuggaugcgaaacaggccaaggacgcuagcaaagaaauugccaaugugcuguucggacuccaaggcaacaugaagaaaaucuuuaucgaguucgaagaggaucagaagauucgccuggacaaugaugagcaggucgaggcuuuuuauucccuuuguccggacgaugggguggcccuguucgaaucuuuucagagcaucuacuccgcguauauucucaugggaauccugaagaacgccaauggcggcagcauuucuuccugcaaaguugcugccuacgaccaauauaaggaagaucuuaaacugcucaaggaccuggugagagaguucgcuagcgaaaaauacgacgaguuuuuccggggagauaucuuugacucuuccaagggauuccgcgccagaaacuauaaucccgccacagcuaaaggcuacaccaaguacaacagcgucagaggggcgucuuaugaugacuuuaagaaagagguggaaaagauuuucaaaggaacaguugccgaggaagauauccgcuacguggacaugaugcagagauucgcugagggcaccuuucugcggcgccucaagacguccgauaacgggagcaucccuuaucagcugcaucuugaagagauggacgccauugucgagaaucagaaacaauucuaccccuuucuggaauccgagaaggaaaagcucgagucucuggugaccuucagaaucagcuauuacgugggaccucuuacacagaaaaacgcccggcuggauaaucacaacaaugcucgcuuugccuggucccagagaaaggaaggcaaagagcaugcgcgggucuaucccuggaacugggaggaaguuauugacagaaagcaaagcgcugccaaauucauggagcgccucaccggcacauguaccuacauccuggaugaaccugugcugccgcggugcucucuccuguacgaggaguauugucuucugaaugaacucaacggguccaaguggagagacaugggaggcgacuggcaccgcuuugauuacgagacgcggauggaaauuaucgagaaucuguucaagaaaaagaaagggagcgugaaguaugccgcugucgaagacuggcuuaaaugcgagaagcauaagucuugugccgaggugaaaggaggccagggggaaacaggauuugagagcaagcuguccucuuacguuuucuuuaaagaagugcuccacgucgaugagaucgacgaagcugauauucccaugaucgaggagcugauuugguggaacacccuguucgaagacagaagcauccucaaggaguccauugaagauaaauauggcgaccgccugacagaugaccagaucaaggccaucugcaaaaagcgguuuaccggcugggggagacuuagcaaggagcugcucuguggaauuaaaacccacacagauaauggcccuuacucuaucauggacgugcugcgcgaagggaaccccaauaacaaugcgcgguccgagacgaugguuuucauggagauucugagagaugacaaguucggauuugacaaacuuaucgaagaggaaaacaugcgccgggugagcgaggucgauaacuucgacgugaaugaucucccuggcucucccgccgucagacggaccgugaaccaggcuaagcgcauuguugacgagaucguggggauugccggcugcgaaccgcaaaauaucuuuaucgaggucacaagagaugaagacggacggaacaaaggcagacgcaccaagcggagauaugauaauauuaagaacgcuaucgccgcgcugaaaaaggagcagaaagaauacuucaauaaggacguguccgauagccugaacaaaacaaauccuuccgaccucgauaacgagcgccuggcccuuuacuuuaugcagaaugggaagugcauguauuguggaaaggaccuggauauuaaacagcucgacaaguaccaaguugaccauauccugccccagucuuaugugaaagaugacagcuucgagaacaaggcucugguccacauggaagauaaucagagaaaauccgccucuaugcuucucgacgauagcauuauccggaagaugaagccuuacugggaggcucugcgcgccgccggccugaucggggagaaaaaguuuaaaaaccucaccagagugcggguguccgacaaggaacugggaggcuucauugcucgccagaugguugaaacgagccaaucuaugaaacuuacaucccugguccucgagaagaccuaucccaauaccaacgugagacccgugaaagcgggguuuagcucugaucugcggaagcgccuggaccuuaucaagugcagagagauuaacgauuaccaucacgcccacgacgcuuaucucgccugugaaaucggccaguucauuacaaugcggcauaauaaacuguacgagaacccuaucuccuacagccacgccgucaaggauuuuaucgcuaaacgcgccaaguaugcgaaugaccauggaaccccgaugucuacauacggcaugcccgggagcuccagcuucgugauuucuuccuuucugacgagcggauucgacgaagagaccggcgaaaucuucaaagaugcuugguccgccgagguugccgcugugcggauucgggagucucucaacagaaaggacugcuauaucagccgcaugccugaagagacauccggggccuuuuggaaggaaacccugauuucuccccgggauccuagccuugggaaaaaucugucccuccccaucaagaaaggccuggacccgagaaaguacgggggcuauaacgagcagaaauucgcguacuuuuucgucuaugaggcugugaagaucaagaaaaagggagaaguuaaagaguacguguuugccgccgucccugugcagguugcugccauuguggcucgcgaucccaaugcccugacaggcuucgcgaagaaagacgccgaagcucggaagaucaaguuucuuagaauuauccgcgagaaagucuacaaguaucaacucauugaagugaacggggagcggcuguacaucaccggacugaaaucugugagaaaugcccgccagauugcucucagccaggauaugacgaccgucuuccugaaggccaucaacgacaaagauguugccgaggacgaacuuaagucccuguuugaggaaaucgugcaacgguauagacucugugcuaaucggcugggcaaccagcugaagauuuucagccuuucugauuccuuuaauagcgcgaacucugaguccaaaaagcgcgcccuggugagccucgucgcuaucauugacgccaaaacaaauaagaucgaucugucugggauuggauccggcaaagccguggggaacaugagacucagcuucuccaaggaaaugagcaacucuaaaaaucacuucgcuuuuaucgaccagagcguuaccggcauguucgagcggaagacauaccuguga

SEQ ID NO: 4066 - RNA, 3777 nt, Artificial Sequence
  Cas9 variant
augaccgaggaaaaccccgacaucagaaagguguuccuggccauucaccauauccucaaaaaucggggccacuuucugcuucaggggcaauccuucaaggagggaaaccugaauaaccucauuaaagaacugcuuaaucuggauauccuccauauuuccaucgagaucacagaagagaacauuaauaagaucacggagauugcucuggagaaaaagacccugacagacaaggucaacgaucucaaaaagaucuacccuaaagagaagcagcugcuugaagccuuucgccugauuuucggcgggaaaaccucucucgacaagcuguuugcgaucgaugaguauaaggagcuugacgcuagcguuaaauccgugucuuucaaggagaaaauuuacgaagaagugagacacgauuaugagcagguccugagcaauuacaucgaacuccuggaccuggccaagcucguguaugauuccaucauucugucugacaucaaaaaggagggaaaaacacuuagcgaguccaagguugaacuguaccauaagcaccgggaggaucucaccaaacugaagacacuugugaaaaacgacagcaagcugucugaagauaaaaaggucgagcucuauuccgccauuuuuaaggaagacaaagacaagggcaccaauuacgugaacuacauccgcaaaagcgaggaggggaagggaugcaauuaugaagauuucaaaaaguuucugguuaaggagcuggcuaaacucgaagagucuuccgccaaggaagagauucugagagaccuugagcuggaacucuuccugccgcuucagcggacgaaagauaacagcgugguccccuaccaaauccacaaggaggaacuggugaaaauccucgacaaugcugccaaguaucauaaguuucugaacgagaaagaugacucuggcuacuccauuaucgagaaggugauucagcugcucgaguuccgcaucccuuauuacgucggcccccugaacagcuccaaaaaggcgaaaguugauggguuugccuggucugugagaaauaagggauaugaaaacaccccugugacacccuggaauuacgaaaaagucauugacgagagcgcuuccgccgaaaaguucaucaccaaccuuacaaauaaguguaccuaccugaaaggcgaggaugugcucccuaagagcucucugcuguauuccgaguucgcccuucucaacgaacugaaugcucugaaauacgacgggaaccggaucagccucgaggcgcgcaauguuauuaucgaaaagcuguuuaaagagcagggaaagaaggugacgaaaacaucuauuaagaaccuucugaaagccgaaggcuauaucgaugggaagggagagauuaccggcaucgacauuacagucaaaaaugaccucaagagcuacagagauuucaagaaaauccugggcgacaaguuuaacaccgagcacguggaaaauaucauucuguggaucacccuuuauggggagucccggaaacucauuaaggcuaaaaucgaagccguuuacggagauauuuauucuaaggaggaaaucgcuaagaugagccgccugguguacaaagacuggggcagauucucccggaagcugcucacagagcuggucagcaaaaagcuguacaacgaggaaacgggggagugccuuaauaucauuggagccaugcgccagaacaacauccucuuuauggaacugcuggccgauagauucgacuauucucaacagauuaucgauuacaauaaagagcuucagaaggaggugaccgaaauuacaccggagauccucgacgaucuguaugucucccccagcgugaaacggucuaucuggcagaccguuagaauuguggaagaacugaagaagaucauuggcugugcuccugcgaaaaucuuugucgaaacaacccgcuccaaccaagacaagaaaaagcccacggauagccggaaaaagcagcucgagcuguucuacaaggccgugaaaaaggacguuaaagaucuugagaaggaaauugggucccugaauuuugacaaacucaacgagagacugucuagcguggaaccuuccaagcugaaggcuaaaaagcucuaucuuuacuauacacagcugggacgcugcauguacucuggcgagaccaucgacaucacccaacugaauacaaccgccuacgauauugaccauaucuauccccagagcaaagucaaggaugacuccuucacaaacacggugcucgugaaacgggaauacaaugccgcuaagaccgauagauauccgcugggcagcgacauucagacaccuucuaaccgccgguuuuggaaguuccuuaaagagaaggggcugaucaccgaugagaaauacaauagacucguucgcacagaagaguuuuccgacgaggaacugaccggauucauugcccggcagcuggucgaaacgagccaaucugugaaggcgguggcuggcauccuuggggagcugaaccccaaaaccuccauuuguuauagcaaggccgagaaugucucuagcuucagacagaacuuuggaaagaucaaagaaggcaaucgcaaguccgauaacacagagcagcucaucaaagugcgggaaauuaaugacuaccaccacgccaaggaugcuuaucugaacguuguggucgggaacguguacgacaccaaauucacaagaaauguuuuuaacuucaucaaggauaaaaaggacggccggaaguacagccucaauaacguguuuuaugagaaugucucuaacuccaauaacguggccugggagcugaauaaaaccguucaucagguggaaaaggucaugaacaauaacaauauucuugugacgcgcagaacaagcgagcaaaaaggaggccuguucgacgcuaccguguacaaggccaaagucgcggccaaggcuaaggaagggguuuauuacccucucaaaacauccgaucccguggugaacgacgucaccaaguauggaggcuuuaccaaagugaagaucgccuacuauucuauuuucgaguacacacugguuaauaaaaagggggaagagaagaucacgcggaucauucccaucccuauuuacgugagccagaacaucaaagaugacuccacccugcuugaguuuggaaagacacagauuaacaucaaaucuggcgaagaggucaaggauuucaaacugaaguauagaaagcucugcaucggggaccuggugaaaauuaauaacuuuuucaauuuuaucggcggaaagaccaacgauagcuucguuuacgacggcgcugugcaggucacacucgauaccgaauccgagcgcuauauuaaaacgcugucuaaguaccaaaauuggaaaaaggaaaacaaagacggggagcuuugggagagcaucacaaaggaaaagaauaccgagcuguauaaccuccugguggagaaaaugaauagcggaauuuucaucaagaaaaagccgaacaaauuuaaugaacugaacagcgaagagauucggaauaacuucucuuccaucagccuugaggaacaggccaagguucugcucgaggugcugaaucuccugaccaacaagaaaucuaucuuugaucuuaaguccauuaauaucacagcggccagaggcaaaauuagcuucaaccugucuaaccugucccaguuuagcaucauugaacaguccgucgcuggguucuacgagaaggagaucaccaucauuggagacaaagaaaaugacauggagaacaauaacuguuga

SEQ ID NO: 4067 - RNA, 3780 nt, Artificial Sequence
  Cas9 variant
augaaguacauccugggccucgaccuggggguggccagcauuggaugggcugucaccgagaucaacgaaaaaggcgagcccguugggcuuauugaugccaauuccgugaucuucaagccucuggacaacgauaaaggaaagcucuauaauguggaaagacgggacaaacgcggcucuagacggauucugcgcagaaagaagcaccgggucgagcgcacaaaaaugcuucuggugaacagcuccuuucucacgaaugaagagaucgauaaccuguacguugggaagcuggacaauaucuaugaggugagacucaaaggacugaaggaacagcuuucuaaaaacgagauugcgcggcugaugaucuacuauugcaagaaucgcggcuucaagagcaacagaaaaaccgaagaucucgagauucugaagucccuuggcgagaaaaucucugaaaaggacagcgaugagaaaaagcugaaaccgauuaucgcuaagaauacagaacucauugaguccaaggggcugacccccaucgaagucaucuacaugauucgggagaacgacaauagcauccugggauuuaaaaacaaggagggcaauuauaaauucggguuuaagcgcaaccaagugauugaugaaguuagaaaaauccucggaacacagcagauucugucuaaggagaucguggacgaauacaucgauauucuuuccagccagcgggacuucucugacggcccugggggagauuccaaguacaaaaucgacuauaccaagcuggccggcaaauguaaguacacaggcgagguccgcgccgugaaaagcgcucccucuuaugaaauuuuuaccaugcuccaaaagcugaacgauaucagauacgugaaguucacguccgaggacaaaauugagaagaaaaagcugagcaaagaagucauccauaagcuguaugaucucguuguggagaagaauaaaacccugacauacgaccugaucgaaaaguccauugaugaggaaaacaucaaacuccugaauauuccuaaacuuucuaagagcaaguauguggagcugcggaaauccuacuuuaaggagagaaacgacaaugaaaaccucaccgaggaagagaucaaugccuucaacgagaagcugaauaacgaacgcaugaaacaggagcuuauucggaauaaccugaaggcuuacaaagaacucaagagcaaauuuaagaagaauaacaucgaugagaauagaauuaaagaacuugggggaaucuauuuccuggaccucgucgccgagcugcuuacauacucuaagaccgaugagaaacuggaauauuuuguggagaacguugaacgcuacucccucuucaaggagcagcgggacaucguggaaauuaucaaaacguuccccaacuauacaaagaauggcaaccugagccugucucuugucagagagcucaauaagcugcugauggaggggcacgacuacgaaagcucccucucuagccugaacuauuacauugauaccgacguggauugggagaaauuuccuacaaucuccgaaauugaggacagccuuucuaccaagaucaccaauccgaacguuaaacauauccuggugauucuccgcaagcuguacaauacacugcuuuucaaauauggacggcccgaaaagguccaccucgagcuguccagagauuuuagcaacgacuucucuacgcgcaauaagauccagaaagagcaacuggaaaacaaggugcggagagaggucgcggccuuugaaauguacggcgcuaauaaagauauuguggccgggaaggaccgccucuccaacgaugacuucguucggaucaaacugugggaggagcagaauaaggugugcauguauagcggaagaaccauugaaaaauaccagcuuacauccgcugagguccagaucgaucauauccugccuuauucuaagagcuuugacaacuccuacucuaauaaggugcucguuuucagcaacgaaaaccaagauaaaaaggagcggacccccuaucaguggcugaaaggcacagaaaaguggaaugaguuuaaacagcgcgugagacugaaccuuaauauuuccaacaagaagaaagagaaucuccuguucgaagacgaggucgugaacaaugaauuucuggagcgggaacuccacgccaccagcuacucuuccagacuggcgcuuaacaucuuccaacgccugauuccugugagcgacgaggauaaguacgacgagcacggcaaugaaaaaguuaaguaucucuacaaccggaaugucaucgccuuucaggggaaaaugacgucuaugcugagaaaccuguauucccuuaauaaguacacacauagcuucgagucugauacccucgacauugauaacaaggcuuucauccugaaagaauuugagaucaauaaggacaaccugaaaaugaccgccuauaacgugaauacaggacucgaaauuaccagcgagacaaagguggagaaaaacaaguccggcgaguucaagacgaucaaagaugaacugcuuaagaaagaacuggacaagaaagagaaucucauugagaucagcgauuacuuuaaggacaagguccuguucgaucugaaaauuguggacuuugaagagaucgauaccguugaacccgagauuaucucuauccuuuauaagaugauuacagcucugaaagaagagguguacuccaagaaccgcgagaaucaccuccaucacagccuggacgccuuccuccugaccaucaugaacagauccaugcagaugaaacuuauuaaguacaaucagcugaucucuguccucaaaaacaaggaaauugagaucuuuaaugaagagaagggggaauauaucgacagcaaagaguucgccgaggaacugcaaaagcagaaaauuaucgauauugacggaaacgagcggggcaucaaguuuaaugugaacgggaaaacacaccgccugaaucuuguuaagccguacgaaaacuuccuggaugacauuaagaauaaaaucuuugauaagagagagaacaauaaacucccuuaucauguggucaaguccaaagugucuggcgcucugcacgcggaaaccauccucggagagagcaagggcgagauuacgaagcggaucuccguuuucgacauuaacuacaaaaaccuggggaagaucuuugauaaagacggaucucagaaggaaauuuaugagacccuugugaaauggcuggaagccaagagcaaggauuaccccaaacucaagaauggcaacaucauuaaaaaggucaaaaucguggacgggaauaaggauaaacugaucaagcugggaaacaagcgcuauguggagaugggcagaacaaccgucaaaauucuuguucugaagaaagaggcugaagaggggcucaaguucgccuccaucggccgguacaaauacaaucugcucaagagcgaaaaggacgugaacauuucuaucuggaaagacgccauucauuucuguaaggugcgcuauaauaaacugaaggagaacggauacagacuuauccacgaacugaucccuggcgagacaauugagcuggaacucaauaaagggaacaucuccaagugccuggucgugggauuuagcggcgggaagauugagaucucuuccguuauuggagaugcucuugaccugaucaaugauaaaaucagcacccggauuaaggaacgcuauuacaucacggugucuacaauuaaauccaucaagaaaauuaacaagaauauccucggcgacuga

SEQ ID NO: 4068 - RNA, 3792 nt, Artificial Sequence
  Cas9 variant
augcacaagaacaaucccgacaucagagagcuguuccucgccauucaucacauccugaaauaccggggccauuuucuuuucgcugggcagcaauuuaagggaagcgaaauuaaagauaacauccgcgagcugcuccaguauaauucccugaacauuaagaucgacaucaccgaugaacuuauuaauaacaucgccgagauucugcucaaaaagaaaaauucuacagacaaaaucauugaauuuaagaaacuguuugcggaugagaagcagcugaucgaggcucucagacuggcccuuggcaacaaaacgcagcuggccaaacucuucgacauugaggcuuacaaggaacuggauaucagcaucaagaccauuuccuuuaaggaaaagaucuaugaggacgugcggucuaauuacgaggaaauucuuggggaguauaucauuguccuggauacagccaagcucaucuacgacgcuaucauucugagcgaaaucaaaauuaagaacaugaccaucuccgagucuaaaguuauuagcuaugaaaagcacggaaaggaucugaaacaacucaagcagcugaucaaagaggacuccaagcugagcaaaaaggagaagcgccagcuguucgaaaauaucuuugugaaagaggaugaaaaggaggccaacuacgugaauuacauuggcaaaaacaaugucgggucuuccaagagcucuugcuccuaugaagacuucaaaaagagccucaucaaggagcugaaauacugugaggaaucuaaacuuaagcaggacauucuggcggagcucgaacuggagacauuucugccuagacaacggaccaaggauaacuccgugaucccguaucagauucauaaagaggaacucgagaagauccugaacaaugccguucaguaccaccccuuccuuaacaauacagacgaauauggaauuagcaucaaggagaaaaucauucagcugcucgaauuucgcaucccuuacuaugugggcucccugaacaccucucacaaggucggcaaugggggauucagcugguccgugagaaacaaaggcuacgagcggacggcuguuacccccuggaauuucaacaaggugauuaauaaagaggaaagcgccaagaacuuuaucgagaaucuuacaaaccaaugcaccuaccugcucuaugaagauguccugccuaaacauucucugcucuacuccgaguucacacugcuuaaugaacugaacagcauuaauuaugggggaaagcgccucaccguggagcacagaaaccugaucaucgagcgguuuuucaagcagucugcucccaaagccacgggcaaggaacugaaaaaguuucuuaugagcgagggggugauugacggaaaagaugaacucuccggcuucgacaucucuauuaagaacgaucuuaagagcuaccgcgacuuuaaaaagauccugggcgagaaauucgauuccgaaaaggucgagaaaaugauuagauggaucacacucuuuggggagagcaagcagcugcuuguugacaagaucaccaaagaauauggagauauuuacucuuccgaggaaaucaagaaaauuagcggccugacauauaaggacugggggcggcucucugagaaacugcugaccgaaaucguguccagccaacuuuacgacgaguccaccggagaguguuucaauauuaucaacgcgaugcgcaauaacacacuccuguuuaucgaacugcucggcacgaauuacgauuauuucgagaagauuaacaccuacaaugggaagcugagaaaagaaaucacagagauuaccccucauauccuugacgaucuguaugugucuccggccgucaagcggagcauuuggcaagugguuagaaucguggaggaacucaaaaaggucauuggauccgagcccaaacgcaucuuuguggaaacaacccggucuaacaaggagaaaaagggcgacgauggcagaaaggacagccgcaaaaaggcucugcuggaacuuuacaaaaagaucaaaacguccgauauugccgagcucgagaaggcucuggggcacacaguugacuucgauaagaaaaagcaggaccugaccgauaucgacaauaacaaacucaaggcccggaaacuguaucuuuacuauacccagcugggaagaugccucuacacaggcaaggccauugaucugaauaaccuguucgggagcaauucugaauacgacaucgaccacauuuauccucaguccaagaccaaagauggaagcuggaacaaucuugugcucgucaacaagacagagaacucuaaaaaguccaauggccugaucagcgaaucuauccagcgcaaaaacaagcauuuuuggcgguuccugaaggcuaaaaaucucauuagcgaggaaaaguacaaaagacugacgcgcaccgaggacuuuacagauggggagcuuuccggcuucaucgcgcggcagcugauugaaaccagccagucugugaaggucguguccaaaauccuccaaaaccugaaucccacaaccgagcuguguuuuagcaaggccgaaaacguuuccgacuucagacaggaguuuggaaagauuaaagugggcaagcgcaaaaaucuuacggaagaggagcagaagaaagcuaaggaagggcagcugaucaaaguccgggaucucaacgaccugcaccaugccaaggaugccuaucucaauaucgugguuggaaacguguaccacauuaaguucaccagaaauccuaaaaacuuuauccggaagaauuucaaaaaccgcgaguauacacugaauacccuuuucuacucugacaaggucgaaagaaacggcgagguggcuugggagaaagggaagacagaagagauugugagcuccguuaugugcaacaaucugaucaacgucacccggagaacgucugaacaaaagggagcccucuaugaggcgacaauuuacaaagcuaaugccgccaaggaaggcagcuacuaucccgugaaaaccaacaauaagaaccugaaaaaugugacacgcuacgggggcuucaccuccaucaagauugcuuauuacucuaucuuuaaguaugauauccggaacaaagacaaggucaaagagaauauuaagaucauuccgaucccuauuuacaucagccagaacaucaaaaccgaucuggaccuuauuaauuucgccgagaagcagaucaagcugaaaaagggagaaaacauugagaaucuccagcugaucuauaaaaagcucaacauuggcgcucuggugaaaaucgaucauuaccccuacuauaucgggggaaagacagacgacaauuucuacguugauggcgccgugcaaguccuucuguccagcgacauugaaagauaucucaaagaggugguuaaguuugugaacuuccagcgcgaaaauaaggaggcgaaagucucuaaggagcacaucucccuggaagagaacauuaaacuguacaacacgcuuguguguaagauggccaccaaaaucuuuacacacaagaagaauaacaaauauaaugaucugacccaggacaaggcuaaaaacacauucaauaagcucagccuggaggaacaaugcaaaguucuccuggaaauucuuaaccugcugaccaauaagaagacgacauuugaucucucucugaucaacgagaaaaccuccagagugaaguguggguucaaucuucugaaccagaaacaguuuagcauuaucgagcagucugucaccggacucuacgaaaaggagaucaaaauuaucgaagacuga

SEQ ID NO: 4069 - RNA, 3795 nt, Artificial Sequence
  Cas9 variant
augaagaacgugcugggccucgaccuggggaccaauagcaucggaugggcccuuauugaggucgaugaaaacaaucugcccaucagaauuaucgcuaugggcucccggauuaucccucucucuacaagcgacaaagaggaguuccagcgcgggcuguccaucacgaagaaccaaucuagaaccguuagccggacacagcgcaaaggauacgauagaaagcagcuuaaaaaguccgaccugaagaaaauucucaauaaguauaacaucuuuccgucugaggaacugcugcggcuccccaugcuggaucuuuggaaacugcgcagcgacuccgccaauccugaugagaacauuagcgcggagcagcucggcagaauccuguacaugcuuaaucaaaagcggggguauaaaucugcucgcuccgaagccaacgccgacaagaaggauagcgacuacgugcaggcugugaaaggaagauaugaucagcugaaggaccggaaacagaccauuggccaauacuucuaugaugagcucuacaaugccaacgcuaauaacucuuacuuucgcaucaaggaagaggucuaucccagagaggccuacauugaagaguucgacacaaucaucuccgcgcagcgggaaaaacacgacuuucugaccgaugaggugguucaucagcugcgcaaugaaauuaucuauuuccagagaaagcucaaaagccaaaagggccuggugucuauuugcgaguuugagggguucgaaaagacagucuuugacaaagagaagaacaaaaacaaggugguuuucgugggaccuaaagucgcccccaagaccuccccucuuuuucagcugugucggaucugggaaguggugaauacgauuacccucaagaucaaaaacccggagggcagcaaguacaaauggggagaaaagauccccgauauuaaagagaaggagauccuggcugacuaucuuuucaagaaugaaucccugucuuuuagcaaacuccuggagauucuggaacucaagaaagagaacgucuacguuaauaagcagauccugaaagggauuaagggcaacgaaacauauuccgcccuucacagcauccugggggauaaugagcuccugaacuucgacgugucuaucaugaccuccaaucaaacagcccuucugguggauagaaagaccggagagauucucgaggagcgcgcuggccuggaacuggacgcgagccucgagaaagagccucuguaccagcuuuggcauacgaucuacucucugaaggaucucgacgaaugcaaaaacgcccugauuaagcgguucgauuuugacgacgagacagcugaaaaacugagcagaaucgauuucaauaagcaggccuuuggcaacaaauccaauaagucuaugcgcaagauucuucccuuccucauggagggguaugacuacagccaguccagcucucuggcuggauauaaccacuccaauagccugaccaaaaacgaacgggagcaacagaucacacucgauagacuggagcuucugccuaagaacucucuccgccagcccauugucgagaaaauccugaaucagaugaucaacgugguuaaugccauucuggacgaauacggcaagccguccgaaauccggguggagcuugccagagaacucaaacaaagcaaggaugagcgcaacgagaccgaccugcaaaauuccaagaacaaaaagcugaaugaugaaauugggaaacggcucgaggaacugggacuuccugucaccaagagauauauccagaaauacaaguuuauuuuccccucucugagcaagaaccucaaagaggcuaaggugaauaaccaguguaucuauugcggcgaaacauuuaaucugacggaggcgcuguccggggacgccuacgauguugaccauaucgugccuaaagcccuucucuucgaugacucucagaccaacaagguccuggugcaccgcaaauguaauagcacaaagaccaaccagacagcuuacgauuauauugccaccaagggagacgagcaccugaaacucuacuccgaacggcuggacgauugguuugagagaggcaucauuagcuauucuaagaugcagcggcuuaaagucucccauaaggaauaccuggagcgcaaaaagcucggcaaagagacggaaacagacaagaagcugugggagaauuucaucgauagacagcugcgggacacccaauauauuagcagaaaaucucgcgaaauccuucagaagaucugcaacgaugugaaaaccacagaagggggaguuaccgcuaagcuccggaaccuguggggcugggacgaugugcugaugaaucuccagaugcccaaauacaaggaacuggggcaaacaauuacgaaggaguggaccuccgagcacggaaaaagaaagcaucagaaagaagagaucgacaacuggacaaagcgcgaugaccacagacaccaugccauugaugcgcuugucaucgcuuguaccaaacagggcuuuauucagcggaucaauacacugaacagcucugacaccaaggaucucaugaucaaggaaguggaggaagccaaaauugaguucaaugagaagacgacccugcuggaaaaauaucuuaagacacaaaaacccuuuagcacccaggagguuaugaaggaagccgacaagauccugguguccuucaaagcugggaagaaagucgccacaauuaccaaguucaaagcuacgggcaagaacaaggagacaggagugaucgugccucgcggcgcccuccacgaacagagcguuuacgggaaaauuaaggucaucgagaaagacaagccgcugaaauaccuccuggaaaauucugauaagauugugaaccccagaaucaaaaaucuuaucgaaauuaagcuguccgagaacaagaaugacccuaaaaaggcgcuccuggcccugaaaaagauccccauuuuucuugaugaggaacagagcaucacccuggagaaagcuagcugcuauaacgacgccacagugcucaaguacaagcugcaaaaucucaaagcugcccaggucgaugacauuguggaugaaaagguuaaaaagaucgugcgggagcgccugucucaguucggaaacaaagaaaaggaggcguuuaaggacacccuuugguucaaugaagagaaaaagaucccuauuaucaccgucagacuguuugcccggcccgaugcuaacaaccuccagacaauuaaaaaggacgagaauggcaacgggaucggauucgugguuacgggcaauaaccaucacauugccaucuaugaagauaaagacaauaagccggugcaacauagcuguaccuuuuggcacgcugucgagcgcaagaaauacaacaucccugccgugauuagagacuccucugaaguuuggaaugaucugcugcggaaggagcuucccgaauccuuccugaacaaacucccugccgacaaucugaaccucaaguuuuccaugcagcagaaugagauguucauccuggggcuuucucaagaugaguuugugaaagcuauugcgaacaaugacaagagccugcuguccaaacaccucuaucuggucuggagcaucucugaaaacaauuacugguuccgccaucaccuugagacaaagaacuccgaucugaagaaaaccgacggcgugaaggaaagcaaaagacucuauaauauucggucucugggaucccucuuuagccugaaccccaucaaggugagacuuaacuaccugggcgagauuacaaaaaucggggaauga

SEQ ID NO: 4070 - RNA, 3801 nt, Artificial Sequence
  Cas9 variant
auggccaaguacauccugggccucgaccuggggaccaacagcauuggaugggcucuuaucgagguggaugaaaauaacauucccaucagaauuaucgucaugggcucccggaucauuccucugucuagcaaugaccgcgaggaguuccagagagggcucuccaucacaaagaaccaaaaucggacgauuucucgcacccagagaaagggauaugaucggaaacagcugaagcgcaacgaccuuaauaaaguucugaacaaguacaauaucuuuccgagcaagaugcuccugaaccugcccaugcucgaucuguggaaacuuagauccgacucugccaauagcaacaaggauauuuccgcggaacagcugggccggauccucuauaugcugaaucaaaaacgcggguacaagagcgugagaucugaagcuaacuccgacaaaaaggauacagacuaugugcaggccgucaagggacgguacgcccagcuuaaagaucgcaaucagaccauuggccaauauuucuacgaggagcuguacaacgcuaacgugaauaacagcuauuuuaagaucaaagaagagguuuacccuagagaagccuauaucgaggaguucgacacaauuaucaauucucagaagaccaaacacgaauuucucacagaucaguucgugcaucagcugcggaacgagauuaucuacuuucaacgcaagcugaaaucccagaagggccucauuagcaucugcgaguucgaaggguuugaaaagaccgucuucgacaaagagaagaauaaacacaagaucguguuuguuggacccaaaguggcuccuagaucugcgccccuguuccagcuuugucgggucugggaggugauuaacacgaucuccauuaaggugaagaauccugaaggcagcaaauauaaguggggagagagaaucccguccauuaaagaaaaggagauccuggccgacuaccucuuuaaaaacgaaguccugucuuucaccaaacuucuggagauccucgggcugaauaagaacgauguuuaugugaauaaacaaauucugaagggcaucaaagggaacgagacauacgccacccucuacaauauucugggagaaaacgaguuccuuaauuuugacgugagcaucauucccuccaaccauacaagcaugcuggucgauaagaaaaccggcgaaauccucgaggaacgcgcuggccuggagcuugacgugucucuggagaagcagccuuucuaucagcucuggcacacgauuuacucccugaaggaucuggacgaaugcaaaaacgcccucaucaagcgguuugauuucgacgaugagacagcugaaaaucugagcagaaucgacuuuaacaaacaggccuucgggaauaagucuaacaaaagcaugcgcaagauucuucccuuucugauggagggauaugauuacucccaaucuuguagccucgcgggcuauaaucauuccaacagccugaccaaagacgagcgggaacagcagguuacacuggacagacuugagcuccugccuaaaaauucucugcgccagcccaucguggaaaagauucucaaccaaaugaucaaucuggucaacgccauucuugaucaguacggggagcuguccgaaauccggguggagcucgcuagagagcugaaacagagcaaggacgaacgcaaugaugccgaccugcagaacaccaaaaauaagaaacuuaacgaugagaucggaaagcggcucgcugaacugggccugccgauuaccaagagauauauccaaaaauacaaguucauuuuuccuucucucuccaaaaaucugaaggacgcccacguuaacaaccagugcaucuacuguggggagacauucaaucuuagcgaagcccuguccggagaugcuuaugacguggaucacauuguccccaaagcgcuccuguuugacgauucucagacgaacaaggugcugguccaucgcaagugcaauagcaccaaaacaaaccagaccgccuacgacuauaucuccacaaagggcgaugagcaagugcggaucuacuucgagagaguugacgacugguuuaaaucuggcauuaucagcuauuccaagaugcagcggcuuaaagugagccacaaggaauaccucgagcgcaagaaaauugggaaggaaaccgagacggauaaaaagcugugggaaaauuucaucgacagacagcugcgggauacacaauauauuucuagaaaaucccgcgagauccuccagaaggucuguaacaaugugaccaccacagagggaggcguuaccgcuaaacugcggaaccuuugggggugggacgaugugcugaugaaucuccagaugccuaaguacagagaacugggacagacagucaucaaggaguggacgagcgaacauggcaaacgcaagcaccaaaaagaggagguggaaaacuggaccaagagagacgaucaccggcaucacgccauugacgcccuggugaucgcuugcacaaaacagggguucauucagcgcaucaauacccuuaacucuuccgauacaaaggaccucaugcugaaggagguugaagaggccaaagucaaguuuagcgagaaaaccacgcugcucgaaaaguaccugagaacccaggagcccuucucuacacaagaagugaugcgggaggcggauaaagugcuugucagcuuuaaggcuggcaagaaaguggccaccauuacaaaguucaaagccaucggaaagaauaaagacuccggcguuauugugccccgcggggcucugcaugaacagagcgucuauggaaagaucaaggugaucgagaaagauaagccucucaaauaccuguuugaaaacucugacagaauuguugacccgaaggugaaaaagcuggucgaggugcggcuuuccgagaaugaaaacaacagcaagaccgccaucuccacgcugaaaaaggcucccauuuuccucaaugaggagaaaacagaaguucuggaaaaggccucuuguuauaacgaugcgaccgugcucaaauacaagcugcagagcaucaaagccucccaggcugacgauauugucgacgagcgcgugaaguuucuugugaaggagagacuggcccaauucggcaauaaagaaaaggaggcuuuuaaagauauccucugguucaacgaagagaagcagaucccuauuaucucuguccggcuguuugcccgccccgacgcgaauaaccugcagguuauuaaaaaggaugagaauggaaagagcaucggguucgugcuuacaggcaacaaucaccauauugccaucuaugaagacaaagauaacaagcugauccaacacuccugcaccuuuuggcacgcuguggagcggaaaaaguacaauauuccugucgugaucaaaaacucuagcgacguuuggucccagcuccuggauaagcagcuccccgaaagccugcuuaauaagcugccgaccgacaaacucaaccugaaguucucuaugcagcaaaaugagauguucauucuggggcuuucccagaaagaauuugacgaggccaucaagaacaaucauaagagcuuccugucuaaguaucucuaccuggugugguccauuagcaacaacgauuacuauuuuagacaccaucucgagacaaagaauacggaacugaaaaacaucucuaccgcuaaggaguccaaaagauacuuccgcuuuaagagcgucggcgcccuugugggaacaaauccuauuaaaauccggcugaaccaccugggcgaaaucaauaagguuggggaguauuga

SEQ ID NO: 4071 - RNA, 3807 nt, Artificial Sequence
  Cas9 variant
augaccaagaacauccugggccucgaccuggggacaaauagcauuggaugggcccuuaucgagguggaugaaaacaauacgcccauuagaaucauugcuaugggcucccggaucaucccucugucuaccagcgacaaagaggaguuccagcgcgggcucuccauuacaaagaaccaaucuagaaccgucagccggacacagcgcaaaggauacgauagaaagcagcugaaaaaguccgaccuuaagaaaauccugaauaaguauaacauuuuuccgucugaagaacuccugaaacugcccaugcucgaucuguggaaacuucggagcgacuccgccaauccuaacgagaauaucagcgcggagcagcugggccgcauucucuacaugcugaaccagaaaagaggguauaagucugcucgguccgaagccaaugccgauaagaaagacaccgauuacguucaggcugugaagggacgcuaugcccagcuuaaagagagaaaccagacaaucggccaauacuucuaugaggaacuguacaaugcuaacaccaauaacagcuacuuucggauuaaggaggaaguguauccccgcgaggccuacacggaagaguucgacaccaucaucaacgcgcagaaaaauaagcacgauuuucucacagacgaagucgugcaucagcugagaaacgagauuaucuauuuccagcggaaacugaagucucaaaagggccucguuuccauuugcgaguuugaaggguucgagaaaaccguguuugauaaggaaaagaauaaggacaaagucguguucguuggaccuaagguggcccccaagacaagcccucuguuucagcuuugucgcaucugggaggucgugaacaccauuucucugaaaaucaagaauccggaaggcuccaaauacaaguggggagagaaaauccccaaccucaaggagaagcagauucuggcugacuaucuuuucaaaaaugauagccuguccuuuacgaagcuccuggaaauccuggaccucaacaaaaaugauguguacgucaacaagcaaauucugaaagggaucaagggcaaugagacauucucuacccuucacacaguucugggggacaacgaacuccugaauuucgaugugagcauuaucccuuccaaccauaccagcaugcuuguggacaagaaaaccggagagauccuggaagagagagccggccucgagcuggaugcuucucuggaaaaggagccccucuaucagcuguggcacacaauuuacucccuuaaagaccuggaugaaugcaagaaugcccucaucaaacgguuuggcuucgacgaugagacggcggagaagcugagccauauugacuuuaacaaacaggccuucgggaacaagucuaauaagagcaugagaaaaauccugccuuuucuuauggaaggauacgacuauucccagucuuguagccucgcuggcuacaaccacuccaauagccugaccaaggaugagcgcgaacaacagauuacacuggaccggcucgagcugcuuucuaaaaacucccugagacagcccaucgucgaaaagauucucaaucagaugaucaacgugguuaaugccauccuggagcaauaugggaaacugagcgagauucgcguggaacuugcucgggagcucaagcagucuaaggaugaaagaaacgacgccgaucugcaaaauuccaaaaacaagaaacugaaugaggaaaucggaaagcgccucgccgagcugggccuuccggucaccaaacgguacauucagaaguauaaguucaucuuuccuagccuguccaaaaaccucaaggacgcucacgugaauaaccaaugcauuuacuguggggagacauucaaucugaccgaagcgcugucuggagaugccuuugacguugaucauaucgugcccaaagcccuucucuucgacgauagccagacgaacaagguccuggugcacagaaaaugcaacuccacaaagaccaaucagaccgcuuaugacuacaucggcacaaagggcgaggaacagguccgcguguacucugagcggauugaugacugguuuaaaagagggaucauuagcuauuccaagaugcaacgccugaaaguuagccauaaggaauaccucgagcggaaaaagcugggaaaagagaccgaaacagacaagaaacuuugggagaacuucaucgauagacagcugcgggacacgcaguauauuucucgcaaggccagagaaauccuccaaaagguguguaauaacgucaccacaaccgagggcggggugacagcuaaacugcggaaucuguggggaugggaugacguucuuaugaaccuccagaugccuaaguacaaagagcugggccagaccgugaucaaggaauggacguccgagcacgggaagagaaaacaccagaaggaagagauugaaaauuggaccaaacgcgaugaccaucggcaccaugccaucgaugcgcuggucguggcuugcacaaagcaaggcuuuauucagagaaucaacacccucaauagcucugacacaaaagaucugaugcagcgcgagauuaaggaggccaagaaacuucugggagaaaacuauaaugagaaggaguucgaaaacgacaaugaguucgugaaaaaccacaaggaaagacucucccagcuggaugacuaccugcggcuucaaaaacccguuaaguuugauaccaaguaugucgagcaggaagccgacaaagugcuggugagcuucaaggcuggcaaaaaggucgccacgaucacaaaauuuaaggcuaccgggaagaauaaagacacaggagugaucguuccccgcggcgcccuccaugaggcggggcuguacggaauuagaaccaucuacucuaagggcgggauugccgaaaaacacaucauuaagaaauauaaggugggcgucagcgcucaggaucacaucuucaccggaaaagagacauacuccgugaagaaggacaaaaacggcaacgaaaagguugaugacaaaauuaagaucgugcucgauagcaucgucgacaauaaagugaaggagguugugcugaaccggcuuaaucgcggguuuaacaaugaggaagauuauagaauugacgucaagaaagcccugaacaauuucaagaaccucgaugaggacccucugugguacaaugaaucuaaaggaaucaagauucuguccaucaaacuuaagacgggccugaaggauagcguggugccgcuccggcugaacgagaaaaaugaggucauuacccucguuaagacagggaacaaucaucacaucgcuaucuaugaagacaacgacggaaaacugauucaguacuccuguaccuuuuggcaugccguggagcgcaagaaauauaauauccccacagugauuaagaacucuagcgaagucuggaaucaagugcuugauaagaaacugccugaguccuuccucaacagacugcccgcggacaagcugaaccuuaaauuuucuaugcagcagaaugaaauguucauccugggccuccuggaggaggaauuugauaaggccauuaaagacaacgauaagagccuccuguccaaauaccuuuaccugguuuggucuaucgcugagggggacuauugguuccggcaccaccuggaaaccaagaauacggagcucaagaaaacaaacggcgccaaggaaagcaaacgcuacuuuagacuguccaccaagggacuuaucgaucugaauccugugaaaguccggcucaaccaucugggcgagauuaccaagaucggggaguauuga

SEQ ID NO: 4072 - RNA, 3810 nt, Artificial Sequence
  Cas9 variant
augaacaauagcaucaaguccaaacccgaggugaccauuggccuggaccucggggucggaucuguuggcugggccaucguggauaacgaaacaaauauuauccaccaucuggggagcagacuuuucucccaggcuaagacggccgaggaccggcgcucuuuuagaggagcgcggcgccugauuagacggcgcaaauacaagcucaaaagauucaucaaccugaucuggaaguauaauagcuacuuuggcuucaagaacaaagaagauauucuuaauaacuaucaagagcagcagaagcugcacaauaccgugcucaaccugaaacuggaagcucucaaugccaagaucgacccuaaagcccuguccuggauucuucaugauuaccugaagaaccgggggcacuuuuaugaggacaaucgcgauuucaacgucuacccgacagaggaacucgcuaauuauuuuggagaguacggcuacuauaagggcaucauugacucuaaagaagauaacgacgauaagcuggaggaggggcuuaccaaauacaaguucagcaaccagcauuggcuggaagagaucaaaaaggugcucuccaaucaaacaggacugcccgaaaaauuuaaggaggaauaugagagccuguucucuuacguuagaaacuauuccgagggcccugggagcauuaauucugugucccccuacggaaucuaucaccucgacgaaaaggagggcaaagucgugcagaaguacaacaauaucugggauaaaaccauugggaagugcagcaucuuuccugacgaauaccgggcccccaaaaacucuccuauugcuaugaucuucaaugagauuaacgaacuguccacaauccgcagcuauuccaucuaccuuaccggaugguuuauuaaucaggaguucaagaaggccuaucugaacaaacuccuggaccuucugaucaagaccaauucugagaaaccgauugaugcgagacaguucaagaaacuccgggaagagacgaucgccgaaagcauuggcaaggagacacugaaggacguugaacgcgaggagaaacuggaaaaggaggaucacaaauggaagcucaaaggccugaaacuuaacaccaaugggaagauccaauacaacgaccuguccagccucgcuaaauuugugcauaagcugaaacagcaccuuaagcuggauuuccuccuggaagaccaguauacaacccuggauaaaaucaauuuucuccagucucuguucgucuaccuuggaaagcaucugagauauuccaaccggguggacagcgccaaccucaaagaguuuucugauagcaauaagcuguucgagagagugcugcaagaacagaaggacgaucuuuuuaaacucuucgagcagacggacaaggacgaugaaaagauucuggcucaaacacacucccugucuaccaaggccaugcuccuggcgaucacacgcaugaccaaccuugacaaugaugaggacaaccagaaaaauaacgauaagggcuggaauuuugaagccauuaagaacuucgaccagaaauuuaucgauauuaccaagaaaaauaacaaucugagccucaagcaggacaaacgguaccuggaugacagauucaucaacgaugcuauucugucccccggggucaagcgcauccuucgggaggccacaaagguuuuuaaugcuauccucaaacaauucagcgaggaauacgacgugacgaagguggucauugagcuggccagagaacugucugaggaaaaagagcucgagaacaccaagaauuaugaaaaacugaucaagaagaacuccgauaaaauuagcgagcgccuugaagcccuggacaucgcugaggacaagauugaagauauccucaaaucuccuacaaaguccuacaaagugcugcuguggcuucagcaggaccacaucgaucccuauagccagaaggagauugcguucgaggacauccucaccaaaacagaaaagaccgagauugaucauaucauuccuuacuccaucucuuuugacgauagcuccucuaacaagcugcugguucucgccgaaagcaaucaagcuaaauccaaccagacgcccuaugaguucaucacaagcggaaaugccggcauuaagugggaggacuacgaagccuauugucggaaauuuaaggauggggacaccucucugcuugauuccacccagagaagcaaaaaguucgcuaagaugaugaaaacagacaccucuuccaaguacgauaucggauuucuggcccgcaaccucaaugacacacgguacgcgacgauuguguucagagacgcucugaaagauuaugccaacaaucaccuggucgaggacaagccgauguuuaaagugguuugcaucaacggcggcgugaccagcuuccuucgcaagaauuuugauaagucuugguacgccaaaaaggaccgggauaaaaacauucaucacgcugucgacgccagcaucaucuccauuuucagcaaugaaacaaagacccucuuuaaccagcugacacaauucgcugauuauaaacuguuuaagaauaccgacgggucuuggaagaaaaucgauccuaagacgggaguggucaccgaggugacagacgaaaacuggaaacagauuagaguucggaaucagguguccgagaucgccaaggucauuaacaaauguauccaggauagcaacauugagcgcaaggcgagauacucccggaagaucgaaaauaaaaccaacaucucucucuucaaugacacaguguauagcgccaagaaaguuggcuacgaggaccaaauuaagagaaagaaccugaagacccuugauauccaugaauccgcugaggaaaauaaaaacucuaaggugaagaaacaguucgucuaucgcaagcuggugaaugugagccuccugaacaaugacaaacuggccgaucuuuuugcugagaaggaggacauucugauguaccgggccaaccccuggguuaucaaucucgcggaacagauuuucaacgaguacacggaaaauaaaaagaucaagucccaaaacgucuuugagaaauauaugcuggaucucacaaaggaguucccugaaaaauuuucugaggccuucgucaagagcaugcugagaaauaaaaccgcuaucauuuacaacguggaaaagaagguggugcaccgcaucaaaagacuuaagauucuguccagcgagcucaaagaaaauaagcugucuaacguuaucauucgguccaaaaacgagagcgggacaaagcugucuuaucaggacaccaucaauuccaucgcccuuaugauuaugcgcagcaucgaucccaccgcuaagaaacaguacauuagagugccccugaacacacucaaucugcaccucggagaccaggauuuugaccugcauaacaucgaugccuaucuuaagaaaccuaaguucgucaaauaccugaaggccaaugagauuggcgacgaauauaaaccguggcgggugcucacgucugggacccugcugauccacaagaaggauaaaaagcugauguacauuuccagcuuucaaaaccuuaaagacguuaucgagaucaagaaucucauugaaacagaguacaaagaaaacgacgauuccgaccccaagaagaaaaagaaagcuaaucgcuuccugaugacccucagcacaauccugaacgauuauauucuucuggacgcgaaggauaauuuugacauccugggccucucuaaaaacagaauugaugagauccugaauagcaaacuuggacuggacaagaucaccaaauga

SEQ ID NO: 4073 - RNA, 3810 nt, Artificial Sequence
  Cas9 variant
augaacaauagcaucaaguccaaacccgaggugaccauuggccuggaccucggggucggaucuguuggcugggccaucguggauaacgaaacaaauauuauccaccaucuggggagcagacuuuucucccaggcuaagacggccgaggaccggcgcucuuuuagaggagugcggcgccugauuagacggcgcaaauacaagcucaaaagauucgucaaccugaucuggaaguauaauagcuacuuuggcuucaagaacaaagaagauauccuuaauaacuaucaagagcagcagaagcugcacaauaccgugcucaaccugaaauccgaagcgcugaaugcuaagauugacccuaaagcccucucuuggauccugcaugauuaccuuaagaaccgggggcacuuuuaugaggacaaucgcgauuucaacguuuacccgacaaaggagcuggccaaauauuuugacaaguacggauacuauaaaggcauuaucgauagcaaggaagacaaugauaacaaacucgaggaggaacugaccaaguacaaauucuccaacaagcauuggcuugaggaagugaagaaaguccugagcaaucagacaggccuccccgagaaguuuaaagaagaguaugaaucucuguucuccuacgugagaaacuauagcgaggggccuggaucuauuaauuccguuagccccuacggcaucuaucaccuggacgagaaggaagggaaagugguccaaaaguacaacaauauuugggauaagaccaucggaaaaugcaacaucuuuccugacgaguaccgggcucccaaaaauucuccuauugccaugaucuucaacgaaauuaaugagcucuccacaauccgcagcuauuccauuuaccugaccggcugguuuaucaaccaggaguucaaaaaggcuuaucuuaauaaacugcucgaccugcuuaucaagacgaacggggaaaagccgauugaugccagacaguucaaaaagcugcgggaggaaaccaucgcggagucuauuggaaaagaaacacucaaggacguggagaaugaagagaaacuggagaaggaagaucacaaguggaaacugaagggccucaaacugaacaccaauggcaagauccaguacaacgaccuuagcucccuggccaaauuugugcauaagcucaaacaacaccugaagcuggauuuccugcucgaggaccaguaugcuacacuggauaagauuaacuuucugcagagccucuucgucuaccuggggaaacaucuucgcuauaauaacagaguugacucugccaaucugaaggaauuuuccgauagcaacagacucuucgagagagugcugcaggagcaaaaagacggacuguuuaaacuuuucgaacagaccgauaaggacgacgagaagauccucgcucagacgcacucucugagcacaaaggccaugcugcucgcgaucacccgcaugacaaaucuggauaacgacgaagauaaucaaaagaacaaugacaagggcuggaacuuugaggccauuaaaaauuucgaucagaaguuuaucgacauuaccaaaaccaacaauaaccuuucccugaagcaggauaagcgguaccucgacgauagauucaucaaugacgcuauucugucucccggggugaaacgcauccugcgggaagccacaaaggucuuuaacgcuauucuuaaacaguucagccaagaguacgaugugacgaagguugugaucgagcucgccagagaacuguccgaggaaaaagagcuggaaaacaauaagaacuauaagaaacucaucaagaaaaauagcgacaagauuucugagggacugaaagcccuugauaucgcugaggacaagauugaagacauccugaaauccccuaccaagagcuacaagguccuccuguggcugcagcaggaucacauugaccccuauucucagaaagagaucgcguucgaagauauccuuacaaagaccgagaaaacagaaauugaccauaucauuccuuacuccaucagcuuugaugacuccucuagcaacaagcuccuggugcuggccgaguccaaucaagcuaaaucuaaccagacccccuaugaguucauuacgagcggcaaugccgggaucaagugggaagauuacgaggccuauugucgcaaguuuaaagacggagauacaucccuccuggacagcacccagcggucuaagaaauucgcuaagaugaugaaaaccgauacauccagcaaguacgacaucggcuuucuugccagaaaccugaaugauacccgcuacgcgacaauuguuuuccgggacgcucucaaggacuaugccaacaaucaccugguggaagauaaaccgauguuuaaggucgugugcaucaacggcggggucacgucuuuccugcggaaaaauuuugacaaguccugguacgccaaaaaggaucgcgacaagaacauucaucacgcuguggaugccagcaucauuucuaucuucagcaauaaaaccaagacacuuuuugaccagcucacccaauucgcugauuauaaacuguuuaagaacacagacggauccuggaaaaagaucgauccuaagaccggcguugugacggaggucaccgacgagaacuggaaacagauucgggugagaaaucagguuagcaagaucgccgaagagauugauaaauguauccaggacucuaacauugaacggaaggcgcgcuacuccagaaaaaucgagaauaagacaaacauuagccuguucaaugacaccguguauuccgccaaaaaggucggguacgaugaccaaaucaagcggaaaaaccucaagacacuggauaucgacgaaucuguggaggagaauaaaaacagcaaggugaaaaagcaguucguuuauagaaaacuugucaaugugucccugcucaacaaugauaagcuggcugaccuguuugccgaaaaggaggauauucuuauguaccgcgcuaaccccugggugaucaaucuggccgaacagauuuucaacgaguacaccgaaaaucggaaaaucaagucucaaaacgucuuuggaaaauauaugcucgaccugacgaaggaguucccugagaaguuuagcgaagcguucgugaaauccaugcucagaaauaagacagccauuaucuacaacguugagaaaaaggugguccaucgcaucaaaagacugaagauucuuucuagcgaacugaaggagaacaaacucuccaaugugaucauucggagcaagaacgaaucuggcaccaaacuguccuaucaggauacaaucaauagcguugcucugaugauuaugcgcucuaucgaccccaccgccaagaaacaguacaucagagugccccuuaacacccugaaucuccaccugggggaucacgacuuugaucuccauaacauugacgcuuaucugaagaaaccuaaguucgucaaguaccuuaaagccaaugagaucggcgacgaguauaagccguggcgggugcugauuuccggaagccuccugauccacaaacgcgauaagaaacugauguacauuucuuccuuucagaaccuuaaugaccugaucgaaauuaagaaccucaucgagacagaauacaaggagaauguugauagcgaccccaaaaagaaaaagaaagccucccaaauccugagaagccucucuacgauucugaacgauuauauccuucuggacgcuaaggauaauuucgacauucugggccucagcaagaaccggaucgaugagauucuuaauuccaaacuugaccuggauaagaucgcgaaauga

SEQ ID NO: 4074 - RNA, 3822 nt, Artificial Sequence
  Cas9 variant
augaagaaaauccugggccucgaccuggggaccaacagcauuggaugggcccuuaucgagguggaugaaaauaacuuccccauuagaaucauugcuaugggcucccggaucaucccucugucuagcaaugacaaggaugaguuucagcgcgggcucuccauuacaaagaaccaaucuagaacggucagccggacccagcgcaagggauacgacagaaaacagcugaagaaguccgaugacuucaaauauucucuucggcgcauccugaauaaguacaacauuuuuccgagcgaggagcuccugaaacugcccaugcucgaucuguggaaacuuagauccgacgccguuaauccuaacgaaaauaucagcgcggagcagcugggccggauucucuauaugcugaaccaaaaacgcggguacaagucugcuagauccgaggccaaugccgauaagaaagacacagauuaugugcuugcugugaagggacgguacgcccagcugaaagaccgcaaccagaccaucggccaguauuucuacgaggaacuccacaaugcuaagacaaccaacagcuacuuuagaacaaaagaagaggucuauccccgggaggccuacauugaagaguucgauaccaucaucaaugcgcaaaagucuaaacaugacuuucugacggacgaagugguucaccagcugcgcaacgagauuaucuauuuccagagaaagcucaagucccagaaaggccuggugagcauuugcgaauuugagggguucgagaagaccaucuuugauaaagaaaaggacaaaaacaaggucguguucguuggaccuaagguggcccccaaaacaucuccucuuuuucaacugugucggauuugggaggucgugaauaccaucacacucaagaucaaaaacccggaaggcuccaaguacaaauggggagagaagauucccaauaucaaggaaaaagaggcucuggccgauuaucuuuucaagaacgagacccugagcuucaauaaacuccuggacauucuggaacucaagaaagagaacguguacgucaauaagcagaucauuaaggggaucaaaggcaacgaaacguauuccgcucugcauagaauccuuggggauaaugagcugcucaaguuugacguuucuauuaucccuagcaaccacacauccaugcugguggauaaaaagaccggagaaauucuugaggagcgcgccggccuggaacucgacgugagccuggagaaagaaccccuguaccagcucuggcauacaaucuacucuauuaaggaucuggacgagugcaaaaaugcgcuuaucaagcgguucggcuuugaugacgagauugccgaaaagcugucccaccucgacuucaacaaacaggcuuuugggaauaagagcaacaaaucuaugagaaagauccugccuuuccugauggagggauauaauuacagccaguccuguacccuugccggcuauaaccacucuaacagccucaccaaagaugaacgcgagcagcaggucacacuggacaagcuggaacuccugcccaaaaauucccuucggcaaccgaucguggagaagauucugaaccagaugaucaauguugugaacgcuauucucgaggaauacgggaagccuagcgagaucagaauugaacuggcccgcgagcugaaacagucuaaggaugaacggcaugacgccgaucuucaaaauuccaaaaacaagaagcucaaugaggagaucggaaaaagacugacggaacugggccuccccgucaccaagcgcuauauccaaaaauacaaguuuauuuucccuagccugucuaaaucccuuaaggacgcucaggugaacaaucagugcaucuauuguggggagacauuuaaccugaccgaagcgcucagcggagaugccuacgacguugaucacauugugcccaagucccugcuguucgacgauucucagacaaauaaaguccuugugcaucggaagugcaacagcaccaaaacgaaucaaacagcuuacgacuauaucgccuccaagggcgaggaagagguccagauuuacucugccagaguggaugacugguuuaaacgcggcaucaucagcuauuccaagaugcagcggcucaaaguuagccacaaggaguaccuggaaagaaagucucugaacaaagagaccgaaaccgacaagaaacucugggagaauuucauugaucggcagcugcgcgacacacaauauaucuccagaaagagcaaagagauucuucagaagguguguaacaacgucaccacaacggaagggggagugaccgcuaagcugcgggaucucuggggcugggacgauauccugaugaaucugcagaugcccaaauacaaggagcuuagacaaacaguuauuaaagaauggaccucugagcacgggaagcgcaaacaucagaaggaagagaucgagaacuggacaaagcgggacgaucacagacaucacgccaucgacgcgcucgugauugcuugcaccaaacagggauuuauccagcgcauuaauacgcugaacuccagcgaaaccaaggaucugaugcaacaggagaucaaugaagccaaaaagcuccugggcgagaacuauaaagacaaggaguucgaaaauucuaacgaacuugucaagaaucauaaagggagacugagcaagcucgaugacuaccugcggcugcagaaaccuauuaaguucaacacaaaauacguggaaaaggaggccgauaagauccuuauuuccuuuaaagcuggcaagaaaguggccaccaucacaaaguucaaagcuaccggaaagaauaaagacacgggcguuaucgucccgcgcggggcccugcacgaagcgggacucuauggcgugagaacaauuuacagcaaagggggaaucgccgagaagcacauuaucaagaaguauaaagugggcgucucugcucaggaccauauuuuuaccgggaaggaauccuacagcgugaaaaaggauaagaacggcaaugagaaaguugacgauaagaucaaagugguccuggacuccaucguggauucuaagguuaaagagauugugcucaaccggcugaauuucggauuuagcgacggcgaagauuauaagaacaacgucaagaaagcccuuaauaacuucaagaaucuggacgaguacccccucugguauaacgaaaauaaagggaucaagauucuguccaucaaacugaagacaggacuuaaggauucugugguuccucugcgccucaacgagagcaaugaggugauuacccuggucaaaaccggcaacaaucaccauaucgcuaucuacgaagacaagaacuccaaacccgugcaacacucuuguacauuuuggcacgccguggagagaaagaaauacaauauuccugcggucaucaagaaaagcuccgauguuuggaaccagcuccuggacaaggaacuucccgagagcuuccugaauaaccucccggaagacaaucugaaccugaaguuuucuaugcagcagaaugagauguucgugcuugggcugucccaagaggaauuuaaagaggccauugaaaacaacgauaagagccuccugucuaaauaucucuaccuggugugguccgucagcgagaauaacuauugguuccggcaucaccuugaaacgaaaaauucugaccugaagaagaccgagggagcuaaggaguccaaacgccuguacaacaucagaagcguguccagccucuuuucucugaauccuguuaaggugcggcuuaaccaucugggcgaaauuacaaaaaucggggaguauuga

SEQ ID NO: 4075 - RNA, 3825 nt, Artificial Sequence
  Cas9 variant
augaccaagcacauccugggccucgaccuggggacaaacagcauuggaugggccaucauucagguggauaauaacaauaacguccccauccaaauuaucgcuaugggcuccagaaucauuccucuugacucuaaugaucgggaccaguuccagaaagggcaggccaucagcaagaacaaagaucgcacgaccgcgagaacacaacggaagggauacgaccgcaaacagcugaagaaguccgaugacuuuaaauauucucucaagaaaauucuggagaaacuugauaucuucccgaccgaggaacugaugaaacuccccacacuggaccuguggaagcucagaagcgaugcuguuuccaauauugaagacaucaccccuaagcagcugggccggauucuuuacaugcugaaccagaaacgcggguauaagucugccagaagcgaggccaaugcugauaaaaaggacacagacuacguggccgaagugaaaggacgguauacccaacucaaggauaaaggccagacgcugggccaguacuuuuauaaggagcuuuccgacgcuaaccagaauaacaccuacuaccgcgucaaggagaaaguguaucccagagaagccuacaucgaggaguucgaugcgaucauuaauguucaaaagagcaaacauucuuuucugacagacgaagugauccacucccuccggaacgagauuaucuauuaccagcgcaagcugaaaagccagaaggggcuggucucuauuugcgaguucgaaggauuugaaaccacauauuucgauaagaaaacccaacaggacaagacgaucuuuacaggcccuaaaguggcccccagaaccuccccucucuuccaguuuuguaagaucugggagguugugaauaacauuagccugaaaacaaagaacccggaagggucuaaguacaaaugguccgaucggauccccaccauugaggagaagcagaccaucgcuaauuaucuucaagaaaacgagaaucugagcuucauugaacuccugaaaauccuucagcugaagaaagagcaggucuacgccaacaagcagauccucaagggcauucaaggaaauacaacguuuuccgcuauccauaaaauuaucgggaacucugaacaccugaaguucgacauugagaccaucccuagcaaacauuucgccgugcugguggauaagaaaacaggagagauucucgacgaacgcgauucccuggagcuuaauagcgcgcuggaacaggagcccuuuuaccagcucuggcacaccaucuauucuaucaaggaccuggacgaaugcaaaaaggcccuuauuaagagauucaacuuugaggaggaaaucgcugagaaacuguccaagauugauuucaauaaacaggccuuuggcaacaagagcaauaaagcuaugcggaagaugcucccuuaccugaugcugggcuauaaccaaucugaagccgagagcuucgccggguacaauagacgccucacaaaggaggaaaaauccaagaacgucucugacgagccccugcagcuucuggcuaaaaauagccuccggcagccgguuguggaaaagauccugaaccagaugauuaacguggucaaugcgaucaucgagaaauauggaaagccugaagagauuagaguggagcuggcccgcgaacuuaagcaauccaaagaugagcgggaagacgcugauaagcagaacggcuuuaauaaaaagcucaacgagcugguugccaccaaacugacggaacucgggcugcccacaaccaagcacuacauccagaaguauaaauucauuuuuccugccaaggacaaaaauuggaaggaggcucaaguggccaaccaguguaucuacugcggagauaccuucaaucuuacagaggcgcugagcggcgacaacuuugaugucgaccauauugugcccaaagcucuccuguucgaugacucucaggccaauaagguucuggugcacagauccuguaacagcaccaaaacaaauaacacggccuacgauuauaucaccaagaaggggucucaggcucuuaaugacuacgucgcccgcguggacgauugguuuaaacggggaaucauuuccuauggcaagaugcaaagacucaaagucagcuucgaagaguaccaggaacgcaagaaaaucggcaaggagacagaagcugacaagcggauuugggagaacuucaucgauagacagcugcgcgagaccgccuauauugcgaaaaaggccaaagaaauccuggagaaggugugccauaauguuacauccaccgaagggaacgugacggcuaaacuccggcagcuguggggaugggacaacguccuuaugaaucugcaacuccccaaguacaaggagcuggagaaaaagaccaaacagacauuuacccagcugaaggaauggacaucugaucacggcaacagaaaacaccagaaggaggaaaucauuaauuggaccaagcgggacgaucaucgccaccaugccaucgacgcucuugugauugccuguacgcaacagggguucauccagagaauuaacacacucagcuccucugauguuaaagacgagaugaagaaagaacuggaggaggauaagaccguguauaaugaacggcugacacuccuggagaacuaccuucuggaaaagaagccuuuuagcaccgaggaaaucgagaaggaggcggacaaaauucucgucuccuucaaggccggcaaaaagguggcuacccugagcaaauacaaggccacaggaaucaaugaaaucaaaggggugcugguuccgagaggcccccuucacgagcaaucugucuauggaaagauuaaggugaucgaaaaagauaagccucucaaauaccuguuugagaacuccgacaagauugugaauccccugaucaaacaucucgucaagacgcgccugcuugaaaacgagaauaacgcucaggccgcccuggugacccucaagaauaaaccuauucugcugaacaauaagcagacagagauccuugaaaaagcuagcugcuauaacgaggcgaccguucugaaguacaaacuccagucucugaaggccucccaaaucgacgauauuguggacgaaaagaucaaauuccucauuaaggagcggcugagcaaauuuggcaacaaggagaaagaggcuuucaaggauauccuuugguuuaaugaaaagaaacagauucccaucacaucuaucagacuguucgcccgcccggacgccaacaaucuccaggucauuaagaaacacgaaaaggggaaaaacaucggauuugugcugagcggcaauaaccaccauauugcuaucuaugaggauaagaauaacaaacugauucagcacaucugugacuucuggcaugccguugaaagaaagcggaauaacauuccugugcuuaucgaggauaccuccacgaucuggaaucaccugauuaacgaggacuuuagcgaaucuuuccucaauaagcugcccaacgauucccucaaacugaaguucagccuucaacagaaugagauguuuauccuggggcucccuaaagaacaguccgaggaagcgauuaagucuaacaauaaaagccugcuguccaagcaccuuuaccuggucuggucuaucacagacggagauuauuucuuucgccaucaccucgagaccaagaacaccgagcugaaaaagauugacggcagcaaagaauccaagagauaccuccggcugucuacaaaaagccuuguggaccugaaccccaucaagguucgccugaaucaucucggggagaucaccaagauuggcgaauga

SEQ ID NO: 4076 - RNA, 3846 nt, Artificial Sequence
  Cas9 variant
auggaggacgauagccagcacgacaucagagaaauuuaccuggccauccaucacauggugaaguaucggggcaacuuccucgucgaggggacccuggaauccucuaaugcuuuuaaagaggaugaacuucugaagcuccugggacgcauuacaagauacgagaugagcgagggcgaacaaaacuccgacaucgagcaggaugacgaaaauaaacuuguugcccccgcgaacgggcagcuggcugaugcccucugcgccacgcggggaucucgcagcaugagaguggacaaugcucuggaggcccuguccgcugugaacgaucucucucgggagcagcgcgccauugucaaggcgaucuucgccggccuggaagggaauaaacuugaccuggcuaagaucuuugugagcaaggaguucuccagcgaaaacaaaaagauucucggaaucuauuuuaauaaaucugauuacgaggaaaaguguguucaaauuguggacuccggccugcuugaugacgaggagagagaguuccuggaccggaugcagggccaguauaacgccaucgcucucaaacagcugcuggggcgcagcaccucugucuccgauagcaagugcgccucuuacgacgcgcauagagccaauuggaaccucauuaagcugcaacuucggacaaaagagaaugaaaaggauaucaacgagaauuauggcauucuggugggauggaaaaucgacuccgggcagcgcaagagcguuagaggagaauccgcuuacgagaacaugcggaaaaaggccaacguguuuuucaaaaagaugaucgagaccucugaucucagcgaaacagacaagaaucgccugauucacgauaucgaggaagacaaacuuuuuccuauucagagagauuccgacaacggcgucaucccgcaucagcugcaccaaaaugagcucaagcagauuaucaaaaagcaggggaaauacuaucccuuccugcuggaugcuuuugaaaaggacggaaagcaaaucaacaaaauugagggccuccuggccuuccgggugccuuacuuugugggcccccuugucguuccugaggaccugcagaaaagcgauaauucugaaaaccacuggauggugagaaagaagaaaggggagaucacccccuggaauuucgacgaaaugguggauaaggacgccuccggacgcaaguucauugagcggcucgucggcacagauagcuaucugcuuggggagccuacccugccgaaaaacucucuccuguaccaggaauaugaggugcugaaugaacucaacaauguuagacugagcgugcgcacgggaaaccauuggaaugacaagcggagaaugcgccuuggccgggaggagaaaacccugcucugucagagacuguuuaugaaggggcaaacagucaccaaacgcacagcugaaaaccugcuucggaaggaguacggaagaaccuaugaacucuccggccugucugaugagagcaaguucacguccagccugucuacauacggcaaaaugugccgcaucuuuggggaaaaguacgugaaugagcaccgggaccucauggagaaaauuguugaacugcagaccguguucgaggauaaggaaacacuucugcaucagcucagacagcuggagggaaucuccgaagcggacugugcccugcuugucaacacccacuauaccggcugggggcggcucagccgcaaacugcugacaacgaaggcuggagagugcaaaaucucugaugacuuugcccccagaaagcacuccauuaucgaaauuaugcgggccgaggauagaaaccucauggagaucauuaccgacaagcaacugggcuucagcgacuggaucgaacaggagaaucuuggggcugaaaacggcuccucucugauggagguggucgaugaccuccgcgugagcccuaaaguuaagcggggaauuauccaguccaucagacugauugaugacaucucuaaagccgugggcaagcgccccagcagaauuuuucuggagcuugcggaugacauccagccuuccgggcggacaauuagccgcaaaucuagacuccaagaucuguaccggaaugcuaaccugggaaaggaguucaagggcaucgccgacgaacucaaugccuguuccgauaaagaccugcaggaugaccgccuuuuucuguauuacacccagcucgggaaggauauguauacaggagaagaacuggaccuggacagacuuagcucugcuuacgauaucgaccauauuaucccccaggccgucacccaaaacgauuccauugacaaucgggugcucguugcucgcgccgaaaacgcgagaaaaacggauagcuucacauauaugccgcagaucgccgaccggaugcgcaauuuuuggcagauucugcuggauaacggccucaucucuagagugaaguucgagcggcugaccagacaaaaugaguuuagcgaacgcgagaaagaacgguucguccagagaucccuuguggagacccgccagaucaugaagaacguggcuacacugaugcggcagagauacgggaauagcgccgcuguuauuggccucaacgccgaacugaccaaggagaugcaccgcuaccugggauucucucauaaaaaucgggacaucaacgauuaucaccaugcgcaagacgcccuuugcgucggcauugcugggcaguuugccgcuaacagaggauucuuugccgauggcgagguguccgacggggcccagaauagcuacaaccaguaucugcgcgacuaccuccggggauauagagaaaagcuguccgcugaggaucggaaacaaggccgcgcguucggguuuaucgugggcucuaugagaagccaggacgaacagaagcgggucaauccucgcacaggagaggugguuugguccgaagaggauaaagacuaccucagaaaggugaugaacuaucggaagaugcuggucacgcagaaagugggcgaugacuucggggcccuuuacgaugagaccagauacgcugccacagaccccaagggaauuaaaggcaucccuuuugauggggccaagcaagacaccucucuguauggaggcuucagcuccgcuaaacccgccuacgcgguucucaucgaaucuaaggggaaaacacgccuggugaaugucaccaugcaggaguauagccugcuuggcgaucggcccuccgacgaugaacugagaaaggugcucgcuaagaaaaagagcgaguacgccaaagccaacauucugcuccgccacguuccuaagaugcagcugauccgguauggaggcgggcuuauggugauuaaaucugcuggagagcugaauaacgcccaacagcucuggcugccguacgaagaguauuguuacuuugacgaccugucccagggcaaggggagccuugaaaaggaugaccugaaaaagcuccuggauucuauccucggauccguccagugccuguaccccuggcacagauucacggaggaggaacuugcggaccugcauguggcuuuugauaaacugccugaggacgaaaagaaaaaugugauuaccggcaucgucagcgcccuccacgccgaugcuaagacagccaaccugucuauuguuggcaugaccggguccuggcgccggaugaauaacaagagcggauauacauucuccgacgaggaugaauuuaucuuccaaagccccucuggccuuuucgagaaaagagugaccgugggggaacugaagcgcaaagcuaagaaagaggucaauagcaaguacagaacgaacgagaagcggcucccuacacuguccggagccucucagcccuga

SEQ ID NO: 4077 - RNA, 3861 nt, Artificial Sequence
  Cas9 variant
augaccaagaacauccugggccucgaccuggggacaaauagcauuggaugggcccuuaucgagguggaugaaaacaauacgcccauuagaaucauugcuaugggcucccggaucaucccucugucuaccagcgacaaagaggaguuccagcgcgggcucuccauuacaaagaaccaaucuagaaccgucagccggacacagcgcaaaggauacgauagaaagcagcugaaaaaguccgaccuuaagaaaauccugaauaaguauaacauuuuuccgucugaggaacuccugaaacugcccaugcucgaucuguggaaacuucggagcgacuccgccaauccuaacgagaauaucagcgcggagcagcugggccgcauucucuacaugcugaaccaaaagagaggguauaagucugcucgguccgaagccaaugccgauaagaaagacaccgauuacguucaggcugugaagggacgcuaugcccagcuuaaagagagaaaccagacaaucggccaauacuucuaugaggaacuguacaaugcuaacaccaauaacagcuacuuucggauuaaggaggaaguguauccccgcgaggccuacacggaagaguucgacaccaucaucaacgcgcagaaaaauaagcacgauuuucucacagacgaagucgugcaucagcugagaaacgagauuaucuauuuccagcggaaacugaagucucaaaagggccucguuuccauuugcgaguuugaaggguucgagaaaaccguguuugauaaggaaaagaauaaggacaaagucguguucguuggaagcaagguggccccuaagacaucuccccuguuucagcuuugucgcaucugggaggucgugaacaccauuucccugaaaaucaagaauccugaaggcagcaaauacaaguggggagagaaaacgccgaaccucaaggagaaggaaauccuggcugacuaucuuuucaaaaaugauucccugucuuuuacaaagcuccuggagauucuggaccucaacaaaaaugauguguacgucaacaagcagauccugaaagggauuaagggcaaugaaaccuucagcgcccuucacacaguucugggggacaacgagcuccugaauuucgauguguccaucauucccagcaaccauaccucuaugcuuguggacaagaaaaccggagaaauccuggaggagagagcuggccucgaacuggaugccucccuggagaaggaaccucucuaucaacuguggcacacaaucuacagccuuaaaguccuggacgagugcaagaaugcgcucauuaaacgguuuggcuucgaugacgagacggccgaaaagcugucucauaucgauuuuaacaaacaggcuuucgggaacaagagcaauaaguccaugagaaaaauucugcccuuucuuauggagggauacgacuauucucagagcuguucccucgccggcuacaaccacagcaauucucugaccaaggacgaacgcgagcagcaaaucacacuggaucggcucgaacugcuuuccaaaaacagccugagacagccuauuguggagaagauccucaaucagaugauuaacguugugaaugcuauccuggagcaguaugggaaacugucugaaauccgcgucgagcuugcccgggaacucaagcaauccaaggacgagagaaacgaugccgaccugcagaauagcaaaaacaagaaacugaaugaagagauuggaaagcgccucgcugagcugggccuucccgugaccaaacgguacauccagaaguauaaguucauuuuuccgucccugucuaaaaaccucaaggaugcgcacguuaauaaccagugcaucuacuguggggaaacauucaaucugaccgaggcccugagcggagacgcuuuugauguggaccauauugucccuaaagcccuucucuucgaugacucccaaacgaacaaggugcugguccacagaaaaugcaacucuacaaagaccaaucagaccgccuaugauuacaucggcacaaagggcgaagaacaggugcgcaucuacagcgaacggguugacgauugguuuaaaagagggauuaucuccuauagcaagaugcagcgccugaaagugucucauaaggaguaccucgagcggaaaaagcugggaaaagaaaccgagacagacaagaaacuuugggaaaacuucauugacagacaacugcgggauacgcaguauaucucccgcaaagcuagagagauucuccagaaggucuguaauaacgugaccacaaccgagggcgggaucacagccaaacugcggaaucuguggggaugggacgauguucuuaugaaccuccaaaugcccaaguacaaagaacugggccagaccgugaucaaggaguggacgagcgaacacgggaagagaaaacaccagaaggaggaaauugagaauuggaccaaacgcgacgaucaucggcaccaugcgaucgacgcucuggucguggccugcacaaagcagggcuuuauucaaagaaucaacacccucaauucuuccgauacaaaagaccugaugcagcgcgagauuaaggaagccaagaaacuucugggagagaacuauaaugaaaaggaguucgaaaacgauaaugaguucgugaaaaaccacaaggagagacucagccagcuggacgauuaccugcggcuucagaaaccuguuaaguuugacaccaaguaugucgaacaagaggcugauaaagugcuggugucuuucaaggccggcaaaaaggucgcuacgaucacaaaauuuaaggccaccgggaagaauaaagacacaggagugaucguucuccgcggcgcgcugcaugaacagagcguguacgggaagauuaaagucaucgagaaggacaaaccccucaaguaccuguucgaaaacuccaaaaagauugugaaccccaagaucaaaguucuuguggaggagagacuggccgaaaaugagaacaauagcaagcucucucuguccacccugaaaaagaacccuauuuuucuuaaugaagagaaaaccgagauccuggaaaaggcuagcuguuauaacgaugccacaguccucaaguacaaacugcagucccucaaggcuucucaggccgacgauauuguggacgaucggguuaaauuccuggugaaggagcgccuugcgcaauuuggaaauaaagaaaaggaggccuucaaggacacgcuguggcucaacgaagagaaacagaucccgaucauuaccgucagacuguuugcucggcccgaugccaauaaccugcaggcuaucaagaaagacaagaauggccgcgauauuggguucgugcuuacaggcaacaaucaccacaucgccauuuaugaggacaaagauaacaagcuggugcaacauagcugcaccuuuuggcacgccgucgaaagaaagaaaaauaacguuccugcugugaucaaaaauuccucugacguguggaaccagcuccuggacaaggagcuccccgagagcuuccugaacaaacuuccuaucgauaagcugaagcugaaauuuucccuccagcagaaugaaauguucguccugggacuucugcaagaagacuucgaggcggccauugagaacaaugauaagacacuccugucuaagcaucucuaccugguguggagcaucaccgacggcgauuacuuuuuccggcaccaccuugaaacgaaaaacacagagcugaagaaaaccgaaggggcuaaggaguccaaacgcuauuuuagacugagcaccaagggacucauugaccugaaucccguuaaggugcggcuuaaccaucugggcgaaaucacaaaaauuggggaguauuga

SEQ ID NO: 4078 - RNA, 3864 nt, Artificial Sequence
  Cas9 variant
augaagaccgugcugggccucgaccuggggacaaacagcaucggaugggcccuuauugagcuggaugaaaauaacauccccauuagaaucgucgcuaugggcucccggauuaucccucucucuacgagcgacaaagaggaguuccagcgcgggcuguccaucaccaagaaucaaucuagaacaguuagccggacccagcgcaaaggauacgauagaaagcagcuuaaaaaguccuaucugaagaaaauucucaacaaguacaauaucuuuccgucugacgaacugcugaaacuccccaugcuggaucuuuggaagcugcggagcgacuccgccaacccuaaugaaaacauuagcgcggagcagcucggccgcauccuguauaugcuuaaucagaaaagaggguacaagucugcucgguccgaggccaacgccgauaagaaagacacagauuauauucaagcugugaagggacgcuacgcccagcugaaagacagaaaucagaccaucggccaauauuucuacggcgaacucaacgaugcuaaugagaacaauagcuacuuucggauuaaggaagagguguauccccgcgaggccuacacagaagaguucgacaccaucaucaacgcgcagaaagauaagcacgacuuucugacggacgaagucauucaucagcugagaaacgagaucauuuauuuccagcggaaacucaagucucaaaaggggcugguguccaucugcgaauuugagggauucgagaaaaccguuuuugauaaggagaaaaauaaggacaaaguggucuucgugggcccuaagguugcccccaagacaagcccucuuuuucagcugugucgcauuugggaaguggucaacaccaucacacucaaaaucaagaauccggaagggucuaaauacaaguggggagagaaaauucccgaugugaaggaaaaggagauccuggcugacuaucuuuucaaaaacgagucccugagcuuuaccaagcuccuggaaauucugaaacucaauaagaacaauguguacuucaacaaacagauccugaagggcauuaaggggaaugagacguauuccauccuucacucuauccugggagauagcgaacuccugaacuucgacgucuccauuaucccuagcaaucauacaucuaugcuuauugauaaaaagaccggcgagauccuggaagagagagccggccucgagcuggacacaucccuggaaaaagagccccucaaccaacuguggcacaccauuuacagcaucaaggaucuugacgaaugcaaaucugcucugauuaagcgguuuggguucgaugacgagaccgccgacaaacucagcagaaucgauuuuaauaagcaggcguucggaaacaaguccaauaaaucuaugcgcaagauccugccuuuucugauggagggcuacgacuauagccaguccuguagccuugccggguacaaccauucuaacuccuucacaaaagaugaacgggagcagcaaauuacgcucgacaagcuggaacugcuccccaaaaauagccugagacagccgaucguugagaagauucuuaaccagaugaucaauguggugaacgcuauucuggaacgcuauggaaagccuucugagauccgggucgagcucgccagagaacugaaacaguccaaggaugagcgcaaugacaccgaucugcaaaacagcaaaaauaagaaacuuaacgaagagaucggcaagcggcucgcugaacuggggcugccccucacaaagagauacauucagaaauauaaguuuaucuucccuucccugucuaaaaaucuuaaggacgcccacgugaacaaucagugcauuuacuguggagagaccuuuaaccugacagaggcccucagcggcgaugcuuucgacguugaucacaucgugcccaaagcgcugcuguuugacgauucccagaccaauaagguccuugugcaucgcaagugcaacucuacgaaaacaaaucaaaccgccuaugacuacauugcuaccaagggcgacgaacagguucggguguacagcgagagagucgaugacugguucaaacgcgggaucaucuccuauagcaagaugcagcggcucaaagugucucacaaggaauaccuggagcggaaaaagcugggaaaggaaacagagaccgauaaaaagcucugggagaacuuuauugacagacagcugcgcgauacacaauauaucuccagaaaaagccgggaaauucuucagaaggucuguaacaauguggccacgaccgagggcgggguuacagccaaacugagaaaccucuggggaugggacgaugugcugaugaaucugcagaugcccaaguacaaggaacuuggccaaaccgucgugaaagaguggacaucugagcaugggaagcgcaaacaccagaaggaagagaucgaaaacuggaccaaacgggacgaucacagacaucacgcuauugacgcccucguuguggcgugcacgaagcagggcuucauccagcgcaucaauacccugaacuccagcgagacaaaggaucugaugcaacaggaaauuaaagaggcuaagaaacuccugggagagaauuauaacgaaaaggaguucgaaaauaacaaugagucugucaaaaaccauaaggaaagacuuagccagcuggacgauuaccuccggcugcagaagccugugaaauuugacaccaaguauguggagcaagaggccgacaaaguucuggucuccuucaagagcggcaaaaagguggccacaaucaccaaguuuaaagcuacggggaagaauaaagauacaggagugauugucccgcgcggcgcccuucacgaacagaacguguacgggaagaucaaaguuauugagaaggacaaaucucugaaguaccucuucgaaaauuccgagaagaucgugaaccccaaaauuaagaacaucgucgaaaucauucugagcgagaaugagaacaauuccaaaauggcucucucuacccugaagaaaaacccuaucuuucuuaaugaagagaagacagaucugcucgaaaaggccagcuguuaugaguacgugaccguuagaaaauauccccugaacaccauuaaggcgucccaggccgacgauaucguggacgagcgggucaaauuccuggugaaggaacgccuuacacaguuuggaaauaaagagaaggaggcuuucaaggauacgcugugguuuaacgaagaaaaacaaauuccuaucaucaccguuagacucuucgcccggcccgacgcuaauaaccugcaggccauuaagaaagaugagucuggcaaggagaucggguuuguggucaugggcaauaaccaucacauugcgaucuacgaagacaaagauggaaagcucgugcagcacagcugcacauucuggcaugccguggagcgcaagaaauauaauauuuccaccgucaucaagaacucuagcgacgcuuggaaucaauuucuggacaacgaacuuccggagccuuuccugaauaaacuccccgccgauaaccugaaccugaaguucucccuucagcagaaugaaauguuuauccugggccucagccaggaggaguucgacaaagcucugaagucuaacgauaaaucccuccugagcaagcaccuuuaccugguuuggucuauuuccgaaaauaacuauugguuuagacaucaccuggagacaaagaauagcgaccucaaaaagaccaacggggugaaagaaucuaagcggcuguacaauauccgcucccuuggaagccuguucucccucaacccuauuaaaaucagacugaaucaccucggcgagauuacgaagaucggggaauacagcuga

SEQ ID NO: 4079 - RNA, 3867 nt, Artificial Sequence
  Cas9 variant
augagacuguucgaggaaggccacaccgccgaggaccggcgccucaagagaacagcucggcgcagaaucagccggcgcagaaaccggcugcgcuaccuucaggccuuuuucgaagaggcgaugacggaucuggacgaaaauuucuucgcuagacuccaagaguccuuucuggugcccgaggauaaaaaguggcaucggcacccuauuuucgccaaacuugaagacgaggucgccuaucaugaaaccuacccgacaaucuaucaucugcgcaagaaacucgcugauucuagcgagcaggccgaccugagacugauuuaccucgcucuggcccacaucguuaaguaucgggggcacuuucuuauugagggaaagcuguccaccgaaaacacaucugugaaagaucaguuccagcaauuuauggugaucuacaaucagaccuucgucaacggcgagagccgccucguguccgcgccccugccugaaucuguucuuaucgaggaagaacugacagagaaggccagcagaaccaaaaaguccgaaaaagugcuccagcaguuuccccaagagaaggcuaaugggcuguucggacaguuucugaagcucauggucggcaacaaagccgacuucaagaaaguguucgggcuggaagaggaagcuaagauuacguaugccagcgagucuuacgaggaagaucuugagggaauccuggcgaaaguuggcgacgaauacuccgauguguuucucgccgcuaagaaugucuaugacgccguggagcugagcaccauucuugcugauucugacaaaaagucccacgccaagcugucuagcuccaugaucgugcgguucacagaacaucaggaggaccucaaaaaguuuaaaagauucauucgcgagaacugcccugaugaauacgacaaucuguuuaagaacgagcagaaagauggcuaugccggguacaucgcucacgcgggaaaggucagccaacugaaguucuaucaguacguuaaaaagauuauccaggacaucgccggcgcugaauauuuucucgagaaaauugcccaagagaauuuccugcggaagcagagaaccuuugauaacggggugaucccccaucagauucaccuugccgaacugcaggcuaucauucaccgccaagccgcguacuacccuuuccucaaagagaaucaggaaaagaucgagcagcuggugacauuucggaucccguauuacgucggaccccuuuccaagggcgacgcuucuaccuucgccuggcugaaaagacagagcgaggagccuauucgccccuggaaccuccaagagacgguggaucuggaccaguccgccacagcuuuuaucgaacggaugaccaauuucgauacauaucugccuagcgagaagguucuccccaaacauucucugcuuuacgaaaaguucaugguguuuaacgagcugaccaaaauuuccuauaccgacgauagagggaucaaggccaacuucagcggaaaggaaaaagagaagauuuuugacuaccucuucaaaacacgccggaaggucaaaaagaaagacaucauccaguuuuauagaaaugaguacaacacggaaauugugacccugucuggccuggaggaagaucaguucaaugcuagcuuuuccacauaccaagaccuucucaaguguggccugacccgcgccgagcuggaucacccggacaacgcggaaaagcucgaggauaucauuaaaauccugacaauuuucgaggaccggcagagaauccggacccagcuuucuacguuuaaggggcaguucagcgccgaaguucugaaaaagcucgagcgcaaacauuauacaggauggggcagacuguccaagaagcugauuaaugggaucuacgauaaagaaagcggaaagaccauccuugacuaucucgugaaagaugacggcgucucuaagcacuacaaccggaauuuuaugcaacugauuaacgauucccagcugagcuucaaaaaugcuauccagaaggcccaaucuuccgagcaugaggaaacccucagcgagacagugaacgaacuggcuggguccccugccauuaagaaaggaaucuaucagucucuuaagauugucgacgagcugguggcgaucaugggcuacgcccccaaaagaaucguuguggaaauggcucgcgagaaucagaccacaagcacgggcaagcggagauccauucagcgccucaaaaucgucgagaaggccauggcugaaauugggucuaaccugcugaaggagcaaccuaccacaaaugaacagcuuagagauacccggcucuuucuguauuacaugcagaacggaaaagacauguacacaggcgacgagcugagccuccaccgccugucccacuaugauaucgaccauauuaucccccagagcuucaugaaggaugacucucuugauaaucuggugcucguuggguccaccgaaaacagaggaaaaagcgacgaugugcccucuaaggaggucgugaaagacaugaaggccuacugggagaaacuguaugccgcuggccugaucucccaacggaaguuccagcgccuuacgaagggggaacagggcggacucacccuggaggauaaagcgcacuuuauucagagacaacugguggaaacacggcagaucaccaagaacguugccggcauucucgaccagcgcuacaaugcuaaaagcaaggagaaaaagguccaaaucauuacacugaaggccucucuuaccagccaguucagauccaucuuugggcuguauaaagugcgggaagugaacgauuaccaucacggacaggacgccuaucucaauugcgucguggcuacgacacugcugaagguuuacccuaaccuugccccggaguucguguacggcgaguaucccaaauuucagaccuucaaggaaaauaaagcgacagcuaaggccaucauuuacaccaaccugcuccgcuuuuucaccgaggaugaaccuagauuuacaaaggacggggagauccuguggagcaauucuuaucucaaaacgauuaagaaagagcugaacuaccaccaaaugaauaucgucaagaaaguggaaguucagaagggaggcuucuccaaggagagcauuaaacccaaggggccuuccaacaaacuuauccccgugaagaauggccuggacccgcagaaauauggaggcuuugauucuccugucguggccuacaccguucucuucacacaugaaaaggggaagaaaccccugauuaagcaggagauccugggaaucaccauuauggagaaaacacgguucgaacaaaacccuauccuuuuucuggaggaaaagggcuuccucagaccccgcgugcugaugaaacucccuaaguauacccuguacgaguuucccgaagggcggagacgccuucuggcuagcgccaaagaggcgcagaagggaaaucagaugguccucccggaacaucugcugacgcuucuguaccacgcuaagcagugucuccugccuaaccaauccgagucucucgccuauguggagcagcaccagcccgaauuucaggagauucuggaacggguggucgacuuugccgagguucauacacuugcuaaaagcaaggugcaacagaucgugaaacuguucgaagccaaucagaccgcugaugucaaggagauugccgcguccuuuauccaacugaugcaguucaacgccaugggcgcucccucuaccuuuaaauucuuucagaaggacaucgagagagcccgcuacacaagcauuaaggaaaucuucgaugcuaccauuaucuaucaguccccuacagggcucuacgagacgcggagaaaagugguugacuga

SEQ ID NO: 4080 - RNA, 3903 nt, Artificial Sequence
  Cas9 variant
auguggggcgugagccuguucgaggccgggaagaccgcugccgaaagacggggauaccgcuccacaagacggcgccucaaccacagaaaauuucggcugcgccuucuggaggacauguucgaaaaggagauccucucuaaagaucccagcuuuuucauuagacugaaggaagcguuucuuuccccuaaagacgagcagaagcaauucaagggcaauauccuguuuaacgauaaagacuauacggaugcugacuacuaugagcaguacaagaccauuuaucaucuccgguacgaucugaucucucagcaccgccaguucgacauuagagaagucuaucuggccauccaucaccucaucaaauaccgggggcauuuuauuuacgaggaucaaacauucaccacagacggaaaucagcugcagcaccacaucaaggccauuaucaccaugauuaacagcacacuuaaucgcaucauuaucccggaaaccaucgauauuaacguuuuugagaaaauccugcucgacagaaugaugaaucgguccucuaaggugaaguuccugauugagcuuacgggcgaagauaaacaggacaagccccugcucaaagagcuguuuaaccugaucguggggcucaaggcuaaaccugccagcauuuucgaacaagagaaucuggcuaccaucgucgaaacaaugaacauguccaccgaacaggugcagcuugaccugcucacacuggccgauguucuugcggacgaggaauaugaucugcuccugaccgcccagaagaucuacagcgcuauuauccuggacgagucuauggauggauaugaauacuucgccgaggcuaaaaaggaauccuaucgcaagcaucaagaggagcucgugcuggucaaaaagaugcuuaaaagcaaugccauuacgaacgacgaaagagcgaaguuugaguacuucuauacagauuacaucggcgccaaaucuuccaauuacgaagagagcaagaacauuaagaaaggccugucugcugccuaugggaaguacuccaaagaagagagacucuuuaagcacaucgagcugcuucuggcuaaagaaaaugugcucaccacaguugagcaugcccugcuggaaaagaacaucaccuucgccagccuccugccccuucagagauccucucgcaacgcugugauuccuuaucagguccacgagaaggagcugguggcgauccucgaaaaucaagccaccuacuaucccuuucugcuggagcagaaagacaacauucacaaacuucucacauuccggaucccuuacuaugugggaccgcuggcugaucagaaggacagcgaauuugccuggauggucagaaagcaggccggcaaaauuacgcccuucaauuuugaggaaaugguugauaucgacgcuuccagcgaggccuucauuaagcgcaugaccaacaagugcacauaccugauccaugaggacgugaucccuaaacacucuuuuuccuacgcgaaguucgaagugcucaaugagcugaacaaaauucggcuugaugggaagcccaucgacauuccucugaaaaagagaaucuuugaaggacucuuccuggagaaaaccaaggucacacaaaccagccugaagaaauggcuugcugaacaugagcacaugacggugucuguugugcagggcacacagaaggagaccgaguucgccaccagccuccaggccuuucaucgcuucgucaaaauuuuugaucgggagacaguguccaaucccgcuaacgaagagauguucgaaaagaucaucuauuggucuaccguuuuugaggacaaaaagauuaugagacgcaagcugagcgaguacccgcaacugacagaacagcaacaggugcagcucgcccagguccgguucagaggguggggacgccugucccagcggcuuaucaauagaauuaaaacgccugugagcggcgaugaggaccacaagcugucuaucaacgaaauucucuggcagaccaaugagaacuuuaugcaaaucauccggaauaaagauuaucuguucaagaaaauuaucgaggaacaguuugagaacgaaacagcucugcuuaauaagcagcgcauugacgagcucgccgcgucccccgccaacaagaaaggcaucuggcaagcuauuaagaucgucaaagaacuggagaaggugcugcagcagccugccgagaacaucuucauugaauuugcuagaagcgaugaggaaucuaaacgguccacccccagagacaaguucaucgagaaggccuacgcgcagcucaaaaaggaaacagauaccuuuaaucuggagcaccuuaaagagcugaagcaacgcagcaaacagcucuccucucagcggcuguuccuguauuucauucagaacgggaaguguauguacagcggagaacaucuugacaucgagagacucgauuccuaugaaguugaccacauucugccccaaucuuacaucaaagacaauagcauugagaaccuggcccucgugaagaaggucgaaaaucagcgcaaaaaggauucccugcuucugaacagcucuaucaucaaucagaacuacuccagaugggagcagcucaaaaaugcuggccugauuggggagaagaaauuucggaaccugacgcgcaccaagaucacagacagagauaaggaaggauucauugcccggcaacuuguggagacccgccagaucacaaaacauguuacccagcugcuccaacaggaauauaaggacacgacaaaaguguuugcuauuaaggccacccuggucagcggccucagacggaaauucgaguuuaucaagaaucgcaacgugaaugauuaccaccacgcccaggacgcuuuccugguggcguuucuugggacaaacaucaccucuaauuauccuaagauugagauggaauaccuguucaaaggauaucagcauuaccucaacgagguuggcaaguccgccgcuaaaccgaaguuuaccuucaucgucgaaaaccugagcaaacaacaguauaauucuacaacgggcgaggugaaguggaaccccgaaguggauauugccaagcugaaaagaauccuuaauuuuaagcagugcaacauuguccggaaaguggaggagcagagcggggcccuguucaaggaaaccaucuacccuguugaggaauccagcucuaaaacaaucccccucaagaagcaccuggacaccgcuauuuacggaggcuauacagccgugaauuacgcguccuaugcucucauccaauucaaaaaggggcgcaaacugaagagagagauuaucggcauuccucuugccguccagacccggaucgauaacagcgaaacgucccugcaggccuacauugcugagcagaucaaaucugagguggaaauccucaauggacggauucugaaguaucaacugaucagcaacaaugggaaccgccuuuacauugccggccccuccgagcggcauaaugcgagacagcugaucguuucugacgaagcugccaaagugauuuggcucaucagcacaaagcaggccgaugaggcuauguuucugaaguauuaccgccucgaacaccuggaggccgucuucgaggaacuuauccggaaacaggcugccgacuaccaaauuuuugagaagcugaucaaaaagauugaagugaacaaaguuuauuucuacuccuguaccuauaaugagaaggugaaggucaucgaggaacugcucaaaauuacccaggcgaacgccacaaauggagaucugaaacuucugaagaugucuaacagagagggccgccucgggagcguguccguggcucuggacuuuaagaucaucaaccagagcgucaccggacucuaccaaucuauugaagacuauaauaacuga

SEQ ID NO: 4081 - RNA, 3930 nt, Artificial Sequence
  Cas9 variant
augggcagcgugggguucgccggaaucgacaaccaguacaaucuggucagaaccaagggcaaaaacguuauuggggugcggcucuuugaugaggcugacuccgccgcggaacgcagaggacaccggacaaaucgcagacggcugcaacgcagacgguggcgccuuagacugcucgaugacaucuucgcuaagccccugcaggccguggauccuaacuuucuugcccggcugaaauauucuuacgucaauaagaaagaccagggccagcaagaucauuauuacgggggauauguguucggcagcacggcugccgaccaggcuuaccaccaggccuauccgaccauuuaccaucuccgcaagagacugauggaggaugaccagaagcacgaucugcgggaaguuuaccucgcgauccaucacauugugaaauaucgcggcaacuuucugaauccccaauccucucuugacaucgaucagcaguucgacgucacagacuuugcccaggcucuggccagauucgcugaucaccaagcccucagcugggcgcuggaggccccuauccgguuucuugaagcugagcuggccaccgggcucuccaacucugcuagaguggacgccgccauugaggcuuucagcuuugauacaaagguugaccgcgcggccaucaaagaaaugcugaagggacuguccggcaaucagauugauuucaccaaacucuuugugaacgucgacagcgcugauugggaccaggaggaacggaagcaauggaagaugaaacugucugaggaggauuucgacgaacaggcccuucccauccuggagagacucucccaggaugaaacagaguucuuucuggccauuaagcgcgcuuacgacgggaucgcccuuaugcgguuccugggagacgaacagagccucucuuccgcgaugauuaaggcuuaugaggaucauagacgcgaccugaccuuucugaaaacgcaagugcggaccccucagaauagacaggcccucagcgagggcuacacaaacuaucugucuguggaugacaaaaagcacaaacgcggggccaaggaacuugcucagcugaucgaggccuccgaugcuagcgaacaagacaaggccaccaugcucgaucggaucgcgaaugaccaguucgcccccaaacagagaacaaaggcuaacggacugauuccuuaccagcuucaucuggccgagcucaaaaagauccuggcuaaacaaggccaguauuacccguuucugcucgauaccuucgccaagcagggccaguccgucaauaagauugaggagcugguucaauuucgcgugcccuacuauguggggccuaugguccccaaaucugagacggcgggaaacgccgaaaaccacuggguggagaagaaugacggccagacaaaaguuagcgugaccccuuggaacuucgaucaggucuuuaaucgggacagagcugccaaguccuucaucgaucggcuuacagggaccgacaccuaccugauuggagaacccacacucccgcgccacagccugacguaugagaccuuuacagugcugaacgaacuuaauaacaucagaaucgacggcaaacggcucccuguugagaccaagcaagcuauuguggaggaucuguucaagaaauacagacuggucacaaagaaacgccuccaggacuauuuugccucuuucgggaagcgggaaguggagcugaccggacuugccgaugaauccagauucacgagcucucugacaagcuaccaugaccuccagggccugcugggcaccgauuuuaucaccaauccccagaaccacucccuucucgagaaaauugucgagauccaaacaguguucgaagacucugauauugcugagcgcgaacuggggaagcugggacucgagcagaagcugaucccuagacuugcgaaaaagcauuauaccggcugggggaaucugagccggaaacuccuggacacauccuuuauccacgaucccgaacgccccgaggagccuguuagcauuauggaccugcuuuacacgaccaacaagaauuucauggaaauccuccaugauucugaguacggaguggaagaguggcugaaaucccagaacaugauugacgaucagaaggacauccaaaugagaauugacgaacugacaaccagcccggccaauaaacggggcaucaagcaggcuuuuaacguccucgaugacauuacacaggccaugggggaggagcccgccuauguguaccuggaguucgcucgcgaaaagcaggccucuagacggaccguuucccgcaaaaagagacuugaaacgcuguauaaaaaugcggcucucaagaccgaguuuaaagccaucaaggaagcccuggcugaggagagcgaugaccggaugcaagaugaccgccuguaccuuuauuacgcccagcucggcagagauauguauacaggacaguccaucucuauugaccaacugagcucccacuacgauaucgaccacauugugccucgggcguucaucaaggaugacucucuggaaaacaaaguccucgugaacagaaccgacaaugcucgcaagacagauagcgccaccuuuacggccgacgugaaagcuaaggccuucccccuguggcagcagcuuaaaaagcugggccucauuuccgcuaagaaauuucggcugcugacaagaaccggggauuucacagagauggaacgcgagcgguuuaucgccagacagcuuguugagacccgccaaaucauuaagaacgucgcggcccugaucgaaggacauuucagccagacccaggcuguggccauucgggcugaggugacaggcgaacucagacagcugacgcaaaucaaaaaggaccgcgauauuaaugacuaccaccaugcccaggaugcccuccuggucgcuaccgcggggacauaucuucaccggcacuucccuaaaagagacgcccgguuuaucuacaacgaguucgauuauuacacccagcauuggcugaagaaucagggagaaaaccgcagacggcaccccuauucuuuugugguuggcacaauguccaaggggaaugaggacuggaccccggauaaccucaauuaccugcgcaaagugaugcaauauaagacgaugcugaugacaagaaaaccugucggccccgagggagcucuuuacaaggaaacccugaucgccgccgacccuaaaaagcggcucgugggcgcuagcaaagagagacaggaucccaccauuuacgggggauauacaaaggaaucuuccgccuacaugagccugguucgcgcgggcgggaagaaccagcucgugaaaaucccuguccggauugcuaaugagauccauucuggacagagaaagcuggacgacuaugugcaagccaaaguuaagaaauucgaacgcauucuucugcccaagaucagccucggccagcugguggaggaugaggggcagcgguuuuaccuggccaccaacgaaaugaagcacaaugcuaaacaacuuuggcuggaccagaaggucgugacaacguauaaaagacucaccgccgaguccccgguggaagauuuccugacagucuuugacgcgcucaccagcucugcuacaauccaucacuucaaguuuuaccagcgcgaucuggagcuucugcgggacaacagagccggcuuccaggaucuggccaaagcuacccaacucaagguucugaaggacgugcuuuaugaacugcacgauaaugccggauggcgcgacccuauuaaacaguacuuuaaggagaucggccucaaagugagaauguggacgaagcugcagaaagaagggggaauuaagcucaccgaucaggcugaacugaucuaccaaucccccagcggccuuuucgagaagcggcgcagaguccaggaccugcuguga

SEQ ID NO: 4082 - RNA, 3939 nt, Artificial Sequence
  Cas9 variant
augcagaacggcuuccuggggaucaccgugagcuccgagcaagucggaugggccguuacaaaucccaaguacgaacucgagagagcuucucggaaagaccuguggggcgugcgccuuuuugauaaggccgaaacggcggaggacagacggauguuccgcaccaacagacggcugaaucagcgcaaaaagaaccggauucacuaucucagagauaucuuucaugaagaggugaaucagaaagacccuaacuucuuucagcaacuggaugagagcaauuucugcgaagacgaucgcacagucgaguuuaacuucgacaccaaucuuuacaagaaccaguuuccgacaguguaucaccugagaaaguaccucauggaaaccaaagauaagcccgacauucggcugguuuaucuggcuuucuccaaauuuaugaagaaucgcgggcauuuccucuacaaaggaaaccugggcgaggugauggauuuugaaaauucuaugaagggguucugugaaagccuugagaaguucaacaucgacuuuccuacacuguccgaugaacaggucaaagaggugagagacauucucugcgaccacaagaucgccaaaaccguuaagaaaaagaauaucauuacgaucaccaaagugaagucuaagacagccaaggcuuggauuggacuguucuguggcugcagcguccccgugaaggugcuuuuucaggauaucgacgaagagauugucaccgauccugagaaaaucuccuucgaagacgccagcuaugaugacuacauugcuaacaucgagaagggcguugggaucuacuaugaagccauugugucugcgaaaaugcuguuugauugguccaucaugaacgagauucucggagaccaucaacugcugagcgaugccaugaucgcugaauacaauaagcaccacgacgaucucaagcggcugcagaaaauuaucaagggcacagggucucgcgagcuuuaucaggacaucuucauuaacgacguguccggaaauuacgucuguuaugugggccaugccaaaaccaugagcucugcugaucagaagcaauuuuacacguuccugaaaaacagacucaagaauguuaacgggaucuccagcgaggacgccgaauggauugauacagagaucaagaauggaacccugcuucccaaacagacaaagcgggacaacuccgugauuccucaccagcugcaacucagagaauuugagcugauccuggauaauaugcaggaaauguauccguuccucaaagagaaccgcgagaagcugcuuaaaaucuuuaauuucgucauucccuacuacgugggcccucugaagggcguugugcggaagggggaaucuaccaacuggaugguccccaaaaaggacggagugauccauccuuggaauuuugaugagauggucgacaaagaagcgagcgccgagugcuucauuuccagaaugaccggcaacuguagcuaucucuucaaugagaaggugcugcccaaaaacucucuucuguacgaaacauuugagguucucaacgaacugaauccgcugaagaucaacggggagccuauuuccguggaacucaaacagcgcaucuaugagcagcuguuccuuacgggaaagaaggucaccaaaaagagccugacaaaauaccucauuaagaauggcuaugaugaggacaucgaacugucugggaucgauaacgaguuucacagcaaucugaaaucccacauugacuucgaagauuacgacaaccuuucugacgaggaaguggagcggaucauucucagaaucaccguuuuugaggauaagcaacugcugaaggacuaucucaaucgcgaguucgugaaacugagcgaggaugaacggaagcagauuugcucccuuagcuacaaaggauggggcaaccugucugagaugcuccugaauggcaucacagucaccgacuccaacgggguggaagugagcguuauggauaugcuguggaauacgaaccuuaaucucaugcagauccugucuaagaaauacggauauaaggcugagauugagagauacaacaaggaacaugagaaaaauaucuauaaccgcgaagaccugauggauuaccucaacauucccccugcccagcggagaaaggucaaucaacugaucacaauugugaaaucccuuaagaaacgcuguggcgugcccaacaagaucuuuuucaaggucagccgggagcaccaggacgaucccaaaagaaccuccucucggaaggagcagcugaaauaucucuacaagagccugaaauccgaagacgagaagcaucugaugaaagaacuugaugagcucaaugggcacgaacugucuaacgacaagguguaucuguacuuucuccagaagggacgcugcaucuacagcggcaaaaagcugaaucuuuccagacugcggaaaagcaacuaucaaaaugauauugacuacaucuauccucucucugcuguuaacgacagauccaugaauaacaaggugcugaccgggauucaggagaaucgcgccgauaaauacacauauuucccggucgaccccgagauccagaagaagaugaaaggcuuuuggauggaacuggugcuucagggauucaugagcaaggagaaauacuuucggcucucuagagaaaacgauuucuccgagaaugaacugguuagcuucauugagcgcgagaucucugacaaccaacagagcggcagaaugaucgccuccgugcugcaguauuacuuuccugaaagcaagauugucuucgugaaagagaagcucaucucuuccuuuaagcgggauuuccaucugauuagcuccuacgggcacaaucaccuucaagcugcgaaagacgccuauaucaccauuguugugggaaacgucuaccauacaaaguuuacgauggaucccgcuaucuauuucaaaaaccacaagcgcaaagacuacgaucugaauagacucuuucuggaaaacauuucucgggacggccagaucgccugggagagcgggccuuauggauccauccagaccgugcgcaaggaauacgcccagaaucauauugcugugacaaagagagucguugaggugaaaggcgggcuguucaagcaaaugccccuuaaaaagggccacggagaguauccgcugaaaaccaacgauccucgguuuggcaauaucgcccaguacgggggauacacaaacgugaccggcucuuauuucguccucguggaaagcauggagaaggggaagaaacgcauuucccuggaauacguucccguguaucuccacgagagacuggaggacgacccuggacauaaacuucugaaagaauaccucgucgaucaccggaagcugaaucaucccaaaauccugcuugcgaaggugcgcaaaaacucucugcucaagauugacggcuuuuauuacagacugaaugggcggagcggcaacgcucucauccugacgaaugccguugagcuuaucauggaugacuggcagaccaagacagccaacaaaauuuccggauauaugaagagacgcgcuaucgauaaaaaggcccggguguaccagaaugaguuccacauucaagaacuggaacagcucuacgacuucuaucuggauaaacuggagaacggcgucuacaagaauagaaagaacaaucaggcugagcuuauccauaacgaaaaagagcaguuuauggaacugaagaccgaggaccaaugugugcuccugacagaaauuaaaaagcuguucguuugcagcccuaugcaggccgaucucacccuuaucgggggaucuaaacacacgggcaugaucgcgauguccagcaacgugacaaaggccgacuuuucuauuaucgcugaggauccccuggggcugcgcaauaaggucauuuauucccacaugggagagaaauga

SEQ ID NO: 4083 - RNA, 3939 nt, Artificial Sequence
  Cas9 variant
augcagaacggcuuccuggggaucaccgugagcuccgagcaagucggaugggccguuacaaaucccaaguacgaacucgagagagcuucucggaaagaccuguggggcgugcgccuuuuugauaaggccgaaacggcggaggacagacggauguuccgcaccaacagacggcugaaucagcgcaaaaagaaccggauucacuaucucagagauaucuuucaugaagaggugaaucagaaagacccuaacuucuuucagcaacuggaugagagcaauuucugcgaagacgaucgcacagucgaguuuaacuucgacaccaaucuuuacaagaaccaguuuccgacaguguaucaccugagaaaguaccucauggaaaccaaagauaagcccgacauucggcugguuuaucuggcuuucuccaaauuuaugaagaaucgcgggcauuuccucuacaaaggaaaccugggcgaggugauggauuuugaaaauucuaugaagggguucugugagagccuugagaaguucaacaucgacuuuccuacacuguccgaugaacaggucaaagaggugagagacauucucugcgaccacaagaucgccaaaaccguuaagaaaaagaauaucauuacgaucaccaaagugaagucuaagacagccaaggcuuggauuggacuguucuguggcugcagcguccccgugaaggugcuuuuucaggauaucgacgaagagauugucaccgauccugagaaaaucuccuucgaagacgccagcuaugaugacuacauugcuaacaucgagaagggcguugggaucuacuaugaagccauugugucugcgaaaaugcuguuugauugguccauccucaacgagauucugggagaccaucaacugcucagcgaugccaugaucgcugaauacaauaagcaccacgacgaucugaagcggcuucagaaaauuaucaagggcacagggucucgcgagcuguaucaggacaucuucauuaacgacguguccggaaauuacgucuguuaugugggccaugccaaaaccaugagcucugcugaucagaagcaauuuuacacguuccucaaaaacagacugaagaauguuaacgggaucuccagcgaggacgccgaauggauugauacagagaucaagaauggaacccuucugcccaaacagacaaagcgggacaacuccgugauuccucaccagcuccaacugagagaauuugagcugauccucgauaauaugcaggaaauguauccguuccugaaagagaaccgcgagaaacuucugaaaaucuuuaauuucgucauucccuacuacgugggcccucucaagggcguugugcggaagggggaaucuaccaacuggaugguccccaaaaaggacggagugauccauccuuggaauuuugaugagauggucgacaaagaagcgagcgccgagugcuucauuuccagaaugaccggcaacuguagcuaucuguucaaugagaaggugcuucccaaaaacucucugcucuacgaaacauuugagguucugaacgaacugaauccgcucaagaucaacggggaguccauuagcguggaacugaaacagcgcaucuaugagcagcuuuuccugacgggaaagaaggucaccaaaaagucucucacaaaauaccugauuaagaauggcuaugauaaagacaucgagcugagcgggaucgauaacgaauuucacuccaaucuuaagucucacauugacuucgaggauuacgacaaccucagcgacgaagagguggaacaaaucauucugcggaucaccguuuuugaggauaagcagcugcucaaagacuaucugaauagagaguucgugaaacuuuccgaagaugagcgcaaacagauuugcagccugucuuacaagggauggggcaaccucuccgaaaugcugcugaauggcaucacagucaccgacagcaacgggguggaggugucuguuauggauaugcuuuggaauacgaaccucaaucugaugcagauccuguccaaaaaguacggauauaaggcugaaauugagcauuacaacaaagagcacgaaaagacaaucuauaaucgggaggaccucauggauuaccugaacauuccucccgcccaaagacgcaaagucaaccagcuuaucaccauugucaagagccugaaaaagaccuauggcgugccuaauaagaucuuuuucaaagugucccgggaacaucaggacgaucccaagagaacaucuagccgcaaagagcagcucaaguaccuguauaaaucccugaagucugaggacgaaaaacaccuuaugaaggagcucgaugaacugaacgggcaugagcugagcaaugacaagguguaccucuacuuucugcaaaaaggacgguguaucuauuccggcaagaaacuuaaccugagcagacuccggaagucuaauuaccagaacgauauugacuauaucuacccccuguccgcuguuaaugaccgcagcaugaacaauaaagugcugaccgggauucaggaaaacagagccgauaaguauacauacuucccugucgacccggagauccagaagaaaaugaagggcuuuuggauggagcuugugcuccaaggauucaugucuaaagaaaaguauuuucggcuguccagagagaaugauuucagcgaaaacgagcugguuucuuucauugaacgcgagaucagcgacaaucagcaguccggccggaugaucgccagcgugcuccaauacuacuuucccgagucuaaaauugucuucgugaaggaaaagcugaucuccagcuuuaaaagagauuuccaccuuauuuccucuuaugggcacaaccaucugcaggcugcgaaggacgccuacaucacgauuguugugggaaaugucuaucacgcuaaauuuaccauggauccugccaucuacuucaagaaccauaaacgcaaggacuaugaucucaacagacuguuucuggagaauauuagccgggacggccagaucgccugggaauccgggcccuacggaucuauccagacagugcgcaaggaguaugcucaaaaccacauugccgugaccaaaagagucguugaagugaagggcgggcuuuucaaacagaugccucugaagaaaggccacggagaguacccccucaagacaaaugauccgcgguuuggcaacaucgcgcaguacgggggauauaccaaugugacgggcagcuacuucguccugguggaguccauggaaaaggggaaaaagcgcauuucucucgaguauguuccuguguaccugcaugaaagacuugaggacgaccccggacacaaacugcucaaggaguaucuggucgaucaucggaaacugaaccacccuaagauccuucuggcuaaagugcgcaagaauagccuccugaagauugacggcuuuuacuauagacucaacgggcgguccggcaaugcccugauccuuaccaacgccguugaacugaucauggaugacuggcagacaaaaaccgcuaauaagauuagcggauacaugaaacgcagagccaucgauaagaaagcucggguguaccaaaacgaguuccauauucaggaacucgagcagcuguaugacuucuaccuggauaaacuugaaaauggcgucuauaagaacagaaagaauaaccaggccgagcugauccacaaugagaaggaacaauuuauggagcucaagacagaagaccagugcgugcugcucaccgagauuaagaaacuguucguuuguucucccaugcaggcggaucuuacgcugaucgggggauccaagcacacaggcaugaucgccaugagcucuaacgugaccaaggcugacuuugccgucauugcugaagauccucuggggcuccgcaacaaagugaucuacucccauaugggagagaaguga

SEQ ID NO: 4084 - RNA, 3942 nt, Artificial Sequence
  Cas9 variant
augcacuaccuggacgagaucuucgcuccccaucuccaggaaguggaugagaacuuucugagacggcuuaagcaaagcaauauucacccugaagacccggcuaaaaaccaggccuucaucggcaagcugcucuuucccgaucugcuuaaaaagaaugagcgcggguauccuacccugauuaaaaugagagacgaacuccccgucgagcagcgggcgcauuacccuguuacaaacaucuauaagcugcgcgaggcuaugauuaaugaagauagacaguucgaccugcgggagguguaccucgccgugcaccauaucaugaaguaucgcggacacuuucugaacaaugccuccgucgauaaauucaaggugggcagaaucgacuuuuacaaaucuuucaacguucuuaaugaagccuaugaggagcugcaaaacggggaagggagcuuuacgauugagcccuccaagguggaaaagaucggccagcuccugcuugauaccaagaugcggaagcugaaucgccagaaagccgucgcuaagcuccuggaggugaaaguugccgacaaggaagagacaaaaagaaacaagcagauugcgaccgccaugucuaaacuggugcucggguacaaggcugauuucgccacagucgcuauggccaauggaaacgaguggaagaucgaccugagcuccgaaaccucugaggaugaaauugagaaauuucgggaggaacuuagcgacgcgcaaaaugacauccugacagagauuaccucccucuucagccagaucaugcugaacgaaaucgugccuaacggcaugucuauuuccgagagcaugauggaucgcuacuggacgcacgaaagacagcuugccgaggugaaggaauaucuggcuacccagccggccucugcucggaaagaguuugaccaagucuacaauaaguauaucggccaggcccccaaagagcgcggguucgaucucgaaaagggacugaagaaaauucuguccaagaaagagaacuggaaggaaaucgacgagcuccugaaagccggcgauuuccuuccuaagcagagaacaagcgcuaaugggguuauuccccaucaaaugcaccagcaggagcuggaccggaucaucgaaaagcaggcgaaauacuauccuuggcucgccaccgagaaccccgcuacaggagaaagagaucgccaucaagccaaguacgagcuggaccagcuugugucuuuucggauuccguauuacgugggcccucuggucacccccgaagugcagaaagccacguccggggcuaaguucgccugggcgaaaagaaaggaggauggagagaucacaccuuggaaucucugggacaagauugaucgcgcugaaagcgccgaggccuuuaucaaacggaugaccguuaaggacacauaccugcugaacgaagacgugcuccccgcuaauucccugcuuuaucagaaauacaacguccugaaugagcucaacaaugugagaguuaacggccgccggcugucugugggcauuaagcaagauaucuauaccgaacuguucaaaaagaaaaagaccgucaaggugagcgacgucgccucccuugugauggcuaaaacaagagggguuaauaagcccagcguggagggacucucugauccuaaaaaguuuaacuccaaucuggccacguaccuggaccucaaaagcaucgucggcgauaagguggacgauaaccgcuaucagaccgaccuggagaacauuaucgaauggcggucuguuuucgaggauggggaaauuuuugcggacaaacuuacagagguggaauggcugaccgaucagcagagaagcgcccucgucaaaaagcgcuacaaaggauggggccggcuguccaagaaacugcuuacagggaucguggacgagaauggacaaagaauuaucgaucucauguggaacaccgaccagaauuucaugcagauugugaaccagccgguuuuuaaggagcaaaucgaccagcugaaucagaaggcuaucacgaacgauggcaugacacugcgggaaugggucgagucugugcucgacggcgccuauaccagcccccaaaauaaaaaggcuauuuggcaagugguccgcgugguugaagauaucgugaaagccgucgggaacgcgccuaaguccauuagcaucgaguucgccagaaaugagggaaacaaaggcgaaauuacccggucuagacgcacacagcugcagaaacuuuuugaggaccaggcucacgaacuggugaaggauaccucccucacagaggaacuggagaaggcccccgaccugagcgaucgguacuaccuuuauuucacgcagggaggaaaggacauguacaccggcgauccuaucaauuuugacgagaucucuacaaaauaugauauugaccacauccucccccaguccuucguuaaggaugacagccuggacaacagagugcuggucucccgcgcugaaaauaacaaaaagucugauagagugccggccaaacucuacgccgcuaagaugaagccuuauuggaaucagcugcuuaaacaagggcugauuacccagcggaaguucgagaaccucacaauggacguugaucagaacaucaaauaccgcagccugggcuuugugaagagacagcuggucgaaacccggcaagugauuaaacuuacggcgaauauccucggauccauguaucaggaggccggcaccgacaucauugaaacacgcgcugggcugaccaagcagcugagagaggaguucgaucuccccaaggugcgggaagucaacgacuaccaucacgccguugaugccuaccugacaaccuuugcuggacaauaucuuaaucgcagauacccuaaacugcggucuuucuuuguguauggcgaguacaugaaguucaaacaugggagcgaccucaagcugcgcaacuuuaauuucuuucacgaacugauggagggagauaaaucccagggcaagguggucgaccagcagacgggggaacuuaucacaaccagagaugagguggccaagagcuucgaccggcugcucaacaugaaauauaugcugguuucuaaggaggugcaugacagauccgaucaacucuacggcgcgacaauugucaccgcuaaagaaagcggaaagcugaccucucccaucgagauuaaaaagaagcgcccuguggaccuuuauggcgccuacacaaaugggacguccgccuuuaugaccaucaucaaauucacaggaaacaagcccaaauacaagguuauuggcgugccgaccacaagcgcugucgggcugaaacgggugggaaagccuggcucugaaagcuauaaucaggagcuccacagaaucauuaaguccaaccccaaaguuaagaaagauuuugagaucguggucccccacgugagcuacucucagcugauuguggacgaugacugcaaguucacccuggccuccgauacguaucagcauccugcgacacaacuuguccugagcaaagaauccauggagaucauugcugacgauuucaaguuuguuaaagaaaauaccgccaccgccgacgagcagcucgugcgcguguucgaugaaaucgucaaccagaugaaucacuacuuuacaaucuucgaccagcggucuaacagacaaaaggugaccaaggcucgcgauaaauuuguuagccugccgacagaguccgaguaugaaggggccaagaaaacccaggugggcaagacggaggucauuacaaaucuccugaugggacuucaugcuaacucugcccagggcgaccugaaagugcucgggcugagcaccuucggauuuuuccaguccucuggcgggcugaaccuuagcgaagacgcgaugaucguuuaccaaucccccacaggacuguuugagcggagaauuugucucaaggauaucuga

SEQ ID NO: 4085 - RNA, 3942 nt, Artificial Sequence
  Cas9 variant
augagcuucaaggagaacuccaaaaucuacuauggccuggacauugggaccgauucugugggauggagcacaacgaaugaaaaguacgagcuccugagauauaaaaacaaucuuauguggggcgucucccuguuugaagccgcuucucucgccgaggaacggcgcgggcacagaacccagcggcgcagauacgaccggcgccaacagagaguugcgcugcuuggagagcuguucgcuaaggagauccucaaaacagaucccgacuuuuuccugcggcugaaggaaagcucccucuauccugaggaucgcaccucuaagaacgugaauacauacuuugacgaugccgacuucaaagauagcgacuauuuuaagauguacccgaccgugcaucaccugauuaaagaacuuuccgagagcaacaagccccaugaugucagacugguguaccucgccugcgcuuucaucguugcccaccggggccauuuucugaauggggcugacgagaacaaugugcaggccguccuugauuucgacucuuccuauugugaauuuacagacugguucaaaagcaacgauauugaggacaauccuuuuucugaauccgugaagaacgaguucagcguuauccugcgcaagaaaaucggaauuaccgcgaaggaaagagagaucaaaaaucuccuguucggcacgaccaagacacccgauugcuacaaagacgaggaauauccuauugauaucgacgugcugauuaaguuuaucucuggcgggaaaaccaaccucgccaagcuguuccggaaucccuccuacgaugagcuugacauucagacagucgaagugggaaaggcugauuuugccgacaccaucgaucugcucgcuagcuccauggaggacacggacgugccucugcuuucugccgucaaagcgauguaugauuggagccugcucaucgacguucugaagggccaaaagacaauuuccgaugccaaggugugugaauacgagcagcacaaaagcgaccugaaggcucucaaguauaucgugcgcaaauaccuggauagagcccaguacgacgagauuuuccggaccgcuggggaaaagccgaacuaugucucuuacuccuauaacgugacagauguuaaacuuaagcagcugcccagcaauuuuaaaaagaagaacucugaggaguucugcaaauacaucaagagcaaacucgaaaagauuaaaccugaauccgacgaugaggccguguauaaugagcugaucgaaaaguguaacucuaagacccuuugccccaaacaagucaccgacgagaauagagugaucccuuaccagcuguauuaccacgaacucagcaugauucuggauaaggccuccgcuuaccuggacuuucucaacaaaacagaggauggaaucagcguuaagcagaaaauucugacgcuuaugaaguuccgcauccccuauuuugugggcccgcuggucaaacggaaugagaccgacaacguguggauugucagaaaggcggaagggcgcaucuacccuuggaauuucgagaacaugguggacuuugauaagucugaagacggauucauccggagaaugacauguaaaugcaccuaucucgccggcgaggauguucugcccaaguacucccugcuuuauagcaaauacacagugcucaaugaaauuaacaauaucaaggucaacggcgagaaaauuucuccugagcugaagcaggacaucuuuaaugaacuguucaugaagaccucccgcgugacgguuaaaaagauuacagagcuccugaaacggaagggggcuuucagcgaagagaaaggagauucccuuucuggcguggacaucaacauuaagagcucccugaagucuuaucucgauuuuagacgccugcuggaaaacgggagccuuuccgagaaugacgucgagcggaucaucgaaagaauuaccgugaccacagauaaaccccgccucgugagcuggcugaaggccgaguacucugaccugcccgccgaagauauccgguacauuuccagacucagcuauaaagacuacggacggcugucugcuaaacuucugaccggcuguuaugagcucgauacaaacacgggggaaaucggaggccgcuccauuaucgacuucaugugggccgagaauaucaaccugaugcaaauucugagcgacucuuacggcuauaagagcuuuaucgaggaagagaauaagaaguacuauaugauuaacccuaccggguccaucgcgcagacacuuagagaaauguacguuagcccgucugucucccgggcuauuaucagaaccauggagaucgugaaagagcuccgcaagauuaccaaaaaggaucccgacaaaaucuucguggaaauggcccggggaggcaagccugaggaaaaagggaagagaacaagcucccgcagagagcagauugaaaagcuguacgauucugccaaggcuuuugucagcgacgaggauaucucccauaugcggucucaacugggaagccucuccgacgagcagcugcgcagagaaaaguauuaccuuuauuucauucaguuuggcaaaugcauguacucuggggaggccaucgauuucagccggcugggcgacaaucacuguuaugauaucgaccauauuuuuccccaguccaagaucaacgaugacagccuccacaauaaagugcugguuaagucucaacugaacggagaaaaguccgacgauuacccuauuaaagcugagauccgcaauaagaugcacccccuuuggaaaaaccucuucuauagagacccgaagaauccugccgauaaagugaaguacgaacggcugacgcgcagcacccccuuuacagaggacgagcuggcgggcuucauugaaagacagcucgucgagacccggcagucuacaaaggccguggcuacccugcuuaaagaaauguuuccugauuccaagaucguuuacgugaaagccgggcaggucagcgaguuccgccaugacuucgauaugcugaagugcagagaaauuaacgaccuccaccaugcuaaagaugccuaucugaauaucgugaucggaaacguucacgacgugaaguuuacgucuaaccccaugaauuucgucaagaacgcggauaaacauuacacaauuaaggugaaagagacccugaagcacaaagugucccggaauggcgagacagccuggaacccugaaaccgacuuugauaccgucaagagaaugaugagcaaaaauuccguucgcuaugugcgguacugcuauaaaagaaaagggggauucuuuaaccaaaaucccgaccgcgcuggcaacccggaccuugcccggcugaaaaaggaucucgacccugugaaauacgggggcuauaauagcaagucuaucagcuguuucucccugauuaaaugcacaggagucggcgcugugaucauucccguugagcuccugugugaaaagagauacuuuucugaugacagcuucgccuccgaguacgccuauucugugcuuaagaacgcucugcccgcgaaaaauaucgccaagaucagcauugaugacaucuccuuuccucucaaacgccggccgauuaagaucaacacgcuguucgaguuugauggguacagagucaauauucgcucuaaagacagcuaucacuacuucaccaucuccagcgcuauggccgccaucuauucuaaggauacauccgacuacauuaaggcugugagcucuuauaucgauaaauccgacaagggaagcaaauucaagcccggcgaagccuuugauguucuguccaaccuuaaaguguacgacgagauugcgaagaagugcaucucugaaccuuucagcaaaauuuccaagcuggcugaggccgggaaacgguggaagaaagaagagaucagccuccagaauugucugcucuga

SEQ ID NO: 4086 - RNA, 3945 nt, Artificial Sequence
  Cas9 variant
augcugaagaaagacuacagcaucggccucgauauugggaccaacuccgugggacacgccgucguuacagacgauuauaaggugcccacgaaaaagaugaaaguguucggcgacaccucuaagaagacaaucaaaaagaauaugcuggggguccuucuguuuaacgagggacagaccgcugccgauacaagacucaaacggggcgcgcgcagacgguacacccgcagaaagaaucggcugcgcuaucuucaagaaauuuucgcuccugcccuggccaaaguggacccgaacuuuuucuacagacucgaggaaagcucccugguugcugaggauaagaaguaugacguguaccccaucuuugggaaacgggaagaggagcugcucuaucaugauacacacaagaccauuuaccaucugcgcucugaacuugccaauaacgacagaccugcugaucugcggcucgucuaccuggcccuugcgcacaucaucaaauaucgcggaaauuuccugcucgagggcgaaauugaccugagaacgaccgauaucaacaagguguuugccgaguucagcgagacacugaaugaaaacuccgacgagaaucucggcaaacuggacguugcugauauuuuuaaggacaacaccuucucuaaaacaaagaaaagcgaggagcuucugaaacucuccggggccaagaaaaaucagcuggcucaucagcuuuuuaagaugauggugggaaacaugggcagcuucaaaaagguccuggggaccgaugaggagcacaagcucucuuuuggaaaagacacguacgaggaugaccugaaugaucugcucgccgaagcgggcgaccaguaucuggauaucuucguggccgcuaagaaaguguacgacgccgcuauucuugccuccauccuggaugucaaggacacacaaaccaaaacaguuuucagccaggccaugauugagcgguaugaggaacaccagaaggaccucaucgaacugaagcgcguguuuaaaaaguaccuucccgagaaaugccaugauuucuuuucugagccuaagaucuccggguaugcuggauacauugacggcaaagugagcgaagaggauuucuacaaguauaccaagaaaacccugaagggcauccccgaaacagaggaaauucuccagaaaaucgacgcgaacaacuaccugagaaagcaacggacguuugauaauggggccauuccucaccagguccaucugaaagagcucguggcuaucguugagaaccagggaaaguauuacccguuccugagagaaaauaaagacaaguuugagaagauccuuaacuuccgcauucccuauuacgugggcccucuggcccggggaaauucuaaauuugccuggcucaccagagcuggggaaggcaagaucacacccuauaacuucgaugagaugauugacaaagagaccuccgccgaagauuuuaucaagcgcaugacaauuaaugaccuguaccugccuaccgagcccguccuuccgaaacacagccuccuguacgaacgguauacgaucuucaacgagcuggcgggggugagauacguuacagaaaauggagaggcuaaguauuuugaugcccagaccaagcgcuccaucuucgaacucuucaaacuggaccggaaggugucugaaaagauggucauuaagcaccuuaaaguggucaugccugccauccgcauucaagcucugaagggccucgauaacggcaaguuuaaugccagcuacgggaccuauaaagaccugguggacaugggaguugcucccgagcugcuuaacgaugaagucaauuccgagaagugggaagacaucauuaaaacacucaccaucuucgagggcagaaagcugauuaaacggagacuggagaacuaccgcgauuuucucggggaagacauccugcggaaacuuagcagaaagaaauauacaggauggggccggcugucugccaagcuccuggaugggaucuacgacaaaaagacgcauaaaaccauucuggauugucuuaugacagaggacuacucccagaauuucaugcagcucaucaacgaugacaccuauagcuuuaaggaaacaauuaaaaacgcgcaagugaucgagaaggaagagacccuggccaagacggugcaggagcugccuggcucucccgcuauuaaaaagggaauccuccagagccuggaaaucguugaugagauuaucaaagugaugggcuacaagcccaaauccauugucguggaaauggcccgcgagacccagaagacacacgggaccagaaagcgggaggacagagugcaacagaucguuaaaaaucuuaaggaugcuaacgaacugccuaaaaagcucccgucuaaugccgagcugagcgacgaacgcaaauaucuguacugccuucagaacggacgggacauguauacaggcgcgccccucgauuacgaccaucugcaguucuaugaugucgaccacauuaucccucaauccuuucugaaggaugacagcaucgagaauaaggugcucaccauuaaaaaggaaaacgugagaaaaacgaaugggcugcccucugaggccgucauccagaagaugggauccuucuggaaaaagcugcuugaugcuggcgccaugacaaacaagaaauacgacaaucuccgcagaaaccugcaugggggccugaaugagaaacuuaaggaacgguuuauugagcgccagcugguggaaaccagacagaucacaaaguacguugcucaacuccuggaucagcggcucaacuaugacggaaauggcguggagcuggaugaaaagauugccaucgucacccuuaaggcccagcuggcuagccaguuccgcucugaguuuaagcucagaaaagugcgggcgcugaacaaucugcaccacgcccaugacgcuuaccuuaacgccguuguggccaaccugaucauggcuaaguauccugagcucgaacccgaguucgucuacgggaaauaucgcaagaccaaauuuaagggacugggcaaagccacagcgaagaauacgcucuacgcuaacgugcuguauuuccuuaaggaaaaugagguuuacccguucugggacaaagccagagaucugccuaccauuaagcgguaccucuaucgcgcccaagugaacaaagucagaaaggcugaacggcagacagggggauuuuccgacgagaugcuggugcccaaaagcgauuccggcaagcugcuuccuagaaaggaggggcuggaccccgugaaauacggcggauaugccaaggcggucgaaucuuacgcuguucucaucaccgccgaugaggugaaaaagggcaaaacaaagaaggugaaaacccuggucaauauuccuaucauugacagcaagaaauaugaagccgaucccacggcuuaccucgccucccgcggguauacaaacgugaccaauucuuucauccugccgaaguacagccuucuggaggacccugagggacggagacgcuaccuggcuuccuuuaaagaguuccagaaggccaacgaacucauucugccccaacaccuuguugaacugcucuauugggugaaugcgaaggauggcgagcagaaacuggaagaccauaaggccgaguuuaaagaacucuucgauaagaucauggaauuugcugacaaauacgucguggcccccaagaacagcgagaaaauccggagacuguaugaagagaaucaggaugcuaccccuauggaacuugggaagaacuucguugagcugcugcgcuacacagccgacggagccgcuucugacuuuaaguucuuuggcgagaauauuccgcggaaaagauauaacuccgcggggagccuccugaauggcacccuuaucuaccagucuaagacaggacuguaugaaacgcgcauugaucucggcaaacuguga

SEQ ID NO: 4087 - RNA, 3948 nt, Artificial Sequence
  Cas9 variant
augggcuacagcguggggcuggacaucggaaccggcuccgucggguggguugugacaaacgaggauggaaagcucgccagagcuaaaggcaagaaucugauuggggugcggcuuuucaaaacggccgaacccgcggcugaccgcagaaccaaccggacaacccgcagacggcugucucgcagaaaguggcggcuccgccugcuugaugagcuguuugccaaugaacucggaaaaaucgacagcaacuuccugacaagacugaaguauuccuacguccacccuaaggaugacgccaaucgggcuaacuauuacggcggcuaucucuuuccgacccaggaggaaacaaagaaguuccaugccaaauaccccaccauuuaucaucugcgccuugcucugaugacggagucuagacaauuugaucuccgggagaucuaccuggccaugcaccagauugugaaguaccgcgggcacuuccuuaauagccaguccaaaaugaccaucggaaacacauauaauccucaggaccugcaaaccgcgauggaaaacuacgccgaggcuaagggccucucuaucgaacugaagcagcccgaggagaugguugccauucugacaggggaagcuggauuuggccucagcaaaaaggccaaagcggagaagcugcuuaauaacuucuuuuucgauaccaaagaagagaaggccacggugcaggcuauccuggccgggauugucggaaauacaaucgacuuuaccaaaguguucaacagacagcucacaggcgauacccugaaggcuuggaaacuuaaacuggacuccgaaaccuuugauguugacagcgagccuauucucucugaccuggaugacgaugagacagaacuguucuucgccauccggcaagccuuugacggcuucacgcucaugaaucugcuuggggaucagaccuccauuagcgcugcgaugguggagagauauacacagcaucacgacgaucugcucaccgucaaacagguggccaagaagcaaggacugucucacaaagaauuuuccaacaucuacagcgcuuuccuuaaggacgauacagacaagggcaugaaaaagcugcucgaggaaucuaaccuguccaccgaggaugugaaugggauccagcugcgcauggacagccaugacuuucucccccagcaacggacgaaagccaacuccgucauuccucaccagcugcaucuugccgagcuggaagcuaucauugagaaucagggacaguauuacccguuccuccuggaaacauuugagaaggaaggcaccgccgcgaacaaaaucgcugagcugcuuaaguuccgcauucccuauuacguugggccuauggugaccaagaaagauguggagaaugccggaggcgacgccacaaaccacugggucaccagaaaugaaggcuacgagaagucugcugugacagccuggaacuuugaucaaguuuucaaucgggaccaggcugcccucgauuuuauccagagacugacggggaccgacacauaucugaucggagaacccacccucccucagaacagccugaaauaccaaauguucacagugcuuaaugagcugaacaaugucaaggugaacggccgccggauugauaaucagaccaaacacgaccucauccaggaucuguuuaaguccaagaaaacgguuagccugaaggcguuccaggacuauuaccaaucucaggggaaauccgauauucagguggucggacuugccgacaagaccaaauucaacagcaaccucucuacauauaucgaucugagcaagaccuuuuccgcugaggaaauggagaauccccagaaccaagaccugcucgaacagauuguggagauccagacagucuucgaagacucuaaaaucgccgagagagagcugagcaaacuugaacugaccccggagcaagugacgaagcucgcuaagacacauuacaccggcugggggaaucuguccaacaagcugcuuacaaccccuauuguugaugugagcggcaaaaaggucucuauccucgaccagcuggccaaaaccuccaagaauuuuaugagcauuaucucuaacgaacaguauggagugcaggauuggauuaaggagcaaaauacaacggaaaccacaggcacccuggaggacaaacucgcggaucugacaaccucccccgccaacaagcgcgggaucaaacaggcuuucaauguucuuuuugacauucagaaggccaugaaaagcgagccugaucggguguaccuggaguucgcuagagaaacgcagacauccguccgcaccaugucucgguacaacuaucucaagggacuguaccaaagcaagucccuggacgccgaagccaaaaaucuuaagaaagagcucgcugaaaccgaucagaagaaauuugacaacgauagacuguaucuguacuuccagcagcaaggcaaggacauguauacagggcagcccaucaauaucgauaagcucucuagcgacuacgacauugaucacaucauuccccaggcguuuaccaaagacgauuccaucgacaaccgggugcuggugagccgcccugagaaugccagaaagucugauuccggaacauauacgaccgagguucaagcugccgccagcggccuuuggaaaacacugguccagucuggguucauuucccggaagaaauacgacagacucacccaugcuggcgauuacagcgaaggacagaagacaggcuuuaucgcccgccagcugguggagacccggcaaaucauuaaaaacguggcggcucugaucgaaucugaguucgaccagacgcaggccgucgccauuagagcugagaucaccggggauaugcgcagacuuguggccauuaagaagcaccgggaaaucaacagcuuucaucacgcguucgacgcucugcucaucacagccgccggacaguauaugcaaaaacgcuacccggauagagacuccaauaacguuuauaaugaguucgaccgguacaccaacgauuaucugaagaaacuccgcgaaucuagcuccaaggacgaggugagaaaacugaagcccuuuggcuucauugucgggacaauggcuaagggaaaugaagauuggaccacagagcagaccgaguaccuucggcacaucaugaacuuuaaaaauauucugacgacauauaagaccggcccugaccgcgggccccucagcaaagaaaccaucuacgccguggauccuaaggcuaaacugauuggcacaaacaagcauagacaggacguuucccuguacggaggcuauaccuaccccuauucugccuacaugacgcuugugcgggcgaaugggaagaaccagcuggucaaagugagccgcuccgccgcuucucucaugaaaagcggacaacugaagcucgaggauuauguucagcagcagccggaagugaagaaauucgagaagauccugcuugaacaucugccucucggccaacuggucgacaaugaugggaagcugauguaccuuacauccuaugaguuuuaccacaacgccaaacagcuguggcucucuaccgagaaugcugaccugaucagcucccucagcauugauucugacgaucagaagcugaucaaagccuucgacauucuuacagccgacuccgugaucgaaagauuucccuucuacgagauugaucugaagaaacugaucgaacuccgggacaaguuugugcugauugauaacaaacuugacguccugagaguugugcucaaggcucugcaacucgauagcgcgcagcagaagccucugaaacuuaucgacaaggccgcuaccgauuggaaaaauuaucgccaggccggaggcaucaagcugucugacaacgccgagauuaucuaccaauccacaaccgggauuuucgaaaaacggaucaagauuagcgaucugcucuga

SEQ ID NO: 4088 - RNA, 3951 nt, Artificial Sequence
  Cas9 variant
augcugcagaagaacuacaccaucggccucgacauugggacaaauagcgugggauaugccgucaucaacgauaauuacaaaguucccgcuaagaaaaugaaggugcugggcaacacggacaaaaagaccauuaagaaaaaucuuaugggggugcuccuguucgaugccggagagacagcggcuaccacaagacugaagcggggcacccgcagacgguauacacgcagacggaaccgccuuagauaccugcaagaaauccucgggccugagcuggccaaagucgacgccaauuuucugcaccggcucgcugaauccucucuggugaccgaggauaaggaguucagcgccuauccgauuuuuggagaccgcgaggaggaacuucuguaccauaaaacguauaagaccaucuaccaccucagauccgcucuggccaacaaggaugagaaagcggaccuucggcugaucuaccucgcccuggcucauauuaucaaguaucgcggcaauuuccugauugaaggcgagaucgagcucucugauacagacauugauaaaguuuacgccgacuuuugccggagcuucaacgaacuguuugauaccgaggugcuucaggaaaucgaggucgaagcuauuuucaaggacaaaacacuguccaagaccaaaaaggccgaggagcucgugaagguuucuggggugaaaaagaaucaggucgcgcaccaguuucugaaaaugauggugggaaacacggugaauuucaagaaagucuuuaaccuuacagaagaccaaaagcugagcuucggcaccgauuccuaugaggacgaacucaaugaucugcuggccaagagcgacgauagauaccucgacguuuuuguggcugccaaaaagguguaugauacagcuauccuggccaacauccuuaacaccaaaaauucugucgccaccaagacaauuuucucccagagcaugaucgagcgcuucaaagaccaucagaaggaucugaaggaacucaaacagcuguuuaagacguaccuucccgagaaauauccugacuucuuugggaacucuaaggaggauggauacgcuggcuacauugaagggaaaaccaaugaggaaaaguucuauacacacaccaagaaaauccugaagaacauuccccaagcggccuccgugcucgcucagaucgacguuggaaauuaccugagaaaacagcggacauuugacaacggcgugaucccucaccagauucaacugaaggagcuccuggccaucauugaaaaucagggcaaauauuaccccuuccuucuggagaacaaggagaaaaucgccaagauucucaccuuuagaaucccuuauuacgucgggccgcuggcucgcggaaauagccgguucgccuggcugaagagagugggcaaagaaaagaucacgcccuuuaacuucgagaauguuguggaucuugaaucuuccgcggagcgcuuuauugagcggaugacacucaacgaccuguaucugccugaagagaaaguccuccccaagcauagcaugcuguacgaaaaauucuccaucuuuaaugagcuugcugggauuagauacaucaccgauaacggagaaaugaaguuccuggacgcccagaccaagcaaucuauuuucgagcucuuuaaacaggagcgcacagugaaggaaaagaagguccuggaucugcuuaaaacccucaugccuagcgagcgggugguugccaucaagggcauugacaaugggaaguucaacgcuuccuuuggaacauaucacgaucugagcaaaaugggcuucaagacggagaaaaucgccucugaauccaaccaggcuagaugggaagagaucauuaagacccugacaaucuuugaggaccgcaaacucauuaagagccggcugagaaaguacgaugacuuccuuaaugaaaaagagaucggcgcccugucuaagcgcaaauauaccggguggggacggcucagcgcgaagcugauugauggcaucuacgacaaaaagacacaucagaccauccuggauuuucuuaugaacgaagacuauaaucaaaacuucaugcagcucauuuccaaugacaacuacucuuuuaaaaagaucauugaggauagccaggugaucaaggaagaggggucccugacggaggucauucaggaacugcccggaagcccggccaucaaaaagggcauccuccaaucuauugagaucguggacgaacugguuaaagugaugggcgggaauccuaagaaaauugucguggagauggcuagagagacccagaagacacacggaaccacacggcgcgaagccagaaucaaggagauuaucaaaaaccuuaauaagcugaaacucaacgaacugcccaaggaucugccuuccaaugaggaacuuagcgacgagaaaguguaucucuacugucugcagaacggccgggauauguacaccggggcuccccuggaccucgauaaucugucucaguaugagguugaccacaucauuccccaauccuuccuuaaggaugacagcaucgaaaacaagguccugacggccaaaauugaaaauuccagaaagacaaacggacucccuucuguggaaaucgcgaaaaagaugggcgccuuuuggcgcagccugcugaaagugggggcuauuuccgagaagaaguaccggaaccuuagacgcucucugcauggaggcaugaccgaaaaacucaaggagacauucgucaaaagacagcugguggagacccggcagaucaccaaguauguugcccagauucucaauagccgcuuuaacgaagagaaaaaugaagauaagguggcuaucgucacacugaaggcccaacuuacgucccaguucagaaaagacuucgagcuguacaaggugcgggaaaucaacaaucuccaccaugcccacgaugcuuaucugaacgcgguucuggccacccuucugaugaccagcuuuccggagcucgagcccgaguucguguacgggaaauaucgcaagacaaaauuuaagggccugggaaaagcuacagccaagaauaaccucuacaccaauauucugcagcuucugaaggaagaaucugcccaauacugggacacgaaagagagagaccucgcuacaaucaagaaaaacgucuaucaggcccaggugaauaagguucggaaaguggagcgccagaccggcuccuucuacgaugaaaccgucgcgaaaaagagcgcuucucaaaaacuguuuccuagaaagaacgggcuggaccccgugaaauauggaggcuaccagcgggccaaugagggguauucccuucuguuccgcgccgauaugcucaacaagagaggaaaaacaaagagcgugaagacccuggucaaaauuccuaucauugaaucugcucaguaccucgccgaccccacagaguaucuggcgaagcggggcuacuacaauguuagcgaacauucccuucugcugccgaaauuuagccuccuggagaacaacaaugggcuuagacgcuaucuggcuucuuccaacgaguuccagaaggccaaugaacucauccugccuaaacaccucgugcggcugcuuuacuggagccaauccaagcagagaaaggaggaacugaacaaacaccgcgccgaguuugcugaacuguucacguauaucauggauuuugccgacaaguacguggucgcucccaaaaauucugagaagauuaaaaacaucuaugagaauaacaaggauagcuccguggaaguucucggcaaaaauuucauugagcugcuuaaguacaccgccgacggagcggccucugauuucacauuuuucgacaccaagaucccucggaaaagauauaacagcgcuggcgaucugcucgacgggacacugauuuaccaguccaagaccggacucuacgaaacgcgcaucgaccugggcgccaucuga

SEQ ID NO: 4089 - RNA, 3957 nt, Artificial Sequence
  Cas9 variant
augaugaucaagcugaacaauaugaaaaagauucucggccuggaccuugggaccaacagcaucggaugggccguggucgagacagaagauaauaaaaaguucgagcugcucgacaaaggcguuagaauuuuucaggaaggggugaagaucgagaagggaauugaauccucuaaagcugccgagcggacgggcuaccgcagcgcgagacggaucaaguuccgcagacggcugcgcaaaaucgagacccuuaaggugcugauugaaaacaauaugugcccccucuccauggaugagcugaucgucuggaaagaaaacaagaauaacuauccuaagaauaaaaucuuuuacaacuggcugaagacaaaagacccgaaggaggggaccaauggaacauauauuaaccccuacuauuucagaaccgaggcuauuaaacggaagcucgaaaauacaaacgaugugggccgcgcccuguaccaccuugcccaaagacggggcuuuaaaucuaaucgccuggagagcaccgacgaaaaguccagagggaucguuaagacggagauuaacaaacucucuagcgaacugaacggacgguaucuuggcgaguacuucuacgagcuguaucucaagggggaaaagauccgcaagagacauaucucccgggaggaacacuaccugaaugaguuuaaaaagauuugugaagugcagaacuucaauaaggagcuggcugagaaacucgaaagagccaucuuuuaucagcgcccucuuaagagccagaaaggacuggucggcaagugcacccugcaaaacaauaaacaucggugucccauuucuagaccugaguucgaagaguuucgcauguggcaguucaucaacuccauuaaguacaagaauagcgaugggaaauuugacuuccucaacaaggaacagcgggagaauaucauccccgcuuucgugucuaacaaaaaugccacauuugaguucuccaagauugagaaaauccugaacaagggaguucacauuuaucaguuuaauuacaagagcaaccauaccaucggcucuaaucaaacaaugauuaacuucauggauguguuugacaucgauagaaaacuuaccaacgcguggcugcucugcgucaauaagaucuaugaacuguacacggccaaaacaaagaaagacggcucccucaagagcaaauccgaagugauuaccgauguguggcacguccuguucacauuugacaacgaggagaaucugaaggaguucgcucgcaacaaacuucugcucgacgaaucuagcgcccagaaauuuuccaagaucaaucugaaacaggauuacagccagcuuucucugaaggcuauuaacaaaauccucccuuaucugcaagaagggcugauuuacuccuaugccguuuucaucgcgaauauugagaacgugaucggaaagagcaucuggaauauuaaggaaaaccagcagaucauucggaccucuaucaaaaagauuaucgacaaucacaaaaccgagcucgauaucaacacaauuacgaauagccugaucaacgacuuuaaggugaauuacaacaacgcccauaaagaguauaaggucgaugacauugaucuuaagaauaucagagagaaaauuaucaaguacuauggcaacaaaaccuggaauugucugccggaagacgaaaagcucuacgugaaagagaagguugaaaagcuguacgagaaacaacugaaguccgggaaacgcggaaucuucauugagaagauccggcuugaugacagaauugaaaacuuucucaaagauaauuucgacucuagcgagcugaaccugaagaaacucuaucaccccuccgacgugagcgucuacaagucugugaagaucacagaucugggccuucgccugcucggguccccuaugauucccagcaucaaaaauccuauggcuaugcgggccaugcaucagcugagaaagcugaucaaccaccuuauuaucgaaggaguuauugacgauucuaccaucauuaauguggagaugucccgggaacucaacgacgcuaauaugcgcaaagccaucgagagauaucagcggcagagagccacagagaacgaagaguucaagaccaaaauuaaggaacuguacaagaaagagugcggcacggauuuugagcccaauaacgacgauaucaugaaguaucgccugugggaggaacaaaaucacaaaugucucuacacaggcaagagcaucgggauuugcgacuucaucggauccaacccggcuuuugaaauugagcauaccaucccucggucucugagcuaugauaacucccuugaaaauaaaacccugugugagaaggaguucaaccagcaggucaagaaaaaucgcauucccuuugaacucucuaacuacaaggagaucaucagcagaauuaauaacugggaaaucaaagcggaggaacuguucaagcagauucaaaaagugaagauccaguccagaauggccgcuacaaaggagauuaaagacaaugccauccagcggaagcaucugcuucagauggaguuuaacuacuggaauggcaaacucagccgcuucaccagagaagaugucccugagggguuuaagaacucucaacugguggacaucggaauuaucacaaaauaugcccgggcuuaccugaagacgguuuucaauaacgugaauaccgucaagggcuccacaguggccgaauuucgcaacauuugggggcuccaggaguauuucgagaaaaaggauagaagcaaucacauccaccauugcauugacgcgaucaccauugcuugucugacaaaagacaaguacgauuuucuugcccaccuguaucaccucgacgaacagaacaaucgggaugccguucaucgcgcuaugaucaaaucuaagcccugggagaacuucgugcaggacgucaaagaaaucgagaaccaaauucuggugucccacuacacccccgauaaucugccuaagcagagcaagaaaauccuuagaaagcggggcaaaauucagaagaacgaaaauggagaccucaucuaugagaaaggcgaugccgugcgcgggucucugcauaaggagagcuucuacggagcuauuaagagagaaaucaucaacaaaaagggcgagacggaagagaaaguucuguacgucaagcggaaaccgcucgaauuuuccgaccugggguucaagaccauuagcgagcuugagaauaucguggaugacgccgugagagauaagguccugaacgcggugaaagacaagggacucaaacaagcccugaaugaacccauuuggaugaacgaggaaaagcagaucccuauuaaaaagguucgcugcuauacacccucugugaccaauccuaucaaccugaagaaacaccgggauaaguccaaacacgaguacaagcagagcuaucaugucacaaaugacggcaacuaccuuauggugaucuaugaagggaaagacucccaggagaagguuaaaagagauuacgagauugugucuaaucugcaagcuggcgaauauuuuaagcagagcguccacggagugcucaaggcccagggcaucaacaaucuggaggggcucauucccaaauucaaggaauccggcaaaaacauccugccgcuuaaguacauucugaaaaccggaacgaugguuaucuuuugggagaacuacccugaagagauuugggacaucgauaagaaucagcucuauaagcgccuguucaaagugacacaauuugagucugacgggcggauccaggcuagauuccaucagauugccaagcccgauaacgaacugaccaaagucagcgagcuugacuuuuccaauaucgcggaaaagauucgccugucuaaaggaaaccucaauaugcuggugaacggcuacgauuucaagaucaaugugcucgggcacauugagaagcugagcuga

SEQ ID NO: 4090 - RNA, 3957 nt, Artificial Sequence
  Cas9 variant
augggcagcaacaugcugaagaaagacuacuccaucgggcucgauauuggaaccaauucugugggccacgccgucguuacagacgauuauaaggugcccacgaaaaagaugaaaguguucggggacaccagcaagaagacaaucaaaaagaacaugcugggaguccuucuguuuaaugagggccagaccgcugccgauacaagacucaaacgggggacccgcagacgguacacacgcagaaagaaccggcugcgcuaucuucaagaaauuuucgcgccugagcuggcuaaaguggacccgaauuuucucuacagacuggaagaguccucucugguugccgaagauaagaaguaugacguguaccccaucuucggaaaacgggaggaggaacuccuguaucaugauaccuacaagacgauuuaccaccuucgcagcgcccuggcuaacaaugaccagccugccgaucucagacuggucuaucuugcucuggcccauaucaucaaauaccggggcaacuuucuccuggagggcgaaauugaccugcgcaccacagauaucaauaagguguucgcggaguuuuccgagacccucaacgaaaauucugacgagaaccuggggaaacuugacguugccgauauuuucaagaauaacacauuuagcaaaaccaagaaguccgaggaacugcucaaacugagcggagcuaagaaaaaucagcuugcccaccagcuguucaagaugauggugggcaacauggggucuuuuaaaaagguccucggaacggacgaggaacauaagcuguccuucggcaaagauacauaugaggacgaucugaacgaccuccuggcugaagccggggaucaauaccuugacaucuuuguggcggccaagaaaguguaugaugcugccauucuggcuagcauccucgacgucaaggauacccagacaaaaaccguuuucucucaggccaugauugagagauacgaggaacaccagaaggaccugaucgaacuuaagcggguguucaaaaaguaucugcccgagaaaugccacgacuuuuucuccgagccuaagaucagcggauacgccggcuacauugauggcaaagugucugaagaggacuuuuauaaguacaccaagaaaacacucaaggggauccccgaaacggaggaaauucugcaaaagaucgaugcuaauaacuaucugcgcaagcagagaaccuucgacaauggagcgauuccucaucagguccaccucaaagagcugguggccaucguugagaaccagggcaaguacuauccguuucuucgggaaaauaaagauaaguucgagaagauccugaacuuucgcauucccuacuauguggggccucucgcuagaggaaauuccaaauucgccuggcugacacgggccggcgaagggaagaucacccccuacaacuuugacgagaugauugauaaagagacaagcgcugaagacuucaucaagcauaugaccauuaaugaucuguaccuuccuacggagcccguccucccgaaacacucccugcuguaugaaagauacacaaucuuuaacgagcucgccggagugcgcuauguuaccgaaaauggcgaggcgaaguacuucgacgcucaaaccaagcggucuaucuuugagcuguucaaacuugauagaaaggugagcgaaaagauggucauuaagcaccugaaaguggucaugccugccauccgcauucaggcccucaagggccuggacaacgggaaguucaaugcuuccuauggaacauacaaagaucugguggacaugggcguugcccccgagcuucucaacgacgaagugaauagcgagaagugggaagauaucauuaaaacccugacaaucuuugaggggcggaagcugauuaaaagacgccucgagaacuaucgggacuuccugggagaagauauccuuagaaagcugucucgcaagaaauacacgggcugggggcggcucuccgcuaagcugcuggacggcaucuacgauaaaaagacccauaaaacaauucuugacugucucaugaccgaggauuauagccagaacuuuaugcaacugaucaaugacgauaacuacucuuucaaggaaacaauuaaaaaugcccaggucaucgagaaggaagagacccuggcgaagacggugcaggagcucccuggaagccccgccauuaaaaagggcauccugcagucccuugaaaucguugacgagauuaucaaagugaugggguauaagcccaaaucuauugucguggaaauggcuagagagacccaaaagacacacggaacccggaagcgcgaggauagagugcagcagaucguugaaaaccugaaagacgccaaugagcucccugaaaagcugccgagcaacgcugagcuguccgaugaacggaaauaccuuuauugccuccagaauggcagagacauguacacaggggcgccccuggacuaugaucaucugcaauuuuacgacgucgaucacauuaucccucagagcuuccucaaggacgauucuaucgagaacaaagugcugaccauuaagaaggagaaugugcgcaaaacgaacggacuucccuccgaagccgucauccagaagaugggcagcuuuuggaaaaagcugcucgacgccggggcuaugacaaauaaaaaguacgauaaccugcggagaaaucugcauggcggacuuaacgagaagcugaaagaacgcuucauugagagacagcucguggaaacccggcaaaucacaaaguauguugcccagcugcucgaccagcgccugaauuacgauggcaacgggguggagcuugacgagaaaauugcuaucgucacccugaaggcccagcucgccucucaauuuagauccgaguucaaacugcggaaggugcgcgcucugaacaaucuucaccacgcgcaugaugccuaucugaacgcuaucguugccaaucucauuauggccaaguacccugaacuggaacccgaguuuguguauggaaaauacagaaaggcuaaauucaagggccucgggaaagccaccgcgaagaacacacuguaugcuaauguccuuuacuuucugaaagaaaacgagguguacccguucugggacaaggcccgggaccucccuacgaucaagcgcuaucuguacagagcccagguuaauaaagugcggaaggcugagcgccagauuggaggcuucagcgaugaaaugcugguccccaaauccgacucugggaaacuucugccuagaaaagagggccucgaucccgugaaguauggaggcuacgccaaggcgguggaaagcuaugcuguccugaucaccgccgacgagguuaaaaaggggaaaacaaagaaagugaagacccucgugaacauuccuaucauugauuccaagaaauacgaggccgaccccacagcuuaucuggccucucggggauacaccaaugucacgaacagcuuuauccuuccgaaguacucccugcuggaagauccugagggcagacgccgguaucucgcuagcuucaaagaauuucaaaaggccaaugagcugauccuuccccagcaccugguggaacuccuguacuggguuaacgcgaaagacggggagcagaagcucgaggaucauaaggccgaguucaaagaacuguuugacaagauuauggaauuugcugauaaauauguggucgcccccaaaaauucugagaaaaucagacgccuuuacgaagagaaccaggacgcuacaccuauggagcugggaaagaauuucguggaacugcuccgguauaccgccgauggcgccgcuuccgacuucaaauuuuucggggagaacauuccgagaaagcgcuacaacagcgcgggcucucugcuuaauggaacccugaucuaucaauccaagacaggccucuacgaaacccggauugaccuggggaaacucuga

SEQ ID NO: 4091 - RNA, 3960 nt, Artificial Sequence
  Cas9 variant
auguucagccagagaaacaaucccuacugcgagcugcucuuuaagaucauugugaccaacaucgaagagaaaaaucuggaagucauuaugggcauccggaacuccgacauuuucuuuaucucuaauuucaugugguaucaaaaacuuaucaugaugauuaaaaacauccuggggcucgaucugggaacaaauagcauuggcugggcccuuaucgagguugacgaaaacaauauuccuauccgcauuaucgcuaugggguccagaaucauuccgcugucuacgagcgauaaggaggaguuucagcggggacucuccaucaccaaaaaccagaaucgcacagugucuagaacccagcggaagggcuacgaccgcaagcaacugagacggagcgaucugaaaaagauucucaaaaaguauaacaucuuccccuccgaggagcugcuuaaacugccuaugcucgaccuguggaaacuucgcagcgauucugccaaucccaacgaagacauuuccgcggagcagcuggggagaauccucuacaugcugaaucagaagcggggauauaaaagcgcucgcucugaggccaacuccgauaagaaagacacagauuacgugcaggccgucaagggcagauaugcucaacugaaagaccggcgccagaccaucggccaguacuuuuacgaggaacucagcacagccuucucugauaagaacaaucagcaauauuuuagagugaaagaagagguuuacccucgggaggcuuauauugaagaguucgacaccaucauuaacgcccagaaggacaagcacggguuucugacggauaaagugauccaucagcuuagaaaugaaauuaucuacuuccaacgcaagcugaaaucccagaagggacucgucagcaucugugagcuggaaggcuuugagaaaaccguguaugacaaggaaaagaacaaaaauaagguuguguucgucgggcccaaaguggcgccuaagacauccccgcuuuuccagcugugccggauuugggagguggucaacaccaucucucucaaaauuaagaaucccgagggaagcaaguacaaauggggcgaaaagguuccuaaccugaaacagaaggagauccuggccgauuaucucuuuaaaaaugaaaaccuguccuucagcacacuucuggagauucucgaacugaagaaggaggacguguacgugaauaaacaaauccuuaaggggauuaaaggaaacgaggcuuacgccgcucugcacaauguccucggcgaucaugaacugcugaacuuugacgugucuaucaucaccuccgaucacacggccauucucguugacaagaaaacaggcgagauccuggaagagagagcggggcuugagcuggaugccagccucgaacgcgagccccuguaucaguucuggcauaccauuuacucucugaaggaccuugaugaauguaaaaaugcucucaucaagcgguuuggacuggacgaggacauugccgaaaagcugagccacaucgauuucaacaaacaggcuuuuggcuccaagucuaacaaaagcaugagaaagauccucccuuuccugauggagggguauaauuacuccgagagcugcucucuugccggauauaaccacuccaauagccugacaaaagacgaacgcgagucucagauuacccucgaacggcuggagcugcuucccaagaacaaucucagacaaccgaucguggaaaagauucugaaccagaugaucaaugucgugaacaccauucuggagaaauacggcaagccuuccgagauccgcguugaacucgcccgggagcugaaacagagcaaggaugaaagaaaugacacagaucuucagaacucccgcaauaaaaagcugaacgaggaaaucgggaagcggcucgcugagcugggacugcccgugacgaaaagauauauucaaaaguacaaauuuaucuucccuucucuuagcaagaaucucaaagacgcgcaugucaacaaucaguguauuuacugcggcgagaccuuuaaccugacagaagcccugaacggcgaugcuuaugacguggaucacaucguccccaaggcccuccuguucgacgauucccagaccaauaaggugcuuguucaucggaaauguaacucuacaaagaccaaucagacggccuacgacuauauuacagcuaaaggggaggaagaggugcgcaucuacagcgagagagucgaugacugguuuaagaaaggaaucauuuccuauagcaagaugcaacggcugaaagugucucacaaggaauaccucgagagaaagaaacugggcaaggaaaccgagaccgacaaaaagcugugggaaaacuucaucgaucgccagcuucgggacacacaguauauuuccagaaaaagccgcgagauccuccaaaagguuugcaauaacgugaccacaacggaagggggagucaccgccaagcugagaaaucuguggggcugggaugacauucucaugaaccugcagaugcccaaauacaaggaacuugggcagacaaucaccaaagaguggacaucugaacacggcaagcggaaacaucagaaggaggaaauugagaauuggaccaagcgcgaugaccacagacaucacgcgaucgaugcucuggugguggccuguacgaaacaaggauucauccagcggauuaacacccucaauuccagcgagacaaaggaccugaugaucaaagaaguugaggaagccaagauugaguuuaacgaaaagaccacacugcuugagaaguaccugaagacccagaaaccuuucacgacacgcgaggucaugaaggaagcugauaaaauccucauuucuuuuaaggccggcaaaaagguggcuaccaucacaaaguucaaagccaccgggaagaauaaagagaccggagugaucgucccgagaggcgcgcugcaugaacagagcguguaugggaagauuaaaguuaucgagaaggacaaaccccucaaguaccuguuugagaacccugauaagauugucaauucccggauccgcgaccuuguggaaacaagacugagcgagaacgaaaacaauucuaaaaaggcccucuccacggugaaaaagaaccccauuuucuuuaaugaggaaaagaacgagauccuggagaaggcuagcugcuauaaugaugccaccguucugaaguacaaacuucaaaaccugaaggcuaaucagguggacgacaucgucgaugaacgggugaaauuccucguuaaggagcgccugacacaguuuggauccaaagaaaaggaggccuucaaggacauucucugguuuaaccaggaaaaacaaaucccuauuaucaccgugagacuguucgcgcggcccgaugccaauaaccuucagauuaucaagaaagacaagaauggcaaagauauuggguuuguccugacaggcaacaaucaccacaucgcuaucuaugaggacaaggauucuaagcucgugcagcauagcugugccuucuggcacgcuguggagcgcaaaaaguacaacauuccggccgucaucaaaaauuccgccgacguuuggucucugcugcuugauaaggaacugccuguccucuuccuggacaaacuccccgcugaugagcugaaccuuaaguuuagcaugcaacagaaugaaauguucauucugggacugucccaggagggcuuugacgaagcgaucaaaaacaacgacaagucucuccugagcaagcaucuuuaucuggugugguccauuagcaauaacgauuacuacuucagacaccaccucgagaccaaaaauacggagcugaagaacaucccuacagccaaagacucuaagcgguauuuuagauucaaauccgugggggcucucgugggaaucaaucccauuaagguucgccugaaccaucuuggcgaaaucaccaagauuggggaguga

SEQ ID NO: 4092 - RNA, 3960 nt, Artificial Sequence
  Cas9 variant
augggcuacaacaucgggcuggacauuggaaccggcagcguggggugggccgcucucacagaugagggaaagcuggccagagcgaaaggcaagaaucuuaucgggguccggcuguucgacuccgcucagucugccgcccaacgcagaagcuaucggacgacccgcagacggcucucccgcagaaaauggcggcugcgccuucuggaaaacauuuucucugaugagaugggaaugaucgacgaaaauuucuuugcuagacucaaguacagcuauguucaccccaaagaugaggugaacaaugcccauuacuauggcggcuaccuguucccuacacagcaggaaacccacgacuuucaugagaaguuccagacaauuuaucaucugcggcucaagcugaugaucgaggauugcaaauuugaccuucgcgaaaucuaccuggcuaugcaccacauugugaaguacagagggcacuuccucaacucccaaucuaaaaugaccaucggagauagcuauaauccgcgggacuuucagcaggccauucagaacuacgcggaggccaagggccugaucuggucccuuaaugaugcucaagaaaugacagacguccugguggggcaggccggauucggccucagcaaaaaggcuaaggccgagcgccugcugucugcguuuuccuucgauaccaaagaggacaagaaagccauucaggcuauccucgccgggauuguuggaaacacgaccgacuuuacaaagaucuucaauagagaacggagcggcgaugagcugaaaaaguggaaacuuaagcuggacucugaagcguucgaugagcagucccaagccaucguggacgaacucgaugacgaugagauggagcuguuuaacgccauuagacaggcuuucgacggcuuuacccuuauggaucugcucggggaccagacaagcaucucugcggccauggucaagcgcuaucaacagcaucacgaugaccugaaaauggugaaggaaauugcuaaaaagcagggacugucccaucaggacuucagcaaaaucuacaccgccuuucucaaggaugacacggauaagggcaugaaagcccugcuugacaaggcugaucuggccgacgauguucucguggagauucaacagcggaucgaaucccacgacuuccugcccaaacagagaacaaaggcuaauucugucaucccuuaucagcuucaccuggcugagcucgagaaaauuaucgaaaaccaagggaaguacuaucccuuucugcuggauaccuucacaaauaaggccggagagaccauuaacaaacucguggaacuggugaaguuucgcgucccuuacuacguuggccccauggugaccgccgcugacguggagaaagccgggggagaugcuacaaaccauugggucaagcggaaugaaggcuaugagaaaagcccugugacgccguggaacuucgaccagguuuuuaauagagaucaggccgcgcaggacuucaucgaccgccuuaccggcacagauaccuaccugauuggggaacccacacuccugaagaacucccugaaguaucaacuuuuuaccgugcucaaugagcugaacaaugucaaaaucaacggacacaagaucgacgagaaaacgaagcaugugcugauucaggaucucuucaaaagcaagaaaacaguuucugaaaaggccaucaaggacuacuaucugucccagggcaugggggagauucagaucgugggacuugcugauaaaaccaaguucaauagcaaccugucuagcuacauugaccucuccaaaaccuuugaugccgaauuuauggagaauccugcuaaccaagagcugcuggaaaauaucauucagauccagacagucuuugaggacgugaagaucgccgaacgggagcuucaaaaacucgcgcugcccgaugaacagguccagcagcuggccaagacccacuauacaggcugggggaaccucucugacaagcugcuuagcacgccuauuauccaagagggcucccagaaagugagcauucugaauaagcuccagaccacaucuaaaaacuucauguccaucauuaccgauaacaaguuuggaguucagcaauggauccaggagcagaauacagcugaaaccgccgacagcauccaggauagaauugacgagcugacgaccgcucccgccaacaaacgcggcaucaagcaagccuucaaugugcuguuugacauucagaaggcuaugggggaggaaccgaaccgggucuaccuugaguucgcgaaagaaacacaaaauucugugagaaccaacucccgcuacaaucggcucaaggaucuguauaaaagcaagacacuguccgacgauguuaaagcccucaaggaggaacuggagucucaaaagagcucccuucagucugaaagaaucggagaccggcuguaccucuauuuucugcagcagggcaaagauauguacaccgggcaaccuauuaacaucgacaagcugagcacggauuaugacaucgaucauauuaucccccaggcuuacacaaaagacgauuccauugacaaucgcgugcuugucagcagaccugagaacgcccggaagucugacuccgccaccuauacaaccgaagugcagcagagcgcuggaggccucuggaaaucucugaagaaugccggguucaucucccagaaaaaguacgauagacugaccaagggcggagacuacagcaaaggccagaagacaggguuuauugcgcgccagcucguggagacgcggcagaucaucaaaaacguugcuucucugauugagagcgaguucucccaaaccaaggccgucgccaucagaagcgaaauuacagcugauaugcgcagacuuguggccaucaaaaagcaccgggaaauuaauucuuuucaccaugcguucgacgcucugcucaucaccgccgccggacaguauaugcaggcucgcuaccccgauagagacggcgccaacguguauaaugaguucgauuacuauacaaacaccuaccugaaggagcugcggcaguccagcuccucuagccaaguccgcagacuuaaacccuuuggguucgugguuggaacgauggcuaagggcaacgaaaauugguccgaggacgauacacaguaucugcggcacgugaugaacuuuaaaaauauucucaccacccgcagaaacgacaaggauaauggggcccugaacaaagaaacaaucuacgcggucgacccuaaggccaagcucaucggcaccaauaaaaagcggcaggaugugucucuguacggaggcuauauuuacccguauagcgcuuacaugacacuuguucgcgccaacgggaaaaaucugcucgugaaggucacgaucuccgcugccgagaaaauuaagucuggacaaaucgaacugagcgaguaugugcagcagagacccgagguuaagaaauucgaaaagauucugaucaacaaacuugccaucggccagcuggugaauaacgacgggaaucucauuuaccugaccuccuaugaguuuuaccauaacgcuaagcaacucuggcugccuacagaagaggcggaccuuaucagccagcugaauaaagauucuuccgacgaagaucucauuaagggauucgacauccugaccagccccgccauucugaagcgguuuccuuucuacgagcuugaucugaaaaagcucgucaacaucagagacaaauuuaucgcuguggagaacaaguucgauauucugauggugauccucaaagcccugcagcuugacgccgcucagcaaaagcccgucaaaaugauugauaagaagucugccgacuggaaagauuaucgccagcggggcgggaucaagcuguccgacacaagcgaaauuaucuaccagucuaccacgggcauuuuugagaaaagaguuaagaucuccaaucugcucuga

SEQ ID NO: 4093 - RNA, 3963 nt, Artificial Sequence
  Cas9 variant
augaccgagcagcaaagacccuacaacaucggccuggacauugggacaagcuccaucggaugggccgugacggaucagaaugacaagcuccugcacauucggggccauaacgggaucggaguccgccuuuucaaagaaggcgagucugcugccgaaagacggggguuucgcaccacaagacggcgccugagcagacggcgcuggagacuccgguuccuggaucgcauuuuugacgcggagcuugcuaagguugauccuaauuuccuggccagacucaaacaguccaacaucucuccgcuggaccccaauaagcagauguuuggaaacauccuguucgaugacgcccaauuugaugaccagaaauuccaccagcaguauccuaccauuuaccaucuccggagcgcucuggcccaacccgaugcuccucaggccgacgugcgccuuaucuaucuggcgcuccaccauaugauuaaguuuagaggccacuuccugaauggcgccgcuguggaaaaguuucacgggggacagcuucaucuggaggccgaguuccaggaacucaaccaaaucuuuuccaaucagcagcgggaucacguccaacugcagacaucuagccuggacgagguggcuaccauucucaaagacaaccagagaacacccuccgaucgccagcgggaacugagcgccagacuuuucguuccuguggacaagaccaucgauaaagagaauaagaaacuggcgacggagcuccugaaggccguccuuggccugaaggcuaaauucgacgugauucucgggguugaagccaccgauccgcaggcuuuuaagcugcaauucucuuccgacgauuuugacgauaaaaucgccgagcuggccagcgaacucacagacgaggcuaacgaaauccugaccgugcuucagcgccuguacuucucucucaaucuggcggauauucuuacaaaccggcagaccaagcaagucgccgacuccaucagcacggcuaugauuaauagauaugacgaucauaaacaccaccugaagaugcucaaagagcuggagacacaggugacccaggaacagcgcgacggacugaagaaggccuacgaugaguauaucgacggcgauaaacccacaauugacaccuuuuacaccaacgugaagaaaaaccucgaugacucugaacuggccaaucaaaucaagucccuuaucgaucugcaggcuuucaugccuaaacagcggagcaaggagaacggguccauuccccaucagcuccaccaaagagaacuggaccagcugaucgagguccagggaaaguacuauccuuggcuucucgccgcgaaagauaagcuggacgcucugauugccuuucgcguucccuacuaugugggcccgaugaucgauccuaaugagucugacgacccccaaaacacaaaauucgccuggauggugcggaaggaagcuggcgagauuacgccuuggaauuuugaagagaaagucgauaagaccgggagcgccacaaacuucaucaagagaaugaccacaaccgacacguaccuccugggagaacccgugcuucccaaaaauucccugcucuaucagcaguuuacaguucugaacgagcugaauaaacuuaaaguggauggcaaggcucucaccgucgaccagaaaaaguaccuguaugagcaugugugcaagaaacaacgccggguuacccugaagaaacucagcgauugucugauggccagaggggacuucccuaugggagcgaucuuuacaggcaccacagaucagaagaacaugaauaacacgcuuaaaaccuaccaggacuuccaggaaauuuucggggaugagaucgacaauccggaucggcaaguggacuuugaaaagaugauugaguggucuacaaucuucgaggaucgcgaaauuuuuaaacugaagcucgccgagcugaacuggcugaccuccgaacagcuugagagagucagcaagaaacgguaccagggauggggcagacucucucagaagcugcugacacacaucgugaaugaaaacggcgagcgcauuaucgaccaacucuggaacaccaaucagaacuucauggagaucauggggcaggacggagucaaacaagcuauucaggaacauaauggcgccaacguggcucagacggggaucaaugagaccauugaugaacuguauacaagcccccagaacaagaaagccauccggcaaauucuucugguuguggacgauaucaagaaggcggucggauacgccccugcuaauaucaugauggaguuugccagagaagaccgcgaugaccacagacucauugcuucccgggcccgccagcuggagaaaaccuaucaggagaucucuaagaacugguucgauaaugaaagcgugacacaggagcugaaagaccaaauuaagaacaaaaccaaguuuacggauagacuuuaccucuauuucauccagggcgggauugaccuguacacaggccacccccugaauaucgaucagcucuccagcuaugacaucgaccauauucugccucagucuuuucuucuggauaacucccucaauaaccggguucugaccagccaaucugaaaaucgcgugcacaaggaggacagacugcccggagaaacagucgccaacaaaaugcggccgaccuggaagaugaugcgcgagcagggccuuaugacccagagaaaauacaacaaucugacacucaagccugaucagaucuccaaauucaacaaucgggggcaauuuauuaaccgccagcugguggagacgagacaggugaucaagcucgcugcggacauuaugaaucaaaaguaccaggccgaucagaccaaaguugucacagugaaggcuaaccugacccaucacaugcgggaaaaauucaauuuuuauaagagcagaaacgugaaugacuaccaccaugccuucgaugccuaucuuacagucuucgugggaaacuggcugcucaaagaguaccccaagcugcagccuuauuuuguuuacggcgacuucgcuaaaaccgggacgaauaaccugaaguccuuuaauuuccuuuaucgcuuugaacgggaucacaagcugaacgacaaaggagccaucgauacagacaaggaucaacagcucggcuacaugaaaagaaucuaccgcuucaagaaaaugcuggugaccaagcagcucgagaccaaugagggggcgcuguauaagcagacaauuuacaaagcucccgccaacgaaaagaacaccaaaaagaaucggucucuuaucaacacaaagaagaauagaccuagcgacauuuauggcggauacucccaaucugucacggccuauaugagccugguguuuuucaagaacaccuuuaaacucaucaagaugccccugguugcugccaaugcgauuaaaaacucccugagcucuuaccaugacacaauccuuaagauucugggcuccaaugaguucaaagugcucaucccgaaggucaagaugaaccagcugaucaaagaaggggauagccucuauaccgugguuggaguguacaagcacaaugcucagcagcugauucuuucugacaacuccaugggcaucauuacaaaaccuauccgcgagauuugcgauagcgaccuggauucugucuuuaaugaacugguggacaacaucgauaaguaccucaaucuguauaaaaucgaggacaaacuuaccauuaaggagaaguucuacgcccugaagaacaaagaaagcaaguucaaauguaucuccgauauucucguggggacgcauugcaaugccggacggagcaaccugaagaucauuggccucucuuccuauugggggauguuuagcggcaauaacgacggacugaaaaucaacgaaaauucccaacuuaucuaccagucucccaccggccuguucgagcacagagucaagguuagcgaucuguga

SEQ ID NO: 4094 - RNA, 3972 nt, Artificial Sequence
  Cas9 variant
augaaggacuucuacaucggccuggauauggggaccgacagcgugggaugggccgucgcugaugaggacuauaaccucugcaaauuuaagggcaaagccauguggggaguuagacuguucgaugaauccgcgacagcugccgagcggcgcggauuuagaacggcccggcgcagagcucagcggaagcgccaacggauucuuuggcugcagaugcuuuucaaugaagagaucucuaaaaaggacauugccuuuuuccagagacugaacgaaagcaagcucuaccuggaggauaaauccaccaaugugcccuaugcuguguuugccgacgagucuuucacagaugucgacuaccacaagcucuauccuaccaucuaccaucugcgcaaagaacuggugcagagcgaugagccgcacgacguuagacucguguaucuggcgcuucaucaccugauuaagaaccggggccauuuucucuucgaaaaugucggguccgauuuugagaaagagucuagcuucgaagugcuguuuaagaaccuucaaaauuacauccugggagaguacgaacucgcccuggaguguaucagcccccugcagauugcugacauccucaaggacaaauccaagcgcaaaacaaccaagucuuccgaaauuugcaaacugcuuggcaucagcaagaaaggccagccuagacugaacgccauuguucuccugaugugugggcagucugugaaacuugcugaucuguauggagacgagaauuacaacaaggaggaaaaauccagcaucucuuucgagaagggcuaugaagauaaugaggaaacauaccgggagcuccugcuggagcgcuucgaacucauugagaaaaucaaggcccuguaugacugggcgauccuugccgauauucugaaaggggaaaccuacaucuccuuugcuaaggucaagacguaugacgagcacagacacgaucuccaacagcugaaagccuucgugaaggaacggugcagaagcgacuacaacgagauuuuucgcgagaccuccgauaaacuuaauaacuacacagcuuauuguggaaaguucaaagaaaauggccggaacggggugauccugcauucugccaaccagaccgacuuuugcaaguaccucaagagcaaauucgauaagcuggacaaauccggauaugaggacauguuugaaaagauugagaauggcagcuucaugcccaaaaucgucguuaaggauaacggcgugaucccuaugcaagugaaugagucugaagucagagccauucugaagaacgcuuccggguaccucgacuuucugaauaaccaggauaaagacggaaucacaguggcggauaagauucuucagaucuucgaguuucgcauucccuauuacguuggcccucugaaugugcacagcgacaacucuuggcucguccggaaagaugggaagaucuauccguggaauuucaacaaaaucguggacguugauaagagcgccgaagaguuuauuaauaaacugaccgcuaaguguacguaccugcccgacagagaugugaucccuaagaacuccauucuuuacucucgcuauaugguccucaaugaacugaacaaucugaaacucgacggaaagaaacccgaugugagcuucaagcaggccgucuucaacgaccuguuuaugcaucggagaaaagugacacaaaaggcccuucgcgaguacaucaaggcucagaccggcacagagccugaaauuaccgggaucgacggagauuucaaagccaacaugcggcccgcgauugagcuggcuggcuauaaucucuccgaaccggacaaggaggaaaucaucaaagccauuaccaucuuuggcgaugacaagaaacugcugaagagacgcauuaaggauaaauacagcgagaugcuuucugaggacgaaaucaagaaaauuugcaagcucaaauauaaggauugggggcggcuguccagagaguuccugacagaaaucuuugacguugauacggccaccggagaguguaaggacaacaucauuaauacacucuggaacaccaaugauaaccugauggaacuucugggcgcuaaauacaauuucacacagagcaucgagcaggccauuucuaaguccacccacaaagcuagcaucgagaagaugguggaagacauguaugucuccccuaaagugaagcggacgguuuuucaaucucucaaaauuaugaaggagaucgugaagaucaaagggcacgcccccaagaaagucuucguggaaaugacacgccaugauggaaccaagggcgacaacgggagaaccaaaagccggaagaagcagcuggaggagcuguacaaaaagugcaaagaagacuccacagagcuuugggaugaacucgagaagaccgacgaugacgaauuuagacaggauaaacuguuccuguacuauacacagaugggccgcuguauguacucuggagagcggauugagcucagagaccuguuuaauaagaaccuuuaugauaucgaccacauuuucccucgcagcaaggugaaagaugacuccaucgauaauagaguucuggucaagaaacaaauuaacagccauaaggacaaugacuacccccucgauucuacggugcgggaaaagaugcgcggccacuggcaguaucugcugagacauggguuuaucuccaagaagaaauacgaccggcuuacccgcgugacaccccucaccgaugacgagcuggcggauuucaucgccagacagcuggucgaaacaagccagucuaccaaggcuguggccacgcuccugaaaacccuuuauccuacaaccgagauuguuuacgugaaggcugaacuggucucccgguuccgcacagaguacaaauuuaucaagugcagagaggugaacgaccuccaccacgccaaggaugcguaucugaauauuguugugggaaacgucuacaacgugcgguauacccauagcaaagccaucuucauuaagggccugcaaacgaaaaaguacucucuuaaucgcauguuugcuuucgacacaccgggggccuggaacaucgaaaaugagaaaagccuguccauuguuaagaaaaccgugaugaagaacaauauccucuauacaagauacagcuauaugaagaaaggaggccuguuuaagauccagccccucaaaaaggggaacggccaggcuccucugaaaaaggaucuuccccugucugacauuggaaaguacggcggguacgauaaaccuaccgccuccuauuucagcuacaucaaguaugaagggaaaaagggcaaagagugccggcagcucgucgccauugacaauuaccugaagaaguauuacgaagagaaccccaucgaguaucugaccaauagacuugggcugaaaaacccggcugugcucauuccugugaucaaguacaauuccuguaucgaaauugauggauuucgcaugaacaucucuagcaaauccaaugagggcaagacaauugucuacaaacccgcgguucaacuggugcucggggccgaaaaggaggcuuaugugaagaaaaucucuaagguccugagcaaaccugaggaacagaagauuacguccuacgacggcgugucugccgaggaaaacaucgagcuuuucgacgcccugaccgcuaaaaugacaaauaccaucuuuaagauuaaacucgaagauaucggaaacaagauuaagagcggccgggacaaauucguuacacuggaugugaagaaacagugcuaugucaucaacgagauucugaagaucaugcacuguaaugugguuaccggggaccuuucccugauuggagccgcgaaaaaggcuggcaucgugagcacgaacucugcccucuccgagaucaagaaagucagcucuauuaugcugaucaaucaauccgugacagggcucuuugaaaccaagauugaucugcuuaacaucuga

SEQ ID NO: 4095 - RNA, 3975 nt, Artificial Sequence
  Cas9 variant
augagagccaagggcaaaacccugaucgggacaagccucuuccgggagggaaacacggcugccgaacgcagaggcuaccggaccacacagcgcagacugaagcggcgcaaaagacggcuuaagcugcucgaggcguuuuucgaccccuauauuuuugaaguggaugagaauuuccuggcucgccuucacgaagccgacaucuccccuaaagaugagaacaagagauuuugggggucucugcuguucccgaaugagaaggacgccaacuuuuaccggaaauaucccaccauuuaccaucugcgcaaggcucugauggaagaggauagaaaauucgacguccgggccaucuuucucgcuauucaccauaucaugaaguaucgcggaaauuuccugagcccucuuuccguugauucuuuuaaacaagaaggccuggagcucaaggagcagcuggacagacagcuuaagcggguggccgaacuguacaacgagcucaauacagaugugaaaaucaacgucagcgacguggaaaccauucaggauaucauuaucgacaagaauaaauccagacgcgauaaggcgggggcccugaaaaagcugcucgcuguuucuagcgaccggaaagagauuaacaagcugaaugccucccuugcuaaggaacugagcaacgccauccucggaaugaaagcgcaauucgccaaucugcuucuggcugacgaucucgagauugacaagaacaaaaagaauuuuucucugcuggauacaaacgccgaggaaaacguguccggccuccuggagcuugucaaugaaaaacaggcugagcuguucgacgccaucaagaccauccacgaucagauuauccucaacgaaauugugcccgacggcaagagcaucucucaguccaugguugauaaauaugaggcccauagagagcaacuccaggugcuuaaggcucuguacgaaaagauggacgcgaagcagauuaaagccaucaagaaggcuuacagccucuauaucgaugggaaagacccuaaggccaaaaaggucgauaaacgcgcccaccagaaucgggcugacuucuacaaggaggugaagaaagugcuggucgaacuggacgauucuagagccgagaagcuccugggacuuauugaaaugggccaauuucugcccaaacagcgcacggcgaugaacgggguuaucccuaaucagcuccaccaaguggagcuggacaagauuaucgagaugcaguccaaauauuacccguggcuggcugaaaagaaccccgugaaaagccaucagaagcgggccccuuauaaacuugaugagcuccugaccuucagaguccccuacuaugugggaccuaugguuacauccaaaaagcagcaacagaccucuaauagcaacuuugccuggauggugcgcaaacaggaaggcgagauuacacccuggaauuucgaggaaaaggucgacaccaucgcuuccgccaacgauuuuaucaaacggaugacggcuaaggacacauaccuggugggggaggauguucucccggccaauagccugcuuuaccagagauauaaggugcugaacgaacucaauaacauuaaagucaauggacgccggcugccuguggagcugaagagagaagcguacgucgcccuuuucgagaacggcgacucuaaaaccguguccgcuaagugcuuuaaaaacuggcucaauguuaagcugaagaaccugaauagccucaaacuggagggccuuucuacagggaccaaguucgauaacaaucugagcaccuaucacgaccucaaaaagaucuuuggaaaagccguggaugacgcuggccggcaaaaggauuucgaacagauuaucgaguggcugacaauuuuugaagacaagaaaauccugcgcauuaaacuuaaagagaucgaauggcucacggaggagaacaucacccagcugacaagacugaauuacaacggguggggacggcucuccagacgccugcuuaccggcauuugugacucuaaugggcagcggaucauggauuggcugugggacacaaccaacaauuucaugcaaauucagagccagcccgauuuucagaaggccaucgucgaauauaacuccgacaaacucgagcaaggagauauugaacagauccugggcgaggcguacacgagcccucagaauaagaaagccaucagaaaggugauuaagguugugcaagacgucgaaaaagcuaugggcgccaagcccacaucuaucuccauugaguucacccgcagcgaugggagaucugagcugaccaacucccggaugacacagcuucagaaaacccucaugagccuguccgaagagaugacagaccaggcucugcucgccgaguucaaggauuuucaagccucuaaaaagaagcugacgaauaaauauuaccuuuacuucacccagcugggacgcgacauguauacaggcgaaccccucaacaucgaucagcugagccuguacuccgacggggaucauauucuuccuagaucuuuuaucaaggacgacagccuggauaaccgggugcucaccaaacgcgcugugaauaacgagaaguccgacacaguuccggucugcgaauauggagcgaaaaugaaggauuucuggaaugaccuguacgauaacggccucaucagcaagcagaaacuggccaaucuucugaccgaccccgaugagauugggccuuauaaggcuaacggcuuuaucagacggcaacucguggaaacgucucaggugauuaaacuguccgccgagauccugcagacccuuuaccaggacacaaagauuaucgaaguccgccaaaaauauacccacgagcugagagagcacuucaauuuugugaagauccggcagcucaacgauuaccaucacgccuucgacgcuuaccugacagccuuuagcggacgcuaucucuaccagagauaucccaagcugcggggcuacuucguuuauggggauuacaauaaauuugacgcgaagaaagacagaaacuaucuuaagucuuacaauuuccuguacgaucucgaagagggaaaaaccgaccaaauuguggauaacgucgaacauaagguguuuaugaaucgccaggacgcuaucaaccagcugaagaaagccuaugaguacaaguauaugcugguuucccaggaaacguacacaaauagcggcgccauguucaaagagaccauuuauccugugaaccccaagcaaaaacuuauccagaagaaaaacgauaagccggucgacauuuacgggggauauucuaauaacuacgaugcuuaccugagcaucgugcggcucgaggacaagaaaggcauuaaguucagaguuguggggaucccuaugcgcaauaaagccgaacuggauaaccucgcgaaggaggaccacaauggcuauaugcagcggcugaacgaaaucgucgaugagcagauuaauuccagcggaaagaagaagacauuuagaaucauucuucccaaagugcauuucaagcaacugguggaagacgauucuggcaaauuuaugcugggguccgcugccuacccuuauaacgccaagcagcucguccugagcguuaaauccaucgagucucuugcuaauaaggacgccagcgaccgcgagcugguggcuguguacgaagagauucucaacgucgugaaugauaaguucacccuguaugacgcccggcaguuuagaaacaaacucaccuccucuaaggauaaauucguugaacugaauacagcggacaaggugacggagcuucuggauauccuggacggacuccacgccaaccccgucgugaaaaagcugaagaucauuagcggcuccccuuuuggguuccuucagcgccccucuggaaucguucugaccgagaaugcuaaacucauuuaccaaagcccgacaggcaucuuugaacggguggucuaucugagagaucucuga

SEQ ID NO: 4096 - RNA, 3984 nt, Artificial Sequence
  Cas9 variant
auggagggccagaugaagaacaaugggaacaaucugcaacagggaaacuacuaucucggccuggacguggggaccagcuccgucggaugggccguuacagauacggacuacaaugugcuuaaauucagaggcaagucuauguggggagcucggcuguuugaugaagccagcaccgcggaggaacgcagaacacaccgggggaaccgcagacggcucgcucgcagaaaauaucggcugcuucugcucgagcagcuguucgaaaaggagauccgcaaaauugacgauaauuucuucgugagacugcaugaguccaaccucugggccgacgauaagucuaagcccagcaaauuucugcuuuucaaugacaccaacuuuacagauaaggacuaccugaaaaaguauccuaccaucuaccaccuccgguccgaucugauucauaauucuacagaacacgacauccgccuugucuuccuggcccuccaucaccugauuaaauauagaggccacuuuaucuacgauaacagcgcuaauggcgacgugaagacccuggacgaggccguuuccgauuucgaagaguaccucaacgagaaugacaucgaauuuaacauugagaacaagaaagaauuuaucaaugugcugagcgauaagcaucuuacgaaaaaggagaaaaagauuucucugaaaaagcucuauggggacaucaccgauuccgaaaacauuaauaucagcguccugauugagaugcuuucuggauccagcaucucucuguccaaccucuuuaaggacaucgaguucgauggcaaacagaaucugagccuggacuccgauauugaagagacacucaacgacgugguugauauccugggggacaauauugaccuucugauccacgcuaaggaaguguacgauauugccguccucaccucuagccugggaaaacauaaguaucuuugcgacgcgaaaguggagcuguucgaaaagaacaagaaagaucucaugauccugaagaaauacaucaagaaaaaucacccggaggacuauaagaagaucuuuuccagccccacagagaaaaagaacuacgccgcuuauucucaaaccaauuccaaaaacguguguagccaggaagaguucugccuguuuauuaagccuuacauucgggauauggucaaaucugaaaaugaggacgaaguucgcaucgccaaggagguggaggauaagagcuuccucacgaaacugaagggcacaaacaauuccgugguccccuaccagauucacgaaagagagcuuaaccagauccugaaaaacaucguggcuuaucucccuuuuaugaaugacgaacaagaggauauuucuguuguggacaagaucaaacugauuuucaaguuuaaaauccccuacuaugucgggccucugaacaccaagagcacacgguccuggguguacagaagcgaugagaagauuuauccguggaauuucucuaacguuaucgaccuugauaaaaccgcccaugaauuuaugaaucgccucauuggacgguguaccuacacaaacgaccccgugcugccuauggacucccugcucuauagcaaguacaauguccugaacgagaucaaucccaucaaagugaacggcaaggcgauuccugucgaagugaaacaggccaucuacacggaucuuuucgaaaauucuaagaagaaaguuaccagaaaguccauuuauaucuaccugcucaaaaacggcuauauugaaaaggaggacaucgugagcgggaucgauauugagaucaaauccaagcugaagucucaccaugacuuuacacagauuguccaggaaaauaaaugcacccccgaggaaaucgagcgcauuaucaagggaauccugguguacagcgaugacaaauccaugcuucggagauggcucaagaacaauauuaaaggccugucugaaaacgauguuaaguaucuggcuaagcucaacuacaaagagugggggcgccugagcaagacacuucugaccgacaucuauacgauuaauccggaggauggagaagccuguuccauccucgacauuauguggaacacaaaugcuacccugauggagauccugagcaacgaaaaauaccaauucaagcagaauaucgagaacuacaaagccgaaaauuaugaugagaagcagaaccuucacgaggaacucgacgauauguacauuucuccugccgcucggagauccaucuggcaagcgcugcgcauuguggacgagaucgucgacauuaaaaagagcgcccccaagaaaaucuuuauugaaauggcucgggagaagaaaucugccaugaagaaaaagagaaccgagucccgcaaggauacacugcucgaacuguauaaaagcugcaagucucaggccgacggcuucuacgaugaggaacuuuucgagaaacugagcaaugaauccaacagccggcucagacgggaccagcuguaucuguacuauacccagauggggcgcucuauguacacaggaaagagaaucgauuuugacaaacuuaucaaugauaagaacacguacgacauugaucauaucuauccucgguccaagauuaaagacgauagcaucaccaauagagugcucguggagaaggacauuaacggcgagaaaacagacaucuaccccaucuccgaagauauucgccaaaagaugcagcccuucuggaaaauccugaaggagaagggccugauuaaugaagagaaauauaagcggcucaccagaaacuacgaacugacagacgaggagcuuucuagcuuuguugcucgccagcuggucgaaacccagcaauccacgaaagcccucgcgacccugcugaagaaagaguauccuucugcuaagaucguguacagcaaggccgggaacguguccgaguucagaaaucggaaagauaaggagcuuccgaaauuucgcgaaauuaacgaccugcaccacgccaaggaugcuuaucucaauaucgucgugggaaacguuuacgacacaaaauucaccgagaaguuuuucaauaacaucagaaaugagaacuacucucugaaacggguguuugauuucagcguccccggcgccugggacgcuaagggguccacauuuaauaccauuaagaaauauauggccaagaacaauccuaucauugcguucgcccccuacgaagugaaaggagagcucuuugaucagcagaucguuccuaagggcaaagggcaguuccccauuaagcaaggcaaggacaucgaaaaauauggaggcuacaacaagcugagcucugcuuuccuuuuugccguggaguauaaagggaagaaagcucgcgagagaucccuggaaacggucuacauuaaggauguggagcucuaucugcaggacccgaucaaguacugugaaagcguucugggacuuaaagagccucagaucauuaagcccaaaauccugaugggcucucucuucuccauuaauaacaagaaacugguggucacagggcggagcggaaagcaguacgugugccaucacaucuaucaacucucuauuaaugaugaagacucccaguaccugaagaacaucgccaaauaucuucaggaggagccugacggcaauaucgaacgccaaaacauucugaacaucaccagcgugaauaacauuaagcucuuugauguccuguguacaaaauucaauuccaacaccuacgagaucauucugaauagccuuaagaacgacguuaaugaagggagagagaaauuuucugaacuggauauccucgagcagugcaacauccugcuccagcugcuuaaggcguucaaauguaaucgggagagcuccaaccuggaaaagcugaauaacaagaaacaggccggcgugauugugaucccccaucucuuuaccaagugcucugucuucaaagugauucaccaaagcaucacaggacuguuugagaaggaaauggaccuucugaaauga

SEQ ID NO: 4097 - RNA, 3984 nt, Artificial Sequence
  Cas9 variant
augaagaacuacagcaucggccuggacauugggaccggauccgugggcugggucugcaucgaugagaauuaucagauucucagauacaacaaucgggccgcuuucgggguucacgaauuugagacagcccauguggcggaagaacgcagaaucaagcggggagcucgcagacgguauaaccgcagaaagaaacggauucaacugcuucagucucuguucgugccccacaugcagcagaaggccuuuuucgccccuacgaucaccgaacauuacuggaaaaaugacaaccaauuugagaaucgcacacucagcgagguccugaugucccuuggcaugaacccgaauaccuaucccacaaucuuccaccugagacaugaacucauugagucuagcgugaagaaggaugcucggcugaucuaccuggcccuccacaaccugguuaaauuucgcgggcacuuccuucaggaaggauccaccuggaaugcuaacaugucugacgccaaucugagcgagcaguuugagcagcuccugcauauuuauacagaaauggaggaacuuccucaagugucccugaccgcgcagcagagcacggaugucgagcacauccuccugaacaaucauauuucuaaggccgaaagagcucggcagcugaccgcccucuucgagcgcacauacgagcccuuuuucaaacugaucgugggccuugacauugcugccgcgcaacuguuuaagcaguccgaacagcaacuccuguacaaagagagcaagaccaagguuaaccuuacagccgaaacccugccugaggugcuccagacgaugcuggaacccgaggucgcuuucaucgaggccgugcagccuuucuaucagcaaacagugcuguuugaucuccugaaaggccagucuuacgucgcugccgccaagguugaggcuuucaaccaguaugagagagaccuugcgcugcucaaauccgugaucaaugaaguggggagcgagaagcaguaccgggccuuuuucauuaccucuaaacaaaagaaaagacaguuugaacagaagccgaacauggagcugcuuugucaccuggaucgcuucaaucgggagaagaaauaugaagagacauuuuacaaggaagucuccaaacuccugaccgcucugaucaaggaggccaccggagaggugaaagaacacauugagcagaucauucaagccauggaaagccaguccuuccucguuaagcagaagggcauccagaacgcuucuauccccuaucaaaauagccuguacgaggccgaaaugauucuuagaaaccagcaggcguacuauccuuggaucacagacgaguuuauugagaaagugaagcaacugaucgcuuuccgcauucccuacuauaucgggccucucguccagggagaugaacagcccuuuggcuggcugcagcggcaagccgacgggaauaucacgccguggaacuucgaugagaaagugaauaaggccgcuuccgccgagagcuuuauuaccagaaugacaaagaacugcaccuaccugaaggaggaaaagguucuuccuaaacagucucucauguaugagaaguucacacugcugaaugagcucaacuccgugcagauccgcagcucucuggaacagccccauaaaaagcaccggcuuugugaggacaugaaacaauggauuaucgaacaugucuucaagaagaccaaaacggugacacacaagacccugauucaggcucucaaaaagagcccuuacaaagacgagcuguaugaugaauccaccggaaauuggaaggacgucuacggcacacagaaagaggauagauuugccucuagccuguccaccuacaucagccuuaaggagauugugggcgacaucguugauaacgcguucauggaagagaucauuuauuggcucacaguguuuacggaccgcgauaucauuacccugaagaugaaugacaaauaccccuucaucacagaacagcaaauucagcggcugcucucucugaacaucuccggguggggacagcuuagccaaagacugcuccagucuauccccgucgaugacaugaaccgcuccgugauugaguauauggagaagcaugccguuaauuuuauggaacugcugagcccucggcaguccgaucuugcuuacaaaaucgaacaggugaacaagcaacacucuaaaaagauucacaagaucagauaugaagacauugagcagcucaccggcagcccggcccugaaacgggggaucuggcgcuccgucaagaucauugaggaacugacagcuaucuucggagagcccaaaaauauuaugaucgaaguggccagagaggaccaggcgucucaucggaccaagagcagaaaagaacagugggaguccauuggcaagagccucgccaaggaagagaaagagcugaaggccuuuuucaaagaaauggcucaauacccuaagcagcaguuugaucgcacgcgguucuggcuuuaugugacccagcaagggaaaugccuguacacaggaaagacccucagacuggaggaccugucuuccuacgaaaucgaucacauccuuccccgcaacuuuguuaaggacgauagcauugacaaucucgcucuggucuauccuauggccaaccaggagaaaaauaaggccggcaacaauaaaaugccccuggaaaucauugaugcuaagcagcagccggcgaugauggcccauuggaaaagacucaaccaacugaaacuuaucucugacuccaaacugcacaagcucaugaagccuagcuucaaugauguggacaaagagaacuuuauugcucggcagcugguggagacacgccagaucauuaagcacgucagagaucugcuucaagaacgguucgagcauaccgacauccacgugguuaaagccaagauggugucucaguuccgcaaauuuagcagaauccccaagauucgggauuacaauaacaagcaucacgccauggacgcucuguucacgacaguccucauccaguuuauucugcagaaauauggcaagaauuuccuccaauuugaccugcagcauaaagauaucuccaagaaauggagcaagauugcccagucuaccaagcacuucuuucuuuuccagcaauuugcggaacagcagaucaaauccccugugacaaaggagcugguuagcggggugcaguacuucgagcacaucuuuuaugaacaauccuggcagaccaccaaaaugacacagacgauugacucuaacuucuacaaggagaccaucuucagccccaaacucaagacagcuaaguauaccuccgccaaagccgaaaaguuuguccaugaugcuauugugaaauacgccguuuguggaauccaauacacaucucugaagaaaaacaaggagcagcaccaugugcugcuuaccgacauuaaugucaucgaacacuaucagcugaaggaggcgagccucaacgagcuggcucuccaucuggccaaacgcgaauccaaggaugacgugaucgaugcccagaugcuuguggucauuccuaaauacaagaaaaucaugcugaauggcucucccuauuacugcauuagcuccgacgagagacacaucgcuacgcaauucguucuccggaaggaucugcuggaagccgugcuucacgugaacgacgagacaagcgucgaugaacugcgcacccucuuuagaucuauuguggaggagaugaugacccaguauaaaguuuacaauaaggacacaauccggaacaagauugaugcuuucaucgaaaccgagcugaucgacguggaaacauuucaggucggguucacggagauuaaaaagaugguggccgcgaaugcccagagauccgacaaauuuggaggccgccuccggcaaguuaugaagguggaagauaucuauauuaucgacgagagcauuaccgggcugagauaccgcaaaccgcggaaacuugucaaguga

SEQ ID NO: 4098 - RNA, 3984 nt, Artificial Sequence
  Cas9 variant
augaagaaaaacuacaccaucggccuggacauugggacagccagcgugggaugggcuguccucacggaggauuaugaacugaucaagagaaaaaugaagauuuccggcaauacccagaaaaaggccguuaagaaaaacuucuggggagugcggcuuuuugagcaaggagaaacagcggagggccgcagacugaagcggaccacacgcagacggaucgcucgcagacggcagcgcauucaguaccucagaaccaucuucgacgaagggaugaaucagguggaugccaacuuuuucgcccggcuggacgagucuuuuagcaucauugaugagaaagaaaaugagcgccaccccaucuucggaaacgucgcugaagaggccgcuuaucaugagcaauuuccuacaauuuaccaccuuagagaacaucuggccaauuccucugagcaggcggaccuccggcugguguaucuggcccucgcucacaucauuaaguuccgcggccauuuucugaucgaaggcgagcuuaacaccgaaaauagcuccguuucugggacguucgagcaguuuauuaaaguguacaacgagaccuucaaugucgaaaaggcccuggaucucacaguggaccuggauggaaucgcugagcagaagaucagcagaaugaaacgggccgaacuuauucugucccucuuuccggaggaaaagagcaccggcgacuucgcgcaauucaucaaaaugauuguugggaaccagggaaaugugaagaaaacauuuucucugaacgaggaugccaagauccaguucuccaaagaggaauaugaggaaaaucuggagacccuccuggcugaaauuggcgaggacuuuagaagcgucuucgaugccgcuaagucuguguacgacgccaucucccuugccaacauccugaaggugacggacgcuacaacccgcgcgaaacucucuagcuccauggucguucgguuuacagaucacaaggaggaccugaaaacccuuaagagauucgugcgcgaaaaccugcccgaugaguacgacgaucucuuuaaaaauaagaagguggccggguaugcuggauacauugacggcaacgaaacccaggaggccuucuauaaauaccugaagaaaacacuggccaaggcuacgggcgccgagggguuucucgcgaaaauggaacaagaggauuuccugcggaagcagagaaccuuugacaauggagucaucccuuaucagcuucaccuggaggaacucaaggcuauuaucaaaaaccaaaagagcuacuauuccuuccuggaugaagagaaaauuucucagcuuaugacauuucgcauccccuacuacgugggcccucuggccaaggagaaagggcaguucgccuggcucacccggaaggaaaugggaaagaucacacccuggaaucugaacgagaaaguugacauugaaaagagcgcuaccgauuucguggagagaaugacgaauaacgacuccuaucugccuauggaaaaaguccucccgaagcauagccugcuuuacgagacauuuaccguguauaaugagcugaccaaaguucgcuacaucgacgauaacggccgggcccagaauuucucuuccaaggagaaaagacaaauuaucaacgaacucuuuaagcagcagcgcaaggugaaaaaggaaaugcuggaggcuuuccugaaaaaugaauaugggauugagaaccccaaggucgagggaaucgaaaagagcuuuaaugccugccuuggcacauaccacgaccucauuaaacugggcauccggccugagcuguucgaacagcccgagcaugagcaacaguuugaacagaucgugaagauucucaccgucuucgaggauagaaaaaugcggcgcaagcagcuggaaaaauuuucuaacauccuuacagaggaggaacaaaagcagcuggagagaaaacacuauaagggguggggacggcucagcgcgaagcugauucacggcaucguggaccagaaaacgcagaagaccauucuggauuaccuuaucgacgaugacgaucucccuaaaaacagaaaucgcaacuucaugcaacugaucaaugacgaaaaccuguccuuuaaggaggaaauugagaaaaucgccuucgauaaugacaagucuacagaagagauuguucaggagcucgcugggagccccgccaucaagaaagggauucugcagucccuuaagaucguggaagagaucauugauaucaugggcgaacugccgaccaacauugucguggagauggcucgggaaaaucaaacaaccgcccaggggaacagagcgagcaaagcccgcaugaaguaccucgaggagucuaucaaaaagcugggcuccagcauucuggaagacgagccuaucucuaaagacgcuaaucuucucagaaacgaucggcuguuucuguauuaccuccagaauggacgcgacauguauacgggcaacgaacuggauaucaauaaccuuuccagcuacgacauugaucauaucguuccccaguccuucgugaaggacgauucuauugacaauagaguccugaccacaagcuccaugaaccgggggaagucuaacaccgugccugccgagagcgugguuaaaaagaugcgccccacaugggagagacuccuggcuuccggacugaucagcaaaaagaaauucucuuaucuuaccaaggccacgaauggcgggcucacagaagaggauaaggcccacuuuauucaacggcagcuggucgaaacccgccagaucaccaaaaacguggcucagauucugcaucaaaaguacaauaacgagcagcucuccgaaaaacccgugagagucaucacacuuaagagcgcgcuggccucucaguuccggaaagacuuuucccuguauaagauccgcgagcucaaugauuaccaccaugcucaggacgccuaccugaacggagugauugcccaagcucugcuuaagguuuauccuaaacuggagccggaguucguguacggcgaauaucagaaggucagcaucagagcccucaauaaagcgaccgcuaagaaagaauuuuacucuaacauuaugaauuucuuuacaagcgaugagaugguggccaacgaagagacgggggagguucuguggaaucggcagagagacaucaagaccauuaagaaagugaugaacuaucaccaaaugaauaucgucaagaaaguggaaauccagacaggcgccuucaccaaggaguccauucuccccaaaggaccuagcaagaagcugaucgcucgcaaaaacaauugggcccccguuaacuacggcgggguggacucuccuacagucgcguauuccgugauuaucacccacgaaaagggaaaagcugccaaggugguccagcagcuuguuggcauuaaaauccuggagcggcaagccuuugaacaggaugagguggcuuuccucgaggaaaagggguuuauccaucccaaagugcagcugaagcugccgaaguacagccuuuaccaguucgccgacggaagacgccggcugcucgcuuccgccgaggaaucucaaaaaggcaaccagaugguccugccugugcaccucauugagcugcuuuaucaugcgaagcacguuagcgauuccucugggaaaagccuggaguaccucaaugaacacagacaugaguucgccgaacugcuggaggcuauccuucaguuuacggaacaguauauugacgccggcaagaaccagaaaaaggugcgcgaucuguacgagaagaaucaagacgcugauaugcgggagcucgccuccucuuucauccagcugcuccagcugaacaaacaaggagcccccgcugacuuuaaguucuuuggcgaaacaauuccuagacgccgguauaaaaauaccgcggagaucgucgaugccaccuucauuaaccagagcaucacagggcuuuacgaaacccagaagagacugguguga

SEQ ID NO: 4099 - RNA, 3984 nt, Artificial Sequence
  Cas9 variant
augaccgagcagcaacagcccuacaacaucggccuggacauugggacaagcuccaucggaugggccgugacggaucagaaugacaagcuccugcacauuagaggccauaacgggaucggaguccggcuuuucaaagaaggcgagucugcugccgaacgcagaggguuucggaccacacgcagacggcugagccgcagacgguggcgccucagauuccuggaucggauuuuugacgcggagcuugcuaagguugauccuaauuuccuggcccgccucaaacaguccaacaucucuccgcuggaccccaauaagcaaauguuuggaaacauccuguucgaugacccucaguuugaugaccagaaauuccaccagcaauaucccaccauuuaccaucucagaagcgcccuggcucagccugaugcuccccaggccgacgugcggcuuaucuaucuggcccuccaccauaugauuaaguuucgcggccacuuccugaauggcgcggccguggaaaaguuucacgggggacagcuucaucuggaguccgaguuccaagaacucaaccagaucuuuucuaaucagcaaagagaucacguccagcugcagacaagcucccuggacgagguggcuaccauucucaaagacaaccagcggacaccuagcgauagacaacgcgaacugucugcccggcuuuucguuccgguggacaagaccaucgauaaagagaauaagaaacuggcuacggagcuccugaaggccguccuuggccugaaggcgaaauucgacgugauucucgggguugaagccaccgauccccaggcuuuuaagcugcaguucuccagcgacgauuuugacgauaaaaucgccgagcuggcuucugaacucacagacgaggccaacgaaauccugaccgugcuucagagacuguacuucucccucaaucuggccgauauucuuacaaaccgccaaaccaagcaggucgcugacagcaucucuacggcgaugauuaaucgguaugacgaucauaaacaccaccugaagaugcucaaagagcuggaggcccaggugacacaggaacaaagagacggacugaagaaggcuuacaacgaguauaucgauggcgacaaaccuaccauugauacauuuuacaccaacgugaagaaaaaucucgacgauuccgaacuggccaaccagaucaagagccuuaucgaccugcaggccuucaugcccaaacagcgcuccaaggagaaugggucuauuccucaucaacuccaccagcgggaacuggaucagcugaucgagguccaaggaaaguacuaucccuggcuucucgcugccaaagacaagcuggaugcgcugauugcuuuuagaguuccguacuaugugggcccuaugaucgaccccaaccagagcgaugacccucagaauaccaaauucgccuggauggugcgcaaggaggccggcgaaauuacacccuggaacuuugaggaaaaagucgacaagacguccagcgcuaccaauuucaucaagcggaugacaaccacagauaccuaccuccugggggagcccgugcuuccuaaaaacucucugcucuaucagcaauuuacgguucugaaugaacugaacaaacuuaaggugaauggaaaggcccucacagucgaccagaaaaaguaccuguaugaucaugugugcaagaaacagagacgcguuacccugaagaaacucuccgacugucugguggcucggggcgauuucccgaugggggccaucuuuaccggaacaaccgaccagaagaacaugaauaacacacuuaaaacguaccaagauuuccaggagauuuucggcgacgagaucgauaaucccgacagacaggucgauuuugaaaagaugauugaguggagcaccaucuucgaagaccgggagauuuuuaaacugaagcucgcggagcugaacuggcugacaucugaacagcuugagcgcgugagcaagaaaagauaccaaggguggggacggcucucccagaagcugcugacccacaucgucaacgaaaauggcgagagaauuaucgaucagcucuggaacacaaaucaaaacuucauggaaaucaugggccaggacucugugaaacaggccauucaggagcauaauggggcuaacguugcccaaaccggaaucaaugagacgauugacgaacuguauaccagcccucagaacaagaaagcuauccgccagauucuucugguggucgaugacaucaagaaggccgugggcuacgcgcccgccaauaucaugauggaguuugcucgggaagauagagacgaucaccgccucauugccuccagagcucggcagcuggagaaaacauaucaagaaaucagcaagaacugguucgacaaugagucuguuacccaggagcugaaagaucagauuaagaacaaaacaaaguuuaccgaccgccuuuaccucuauuucauccagggaggaauugaucuguacacgggccacccucugaauaucgaccaacucuccagcuaugauaucgaccauauucugccccagucuuuucuucuggacaacucccucaauaacagagugcugacaagccaggccgaaaaccggguccacaaggaggaucgccugccgggggaaaccguggccaauaaaaugagaccuacauggaagaugaugcgggagcagggccuuaugacccaacgcaaauacaacaaucugacccucaagcccgaccagaucuccaaauucaacaauagaggacaguuuauuaaccggcaacugguggaaacacgccagguuaucaagcucgcugcggauauuaugucucagaaguaccaggccgaccaaacgaaagucgugaccgugaaggcuaaucugacacaucacaugagagagaaauucaacuuuuauaagagccggaaugucaacgauuaccaccaugccuucgacgccuaucuuacccuguucgugggcaauuggcuccugaaagaguacccuaagcugcagcccuauuuuguuuacggggauuucgcuaaaacaggaaccaacaaucuuaaguccuuuaacuuccuguauagauuugaacgcgaccacaagcucaaugauaaaggcgccaucgacacggauaaggaccagcagcugggguacaugaaacggaucuacagauucaagaaaaugcucgugacaaagcaacuggagaccaacgaaggagcgcuuuauggccagacccuguacccugcucccaagaacgauaaaaagacacgcaaucucauuaacucuaaaaagaaucggccgagcgacaucuaugggggcuacuccaacgagaaugggagcuuucugacccuggucaaacuuaagaagggcucuaaauaugacuacagacugguggccguuccuguguccaagauuagcgagaucaaagaaucugagcucgccacaauugaaaaggcuaucgcgccccaguuccugaaauccagcgggaaguaucgcgauuuucaggucgugcucucuaagauucugaucaaccaaaaaguuaucgacgauggaaugauuuucacgaucggcagcaaguccuacaaacauaaugccaaacaggugguccuuagcgacaacucuauucagaucguguccacccugagccggauuuccgauaaggagaagcugaucacaguguuugacgaaaucgucgauauuaccucuaaguaccuccccugguauaaaguuaaugacguggagaagacaaaaaugcuguucagacaaaugcaggauaucgacgagaugaagaaaauuaucgauaacagccuuauugggcugcacugcaaugcuuccaucaccgaccucggaaaggugggccugucuaaauacugggggcgcuucguccucacggccggcaucagccugaccguggaugcccagcuuauuuaucaguccccuacaggacuguuugaacaucggguuaaggugucugaccuguga

SEQ ID NO: 4100 - RNA, 3990 nt, Artificial Sequence
  Cas9 variant
augaacaagcagcccuacaauaucggccuggacauugggaccagcuccgugggauggucugccacagagcucgauaacagacugcuucacaucaaaggccauaaugggauuggaguccggcuguucaaggaaggcgagagcgcugccgaccgcagaggguuucggacgacccgcagacggcucgcgcgcagaaaauggcggcugcgccuucugaacgaaaucuucgcuacagagauugccaagguugauccuuccuuuuucgccagacucaaacaaucuaaugugagcccgaaggaccccaacaagaccauguuuggaaauauccuguucgaugacgaaaaccuggaugaccagaaauuucaccaugauuauaagacaaucuaccaccuccggcaggcuauuaucaaucauccugagcagaaauucgacauucgccugaucuaucuugccaugcaccacauuaucaaguacagaggccauuuucugaaccaagcuaaugugcaggauuucaaaggcgggaagauugaccucgagaaguccuuuaaagcccugaacgauaucuucgaaaaucagggacgggaccuucgccuggucaccgacgaggcgaaccaguaugugaagguucucucugauaaugccaaaacaagaagcgaccggaagaaagaacuguccaagcugcucuacgugcccaucgauaaagacaccgauaagaacagcaagaaagucacgggcgagauucugaaggcuauccuugggaacaaagccaaguuugacgugauuuucggaaucgagguugaaaauccuaaagagugggugcugaccuucaacucugaugacuuugaugacaagauugaaggccucuccagccaaaugacagaugaggacucugaaauccugcuuauccugaaggagcucuauuucgcucugaaucuguccgacauucucaacaauagcgucaccgauaaaaacgccaagacacugucugaggcgaugaucaauagauacgacgaucacaaaaaccagcuugccaugcugaagaaagugauugacuccagcgauaagaagcaugcuaaagaacucaaggaggccuacuccgcuuauaucgacggggaaaauaacaaaaagauuucuuuugaggaucugaaaaagcgcauccagaagaaucuuguggacagcgaacugucccagaaaaucaacgaucuccuggaccacgauuacuuccugcccaagcaacggagcaaagagaauggagccauuccucaccagcuccagcaacaggagcuggaccagaucauugaaucucagaagcaauauuacccguuucuugccgagcugaaccccaaugaaaagagaucccgccaggcuaaguauaaacucgaugagcuggucgcguuccggguuagcuacuaugugggcccuaugguggaagucaccgacucuaaccaggagaacaauggcaaguuugccuggaugaucagaaaggagcagggggaaauuacgcccuggaacuucgacgagaaaguggaucgcacagaaaccgcuacaaaguuuaucacccggaugaccacaacggacaccuaccugauuggagagccuguucuucccaaaaauagccuccuguaccaaaaguucgugguccugaacgagcucaauaaccugaaaaucaaucaggaaacaaucaccccgggccagaagcaguaucuuuacgagcaugugaugaagaaaaacaagagaguuacacugaaaaagauugccgaugcccucgugaucaaaggggacuauccuuacgcucccgaagucaagggaaccacggaucaaaagaaucugaacaauggccugacaaccuauauugaccuugccaaaaucuuugggaacgagcucgaugacguggaucgcgaagcggacuucgagaagauuaucgagugguccaccaucuuugaagaucagcacauuuucguccugaaacugcaggagcucaaguggcugacagaaaaacagcggaaucaagugguuaaacuuagauaccagggauggggcaagcugucuaaagagcuccuggcuggccugguggacgauaacgggcagcgcaucauugaccuucucuggagcgacaaucaaaacuucaugcagaucgucaaccagaaguccuuuaaagaaagcauugccgaucauaauggagcccaccuggaggagaagaaccugaaagacgugaucaaugaucucuauaccucuccucagaacaagaaagcuauccggcaaguuauucugguggucgacgauaucauuaaugccgugggcuacgaacccgcuaacaucaugauggaguucgccagagaagacuccaaugaucaucggcuuacaaacagccgcucuagacagcuggagaauguguacaaggacauuacgaacuccugguuugauaaugacagcguuaaggaugaacucgaggacaaaaucaagaacaaagacaaguucaccgaucggcuguaucuguacuuuacacaagggggaaaagaccuuuauaccggcgagccccucaauaucgaugaccuguccucuuacgauauugaccacauccugccucagagcuucauucucgauaacucccuggacaauagaguccuuacaucucagcgcaacaaccgggugagcaaggaagaucagcugccgggggagcucuuuggcaccaagaugcacgcguucuggaaaagacugaaggccgcucaucugaucuccaauaaaaaguauuacaaccuuacgcugacccccaauagcauuucuaaauuuaacaaucagggacgcuucaucaacagacagcucguggaaacacggcaagucauuaagcuggccgcugagauccuccacaaucgcuauuccgaggaaaagggcaccaacaucgugacaauuaaagccaaucugacccaucacaugagagagaaguuuaacuucuacaaaaaucggaacguuaaugacuaccaccaugcguuugaugccuaucuuacggcuuucguggggaacuggcugcuccagcaguacccuaagcugaaacccuauuucgucuacggagacuuugccaagacagaaaucaauaaccucaagagcuucaauaugcuuuauaaauuugagcaagcucaccagcugaacgaaaaggauggcaaaauugccaaggacaccgacgcccuccugggguacaugaaaaacguguaucauuucaagaagaugcucguuacaaaagagcuggagaccaaucacggagcucuuuuuaaccagacccuguacccuucucccgcgcaugauaucaagaaacgccagcucauuaagccgaaagacaauagaccuacagauaucuacggcggguauacgcacgaggaacggaaguacaugucccuggugaaagucaucggcaagaaggacaacgaauaucgcauggccaaugugccccugcuuaaaauuaacaagaauaacgauaucaaagagauucucaagagccaauucucuaauaaaaaguuugaaaucguucugccuaaggugcugaaaaaccagcuguucagcgagaauggagcucuguuugucauuggcuccaagggguacaaauauaacgccaaucagcuugugcugagcgaccuggauaugaagcuccugaacgaccuuucuaauaacaaauccaucgaugaggugaccaucaaccagcuguucaagaauauugucgacagcacaaacaaguacaugccccucuaugaaaucaaaaaucugaacgagguuguggaaaaguuuaauaaccucgaguucaaugauaaaaagaaaaccauuacagacuuccugcuugccacccacgcuaacccuacgauguccaaucugaagaacaucggacugcccuacuuuggcagauucauucggaauacagggaucaagcucucugaaaacgccaaugugauuuaccaaagcccgaccggacuguuuucccgcaaaaucaagaucucugauuucuga

SEQ ID NO: 4101 - RNA, 3993 nt, Artificial Sequence
  Cas9 variant
augaagaacgacuacaccaucggccuggauauugggacaaauagcgugggauauuccgucguuacggacgauuacaaagugaucucuaagaaaaugaacguguucggcaauaccgagaagaaaagcauuaagaagaacuuuuggggagucagacucuucgaauccggacagacagcccaagaggcucggaugaaacgcaccucuagacggcgcaucgccagacggaagaaucgcauuugcuaucugcaggaaaucuuucagcccgagaugaaccaccuugacaauaacuucuuuuacagacugaaugaauccuuccucguggcggaugacgcuaaauaugauaagcauccuaucuuuggcacacuggacgaggagauucacuuccaugaacaguuuccgaccaucuaccaccuucggaaauaucuggccgauggggacgagaaggccgaucuccgccugguuuaccuggcuauugcccauaucauuaaguucagaggaaacuuucucaucgaaggcgagcugaauacagagaacaauuccgugauugaacuuucuaaagucuucgugcaacuguacaaccagacccucagcgagcuggaaggcuuucaguucaucgacgaguccaucgauuucagcgaaguucuuacgcagcaacugucuaaguccgagcgggcugacaaugugcucaaacuguuucccgacgagaaggggaccggaauuuucgcccaguuuaucaaacugauugucggcaaccaggggaacuucaagaaaguguuucagcucgaagaggaucaaaagcugcagcuuagcacagacgauuaugaagagaauaucgaaaaccugcucgcgauuaucggagacgaguacggcgauaucuucguggccgcucagaaucuguaucaagccauucuucuggcugggauccucaccucuacagagaagacccgcgccaaacuguccgcgagcaugauucagagauacgaagaacacgccaaggaccugaaacuccugaagcgguuugucaaagaacacaucccugauaaguaugcugagauuuucaacgacgccacgaagaauggauacgcuggcuauaucgauggcaaaacaaaggaagaggaguuuuacaaauaccuuaagaccacacugguucagaaaucuggguaucaguacuucaucgaaaagauugagcaagaaaacuuucuccgcaagcagagaaucuaugacaauggagugauuccccaucaggugcacgccgaggagcugcgggccauccuuagaaaacaggaaaaguacuauuccuuccugaaagagaaccaugaaaagauugagcaaaucuuuaaaguccgcauuccuuacuaugugggcccccucgcuaagcacaaugaacagagccgguucgcguggaacaucagaaaguccgaugagccuauccgcccguggaauaugaacgacguuguggacgagaaugccucugcugucgccuucauugaacggaugaccaucaaagauauuuaccugaacgagaaugugcugcccagacacagccucaucuacgaaaaguuuaccguuuucaacgagcugacaaaagugcuuuaugccgacgaucgcggggucuuucagcgguucuccgcugaagagaaggaggacauuuuugaaaaacuguucaagagcgagagaaaagugacgaagaagaaacucgaaaacuaccugcgcaucgagcugucuaucuccagcccuucugucaagggaauugaggagcaguuuaaugccaacuucggcaccuaucuugaucucaaaaaguuugacgagcugcaucccuaccuggaugacgaaaaauaucaagauacacucgaggaagugaucaagguucugaccguguucgaggaccggagcaugauucagaaucagcuugagcagcugccucucaaccuguccacaaagaccaucaaagcgcugucuagacgcaaguacacgggguggggacggcuuagcgcuagacucauugauggcauccacgacaaaaauuccggcaagacaauccuggauuaucugauugaagacgagagcgacucuuacaucgucaaccggaauuuuaugcaacucauuaacgaugaccaucuguccuucaaaaagaucauugaagauagccagcccuacaaggagcagcaaucugccgaagagaucguguccgagcuuagcggguccccggccaucaaaaaggggauucugcagucucucaaaaucguugacgaacugguggcuauuaugggcuauaagccuaaaaauaucgucguggagauggcccgcgaaaaccagaccaccgggagaggaaagcagaauagcaagccccggcugaaaggcauugagaacgggcuuaaggaauuuuccgauucugugcucaaaggcagcuccaucgacaauaagcaacugcagaacgauagacuguaccucuauuaccugcagaauggaaaagacauguauacaggccacgagcuugauauugaccaucugagcaccuacgauaucgaccacaucauuccucagucuuuccucacagauaacuccaucgacaaccgcguucugacgaccagcaagucuaaucgggggaaauccgacaacguccccagcgaggaaguggugagaaagauggaucgcuucuggagaaagcugcuuaaugcuaaacucauuucugagcggaaguauacaaaccugaccaaaaaggaacugacagagagcgacaaagccggauuucucaagcgccaacuggucgaaaccagacagaucacgaagcacguggcgaccauucuugauuccaaauucaaugaggacagcaacaaucgggauguucagaucaucacacugaagucugcccucguguccgaguuucgcaaaaccuucaaccuguacaaggucagagaaauuaaugaccugcaucacgcucaugaugccuaccuuaacgcugugguugcccugagccuccugcggguguauccccagcucaaaccugaguuugucuacggcgaauaugggaagaauagcauccacgaccaaaacaaggcgacaauuaaaaagcaguucuacucuaauaucacccgcuauuuugccagcaaagauuacauuaucaacgacgauggagagauccuguggaauaagcaggagacgauugcucaagugaucaaaacacuuggcaugcaccagguuaacguggucaagaagguggaaauucagaaagggggcuucuccaaggagucuauccagccgaaaggagaaagccaaaagcugauuagacggaaacagcaguggaacaccaagaaguauggcggguuugacucccccguggucgccuacgcuauccuccugucuuucgacaaaggaaagcgcaaagcccggagcuuuaagauuguuggcaucacaauccaggauagagaguccuucgaagggaauccuauucuguaccuuagcaaaaaggacuaucauaaccccaaaguggaggccauccugccuaaguacucucucuucgaguuugaaaauggaagacgccggaugguggcuuccgcgagcgagacccaaaagggcaaccagcugauuauccccgggcaccucauggaacugcuuuaucauucuaaaaagauuaucaauggcaaaaacuccgauagcgucucuuacauccagaauaacaaggagaaauucagagaaauuuuugaguauaucguggacuucuccagcaaguacauuuccgccgaugcuaaucugaacaagaucgagaaaauuuuugaaaauaacuuccacaaggccagcgagcaggaaaucgccaaaucuuuuaucaaucuccugaccuucacagcuaugggagccccggcggacuuugaguucuuuggcgaaaagauuccucgcaaacgguauguuagcaucuccgagauuaucgaugcuguguucauucaucaaucuaucacggggcuguacgagaccagaguccgccuuacagaaguguga

SEQ ID NO: 4102 - RNA, 3993 nt, Artificial Sequence
  Cas9 variant
auggagaaggaauacaccaucggccuggacauugggacaaacagcgugggaugggccguccucacggaugacuauagacugguugcucggaaaauguccauccagggcgauucuaaucgcaagaaaauuaagaaaaacuucuggggagccagacuuuuugaggaagggaagaccgcgcaauuccggcgcaucaagagaacaaaucggcgcagaauugcucggcgcagacagcgggugcuggcccuccaggacaucuuugccgaggaaauccacaaaaaggaucccaacuucuuugcucgccuggaggagggcgacagaguggaagccgauaaacgguucgcuaaguuuccugucuucgccacccuuagcgaggagaaaaauuaccaucgccaguauccgacaauuuaccaccugagacaugaccucgcgaacuccaaggagcaagccgauauccggcugguguaucuggcuauugcccacugccucaaguacagagggcauuuucuguucgagggagaacuugacaccgagaauacaucuguuaccgaaaacuaucagcaguuucugcaggcuuaccaacaguucuuucccgagccuaucggcgaucucgacgaugccgugcccauucugacggaacgccuuagcaaagcgaagcgggucgagaaagugcuggccuacuauccuuccgagaagucuaccggcaauuucgcucaguuccucaaacugaugguugggaaccaggccaauuuuaagaaaacauucgaccuggaagaggaaaugaagcucaacuuuaccagagacuguuacgaggaagaucugaaugagcuucuggagaagacaagcgacgauuaugcugaacucuuccugaaagccaagggaguguacgacgccauccuucugucccaaauucucagcaaaucugaugacgagaccaaggcuaaacuguccgcgaacaugaagcugcgcuuugaagaacaccagcgggaucucaagcagcugaaagaacuugucagacgcgaccugcccaagaaauaugaugacuucuuuaagaaucggagcaaaaacggcuacgccggguaugugaagggaaaggcuacgcaagaggauuucuacaaauuucucagaacagagcuggccggccuugaagagucucaguccaucauggaaaagaucgaccuggagauuuaccuccugaaacagcgcaccuucgccaacggggugaucccucaccagauucaucuggucgagaugcgggaaaucauggacagacaaaagcgcuuuuauccguuccucaaaggagcucagggcaagauugagaagcugcuuacauuucggauccccuacuauguuggcccucuggcccaggaagggcagagccccuucgcguggaucaaaagaaagucuccuucccaaauuacccccuggaauuucgcugaggugguggauaaagaaaacagcgccaucgaguuuauugagcggaugaccaaucaggacacauaccucccgaaggaaaaaguccugccuaagcagucccugaucuaucagcgcuucaugauuuuuaacgagcuuacgaaagugucuuacaccgaugaaagaggaaagagccacuauuucuccagcgagcaaaagcggaaaaucuuuaaugaacucuucaagcagcaucccagaguuacagagaaacagcugcgcaaguuucuggagcucaacgaacagaucgacucuaccgagauuaaaggcaucgaaacauccuucaaugccagcuacucuaccuaccacgaucugcuuaagcugagcgaccaaauggauacgcuccuggacgauccugacaugacaaccauguuugaggaaauuaucaagauucugaccaucuucgaggaucgggagaugauuagagaacagcuuaaacccuaugagacagugcucgggcugcccgcuaucaagaaacuggccaagaaacacuacaccggauggggccgccucuccgaaaagaugauccaggggaugagagagaagcaaucucggaaaacaauucuggacuaucuuaucgaugacgacgauuuuccuugcaaccgcaauagaaacuucaugcagcugauuaaugacgaucaucucagcuuuaaggagacgaucgcuaacgaacugauuauguccgacagcaauguccugcuugaucaggugaaagccaucccgggaucucccgcgguuaagaaaggcaucuggcaguccauuaagaucguggaggaaauuaucggcauuaucgggaaggccccuaaaaacaucgucauugagauggcucgggaaaaucaacgcaccagcagaucucggccccgccucaaggcccuggaggaggcucugaaaaacaucgacuccccucuccugaaggauuaccccacagacaaccaggcccuucagaaagauagacuguaucucuacuaucugcagaauggaaaggacauguacaccggcgaaccgcuggagauucaccggcuuagcgaauacgauaucgaccauauuaucccucgcuccuucaucguggauaacucucucgacaauaaaguccuggugagcuccaagguuaacagagggaagcuggacaaugcgcccgauccucucguggucaaacggaugagaucucacugggagaagcugcaucaagccaaacuuauuagcgacaagaaacuggcuaaccucacaaagcagaaucugaccgaagccgauaaggcucgcuucauccagcggcagcugguggagacgagacaaauuaccaaacacguugccaaccuucugcaccagcauuuuaaucuccccgaggaaguguccgccacagagaagaccagcaucauuacacugaaaucuacccucacgucccaguuccgccaaauguuugacaucuauaagguccgggaaauuaaccaccaucaccacgcucaugaugcguaccugaauggagugguggccaugacacuucugaaaaaguauccuaagcucgcucccgaguucguuuacggcagcuauaucaaaggggacaucaaccagauuaauaaggccaccgccaaaaaggaauuuuacucuaacaucaugaaauucuuugaguccgaggaaauuaucugugaugagcagggcgaagucauuuggaauaagaagagagaccugagcacaaucaaaaagaccaucggagcucaccaggugaacauugugaaaaaggucgagaaacaaaagggcggguucuauaaggagaccaucaacucuaaagccaauccggaaaagcugauuccucgcaaagcgagccuugauccccugaaguacggaggcuacgggagcccccucguggcuuauacaguuaucuuuauuuucgagaaaggaaagcagaaaaaggugacgaagggcaucgaagggaucaccgucauggagcagcugcgguuugaacaggacccuagagaguuccucaaaacaaagggcuacgagggagugaaacaauggcugauucuuccgaaguauauccuguucgaagcccagggcggguaccgccggaugauugccucccaucaggagacccagaaagcuaacucucucauccugcccgaaaaucugguuacacuucuguaucacgccagacauuacgaugagauuaaccacaagguguccuuugacuaugucaaugcgcacaaggaaggauucaacgacaucuuugauuucauuagcgacuuuggcgugcgguacauccucgcuccucaacaucuggagaaaaucaagguugccuacgagaaaaauaaggaaguggaucucaaagagaugauugacgccauccugucccuucugaaguucacccuguuuggggcuucugucgaguucaaguuuuucgauauuaaaauccucaagcgcuauaaaagccugacggacauuugggaagccacaaucaucuaccaguccgugaccggacuuuaugaaagacggguggagguccgcaagcugugggauggcgagagacucuga

SEQ ID NO: 4103 - RNA, 3996 nt, Artificial Sequence
  Cas9 variant
augaacaagcagcccuacaauaucggccuggacauugggaccagcuccgugggauggucugccacagagcucgauaacagacugcuucacaucaaaggccauaaugggauuggaguccggcuguucaaggaaggcgagagcgcugccgaccgcagaggguuucggacgacccgcagacggcucgcgcgcagaaaauggcggcugcgccuucugaacgaaaucuucgcuacagagauugccaagguugauccuuccuuuuucgccagacucaaacaaucuaaugugagcccgaaggaccccaacaagaccauguuugaaaauauccuguucgaugacgagaaccuggaugaccagaaauuucaccaugauuauaagacaaucuaccaccuccggcaggcuauuaucaaucauccugagcagaaauucgacauucgccugaucuaucuugccaugcaccacauuaucaaguacagaggacauuuucugaaccaagcuaaugugcaggauuucaaaggcggcaagauugaccucgaaaaguccuuuaaagcccugaacgauaucuucgagaaucaggggcgggaccuucgccuggucaccgacaaggcgaaccaguaugugaaaguucucucugauaaugccaagacaagaagcgaccggaaaaaggaacuguccaaacugcucuacgugcccaucgauaaggacaccgauaagaacagcaaaaaggucacgggagagauucugaaagcuauccuuggcaacaaggccaaauuugacgugauuuucgggaucgagguugaaaauccuaaggagugggugcugaccuucaacucugaugacuuugaugacaagauugaaggacucuccagccaaaugacagaugaggacucugaaauccugcuuauccugaaagagcucuauuucgcucugaaucuguccgacauucucaacaauagcgucaccgauaagaacgccaaaacacugucugaggcgaugaucaauagauacgacgaucacaagaaccagcuugccaugcugaaaaaggugauugacuccagcgauaagaaacaugcuaaggaacucaaagaggccuacuccgcuuauaucgacggcgaaaauaacaagaaaauuucuuuugaggaucugaagaagcgcauccagaaaaaucuuguggacagcgaacugucccagaagaucaacgaucuccuggaccacgauuacuuccugcccaaacaacggagcaaggagaauggggccauuccucaccagcuccagcaacaggagcuggaccagaucauugaaucucagaaacaauauuacccguuucuugccgagcugaaccccaaugaaaagagaucccgccaggcuaaauauaagcucgaugagcuggucgcguuccggguuccuuacuaugugggacccaugguggaagucaccgacagcaaccaggagaacaauggcaaguuugccuggaugaucagaaaagagcagggcgaaauuacgccuuggaacuucgacgagaagguggaucgcacagaaaccgcuacaaaauuuaucacccggaugaccacaacggacaccuaccugauuggggagcccguucuuccgaagaauagccuccuguaccaaaaauucgugguccugaacgagcucaauaaccugaagaucaaucaggaaaucauuacaccuggacagaagcaguaucuuuacgagcaugugaugaaaaagaacaaaagaguuacccugaagaaaaucgccgaugcccucgugauuaagggcgacuaucccuacgcuccugaagucaaggggacaaccgaucagaaaaaucugaacaauggacugacgacauauaucgaccuugccaagauuuuuggcaacgagcucgaugacguggaucgcgaagcggacuucgagaaaaucaucgaguggagcaccauuuuugaagaucagcacaucuucgcucugaagcugcaggagcucaaauggcugaccgaaaagcagcggaaucaagucgugaaacuuagauaccagggguggggaaagcuguccaaggagcuccuggccggccugguugacgauaacggccagcgcauuaucgaccuucucuggucugacaaucaaaacuucaugcagauugugaaccagaaaucuuuuaaggaauccaucgccgaucauaauggggcucaccuggaggagaaaaaccugaaggacgucaucaaugaucucuauacaagcccccagaacaaaaaggccauucggcaagugauccugguuguggacgauauuaucaaugcugucggauacgaacccgccaacauuaugauggaguucgcgagagaagacucuaaugaucaucggcuuaccaacucccgcagcagacagcuggagaauguguacaaggacaucacaaacucuugguuugauaaugacuccgugaaagaugaacucgaggacaagaucaaaaacaaggacaaauucacggaucggcuguaucuguacuuuacccagggcgggaaggaccuuuauacaggagagccucucaauauugaugaccugagcuccuacgauaucgaccacauucugccgcagucuuucauccucgauaacagccuggacaauagaguucuuaccucccaacgcaacaaccgggucucuaaggaagaucagcugcccggcgagcucuuugggacaaaaaugcacgccuucuggaagagacugaaagcugcccaucugauuagcaauaagaaauauuacaaccuuacccugacgccuaauuccaucagcaaguuuaacaaucagggccgcuucauuaacagacagcucguggaaacccggcaagugaucaagcuggcugccgagauccuccacaaucgcuauucugaggaaaaaggaacaaacauugucaccaucaaggcgaaucugacacaucacaugagagagaaauuuaacuucuacaagaaucggaacgugaaugacuaccaccaugccuuugaugcuuaucuuaccgccuucguuggcaacuggcugcuccagcaguaccccaaacugaagccuuauuucguguacggggacuuugcuaagacggaaauuaauaaccugaaauccuucaauaugcuuuauaaguuugagcaagcccaccagcugaacgaaaaagauggaaagaucgccaaagacgcugacgcgcuccugggcuacaugaagaacgucuaucauuucaagaaaaugcucgugacaaagaaacuggagaccaaucacggggcccuuuuuaagcagacacuguaccccagcccggcucaugauauuaaaaagcgccagcucaucaaaccuaaggacaacagacccaccgauaucuacggaggcuauacccacgaggaacggaaguacaugucucugguuaaagugauugggaagaaagacaaugaguaucgcauggccaacgucccucugcuuaagaucaauaaaaacaaugauauuaaggaaauccugaagucccaauucagcaacaaaaaguuugagauugugcuccccaaaguucugaagaaucaacucuucucugaaaacggcgcccuguuugugaucggaagcaaaggcuacaaguauaaugcuaaccagcuuguccuguccgaccuggauaugaagcuccugaaugaccuuagcaacaauaaaucuaucgaugaggugacaauuaaccagcuguucaagaacaucguggacuccacgaauaaauacaugccucucuaugagauuaagaaccugaaugaagucguugagaaauuuaacaaucucgaguucaacgauaagaagaaaaccaucacagacuuccugcuugccacccacgcgaaucccacaaugagcaaccugaagaauauugggcugccguccuacuuuggaagauucaccucuggcaacgcugggaucaaacucagcgaaaaugccaacgugauuuaccaauccccuacgggacuguuuucucggaaggugaaaaucagcgauuucuga

SEQ ID NO: 4104 - RNA, 3999 nt, Artificial Sequence
  Cas9 variant
augaagaacagagagaauaucaaauacuauauuggcguggacaucgggaccaacagcgucggaugggccguuauugaugaaaauggcaaccugcucaagaaagggaagcaccaucuguggggaucccggcuuuucgaccaggcucaaacagcccagaaucgcagaaacuaccggucuagccgcagacgguauaauaaacgcagacagcggaucggccugcuccgccugauuauguccgauauggugcuugagguggaccccagcuuuuucaucagacuggaaaagacgaccuuucucgauaaggaggacaaaaaggcgauccugaaagauaacuacaagaugaauuauaaccuguucugcgacgaagauuacaaugacaaaaaguauuuuaaggauuacccuacaauuuaccaccuccggaaaaagcugugugagagcgacgagaaagcugauccgcgccuuaucuaucuggcccuccaucacauugucaaguacagagggaacuuccuguaugaaggacaggagcuucaucuggaacccuccaauaaagaggaggaccucaagauccuguuugacauucugggcaaaaacaaugauaccguguacgacaucucugaagaacaaauucaguucauccucaagacaguuguggaaaacaucagcaagaccgccaaagucgaugagugcaugucccagcugaagcugaacagcgaagacaaaaagauugugaaagaguuuaugcggggccugguugggaauaaguucaacgugucuaagcucuauaugcacgaggaucugcaguuugacgaugaagaccuuaaacugcaauucuccgauaagagcuacgaggaaaagaucacagaguaugaaaauguccucgaggagaagauggaauuuauugaccugaugcagcgcuucuacucuuggaucgagcuguccaaaauugugggaagcgauucucagcacgcuuccaucagcggcgccauggugaacaucuacgaaucccauagagaggaccuccggacccugaaggaagucaugcuuaagauugggaaaaaggaguaugacgagauguucaaaccuacgucuaagaauguugugaacuacuauaauuacgugaaccccgucgcuuguagcggagauaaaaccgacggcuuuuauaaguacgugaagaaagccaucgaaaaguccgaugacagcagaaaagaugagauucugcagaagaucgcgaaugaaacauauaugcucaaacaaaccucuaagaacaaugccuacauuccuuaccagaugcagaaagacgagcugaucaagauccuugaucaccaagagaaguauuaccccguucugaaagaaaaccgcgacaagauuaucuccauucucgaguuccggaucccuuauuacuaugggccgcuggauggaaauaaacaguuuggcuggcugauuaagaaaaagggcaaggaaaacgagagaauccuccccuggaaucaucaggaaauuguggacguccaggagacagcugcccaauucaucaaaaagcugaccaacuacugcacguaucuuccuaucgagaaagugaugccccagaaaagccugacauguucuauguacgaaguucucagcgaggugaacaaaauucgcaucgaugggaagcugcugccuauugacaccaagaaucggcuuaucgaagaucucuuuuucaaaagaaagacagucaaagagaaggaccugauuaacuggcugaaacagaaucagcucaccgugggagaaaucaccggcuaccaaaaggagaaggcuuuuuccucuagccuggcccccuggaucgacuucaaagagauuuuugaugaaaucaacgacuccaauuaugaucuuauugagaagaucauugaagacaugacaaucuucaacgaggggagcauccugaaagaacgccucaagaaagcguacaaucuggaucagaacaaggucaaaaagauuaugaagcugaaauauucuggauggucccggcuuagcaagaaacucaucaauggcauuagagccgacaacaaguuugggucuuccgugagcauccuggauguuaugaaagagucccacauggcucugauggagauuaucaaugaccaggaucucggauucaagcagaucauugaaaaggagaacuuuaaaaaugaaacgggcucuuucgaguacgaggacaucgaaaaccuggccggcagcccggcucuuaagcgcgggauuuggcaaacccuucaggugaucgaggaaauuaaaaauuauaugggacacgagccuaagaacaucuacauugaguucgcccgggaggagcaggaaaaagucagaacaaccacacgcgugaagaagcucaaauccaucuauaacgauaucaagaaucagcuggacguucauggcaaagagguguacucuaaccugaauaagcaagaugaaaaaucuuccauugagaagcggcuuuaccucuauuacacccagcuggggaagugcauguauagcggagaaucucuggacaucgacaaacucuccaacuacgagauugaucacaucuuucccagaacgcugacaagcgacgauucucuugacaaucugguccucgugaagaaaaaggagaaccagcggaaacuggaugaccuggugcuuccucucgaaauucgcaauaagauggagguuuucuggaagaaacuguaugauaacggccugaucacccaaaccaaguacuauagacucaugcgggacgaauuuagacgcgaucagaucgacaaauucauuaaucggcagcuggucgagacaagacagaucauuaagcauguggccaacaucauugaaaaucacuacgaggauaccaaaguguuuacaguccgcgcuaaccuuucccaugaguucagagaaaaguacgggaucuauaaaaaucggaacgugaaugacuuucaccacgcgcaugacgccuacaucgcuuguauuaucggccgcuauauucaaaucagauuccccggacuggaggccaaguacguuuauggccaguacaugcagaacgugaagaaaacgaagaacaauauugauaaagaaaaccacggguuuaucauuaauagcaugaaguaugagugcaucgacgaggauaccggagaagucaucuggaaccccgagcggauucucgacuacaucaaauguuucaauuaccgcgauguguauauuacaaagaagcuggacaccaacaauagagaacuguuuaacguuacaauccuuccuaaugauaaaaacucugagaagggcaaaaccaaggccacgauuccggugaauaaacugcggagcaacguccgcaaguacgggggauucuccggccuccagagcgacaucguggcuaucgaagggaagaaaggcaagaaaauugauagacggcugaucaaucuccccauucugcuucgcuauguuucuaucgaggaccaaugcaaguacauuauggagaacaauaaauauuccgaugugaagaucaucaagaaaauuaagaaaaaccagcugaucgaaauugacggaaucuguuacuaucucaagagcgccgaugagcuggacaccgcguaccagcugauucuuuccagagacgauaaugaaaugaucuaccggauugacagagcuauccagaacaacgauuuuucuuauuucgacaauaaaaaggagaacaucgaugaacuguaccgccucauuugccauaaaaugaucgagaauuauccuaaguacaagaaaaaggucuaugaguucauuaaagaacgggaggaagaguuuuucgaacuggacaacagccaaaagugcaucgugauuuuugagaugaucagagugaugaaacgcggcgagcaguacaucaauauucccuucgaaccuuauaaccucaagaaugaucggaaggggagacugaacugucaguccauccuucuggacaauacauacuuuuacgaugucucuauuaccggaaucuauagcaaaaaguacaaacucuga

SEQ ID NO: 4105 - RNA, 3999 nt, Artificial Sequence
  Cas9 variant
augcagaagaacuacaccaucggccuggacauugggacaaauagcgugggaugggccgucaugaaagaugacuauacgcucaucagaaagcggaugaaaguucugggcaacaccgauauuaagaaaaucaagaagaauuucuggggagugcgccuuuuugacgagggagaaacagcuaaagagaccagacugaagcggggcacacgcagacgguaccaacgcagacggaaccgccucauuuaucugcaggauaucuuccagcagcccaugcuugccaucgacgaaaauuucuuccacagacuggaugacuccuuuuucgugccugaugacaaaucuuacgaucggcauccgauuuuugggagccucgaggaagaggucgcguaucacaacaccuaccccacaaucuaucaucugcgcaagcaccuggcugacaauccugagaaagccgaucucagacugguguacaccgcccuugcucauauuguuaaguaccggggacacuuccugaucgaaggcgagcucaacacggaaaauaccuccauuucugagacauuugagcaauuccuggacaccuauagcgacaucuuuaaggaacagcuugugggcgauauuuccaaagucgaggaaauccugucuagcaagcagucccgcagcagaaaacacgagcagaucauggcccucuuccccaacgaaaauaagcuggggaacuuuggacgguucaugaugcugauugugggcaauacaucuaacuucaaaccuguuuuugaccucgaugacgaguacaagcugaaacuuuccgaugagaccuaugaagaggaccuggauacgcuccuggggaugacagacgauguguuccuugacgucuuuauggcugccaagaauguguacgaugcgguggaaaugagcgccaucauuucuaccgacacaggaaacuccaaggcuguccugagcaaccaaaugaucaauuucuaugacgagcauaaaguugaucucgcccagcugaagcaguuuuucaaaacccaccuucccgacaaguacuaugaaugcuuuucugauccuuccaaaaacggcuacgcuggguacauugacggaaagaccaaucaggaggauuucuauaaguacaucgagaaagugaugaagacaaucaaaagcgacaagaaagauuauuuucucgacaagauugauagagaaguguuccugcgcaagcaacgguccuuuuacaacucugucaucccgcaucagauucaccuucaggagaugcaagccauccuggacagacagagccaguauuaccccuuccucgcggaaaaucgcgauaaaauugagucccuggugacguuucggaucccuuauuacguuggcccccuuaccgugagcgaccagucugaauuugccuggauggagagacaauccgaugagccuauccgccccuggaacuucgacgaaauugucaauaaggagcggagcgcugaaaaauuuaucgagagaaugacaaacauggacaccuaccugcucgaggaaaaggugcugccgaaacgcucucugcucuaucagacauucgagguuuacaaugaacugaccaaggugcgguauacgaacgagcagggcaagacagaaaaacuuaauagacagcaaaaggccgagauuaucgagacccuguuuaaacagaagaaccgcguccgggaaaaagauauugcuaauuaccucgagcaguauggguacguggacggaaccgauaucaagggcgucgaagacaaauucaacgccagccuguccacauauaaugaucuggccaagauugacggggcuaaggcguaccuugaugacccugaguacgccgaugugugggaagacaucaucaaaauucucaccaucuuugaggauaaggcuaugcggaaaaagcagcugcaaacauauucugacacgcugagccccgagauucucaaaaagcuggaaagaaagcacuacaccggauggggccgcuucuccaaaaagcugaucaacgggcugagagaugagggaagcaacaaaacaauucucgacuaucugaagucugacgaaggcuccagcggcccuaccaaucggaacuuuaugcagcugaucagagauaauacacuuucuuucaaaaagaagaucgaggacgcccagaccauugaagauacgacccauaucuacgacacaguugccgagcuccccgggucccccgcuauuaaaaagggaauccgccaggcccugaaaauuguggaggaaaucaucgauauuaucggcuaugagccugaaaacauugucguggagauggcgcgggagagccaaaccacaaagaaagggaaggaccuguccaaggaaagacucgagaaacugaccgaagcuaucaaggaguuugauggaccgucugacguuaaagugaaggaucuuaaaaaugaaaaccugcgcaaugacagacucuaccuguauuaccugcagaacggccgggauauguacacgaaugagccccuugacauuaacaaucucagcaaguaugacaucgaucacaucauuccucaguccuucacaaccgacaacucuaucgauaauaaaguccuggugagccgcacaaagaaccaagggaauaaguccgacgaugugcccagcauuaacaucguucauaaaaugaagccuuuuuggagacagcugcacaaagccggccucauuucugaccggaaguucaaaaaccugaccaaggccgagcauggaggccuuaccgaagcugaucgcgcccacuuucugaauagacagcucgucgagacacggcagaucacgaagcacguggcuaaccugcuggacucccaauacaauaccgccgaagaacagcgcauuaacaucgugcuucucaaaagcucuaugacauccagauuccggaaggaguucaaacuguauaagguccgcgagaucaaugauuaccaucacgggcaugacgcguaucugaacgccgugguugcuaccacaauuaugaaaguguaccccaaucucaagccgcaguuugucuauggacaguacaagaaaaccagcauguucaaggaggaaaaagccacggcuagaaagcacuuuuacucuaacaucacaaaauucuuuaagaaggagaaagugguuaaugaagagaccggcgaaauucugugggauaccgagcggcaccuuagcacaaucaagagagugcuguccuggaaacaaaugaacauugucaagaaaguggagaagcagaaggggcagcucuggaaagaaaccaucuauccuaagggagacagcucuaaacugauccccguuaaggagggcauggauccucagaaauacgggggccugucccaagugagcgaagccuucgcggucgugauuacacaugagaaggggaaaaagaagcagcuuaaauccgaccugaucucuauucccaucguggaccagaaggccuaugagcaacacccuacggcuuaccucgaagaggccggcuauaauaaccccaccguccugcaugaacucuuuaaauaccagcuguucgagcuugaagaugggagccgccggaugauugcuuccgccaaggaguuucagaaaggaaaucagaugguucugccgcucgagcugguggaacugcuuuaucacgccaacagauacgacaaggugaaguucccugauucuaucgaguacguccaugacaaucuggcuaaauuugaugaccuccuggaauaugugaucgauuucagcaacaaguacauuaacgcggacaaaaauguucaaaagauccagaaaauuuauaaggagcacggcacagaagauguggagcucaccgucgaguccuucgugaaccugaugacauuuaccgccaugggggcucccgccacguucaaguuuuacggagaaucuaucacccgcagccgguauacauccauuaccgaguucagaggcagcacacuuaucuuucagucuauuaccgggcuguacgaaacacgcuauaaacucgaggacaauuga

SEQ ID NO: 4106 - RNA, 3999 nt, Artificial Sequence
  Cas9 variant
augaugaaggaguacagcaucggccuggacauuggguccucuagcgugggauucgucgccguugaugaccaguauagaguggugcgggcuaaaggcaagaacgucaucgggacccgccucuuugaugaaggaaaaacagccgcggacagacggggccugcgcacgaccagacggcgccuuuccagacggaaguggcgccugagacuccugcgggggauuuucgagccccacaucaaugaaauugaugagucuuucuucaugcgccuuaaagaaagcaacaucuccccuaaggacucuaauaagcauuuuccgggagauauccuguucaacgacagaagcgaucgggaguuuuacgagaauuaucccacaauuuaccaccuccgccaagcucugaaaaccgaaaagagacaguucgacauccgggagauuuaucuggccaugcaucacaucgugaaauacagaggccauuuucucgaaggcgggacaguuaccgauuucgaggugggagagcuggaccuugccggcaaguuuucccgccugaacgaacucuucgagagcauuaaucuggaagucccuuuugugcuucggcuggauaaccucgaggacguuaaagcugugcugaucgacucucagagauccgcccaggaucgccaacggacacugacccccgacauuuaugucccuagcacggauaagaucaccgaaaagagauucaaagggaucgcuacagagcuccugaaggccauugugggaaauaaagcgaaguucgacgugcuugccggccuggagcucgauaaagaagaggcuaagcugugggcccuuaccuuugacucugaaacauucgaugaggacaucgaacagcuggagggggauaugaccgaggcuacgcaggaccucauugaaauccugaaaucccugcgcagccucauucggcuggccgucaacaugcccgagggaguuucucuuuccgaaaugaugauccagagauacgaggaucacgcggaccaccugaagcuccugcgcgacaucauucauaauacagaugccgaaaaggcugccggccuucaagcugccuacgacggcuauaucgauggggugaaaggaaagaaaaccccuguggacgauuuuuacaaggccauuaaaaagaaccuggacgauagcgaggcugcgcaccagauccucgcccugauugacaagaaugaguucaugccgaaacagcgguccaagucuaacggcuggaucccccaucagauccaacagaaagaacuggauagaauuaucgagaaucagaagcaauauuacccuuggcucgcugacgucaaccccaacgaaagccgccggaaaguggccccuuauaagauugaugagcugguuacauuuagagugcccuacuaugucgggccgcuugugaccuccgaggaacagaagaaauacggaagcaaguucgccuggaugguucggaaagaggaaaagggcgagaucaccccuuggaauuuugaccagaaaguggaucgcgcugccucugcgacagaauuuauuaacagaaugacgaccauggacacauaccugcucaaugaggacguccugcccgcucacucccugaucuaucagaaguacgaggugcuuaacgaacucaauaaggucaaaauuaacggggaugccaucaccccugagcugaagcaaaagaucuaucacgaccuguuugaaaagcagacaaccgugagcauuaaaaaucuccagacguaccugguuucugagagcgaagccuccgaggugcccgagaucaagggacuugcugaugagaaaaaguuccugucuggccucacaaccuaucaugaccugaugaagauuuuugaucggaacgucgugaaugaccccgagagagccgaagauuucgagaaaaucauucgcuggagcaccguuuuugaagacaagcacaucuaccgggagaaacuggauucccuuagcuggcucacaaccgaccagaaggauagacuggcugugaaacgcuauagaggcugggggcggcugucugagaagcuccugaucggacuucgcgacgaaggccauagauccauuauggauuaccugugggagacaacgagcaacuucaugcaaauccaggcccagaaugacuucucugaaaagauugcggccgagaacaaagaguuucucgacaauacccaguccguccaagggaucauuaacgaacuguacacaagcccucagaauaagaaagcuauccggcagacccugcuugugguggaggauaucaagaaagccuuccacggagaagcuccgaagcgcauuuuuguugaguucgccagagaaaacgaguccacaccccagcggucuauccaacgccagagacaggucgagaacgcguaugaaaaggugacccaaaaucuccugguggacgauaaaauucgggccgagcugaaggacagcaucaacgaaaaacgccucuuucaugauagacuguuccuuuacuuuaugcagggcgggauugacauguauuccggcaagaaaaucaauaucgauaaccugucugcuuacgacauugaucacauccucccucagagcuucacggucgacaauucccuggauaaccgggugcugaccaaucagaaggacaacagagagaagggaaauagccuucccucugaacucuaucgcggcuccaugaaagagacaugggagaugaugcggaaccaagggcugcugagcaagggaaaauuucacagacucaugaugaccccuaauucuaugacagccuacgaccagcagggcuucauuaaccgccagcugguugaaacccggcaagugaucaaacuugcugucgagauucuggccuccgaauuugaucaggccgacgagaaaguggaaaucguuagcgugaaggcugggcucacgcaucagaugagacaggauuucucucugauuaaaaaucgcgacgucaacgauuaucaccaugcguuugacgccuaccugacagcuuucgugggaaccuaccuucugaagcgguaucccaagcucagaccguacuucguuuauggcgaguuuaaaaaguucagccaaaaacaggccaaucugacaaacuuuaacuuccucugggcccugaagcacaaagaucagguggcugucgaggacaccggggaaaagaucuggaauaagccucaagaucuugccuacauccgccaccuguuugcguucaaaaagauucucaucucccgggaggugagcgaaagacauggcgcucuguuugaccagacccuguauaaagccucugaugacaaggccuccggacagggcagcaaaaagcugauucccgcuaaggauaaccggccuacagagcuuuacgggggauauuccggccagacgucugccuucauggcgaucgugaaagucaccaaggggaaaaagacaaaauaccucguugugggagugcccaccgcugccauuagccaacugcagggcauggacgucaaguccucucaguacacagagaagaucuauaauauccucagcccuaaacugcuuuccaagaacgacgauuuugaagugauuguucccaaagugcgcuacagacagcugauccucgacaauaaccaacuguucacccuggggucugauacguauaaguacaaugcccggcagcuuguccugagcaacgaggugcucgcuguuauuaaucgcgacaaauccuuuaucgauaagaagcugagcgaagaggccgaaaaccaggcucucaaugacgccuucgaugagauuguggucgcgauggacaaacacuucgaucuguaugacaagaacggcuuuagagagaaagugaaggccggaaaacagcgguucgaagaacuuccgguuucucuguuuuccgaagauaaggagaaugaaggcaucacaaaaagaaccgugcugaagcgcauccuccaagggcugcaugcuaacgccaccacaagcgaccuuaagguccuggauggaaaauucuacaauuga

SEQ ID NO: 4107 - RNA, 4002 nt, Artificial Sequence
  Cas9 variant
augaagaacuacaccaucggccuggacauugggguggccagcgucggauggguuugcaucgaugagaauuauaaaauucucaacuacaauaacagacacgcuuucggcgugcaugaauuugaguccgccgaaucugcggcugggcggcgccugaagagaggaaugcggcgcagauauaaucggcgcaaaaagagacuucagcugcuccaaagccuguucgacuccuacaucacagauucuggcuuuuucagcaaaacggacucccagcacuuuuggaagaacaauaacgaguucgaaaaucggucucuuaccgaggugcugagcucccuccgcauuagcucuagaaaguaucccacaaucuaccaucugcgguccgaucugaucgagagcaacaaaaagauggaccuccgccuggucuaucuugcccugcacaaucucgugaaauacagagggcauuuucugcaggaaggaaacuggucugaggccgcuuccgccgaaggcauggaugaccagcuucuggagcucguuacccgguacgcugagcuggaaaaucugagcccucucgaucugucugagucccaauggaaggccgcggaaacacuucugcucaaccgcaaucugaccaaaacagaccagagcaaggagcuuaccgccauguucggcaaggaauaugagccguuuuguaaacugguggcugggcucggagucucccugcaccagcuguuccccucuagcgagcaggcccucgcuuacaaggaaacgaaaaccaaggugcaacuguccaacgagaacguugaagaggugauggaacuucugcucgaggaggaaagcgcccugcuugaggcgguccagccuuuuuaucaacagguggugcuguacgaacuccugaaaggcgagacauaugucgccaaggcuaaaguuucugccuucaagcaauaccagaaggauauggcuucccugaaaaaucuccuggacaagaccuuuggggaaaaaguguauagaagcuacuucauuucugauaagaacagccagcgggaguaccaaaaaucccacaagguggagguccuuugcaagcuggaccaguucaauaaagaagccaaguuugccgagacauucuauaaagaccucaagaaacugcuggaagauaagucuaagaccagcaucggaacgacagagaaagacgagaugcuuagaauuaucaaggcuauugauuccaaccaguuucuccagaaacaaaagggcauccagaaugcggccauuccccaucagaacagccuguacgaagcugagaaaauccugcgcaaucagcaagcccacuauccuuucaucaccacagaauggauugagaaggugaagcagauccucgccuuucggauucccuacuauaucgggccucugguuaaagacaccacccagucuccguucuccuggguggaaagaaagggagaugcucccauuacaccuuggaacuuugacgagcagaucgauaaagccgcgagcgcugaggccuucaucucucgcaugcggaagacguguaccuaccuuaaaggccaagaaguccugcccaaguccagccucacauaugagagauuugaagugcugaaugagcugaacggcauucagcuucgcaccacaggggccgaauccgacuuccggcauagacucucuuacgagaugaaaugcuggaucauugauaauguuuuuaagcaguacaagaccgugagcacgaaacgccugcugcaggagcucaagaaauccccuuaugcugacgaacuguacgaugagcacacaggagaaaucaaggaggucuucggcacccaaaaagaaaacgccuuugcuaccucucuuagcggguauauuuccaugaaaagcauccugggagccguggucgacgacaaucccgcgaugacagaggagcucaucuacuggauugccguguucgaagaucgggagauccugcaccugaagauucaggaaaaauauccgucuaucaccgacguucagagacaaaaacuugcucucgugaaacugccuggcugggggcgcuucucccggcugcucauugauggacugccccuugacgagcagggccagagcguccuggaucauauggagcaguacucuuccguguuuauggaaguucucaagaacaaaggcuucgggcuggagaagaagauccagaaaaugaaucagcaccagguggacggaacaaagaaaauuagauaugaagauaucgaggaacuggccggcagcccugcucuuaagcgggggaucuggcgcucugucaaaauuguggaggagcucgugagcaucuuuggagaacccgccaacauuguucuggaggucgcgagagaagacggcgagaagaagcggacgaaauccagaaaggaucagugggaggaacugaccaaaacaacccucaagaacgaccccgaucugaaaucuuucaucggggagauuaagagccaaggcgaccagcgcuuuaaugaacagcgguucuggcuuuacgugacacagcaaggaaaaugucuguacaccggcaaggcccucgauauccagaaccuguccauguaugagguggaccauauccugccucagaauuuugucaaggacgauagccuugacaaccuggcucucgugaugccggaagccaaucaaagaaagaaccagguugggcagaauaagaugccccuggagauuaucgaagcuaaccagcaauacgccaugcgcacgcucugggagagacugcacgagcuuaaacugauuuccucuggaaagcucggccggcugaaaaagccuagcuucgaugaaguggacaaggauaaauuuaucgcccgccagcuggucgagaccagacagauuaucaagcaugugcgggaccuucuggaugaacgcuucuccaaaucugacauccaccucguuaaggcugggauugugagcaaauuuagacgguucuccgagauccccaagauucgcgauuauaauaacaagcaccaugcgauggacgcccuguuugcugccgcccucauccagucuauucugggaaaauacggcaagaauuuccuugcuuucgaucugagcaaaaaggacagacaaaaacaguggcgguccgucaaggggagcaacaaggaguuuuuccucuuuaaaaauuucggcaaccugcgccugcagucuccugugacaggagaagagguuuccggcguggaauauaugaagcacgucuacuuugagcuucccuggcagaccacaaaaaugacccaaacgggggauggaauguucuauaaggaaagcaucuuuucuccgaaagugaagcaggccaaguacguguccccuaaaacagagaaguucguccaugacgagguuaaaaaucacagcaucugccugguggaauuuaccuucaugaagaaagagaaggaagugcaggagacaaaauuuauugaccucaaggucaucgaacaccaucaguuccugaaggagcccgagucucaacucgcgaaauuccuggcugaaaaggagaccaacuccccuauuauccacgccagaauuauccggaccauucccaaauaccagaagaucuggaucgaacauuuuccuuauuacuucauuagcacaagagagcuucacaacgcccgccaguuugaaaucuccuaugagcugauggagaaagugaagcaacugagcgaacggucuagcguugaggaacucaagauuguguucggccugcuuaucgaucagaugaaugacaacuaccccauuuauacgaaauccucuauccaggauagaguccagaaguuuguggacacccaacuguacgauuucaagagcuuugagaucggguucgaggaacucaagaaagcuguugccgcgaaugcucagcgcuccgacacauuuggaucucggauuagcaagaagccgaaaccugaggaaguggccaucggcuaugaguccauuaccgggcugaaguacagaaaaccccgcucugucgugggcacaaagcgguga

SEQ ID NO: 4108 - RNA, 4002 nt, Artificial Sequence
  Cas9 variant
augagccagaacaucguggacuacugcauuggccuggaucucgggaccggauccgucggcugggccguuguggacaugaaucacagacugaugaagcggaacgggaaacaucuuuggggaucucgccuguucagcaaugcugagacagccgcgaacagacgggcuucccgcucuaucagacggcgcuauaauaagagacgggaacgcauuagacuccugcgggccauccuucaagauauggugcuggagaacgaccccacguuuuucauucgccucgaacacaccagcuuucuggaugaggaagacaaagccaauuaccugggcgcugauuauaaggacaacuacaaucucuucaucgaugaggacuuuaacgauuauacauacuaucauaaauacccuaccaucuaccaccugagaaaggcccuuugugaguccacagaaaaggcugacccgcggcugauuuaucucgcccugcaucacaucgucaaauaccgcgggaauuuccuuuaugagggacagaaguuuaacauggaugcgucuaauauugaagacagacugagcgacguguucacccaguuugccgauuucaacaauauccccuacgaggacgaugagaaaaagaaccucgaaauucuggagauccugaaaaagccucucuccaagaaagcuaagguugacgaagugauggcccugauugcucccgagaaagauuuuaagagcgccuauaaagaacuugucacaggcaucgcgggcaacaagaugaaugugaccaaaaugauccugugcgagccuauuaagcagggggacucugagaucaagcucaaauucuccgauagcaacuacgacgaucaauuuucugaaguugagaaugaccugggagaauauguggaguucauugauucccuucacaacaucuacagcugggucgaacugcagacgauuaugggcgccacccauacauacaaugcuucuaucuccgaggccauggugagccgguauaacaagcaccaugaggaccuccagcugcugaaaaaguguaucaaagacaaugugcccaagaaguacuucgauauguuuagaaacgacuccgaaaaacucaagggguauuacaauuauauuaaccacccuucuaaagcuccggucgaugaguucuacaaguauguuaaaaagugcaucgaaaagguggacacccccgaggccaaacagauucugcacgauaucgaacuugagaauuuucugcucaagcaaaacagccgcacaaauggauccgugccuuaccagaugcagcuggacgagaugauuaaaaucaucgauaaccaggccaaguacuaucccguccuuaaagaaaagcgggagcaacugcucagcauucugaccuucaagaucccuuacuauuuuggcccccugaaugaaacgucugagcaugcuuggauuaaaagacucgaggggaaggaaaaccagcgcauccugccguggaacuaccaggacauuguggauguugacgcgacagccgagggauucaucaaacggaugagauccuauuguaccuacuuuccugaugaagaggugcuucccaagaauagccugauugucucuaaauaugaaguguacaacgagcucaauaagauccgcguugacgauaaacugcuggagguggacaucaagaacgacauuuacaaugaacuuuucaugaacaauaagacagucaccgagaaaaagcucaaaaacuggcuggugaauaaccaaugcuguaauaagaacgcugaaaucaaaggcuuucagaaggagaaucaguucagcaccucccugacaccuuggauugauuuuacgaacaucuucggcgaaauuaaucagucuaacuuugaccucaucgaggauaucauuuaugaccugaccgucuucgaggauaagaaaaucaugaagcggagacuuaaaaagaaauacgcccugcccgacgauaagauuaagcaaauccucaaacugaaguauaaagacuggagccgccuguccaagaaacuucucgaugggauuguggccgacaacaaguucggaagcucuguuacagugcuggauguccuggaaaugucccggcucaaucugauggagaucaucaacgacagagaucuuggcuacgcucagaugauugaagccgcggcuagcugccccgaggacgggaaguuuaccuauaaagaagugcagcgccuggccggaucuccugcccucaagcggggcaucuggcagucccugcaaauuguugaggagaucacaaaagugaugaaguguagaccgaaauacauuuauaucgaguucgagcggagcgaagagaccaaggagcgcacggaauccaaaaucaagaagcuggagaaugucuacaaagaccuugaugaacagacaaagguggaguacaaaaccgugcucgaagaacugaagggguuugacaacaccaaaaagauuucuagcgauucccuguuccucuauuuuacacagcugggaaagugcauguacucuggcaaaaagcuggacaucgauagccuugacaaauaucagauugaucacaucguuccccaaucccucgucaaggacgauagcuucgacaauagagugcugguggucccuucugagaaccagcggaaacuggaugaccuugugguucccuccgacauuagagugaagaugaauagcuuuuggaagcuccuguucgaucaugaacugaucucuccuaaaaaguuuuacucccucauuaaaaccgaguauacagaacgcgacgaggaacgguucaucaacagacagcuggucgagacgcgccagaucaccaagaaugugacacaaauuaucgaggaucacuacagcaccacaaaaguugcugccauuagagcuaaccuuucucaugaauuucgggugaagaaucacaucuauaagaaccgcgacauuaaugauuaccaccaugcccacgacgcguacaucgucgcccugaucggcggguucaugagagaucgguaucccaacaugcaugacagcaaagcuguguacuccgaguauaugaagauguuucgcaaaaauaagaacgauaaaaagagauggaaggacggauucguuauuaacagcaugaauuacccguaugaaguggauggcgagcucaucuggaacccugacauuaucaaugaaauucggaaauguuucuacuauaaggauugcuacugcaccacgaaacuggaccagaagucugggcagauguuuaaccugaccguccuucccaaugacgcccacuccccuaaaggaacaaccgaggcugugauccccgugaacaagaaucgcaaagaugucaacaaguacggcggguucagcggccugcaauauguuaucguggccauugagggaaagaaaaagagaggcaaaaagacaaaacucgugaagaagaucuccggggucccucugcaccucaaagcggccucucuggacgaaaagauuaaauacaucgaggaaaaggagaaucuuaccgaugugaaaauuaucaaggacagcauucccguuaaccagaugaucgagauggauggaggcgaauaucugcucacguccccgaucgaguuugugaaugggcggcagcugguccugaacgaaaagcagugugcucuuauugccgacaucuacaaugcuauuuauaaacaagauugcgacaaccuggaugacgugcucaugauccagcuguacauugagcucaucaauaagaugaaagcccuguauccugccuaccagucuaucgcugaaaaguucgagagcaugacagaggauuacguugcgguguccaaagaagagaaggccgacauuaucaagcagaugcuuauuaucaugcaucgcggacccagaaacggcaaaauucaauaugcugauuuuaaugucggggaccggaucggcagaaagaacaaaaugucucuggaccucgaacgcgugaccuucguuagccagucccccacaggaaucuacaccaagaaauauaagcuguga

SEQ ID NO: 4109 - RNA, 4002 nt, Artificial Sequence
  Cas9 variant
augggcaaggaguacuaucuggggcucgacaucggaaccgauagcgugggcugggccgucugcgacacaaacuacaaaauucccaaguucaaagggaaugcuauguggggaaucagacuguuugaaaaguccaacucugccgaggaacggcgcggcuucagaagcucccggcgcagaacgcagcggaaacgcgagagacuuaagcugcucgaaaugcuguuugaugaggagauuucuaagaucgacccugcguucuuuauuaaacuucgggaaagcaaucuguaucucgaggauaaguccaccaaaaucccguacuguguuuucucugacgaaaacuauacagauaaggacuuucaccgcgauuaccccaccaucuaucaucugagaaaugagcugauuaaaagcaacaagccucacgacgugcggcucguguaccuggcccuucaucacaucauuaagaaucgcgggcauuuccuguuugauuacuccuauaaaaacgacaagagcggagauuucaugcccaucuacaaugaccucaaaaacuauuuuuacgacaauuaugagauugaacuggauugcucugacgucgaugaguucgcuaacacacuuaaggacaaauccaagggcaaaaccaagaagaaugccgaaaucgcugagcuguuuggcgugagcaaaaaguacgauaaaguucucuauucugcccugucccugcucagcgggucuuccgugaagcuguucgacauuuucgaugacgaagcucuuaaagaugucgagaaaaagagcguguccuuuucuagcggauucgacgauaacgccaaugacuuucaauccuaccugggcgagagauucgaacuccuggagaaacuuaaggcgguuuacgacugggccgugcuggcugauauccucgacgggaaagaauauaucagcgaggccaaggucgcuauuuacgaaaaacacaagcgggaucugaagacacugaaaaaguauaucaaaauuuacaugccugagaagaaagccgagaucuuuaacauuucuuccaaggacaacaauuauguggcguacagcaagcacaucaaaaccucuaacggaacgggcgugcucaucagcaccuguacacaggaagaguucugcgccuaucugaagaaaacccuugggauuuguaaggaugcuuccuacgaagagauguuuaaagaaaucgaaaauucuacauucaugcccaagcaggucaccaaagacaacggaguugugccuaugcaagugaaugagaaggaacuggucgccauucucgauaacgcuaaggaguaccugccguuucuucugaauaaagacaacgauggcaagacgguguaugacaaaaucaaggcccucuucgaauaccgcauucccuauuacaucggcccucugaauacacauagcaccaaauccuggcugguuagaagcaacgagaagaucuaucccuggaauauugaggauguggucgacuuugauaagucugccgaaaaauucaucgagaaccucacauccaagugcaccuaccugccucaguaugacgugauucccaaacacagccuucuguacaauaaguuuuguguucucaacgaacugaauaaccugaaaaucgacggggagaagauuucugugcagcuuaagcaggauaucuacaacgaccucuucaaaaaguauuacaaagucaccaauaagaaacugugcgauuaucugaagucccggaacauugcuuucgacgaaaucagcggaaucgauaaugacuuuaaguccucucucaaaagcuacaaggaucugguggcguauaaccuuacagacgagcagaaagaggaaauugucaaggccaucacgauuuucggcgaugacaaaaagcugcucaaaaagagacugaagaaugaguuugggggaugucuguccgaugacgaaaucaaaaagauuugcaaacuuaaguacaccggcuggucuaaacucagccgcgaguuccugacagaugugaccgcuguuuauaaggaaacaggggagcugaucaacaucauuugugcccucugggagaccaauuacaaccugacgucccuucuguacagcgacgaauuuugcugcgacgauaaggagaauaaaacauucaacgacaagaucaaugaacucaacucuuuuggaaaugauaaaacccugaaccaaauuguggaggaacuguaugucuccccgcuugugaagcggccuaucuaccagagccuccugauuaccaaagagcuggagaagaucaugaagugucccccuaaaaagaucuucguugaaguggccagaggcgcugaggaaaagaagcgcacagucucucggagaaauaaacuccuggaccuuuauaaguccugcaagaacgauuacccccugcucuuugacgagcugcagaacaauaccacagaugacgagcugaaaagcgauaaacuuuaucucuacuucacgcaguuuggcaaauguauguauaccggggaaaacauugagcugggagaccuguucaauaagaaccucuacgauaucgaccauauuuacccccaaucuaaaaucaaggacgauagccuggacaaucgcgugcuugugaagaaaacaaccaacgccaagaaagauaaugaauauccucuguccagccagauucgggagaagaugacaccgcacuggaaagcgcuccuggacaagggccugaucaacaaaaagaaguacgaaagacuuguucgcaauuauccccugucugaugaggagcucucccaguuuaucagccggcaacuggucgaaaccagacaguccacgaaagcuguggccaacauucucgagcagcuguacccucgccccgacaccgaaaucguguaugucaaggccgcucuugccucugaguuccggcaccaguacgauaugcugaaaugcagagaagugaaugaccuccaucacgcuaaggaugccuaucugaacauuguuguggggaaugcguacaacggaaaauucacacauaauaaggccaacuuuaucaagggccugcaaaacaaugacaaggcuuacaccgucaaacuugauagcaugcugaagcacaacauugacggggccuggaucgcugauaauaacgagucccucaauauugugaagucuacaaugaacaaaaauaacauccgguauacccgcuacgccuucgagaagaagggcggacuguuuaaaguuacgauccucaagaaaggcaaugggcaggcgagcauuaagaaaaacgacaagagaaauuccaucgaaaaguauggaggcuacaaccaggugucuagcacauauuucuccugugucgagcaugggaaagacaauaaccggaugauuagcauguuuucugugaaucuguacgauaagaacaaauaugaagagaauccuaucgccuaccuuauugaaaacuacggacugaucaaccccaucauuaagguuaaaaaggugaaaauccaguccugcauuagcuucgacaauaugcucugucaccugggcgggaaggauucuggcggaucccaaaucagcuauagaccgggcguccagcuggugcuuggguacgacaacgagcgcuauauucggaaugugaucagaugcgcuggaggcgaucugcaccuccagaccucuaagaacgagaaagacaucgucacagccgaaaagaauauugagcuguuuaaccuccugaucgagaaaaugaagaauaacauuuacgggguucuuuauuccaaucugggagauaaacuguacuguagcaaggagaaguucgagaaacucgacaucguggaacagugcaacgugauuaagaauguccugaccauccuuaaaaacaaugcuuccaagggcgaucugaaaagcauugggaucaaggccaacggcgccauccgccucaauaacaacauuucugagaucaagaaaguuaagagcauuaaacugaucaaucaauccgugaccggacucuuugaacaggagauugaacugcuuaaccuguga

SEQ ID NO: 4110 - RNA, 4002 nt, Artificial Sequence
  Cas9 variant
augagccagaacaucguggacuacugcauuggccuggaucucgggacaggauccgucggcugggccguuguggacaugaaucacagacugaugaagcggaacgggaaacaucuuuggggaucucgccuguucagcaaugcugagacagccgcgacgagacgguccucucgcagcaucagacggcgcuauaacaagagacgggaacgcauuagacuccugcgggcuauccuucaagauauggugcuggagaaagaccccaccuuuuucauucgccucgaacacacauccuuucuggaugaggaagacaaggccaaauaccugggcaccgauuauaaggacaauuacaaccucuucaucgaugaggacuuuaaugauuauacauacuaucauaaguacccuaccaucuaccaccugagaaaagcccuuugugagucuacagaaaaggcugacccgcggcugauuuaucucgcccugcaucacaucgucaaauaccgcgggaacuuccuuuaugagggacagaaguuuaauauggaugcuagcaacauugaagacaaacuguccgacguguucacccaguuugccgauuucaauaacauccccuacgaggacgaugagaagaagaaucucgaaauucuggagauccugaaaaagccucucagcaaaaaggcgaaaguugacgaagugauggcccugauuucucccgagaaggaauuuaaauccgcuuauaaggagcuugucacgggcaucgccggcaacaagaugaaugugaccaaaaugauccugugcgagagcauuaagcagggggauucugaaaucaaacucaaguucuccgacagcaacuacgaugaccaauuuucugagguugaaaacgaucugggagaguauguggaguucauugacucccuucacaauaucuacagcugggucgaacugcagacaauuaugggcgcuacccauacagauaacgccuccaucucugaggcgauggugagcagauacaauaaacaccaugaagaccuccagcugcugaagaaguguaucaaagacaacgugccuaagaaauauuucgauauguuucggaaugacuccgagaaggucaaaggguacuauaacuacauuaauagacccaacaaggccccuguugaugaguucuauaaguuugugaaaaagugcaucgaaaaaguggacaccccggaagcuaagcagauucuccacgauaucgagcuggagaauuuccuucugaaacaaaacagccgcacgaauggaucuguccccuaccagaugcagcucgacgaaaugauuaagaucaucgauaaccaggccaaguauuacccugugcugaaagagaagcgggaacaacuucuguccauucucacauuuagaauccccuacuauuucggcccucugaaugagaccagcgagcacgcuuggauuaaacgccuggaagggaaggagaaccagcggauccuccccuggaauuaccaggacacaguugauguggacgccaccgccgaaggauuuauuaaaagaaugcgcucuuauuguaccuacuucccggaugaggaaguccugccuaagaacagccuuaucguguccaaauaugagguuuacaacgagcugaauaagauucggguggacgauaagcuccuggaagucgacgugaaaaacgacaucuauaaugagcuguuuaugaagaacaaaacagucacggaaaagaaacuuaagaauuggcucgugaacaaucaaugcuguagaaaggaugcugagaucaaaggcuuccagaaggaaaaccaguuuucuaccagccugacacccuggauugacuucaccaauaucuuuggcaaaauugaucaguccaacuucgaccugaucgagaagauuaucuacgaucucacaguuuucgaggacaaaaagaucaugaagcgccggcugaaaaagaaauacgcgcuuccugaugacaagauuaaacaaauccugaagcucaaguauaaagauuggagcagacugucuaagaaacugcuugacgggauuguggccgauaaucgcuuuggauccagcgucaccgugcucgacguucuggaaaugucucggcugaaccucauggagaucauuaaugauaaggaacugggcuacgcucagaugaucgaggaagccuccagcugccccaaagacgggaaguucacguaugaggagguggccaaacuugcuggaucccccgcccugaagagaggcaucuggcagucucuccagauugucgaagagaucacaaaggugaugaaaugucggccuaaguacauuuauaucgaauuugagcgcagcgaggaagcgaaagagagaaccgaauccaagauuaaaaagcuggagaacguguacaaggaccuggaugaacaaaccaaaaaggaguauaaaucuguucuugaggaacucaagggguucgacaauacaaagaagaucagcuccgauagccuguuucuguacuucacccagcucggaaagugcauguacucuggcaaaaagcuggacaucgauucccuugacaaauaucagauugaucauaucgucccgcagagccuggugaaggacgauucuuuugacaaccgggugcucguccugcccuccgagaaccaaagaaaacuggaugaccuugugguuccuuucgacauucgcgauaagauguaccgguuuuggaagcuccuguucgaccacgaacugaucagccccaaaaaguuuuauucucucauuaaaacagaguacacggaaagagaugaggagcgcuucaucaauagacagcugguggaaacccggcagauuacaaagaacgucacccagaucaucgaggaccauuauagcacaaccaaaguggcugccauucgcgccaaucuuucccacgaauuuagaguuaagaaccauaucuacaagaaucgggauauuaacgacuaucaccacgcucaugaugccuacaucguggcucugauuggcggguucaugcgcgacagauacccuaauaugcacgauagcaaagccgucuauucugaguacaugaagauguuccggaaaaacaagaaugaccagaaaaaguggaaagauggauuugugaucaacuccaugaauuaucccuacgaaguugacggcaagcucaucuggaacccggaucugauuaaugagaucaagaaauguuucuauuacaaggacugcuauugcacgaccaaacuggaccaaaagagcgggcagauguuuaaccuuacagugcugccuaaugaugcgcauuccgccaaaggaaccacagaggcugucauucccgugaacaagaaccgcaaggacgugaauaaauacggcggguucucuggccuccaauacgucaucgccgcuauugaaggaaccaagaaaaagggcaaaaagcugguuaaggugagaaaacucagcgggaucccucuguaucuuaagcaggccgauaucaaagagcagauugaauacguggagaaggaggaaaaacuguccgacgucaagaucauuaagaacaauaucccccucaaccagcugauugagaucgauggacggcaauaucugcuuacgucuccuacagaaugugugaaugcgaugcagcugguucucaacgaggaacagugcaaacugauugccgacaucuacaaugcuaucuauaagcaggauuuugacggccucgauaacaugcugaugauucaacuuuaccugcagcucaucgacaaacugaagacccuguaucccauuuacauggggaucguggagaaauucgagaaacuuacagaagauuuugucagcauuuccaaagaggaaaaggccaaugugaucaagcagaugcugaucauuaugcacaaaggaccgcagaacggcaauaucauuuacgacgauuucaacguugggaagcgcaucggcagacucaauggacggaccuuuuaucuggacaacauugaguucaucucucaaagcccuaccggcaucuacaccaaaaaguauaaacucuga

SEQ ID NO: 4111 - RNA, 4002 nt, Artificial Sequence
  Cas9 variant
auguacaccuauuacuucaaggagagcgaaaugguguaugacgucggccuggauaucgggacaggauccguuggcuggguggcccucgacgagaacgggaaacuggcuagagccaagggaaagaaucuugugggcguccggcuguuugauacggcgcagaccgcugccgaccgcagaggguuccggacaacccgcagacggcucucucgcagaaaguggcggcugcgccuucuggaugaacucuuuagcgccgagauuaacgaaaucgacuccucuuucuuucaaagacugaaauacagcuaugugcaccccaaggaugaggagaauaaggcucauuacuauggaggcuaccuguucccuacagaagaggaaaccaaaaaguuucaccgguccuacccgacaauuuaucaucuccgccaggagcugauggcccagcccaacaaaagauucgacauccgggagauuuaccuugcuauccaccaucugguuaaguaucgcggccacuuucucucuagccaggaaaagaucaccauuggguccacguacaauccugaggaucuggccaacgcgaucgaaguguaugccgacgagaagggacuuagcugggaacugaauaaccccgagcaacucaccgagauuaucucuggcgaagcuggguacggacugaauaaguccaugaaagccgaugaggcucugaaacucuucgaauuugacaacaaucaggauaaagucgccauuaagacacugcuugcgggccugaccgggaaccagaucgacuucgccaaacucuuuggaaaggacauuagcgauaaagacgaggcuaagcuguggaaacuuaaacuggaugacgaagcccucgaggagaagucucagacaauccugucccaacugaccgaugaagagaucgaacucuuccacgcugugguucaggccuaugacggcuucgugcugauuggccuucugaauggggccgauagcgucucugcugcgauggugcagcucuacgaccagcauagagaggaucggaaacugcuuaagucccuggcccaaaaagcuggacucaagcacaagagauuuagcgaaaucuacgagcagcuggcccuggccacggacgaggcuacaauuaaaaacggcaucuccaccgcccgcgaacucguggaggaaucuaaucugagcaaggaggucaaagaggauacacuucggagacuggacgaaaacgaguuccucccuaagcagcgcaccaaagcgaacuccguuauuccccaucaacugcaccuggcugaacuucagaagauccuccagaaucaggggcaauauuacccuuuucugcuggacaccuucgagaaggaagauggacaggacaacaaaaucgaggagcuccugcgguuucgcauuccguauuacgugggcccccuugugacaaagaaagaugucgaacacgccgggggagacgccgauaaucauuggguggagagaaacgaaggcuucgaaaagagccggguuacgccuuggaauuuugacaaaguguucaacagagauaaggcugcccgcgacuuuaucgaacggcugaccggcaaugauacauaucucauuggggagaagacccugccccagaacucucugagauaccagcuuuucacaguccucaaugagcugaacaaugugcgcguuaacggcaaaaaguuugacuccaaaaccaaggcugaucugaucaaugaccucuucaaagcccggaagacggugagccugucugcgcuuaaagauuaucugaaggcccaaggaaagggggacgucacaauuaccggacucgcugacgaaagcaaauuuaacuccucucugagcuccuacaaugaucugaagaaaaccuucgacgccgaguaccuugaaaacgaggauaaccaggaaacacucgagaagaucaucgagauucagaccguguucgaagacagcaaaaucgcuucuagagagcuguccaagcugccucucgaugacgaucaggucaagaaacugagccaaacacacuauacgggcugggggcggcuuucugaaaagcugcucgacuccaaaauuaucgaugagcgcggccagaaggugagcauucuggacaaacugaaguccaccucucagaauuuuaugagcaucauuaacaaugauaaguacggaguucaggccuggaucacagagcaaaacaccggcuccucuaaacuuacauucgacgaaaaggugaaugagcucaccacgagccccgcgaacaaaagagggaucaagcaguccuuugccguccugaaugauauuaaaaaggcuaugaaggaggagccgcggagaguguaucuggaguucgcccgcgaagaccagaccagcguucggucugugccuagauacaaccaacucaaagagaaguaucaguccaaaagccugucugaagaggcuaagguccuuaaaaagacacuggacggaaauaaaaacaagauguccgaugaccgcuacuuucucuauuuccagcagcaaggcaaggauauguacaccgggagacccaucaauuuugaacggcugagccaggacuacgauauugaccauaucauuccucaggccuucacaaaagaugacucucuggauaaccgcgugcuugugagcagacccgagaaugcccggaaguccgacagcuuugcuuauaccgaugaaguucagaaacaagacggaucucuguggacgucccuccucaagagcggcuucaucaaccgcaaaaaguacgagagacugacaaaggcggggaaauaucuggacggccagaagaccggauuuaucgcccggcagcuugucgagacacgccagauuaucaaaaauguggcuucccugauugaaggcgaguacgaaaacucuaaggccguggccaucagaagcgagauuaccgcugauaugcggcuccuggucgggaucaaaaagcaccgcgaaaucaacuccuuccaucacgccuuugacgcgcugcuuauuaccgcugccggacaauauaugcagaauagauaccccgaucgggacucuacaaacguguauaaugaguucgauagauacacgaacgacuaccugaagaaucuccgccagcugagcucccgggaugagguuagacgccucaaaucuuucggcuuuguggucgggaccaugcggaagggaaacgaagacuggagcgaggaaaauacauccuaucugagaaaagugaugauguucaagaacauccuuaccaccaaaaagacagagaaggaucgcggcccucugaauaaagagacgauuuuuagcccgaagucugggaaaaagcucaucccccugaacuccaaacggagcgacacagcccuguacggcggauauucuaauguuuacuccgcuuauaugacccuugugagagccaacggcaagaaucugcucauuaagaucccuaucagcauugcgaaccaaaucgaagucgggaaucugaaaauuaacgauuacaucgugaacaaucccgcuauuaagaaauucgagaagauccucauuucuaaacugccucuuggacagcugguuaacgaagacggcaaucugaucuaucucgccuccaacgaguaccgccacaaugccaagcagcuguggcuuagcaccacagaugcugacaaaaucgccuccauuagcgaaaacucuagcgacgaggagcugcucgaggcuuacgauauccugaccuccgaaaaugugaagaaccgguuucccuucuuuaagaaagacauugauaagcucucucaggucagagacgaguuccuggauagcgacaaacggaucgccgugauucaaacaauccuucgcgggcugcagaucgaugcggccuaucaggcuccggugaagauuaucuccaaaaaggucucugacuggcauaagcugcagcaaagcggaggcauuaaacucuccgauaauucugaaaugaucuaccagagcgccacggggauuuuugaaaccagaguuaagaucuccgaccugcuuuga

SEQ ID NO: 4112 - RNA, 4005 nt, Artificial Sequence
  Cas9 variant
augaagaaccccuacaccaucggccuggacauugggacaaauagcgugggaugggccguccucacgaaccaguaugaucugguuaaaagaaagaugaaaguggcuggcaauuccgacaagaaacaaaucaagaagaacuucuggggagugcggcuuuuugaugacgggcagaccgccgucgaucgcagaaugaaucggacagcgcgcagacggauugagcgcagacggaaccgcaucucuuaccugcaggaaauuuucgcuguggagauggccaauaucgacgccaacuuuuucugcagacucaaugauagcuuuuauguugacuccgaaaaacggaacucucgccacccuuucuuugcuaccaucgaggaagagguggccuaccauaagaauuauagaacaauuuaccaucugcgggaggaacuugucaacagcuccgagaaagcugaucugcgccucguguaucuggcccuggcgcacaucauuaaguacagaggcaauuuccucaucgaaggggcccuggacaccaaaaacacaucuguugauggaguguacgagcaguuuauucaaaccuauaaucaggucuucaugagcaacaucgaggaaggcacgcuugcuaagguggaggaaaacauugagguggccaauauccuggcuggcaaguuuacccggagagaaaaauucgagcgcauccuccagcuguacccgggggagaaguccacaggaauguuugcccaguucauuagccuuaucgucggcucuaaagggaacuuccaaaagguuuuugaccugauugaaaagaccgauaucgagugugcgaaggacuccuaugaagaggaccucgaagcccugcuggcuauuaucggagaugaguacgccgaacucuucguggcugccaaaaauacauauaacgccgugguccugagcucuaucauuaccgugacggcuacagaaaccaaugcgaagcucuccgccagcaugaucgagcgguuugacgcucacgaaaaggaucugggcgagcucaaagccuucauuaagcugcaucuucccaaacaguaccaggaaaucuuuaacaaugccgcuauugacggguaugccggauacaucgauggcaagacaaaacagguugacuucuacaaguaucugaagaccauccucgagaacauugagggcgcggauuacuuuaucgcuaaaauugaagaggaaaauuuccugagaaagcaacgcaccuuugacaacggggccaucccucaccagcugcaccucgaggagcuggaagccauuauccaucagcaagcuaaauauuaccccuuccuucgggaggauuaugaaaagauuaaaucucuggugacauuuagaaucccuuacuucgucggaccccucgccaagggccaguccgaguuugcuuggcugacgcgcaaggccgacggggaaauccggccuuggaauauugaggagaaaguggauuucggaaagagcgcgguugacuucaucgagaaaaugaccaacaaggacacauaucuuccgaaagagaaugugcugcccaagcacucccucugcuaccagaaguacauggucuauaacgaacugaccaaagugagauacauugaugaccagggcaagacaaauuauuuuucugggcaagagaaacagcagaucuucaacgaucuguuuaagcagaaacgcaaggucaaaaagaaggaccucgaacuguuccuucggaacauuaaucauaucgagagcccuaccaucgagggacuggaagauuccuuuaacgccagcuacgcuacguaucacgaccuccugaaagugggcaugaagcaagagauucuggauaauccccuuaacacagaaaugcucgaggacaucguuaaaauucugaccguguucgaagauaagccuaugaucaaagagcagcugcagcaguuuucugacguccucgauggcggggugcugaagaaacuugagagacgccacuacaccggauggggccggcuguccgccaaacuccugguugggauuagagaaaagcaaagccaucugacaauccuugacuaucucaugaaugaugacggacugaaccggaaucugaugcagcucaucaacgacucuaaucugagcuucaaauccauuaucgagaaggaacaggugucuaccacagauaaagaccuucagagcauugucgcugaucuggccggcucccccgcgaucaagaaggggauucuccaaagccugaaaaucguggacgagcuggugucuaucaugggcuacccgccucagacgauuguugucgagauggcccgcgaaaaccagaccacaggaaagggcaaaaauaacuccaagcccagauacaaaagccuugagaaggcuaucaaggaauuugggucuaaaauucucaaggagcacccuaccgauaaucaagaacugaaaaacaaucggcuguaucucuacuaucugcagaacggaaaggacauguacacaggccaggagcuugauauccauaaccuguccaauuaugacauugaucacaucgugccccagagcuucauuaccgacaacuccaucgauaaucucgugcugacgucuagcgccgggaacagagagaaaggaggcgacguucccccucuggaaaucgugcgcaagcggaaagucuuuugggagaaacuuuaccaagggaaucucauguccaagagaaaguucgauuaucugaccaaggcugaacgcggcggacugacagacgccgacaaagccagauuuauucaucggcagcucguggagacccgccagaucacaaagaacgucgcuaauauucugcaccagagauucaacaaugaaaccgauaaccacggcaauacgauggagcaagugcggaucguuacacuuaaaucugcgcuggugagccaguuccgcaagcaguuucagcucuacaaggucagagaggugaacgacuaccaucacgcccaugaugcuuaucugaaugggguuguggccaacacccugcuuaaagucuacccgcaacuggaacccgaguucguguauggagaauaccaccaguuugacugguucaaggccaauaaagcuacagccaagaaacaguuuuauaccaacauuaugcuuuucuuuggccaaaaggagcggaucaucgaugaaaacggggagauucugugggacaagaaauaccucgagaccaucaagaaagugcuggauuaucgccagaugaauauugucaagaaaacagaaauccagaagggagaguucuccaaggcgacgauuaaaccuaagggcaacagcucuaaacuuauccccagaaaggaaaauugggacccuaugaaauacgggggccuggauucccccaacauggcuuacgccguuaucauugagcacgccaagggaaagaaaaagcucaucuuugagaaaaagauuauccggauuaccaucauggaacgcaaaauguucgagaaggacgaagaggcuuuucuggaagagaaaggcuauagacauccgaaggugcugacaaaacuuccuaaguacacccuguaugagugugaaaaggggcggagacgcaugcucgccagcgcgaaugaggcucagaaaggaaaccaacuggugcucucuaaucaccuggucucccuucuguaccaugccaagaacugcgaagccagcgauggcaaaucucucaaguauauugaggcucaccgggaaacauucagcgagcugcuggcccagguguccgaguucgcuaccagauacacgcuugccgacgcgaaucugagcaagaucaacaaucucuuugaacagaacaaagagggggacauccaggccauugcucaaucuuucguugaucugauggccuuuaaugcuaugggagcccccgccuccuucaaguuuuucgaagcuacaaucgaccgcaaacgguauaccaaccucaaggagcugcuuagcuccaccauuaucuaccagucuauuacaggccuguacgaaagcagaaaacgccuggaugacuga

SEQ ID NO: 4113 - RNA, 4005 nt, Artificial Sequence
  Cas9 variant
augaagaaacccuacaccaucggccuggacauugggacaaacagcgugggaugggccgcucucacggaucaguaugaccuggucaagagaaaaaugaagguugccggcaauuccgagaaaaagcaaaucaagaaaaaccuuuggggagugcggcugguggaugaagggaagaccgcggcucaccgcagagucaaucggacaacccgcagacggauugagcgcagacggaaccgcaucucuuaccuccaggaaauuuucacagccgagauguuugaaguggacgccaauuucuuuuauagacuggaggauagcuucuacaucgaguccgaaaaacggcagucucgccauccuuucuucgcuaccaucgaggaagagguugccuaucacgagaacuacagaacaauuuaucaucuucgggaaaagcuggugaauagcuccgacaaagcugaucuccgccuggucuaccuggcccucgcgcacaucauuaaguacagaggcaacuuucugaucgaggggaagcucgacaccaaaaauacgucuguggaugaaguuuucaagcaguuuauuaaaaccuauaaccaaguguucgccagcgacaucgaggaaggaucccugacacggauugaggagaauaacgaagucgcuaagaucuuuagcgagaaacucaccaagagagaaaaacuggauaagauccuuaaucuguacccgaacgagaagucuacagaccucuucgcccaguuuauuucccugaucauuggcagcaaaggcaauuucaagaaauucuuuaaccugaccgaaaagacggauaucgagugcgcuaaagacucuuaugaggaagaccucgaggugcugcuugcccgcgugggggaugaauacgcggagauuuucgucgccgcuaagaacgccuauaaugcuguugugcuguccagcaucaucacagugucuaacaccgaaacaaaggccaaacucuccgccagcaugauugagcgguuugacaagcaugauaaagaccugaagagaaugaaggcuuucuuuaagguccgccuucccgagaauuucaacgaaguguuuaaugauguugagaaggacggauacgcgggcuauaucgaagggaaaaccaagcaggaggccuucuacaaauacaugaagaaaaugcuggagcacguggaaggagcugauuauuuuauuaaccagaucgaggaagagaauuuccuccggaagcaaagaaccuuugacaacggcgccauuccucaccagcugcaucuggaggaacucgaggccauccugcaccagcaggcuaaguacuaucccuuccuuaaagucgauuacgaaaagaucaaaucccuggugacauuucgcauuccuuauuucguugggccccucgccaauggacaaucugaguucagcuggcugacgcggaaggcggacggcgaaaucagaccuuggaacauugaggaaaaaguggauuuuggcaaguccgcuaucgacuucauugagaaaaugaccaauaaggacacauaccuuccgaaggagaacguccugcccaaacauagcauguguuaucagaaguacaugguguacaaugaacucaccaaaauccgcuauacagaugaccaggggaagacccacuacuuuucuggacaagagaaacagcagauuuucaacgaucuguuuaagcagaagcggaaagucaagaaaaaggaccuggaacucuuccuguauaauaugaaccacguggaguccccuacgguugaaggcguggaggaugccuuuaacagcucuuucacaaccuaccaugaccuucaaaaagucggggugccccaggagauccuggaugacccucucaauaccgaaaugcuggaggaaaucauuaagauccugacaguuuuugaggauaagagaaugauuaacgagcgccuucaggaguucagcaaugugcucgacgaagccguccugaaaaagcuggaacggagacacuauaccggauggggccggcucuccgcuaaacugcuuaucgggauucgcgauaaggagucucaucugacaauccucgacuaccugaugaacgaugacaaacacaauagaaaccugaugcagcuuaucaaugacagcaaccucuccuuuaagagcauuaucgaaaaggagcaagugucuacggccgauaaagacauucaguccaucguggcugaucuggccggaagccccgcgauuaagaaaggcauccugcagucucucaagaucguugacgagcuggucggcauuaugggguauccgccucagaccaucgugguggaaauggcccgggagaaucaaacaaccggaaaaggcaagaacaauuccaaacccagauucacaagccuugaaaaggcuauuaaggagcuggggucccagauccucaaagaacauccuaccgauaaccagggacugaagaaugaccgccuguaccuuuacuaucuccagaacggcaaagauauguacacggggcaagagcuggacauucacaaucugucuaacuaugauaucgaccacgucgugccccagagcuuuaucaccgauaacuccauugacaaucggguucucgccucuagcgcugccaacagagagaagggcgauaaugugcccucccuggaagucgugcgcaaaagaaagguuuacugggagaaacuuuaucaggcgaaacugaugagcaagcggaaauucgacuaccucacaaaggccgaacgcggaggccugaccgaggcugacaaagccagauucauccaucggcaacugguggaaacacgccagauuaccaagaacgucgcuaauauccuucaccagagauuuaacugcaagaaagaugagucugggaaugugauugagcagguucggaucgugacgcucaaggccgcccuggucucccaauuccgcaaacaguuucagcuguauaaggugagagaagugaacgacuaccaucacgcucacgaugcguaccucaauugugucguugccaacacacugcuuaaaguguauccucagcuggagccggaguucguguacggagacuaucaucaauuugauugguucaaggcuaauaaggccaccgccaaaaagcaguuuuacacaaacauuaugcuuuucuuugcuaaaaaggaccggaucaucgaugaaaauggcgagauucugugggacaaaaaguaucuggauaccaucaagaaaguccuuaacuaccgccagaugaauauugugaagaaaaccgaaauccagaagggggaguucagcaacgccacagcgaaccccaaaggaaauucuuccaagcugauuccuagaaaagcugacugggaucccaucaaguauggcggguuugacggcagcaacauggccuacgccaucguuauugaacacgagaagcggaaaaagaaaacggugaucaagaaagaacucauucaaaucaauauuauggagagaaccgcuuucgagaaggaccagaaggaguuccuggaaggaaaaggcuaccgcaacccuaaggucaucacaaaaauccccaaguauacccucuacgaaugcgagaaugggcggagacgcaugcugggaucugccaacgaagcgcagaaaggcaaucaaauggugcuuccgaaccaucugaugacacuccuguaucacgcuaagaauugugaggccagcgaugggaagucccuggccuacauugagagccaucgggaaauguuugcugagcuucuggacucuaucuccgaauuugccagcagauauacccucgcugaugccaaccuggagaaaauuaauacgaucuuugaacagaacaaguccggagacguuaaagugauugcgcagucuuucgucaaucuccuggaguuuaacgccaugggcgcuccugccagcuucaaguacuuugagacaaauaucgaacgcaaacgguauaacaaucuuaaggagcugcucaacgcuaccauuaucuaccaguccaucaccgggcuguacgaagccagaaagcgccuggaugacuga

SEQ ID NO: 4114 - RNA, 4005 nt, Artificial Sequence
  Cas9 variant
augaagaaccccuacaccaucggccuggacauugggacaaauagcgugggaugggccguccucacggaucaguaugaccugguuaaaagaaagaugaaaguggcuggcaacuccgauaagaaacaaaucaagaagaauuucuggggagugcggcuuuuugacgauggacagaccgccgucgaccgcagaaugaaccggacagcgcgcagacggauugagcgcagacggaaucgcaucucuuaccugcaggaaauuuucgcuguggagauggccaacaucgaugccaacuuuuucugcagacucaaugacagcuuuuauguugauuccgaaaaacgcaauucucggcacccuuucuuugcuaccaucgaggaagagguggccuaccauaagaacuauagaacaauuuaccaucugcgggaggaacuugucaauagcuccgagaaagcugaccugcgccucguguaucuggcccuggcgcacaucauuaaguacagaggcaacuuccucaucgaaggggcccuggauaccaaaaauacaucuguugacgagguguacaagcaguuuauucaaaccuauaaccaggucuucaugagcaauaucgaggaaggagcucuugccaagguggaggaaaacacggagguggcuuccauucuggccggcaaauuuacccggagagaaaaguucgagcgcauccuccggcuguacccgggcgagaaaagcacagggauguuugcgcaguucaucucucuuauugucggaaacaagggcaauuuccagaaaguuuuuaaccugguggaaaagaccgauaucgagugugccaaagacuccuaugaagaggaccucgaagcucugcuggccauuaucggggaugaguacgcugaacucuucguggccgccaagaauacauauaacgcugucgugcugagcucuauuaucaccguuacggcgacagaaaccaaugccaaacuuuccgcuagcaugaucgagagauuugacgcccacgaaaaagagcugggagaacucaaggccuucauuaaacugcaucuucccaagcaauaccaggagaucuuuaacaaugcugagauugauggcuaugccggguacaucgacggaaaaacaaaacagguggauuucuacaaguaucugaagaccacccucgaaaacgucgagggcgcggacuacuuuauuacaaagaucgaagaggagaauuuccugcgcaaacagcggacguuugauaacggcgugaucccucaccaacugcaccucgaggagcuggaagcuauucuucaucagcaggccaaguauuaccccuuccugagagagggguaugacaaaaucaagucucucguuaccuuucgcauuccuuacuucgugggaccccuggccaauggccaauccgaauuugcuuggcuuacacggaaggaugacggggagaucagaccuuggaacauugaggaaaaagucgauuucggaaagagcgccguggacuucaucgagaaaaugaccaauaaggacacauaucugccgaaagaaaacguccuccccaagcacucccugugcuaccagaaguacaugguguauaaugagcugaccaaaauucgcuacaucgaugaccagggcaagacgaacuauuuuucugggcgggaaaaacagcaaaucuucaacgaucucuuuaagcagaaaagaaagguuaaaaagaaggaccuggagcuuuuccugcgcaauauuaaccauaucgagagcccuacaauugaaggacucgaggauuccuuuaaugcuagcuacgccaccuaucacgaccugcugaaagugggccuuaagcaggaaauccucgauaacccccugaauaccgagauucuggaagacaucgucaaaauccucacaguguucgaggauaagcggaugauuaaagagcagcuggaacaauuuucugacguucuugauggcgugguccugaagaagcucgagagacggcacuacaccggguggggacgccuguccgcgaaacugcuugugggcaucagagacaagcagagccaucucacaauucuggauuaucugaugaacgacgacgggcucaaucggaaccugaugcagcuuaucaaugauucuaaccugagcuucaaauccauuaucgaaaaggaacaggugucuacgaccgacaaagaucuccaaagcaucguugccgaccuggcuggauccccugccauuaagaagggcauccugcagagccuuaaaauugucgaugagcucgugucuaucaugggguaucccccgcagacaauuguggucgaaauggcuagagagaaucagaccacaggcaaggggaaaaacaauuccaagccucgcuacaaaagccuggaaaaggccaucaaggacuuuggcucucaaauccugaaagagcaccccaccgauaaccaggaacucaagaauaaccggcuguaccuuuacuaucugcagaacgggaaagacauuuacacgggacaagagcucgauauccauaaucuguccaacuaugacauugaucacaucgugccucagagcuucauuaccgacaauuccaucgauaaccugguucuuacaucuagcgcgggcaauagagagaaagggggagacgugccuccccucgaaauuguccgcaagagaaagguguuuugggagaaacuguaccagggcaaccugauguccaagcggaaguucgacuaucucaccaaagccgaacgcgggggccugacagaggcugauaaggccagauuuauccaucggcagcuuguugaaacccgccaaaucacgaaaaauguggcuaacauucugcaccagagauucaauaaggagacagacaaccacggaaauaccauggagcagguccggaucgugacacucaaaucugcccugguuagccaguuccgcaagcaauuucagcuguacaaggugagagaagucaacgauuaccaucacgcccaugacgcuuaucuuaauggcgugguggcgaacacccugcucaaagucuacccccagcuggagccggaguucguuuauggggaguaccaccaguuugauugguucaaggccaauaaagcuaccgccaagaaacaauuuuauacaaacauuaugcuguucuuugcccagaaggaacggaucauugacgagaacggagagauccucugggauaagaaauaccuugaaacgaucaagaaagugcuggacuaucgccagauuaauaucgugaagaaaaccgagauucaaaagggcgaguucuccaaggcuacaaucaaacccaaggggaacagcucuaaacucauuccuagaaaggaaaauugggaucccgucaaauacggaggccuggacuccccuaacauggccuacgcggugaucaucgagcacgcuaaggggaagaaaaagauuguuaucgaaaagaagcugauucagaucaauauuauggagcggaaaauguuugaaaaggaugaggaagccuuccuugaggagaaaggcuaucaucagcccaaggugcugaccaagcucccgaaauacacacuguaugaaugugagaagggaagacgccggaugcucagcucugccaacgaagcucagaaaggcaaucaacugguccuuuccaaccaccuggugagccuccuguaccaugccaagaauugcgaggcgucugacgggaaaagccugaaguauaucgaagcucacagagagaccuuuuccgagcuucuggcccagguuagcgaguucgccacgaaguacacacucgcugacgccaaccugucuaaaauuaauaaccucuucgaacagaauaaggaaggagauaucaaagcuaucgcccaguccuuuguggaccugauggcguucaacgccaugggcgcuccugccagcuuuaaguucuuugaggcuaccauugaucgcaaacgguauaccaaucuuaaggaacugcuguccucuacaaucauuuaccaaagcaucaccgggcucuacgaguccagaaagcgccuggacgauuga

SEQ ID NO: 4115 - RNA, 4005 nt, Artificial Sequence
  Cas9 variant
augggcagaaagcccuacauccugagccucgacauugggaccggauccgugggcuaugccugcauggauaaaggguucaacguccugaaguaccacgacaaagaugcucuuggaguuuaucuguuugacggcgcccucacagcgcaggagcggcgccaauucagaacgucucggcgcagaaagaaucggcgcaucaaaagacuggggcuucugcaggaacuccuggcuccucuggugcagaacccgaauuuuuaccaguuccaacggcaguuugccuggaagaacgauaauauggacuucaagaacaaaagccucuccgaggugcugucuuuucuuggauaugaaagcaagaaauaccccaccauuuaucaucugcaggaggcccuccugcuuaaggaugaaaaauucgacccugagcugaucuacauggcucucuaccaccuggucaaguaucgcggccauuuucuguucgaucaccucaagauugagaaucugacaaacaaugacaacaugcaugauuuuguggaacuuaucgagaccuacgaaaaucugaacaauaucaaacucaaccuggacuaugagaagacaaaaguuauuuacgagauccuuaaggauaaugaaaugaccaaaaacgacagagccaagcgggugaaaaacaugcagaagaagcuggagcaauucuccauuaugcuccugggccugaaauuuaaugaagggaagcuguucaaccacgcugacaaugccgaggaacugaaaggagcgaaccagucucacacauucgccgauaauuaugaggagaaccuuacccccuuucugacggucgaacagagcgaguucaucgaacgcgcuaauaagauuuaccucucccugacccuucaggacauccugaaaggcaaaaagagcauggccaugucuaagguggcugccuaugauaaguuuagaaacgagcucaaacaaguuaaggacauuguguacaaagcggauuccacacggacccaguucaagaagaucuuugucagcucuaaaaagucccugaaacaguacgacgccacaccuaaugaucaaaccuucagcucucugugucucuuugaccaguaucugauccgccccaagaaacaguacucccuucugauuaaggaacucaagaaaaucauuccucaggauagcgagcuguauuucgaggcugaaaacgacacgcugcuuaaggugcucaauacaaccgauaacgccuccaucccgaugcaaauuaaucuguacgaggcugaaacaauccugagaaaccagcagaaauaucaugccgagaucaccgacgaaaugauugagaaggugcucucucugauccaguuucggauucccuacuaugucgggccucuuguuaaugaccacaccgccagcaaauucggauggauggagagaaaguccaacgaaagcaucaaacccuggaacuuugaugaggugguggaccgcucuaaguccgcuacacaauucauucggagaaugacgaauaagugcagcuaccugaucaacgaagauguccucccuaaaaauucucugcuguaccaggagauggaggugcuuaacgaacucaaugcgacccagauccgccugcagacagaccccaagaaccggaaauauagaaugaugccgcaaauuaagcuguuugccguugagcauaucuucaaaaaguacaagaccgugagccacuccaaauuccucgaaauuaugcucaauucuaaccaccgcgagaauuuuaugaaccauggcgaaaagcugagcaucuucgggacacaggaugacaaaaaguuugcuuccaaacugagcucuuaucaggauaugaccaagauuuucggagacaucgagggcaagcgggcccagauugaggaaaucauccaauggauuacgaucuuugaggauaaaaagauucucguccagaaacugaaggaauguuacccugagcugacauccaaacagaucaaucaacuuaagaagcucaacuauagcggcugggggagacugucugaaaaacugcucacccacgccuaccagggacauuccauuaucgagcugcuucgccacagcgacgagaauuucauggaaauccugaccaacgauguguauggcuuucagaauuucauuaaggaggaaaaccagguucaauccaacaaaauccagcaucaggacauugcuaaucucacaaccucucccgcccugaagaaagggaucuggagcacaauuaagcuggugcgggagcuuacguccaucuuuggagaaccugagaaaaucauuauggaguucgcgaccgaagaucagcaaaagggcaaggagcagaaaucuagaaagcagcucugggacgacaacaucaaaaagaauaaacuuaagagcgucgaugaauacaaguacauuaucgacguggcuaacaaacugaauaacgagcagcuccaacaggagaagcuguggcuuuaucugucccagaaugggaaaugcauguacagcggacaaucuauugaucucgacgcccugcugucccccaacgccacaaagcacuaugaagucgaucacaucuuuccccgcagcuucaucaaagacgauucuauugacaauaaggugcuuguuaucaagaaaaugaaccagaccaagggcgaucaggugccucugcaguuuauucaacagccguacgagcggaucgcuuauuggaaaucccucaauaaggccggccugauuagcgacucuaaacuccauaagcugaugaagcccgaguucacagcuauggauaaagaaggguucauccagagacagcuugucgaaacccggcaaauuagcgugcacguucgcgacuuucugaaggaggaguacccuaacacgaaagugauccccaugaaggccaaaauggucuccgaguucagaaagaaguuugauaucccuaaaauucggcagaugaaugacgcgcaucacgccaucgacgcuuaucucaacggagugguguaccacggcgcccagcuggcuuaccccaauguugaucuguucgacuuuaacuucaagugggaaaaagucagagaaaaguggaaagcccuuggggaguuuaacaccaagcagaaaagccgcgaacuguucuuuuucaagaagcucgagaaaauggaggugucucaaggagaacggcugauuuccaagaucaaacucgauaugaaucauuuuaagauuaacuauagcagaaaacuggcgaauaucccgcagcaguucuacaaccagacagccguguccccuaagaccgcugagcuuaaguaugaaucuaauaaaagcaacgaggucguguacaagggccugacacccuaucaaaccuacguuguggccaucaaauccgucaauaagaaagggaaggaaaagauggaguaucagaugauugaccacuacguguucgauuuuuacaaauuccagaacggcaaugagaaggaacucgcucuguaucuggcccaacgcgagaacaaagacgaaguucuugaugcccagaucguguacucucugaauaagggagaccuccuguauauuaacaaucauccuuguuacuuugucagcagaaaagaggugaucaacgcuaagcaguucgagcucacgguugaacagcaacugucccuuuauaaugugaugaacaauaaggagacaaacgucgaaaaacugcugauugaguacgauuuuaucgcggaaaaggugaucaacgaguaucaccauuaccucaauucuaaacugaaggagaaacgggugcgcaccuucuuuagcgaauccaaccagacacacgaggacuucauuaaggcccuugaugaacuguuuaaagucguuaccgcuagcgccaccagaucugacaagaucggcucccggaagaauagcaugacacaccgcgccuuccucgggaaaggaaaggacgugaaaauugcuuacacgucuaucuccggccugaagaccacaaaacccaagagccucuuuaagcuggccgagucuagaaacgaacuuuga

SEQ ID NO: 4116 - RNA, 4005 nt, Artificial Sequence
  Cas9 variant
augaagaaccccuacaccaucggccuggacauugggacaaauagcgugggaugggccguccucacggaucaguaugaccugguuaaaagaaagaugaaaguggcuggcaacuccgauaagaaacaaaucaagaagaauuucuggggagugcggcuuuuugacgagggagaaaccgccgcggaucgcagaaugaaccggacagcucgcagacggauugagcgcagacggaaucgcaucucuuaccugcaggaaauuuucgcccucgagauggccaacaucgacgcuaacuuuuucugcagacugaaugauagcuuuuaugucgacuccgaaaaacgcaauucucggcacccuuucuuugccaccaucgaggaggaaguggcuuaccauaagaacuauagaacaauuuaccaccuucgggaggaacugguuaauagcuccgagaaagccgaucuccgccugguguaucuggcgcucgcccauaucauuaaguacagaggcaacuuccugaucgagggggcucuugacaccaaaaauacaucugucgauggaguguacaagcaguuuauucagaccuauaaccaaguuuucaucagcaauauugaagagggcacgcuggccaagauggaagagaacaccacaguggcugacauccucgccggcaaauuuacccggaaggaaaaacuggagagaauccuucagcuguacccgggggagaaguccacaggaauguucgcgcaguuuauuagccucaucgucggcucuaaagggaacuuccagaagguguucgaucugguggaaaagaccgacauugagugugccaaggacuccuaugaagaggaucuggaagcucuccuggccaucauuggagacgaguacgcugagcuuuuugucgccgccaagaauacguauaacgcuguugugcugagcucuaucaucacagugaccgauacagaaaccaaugcgaaacucuccgccagcaugauugagcgcuucgacgcucacgaaaaggaucugcgggagcuuaaagccuuuaucaagcugcaucuccccaaacaauacgaagagauuuucucuaacgucgccaucgacggcuaugcuggguacauugauggaaagaccaaacagguggacuuuuacaaauaucugaagacacugcucgagaauaucgaaggcgccgauuacuucaucgcgaaaauugaggaagagaacuuucugagaaagcagcgcacguucgacaauggcgcuaucccucaccagcuucaccuggaggaacucgaggccauucugcaucaacaggccaaauauuaccccuuuuucaaggaggcuuaugauaagaucaaaucccuuguuaccuuucggauuccuuacuucguggggccccuggccaacggacagagcgacuuugcuuggcucacaagaaaggccgacggcgaaauccgcccuuggaauauugaagagaaagucgauuucgggaaguccgcgguggacuucaucgagaaaaugaccaacaaggauacauaucugccgaaggaaaauguucugcccaaacacucucucuacuaccaaaaguauaugguguacaacgagcugaccaaaguccgguauaucgacgaucagggaaagacgaauuacuuuagcggccaggaaaaacagcaaauuuucaacgacuauuuuaagaaaaagagaaagguguccaaaaaggaucuugagcaguuccugcgcaauaugagccauaucgaaucuccuacaauugaggggcucgaggacuccuuuaacagcucuuacgccaccuaucacgaucugcugaaagucggaaucaagcaggaagugcuugagaacccccucaauaccgaaaugcuggaggacauuguuaaaauccugacaguguucgaagauaagcggaugaucaaggagcagcuccaacaguuuagcgacguccuggauggcgcugugcuuaaaaagcuggagagacgccacuacaccggcugggggcggcucuccgccaaacugcugguuggaauuagagacaagcagucucaucuuacaauccucgacuaccugaugaacgaugacggccugaaucggaaccucaugcagcugauuaaugauagcaaccuuuccuucaaaagcaucauugaaaaggagcaagugucuacgaccgacaaggaucugcaguccaucgucgcugaccucgccgggagcccugcgaucaaaaaggggauucugcagucucugaaaaucguggaugaacuuguguccauuaugggcuaucccccgcagacaaucguugucgagauggcccgcgagaaucaaaccacagugaaggggaaaaacaauagcagaccucgguacaagucccucgaaaaggcuauuaaagaguuuggcucucagauccugaaggaacaccccaccgacaaccaggagcugagaaauaaccgccucuaucuguacuaucuucaaaauggaaaagauauguacacgggccaggaacuggacauccauaaccucagcaauuaugauauugaccacaucgugccucaguccuucauuaccgauaacucuaucgacaaccugguccugacaagcuccgccgggaaucgggagaagggagacgaugugccuccccuugagauuguuagaaaacgcaagguguuuugggaaaaacucuuccagggcaaccugaugagcaagagaaaguuugacuaccugaccaaagcugagcgcgggggacucacagaagccgauaaggccaccuucauccaucggcaacuggucgagacgagacagauuacaaagaauguggcuaacauccuucaccagcgguucaauaacgaaaccgacaaucacggcaacaauauggagcagguucgcaucgugaugcugaagucugcgcucgucucccaauuuagaaaacaguuccagcuguacaaggugcgggagguuaacgauuaucaucacgcccaugacgcuuaccugaaugggguggucgccaacacacuucugaagguguauccccagcucgaaccggaguuuguguacggcgaauaucaccaauucgauugguuuaaagccaauaaggcuaccgccaaaaagcaguucuacaccaacauuaugcuguuuuucgcgcagaaagagcgcaucauugacgaaaauggagagauccucugggauaagaaguaucuggagacaauuaaaaagguccuugacuacagacaaaugaacaucguuaaaaagacggaaauccagaaaggcgaguuuagcaaggcuaccauuaagcccaaagggaacucuuccaagcugaucccucggaaagaaaauugggaucccaugaaguacggaggccucgacagcccuaacauggccuaugccgugauuaucgagcacgcuaaagggaagaagaaaguggucuucgagaagaaaauuauccgcaucacaauuauggaaagaaaggccuuugagaaagacgaaaagucuuuccuggagaaacagggauaccggcagcccaaggugcugaccaaacuuccgaaauauacacuguacgaaugcgagaauggcagacgccggaugcucgcgagcgcuaacgaggcccaaaaggggaaucagcagguucugaaaggccagcucaucacccugcuucaucacgccaagaacugugaggcuuccgauggaaaaagccuggacuauauugaaucuaauagagaaauguucggcgagcuccuggcccauguguccgaauuugcuaagcgcuacacgcuggccgaugcgaaccuuagcaagaucaaucaacuguucgagcagaacaaagacaaugauauuaaggucaucgcccaguccuuugugaaccucauggcuuucaaugccaugggggcuccugccucuuuuaaauucuuugaggccacaauugaacggaagagauauaccaaccugaaagagcuccugagcgcuaccaucaucuaccaguccauuacaggacuuuacgaagcgcgcaagcggcuggacggcuga

SEQ ID NO: 4117 - RNA, 4005 nt, Artificial Sequence
  Cas9 variant
augaagaaccccuacaccaucggccuggacauugggacaaauagcgugggaugggccguccucacgaaccaguaugaucugguuaaaagaaagaugaaaguggcuggcaauuccgacaagaaacaaaucaagaagaacuucuggggagugcggcuuuuugaugacggacagaccgccgucgaucgcagaaugaaucggacagcgcgcagacggauugagcgcagacggaaccgcaucucuuaccugcaggaaauuuucgcuguggagauggccaauaucgacgccaacuuuuucugcagacucaaugauagcuuuuauguugacuccgaaaaacggaacucucgccacccuuucuuugcuaccaucgaggaagagguggccuaccaugauaauuauagaacaauuuaccaucugcgggaggaacuugucaacagcuccgagaaggcugaccugcgccucguguaucuggcccuggcgcacaucauuaaauacagaggcaauuuccucaucgaaggggcccuggauaccaagaacacaucuguugacgagguguacaaacaguuuauucaaaccuauaaucaggucuucaugagcaacaucgaggaaggagcucuugccaagguggaggaaaaccuggagguggcuuccauucucgccggcaaguuuacgcggagagaaaaauucgagcgcauccugcggcuuuacccgggcgaaaagagcaccgggauguuugcgcaguucaucucucugauugucggaaauaaaggcaacuuccagaagguuuuuaaucucguggaaaagacagauaucgagugugccaaggacuccuaugaagaggaccuggaagcucugcucgccauuaucggggaugaguacgcugagcuguucguggccgccaaaaacaccuauaaugcugucgugcuuagcucuauuaucacaguuaccgcgacggaaacaaacgccaagcuguccgcuagcaugaucgagagauuugacgcccacgaaaaggaucucggagagcugaaagccuucauuaaacuucaucugcccaaacaauaccaggaaaucuuuaauaacgcugccauugacggcuaugcgggguacaucgauggaaagaccaaacagguggacuucuacaaguaucucaagacaacccuggagaaugucgagggcgcugauuacuuuauuaccaaaaucgaagaggaaaacuuccugcgcaagcagcggacauuugacaauggcgugaucccucaccaacuccaccuggaggagcuugaagccauucugcaucagcaggccaaauauuaccccuuccucagagaggauuaugaaaagaucaaaucucugguuacguuucgcauuccuuacuucguggggccccuugcuaagggacaauccgaguuugccuggcugacccggaaggcugacggcgaaaucagaccuuggaacauugaggagaaagucgauuucggaaagagcgccguggacuucaucgagaaaaugacaaauaaggacaccuaucucccgaaagagaacguccugcccaagcacucccugugcuaccagaaguacaugguguauaaugaacucacaaaaguucgcuacauugaugaccaggggaagaccaacuauuuuucuggccaggagaaacaacagaucuucaacgaucuguuuaagcagaaacggaaggugaaaaagaaggaccuugaacuguuccucagaaauaucaaccauauugagagcccuacgaucgaggggcuggaagauuccuuuaaugcgagcuacgccacauaucacgaccugcuuaaagucggaaugaagcaggagucucucgauagcccccugaacgcugaaaugcuggaggacauugugaaaauccucaccguuuucgaagauaagcgcaugauuaaagagcaacugcagcaguuuuccgacgugcuugauggcgucgugcugaagaagcucgagcggagacacuacaccggcugggggcggcugucugccaaacugcuugugggaauccgcgacaagcagagccaucucacaauccuggauuaucugaugaaugacgacggccucaacagaaaucugaugcaacuuauuaacgauuccaaucugucuuucaaaagcaucauugaaaaggagcagguuuccaccacagacaaagaucuccagagcaucgucgcugaccuggccgggucuccugcgauuaagaagggaauccugcagucccuuaaaaucguggaugaacucgugagcauuaugggcuaucccccgcaaacgaucgucguggagauggcccgggagaaccagaccacaguuaaggggaaaaauaacucuagaccucgcuacaagucccuggaaaaagcuauuaaggaguuuggcagccagauccugaaggaacaccccaccgacaaucaagagcucaaaaacaaucggcuguaccuuuacuaucugcagaacggaaaggauauuuacacaggccaggaacucgacauccauaaccuguccaauuaugauaucgaccacauugugccucagucuuucaucaccgauaacagcauugacaaucugguccuuacguccucugccgggaacagagagaaaggaggcgaugugccuccccucgagaucguucgcaagagaaaaguguuuugggaaaagcuguaccaagggaaucugaugagcaaacggaaguucgacuaucucaccaaggcugagcgcggaggccugacagacgccgauaaagccagauuuauucaucggcagcuugucgaaacccgccagaucacaaagaacguggcuaauauucugcaccagagauucaacaaugagaccgacaacuacgggaauacgauggaacaaguucggaucgugacacucaaauccgcgcuggucagccaguuccgcaagcaguuucagcuguacaaagugagagaggugaacgauuaucaccaugcccacgacgcuuaccuuaauggcgucguugccaacacccugcucaagguguauccccaacuggagccggaguucguguacggagaauaucaucaguuugauugguucaaggccaauaaagcuacagccaagaaacaguuuuacaccaacaucaugcuguucuuugcgcaaaaggaacggauuaucgacgagaacggcgaaauucucugggauaaaaaguaucuugagaccaucaagaaaguccuggacuaccgccagaugaauauugugaagaaaacagagauccagaagggggaguucucuaaagcuacgaucaagcccaagggaaacuccagcaaacucauuccuagaaaggaaaauugggaucccaugaaauacggcgggcuggacucuccuaacauggccuaugccguuaucauugaacacgcuaaggggaaaaagaagaucgugauugagaaaaagcugauccagaucaauauuauggagcggaaaauguuugaaaaggaugaggaagccuuccuugaggaaaaaggcuacagacaccccaagguccugaccaaacucccgaaguauacacuguacgagugugagaaggggcgccggagaaugcucgcguccgcuaacgaagcccaaaaaggcaaucagcuggugcuuagcaaccaucugguuucucuccuguaucacgccaagaauugcgaggcuagcgacggaaaaucccugaaguacaucgaagcccaucgcgaggcuuuuagcgaacuucuggcccaggugucugaguucgcgacccgguauacacucgccgacgcuaaccuguccaaaauuaauaaccucuucgagcagaauaaggaaggcgauaucaaggccauugcucagagcuuugucgaccugaugguguucaacgccaugggggccccugcuuccuuuaaauucuuugaggcgaccaucgauagaaagcgcuacacgaaucuuaaagaacugcugucuagcacaauuaucuaccaauccaucaccggacucuaugagucucggaagagacuggacgauuga

SEQ ID NO: 4118 - RNA, 4005 nt, Artificial Sequence
  Cas9 variant
augaagaaccccuacaccaucggccuggacauugggacaaauagcgugggaugggccguccucacggaucaguaugaccugguuaaaagaaagaugaaaguggcuggcaacuccgauaagaaacaaaucaagaagaauuucuggggagugcggcuuuuugacgagggagaaaccgccgcggaucgcagaaugaaccggacagcucgcagacggauugagcgcagacggaaucgcaucucuuaccugcaggaaauuuucgcccucgagauggccaacaucgacgcuaacuuuuucugcagacugaaugauagcuuuuaugucgacuccgaaaaacgcaauucucggcacccuuucuuugccaccaucgaggaggaaguggcuuaccauaagaacuauagaacaauuuaccaccuucgggaggaacugguuaauagcuccgagaaagccgaucuccgccugguguaucuggcgcucgcccauaucauuaaguacagaggcaacuuccugaucgagggggcucuugacaccaaaaauacaucugucgauggaguguacaagcaguuuauucagaccuauaaccaaguuuucaucagcaauauugaagagggcacgcuggccaagauggaagagaacaccacaguggcuaacauccucgccggcaaauuuacccggaaggaaaaacuggagagaauccuucagcuguacccgggggagaaguccacaggaauguucgcgcaguuuauuagccucaucgucggcucuaaagggaauuuccagaagguguucgaccugguggagaaaaccgauauugagugugccaaggacuccuaugaagaggaccuggaagcucuccuggccaucauuggagaugaguacgcugagcuuuuugucgccgccaagaacacguauaaugcuguugugcugagcucuaucaucacagugaccgacacagaaaccaacgcgaaacucuccgccagcaugauugagcgcuucgaugcucacgaaaaggaccugucugagcuuaaagccuuuaucaagcugcaucuccccaaacaauacgaagagauuuucuccaaugucgccaucgauggcuaugcuggguacauugacggaaagaccaaacagguggauuuuuacaaauaucugaagacacugcucgagaacaucgaaggcgccgacuacuucaucgcgaaaauugaggaagagaauuuucugcggaagcagagaacguucgauaacggcgcuaucccucaccagcuucaccuggaggaacucgaggccauucugcaucaacaggccaaauauuaccccuuucuuaaggaggcuuaugacaagaucaaaagccugguuaccuuccgcauuccuuacuuuguggggccccucgccaauggacaguccgauuucgcuuggcugacacggaaggccgacggcgaaaucagaccuuggaacauugaagagaaagucgacuuugggaagucugcgguggauuucaucgagaaaaugaccaauaaggacacauaucugccgaaggaaaacguucuccccaaacacagccuguacuaccaaaaguauaugguguacaaugagcuuaccaaaguccgcuauaucgaugaccagggaaagacgaacuacuucuccggccaggaaaaacagcaaauuuuuaaugauuauuucaagcagaaacggaaggugagcaagaaagaccuggagcaguuucucagaaacaugucucauaucgaauccccuacaauugaggggcuggaggauagcuucaacucuagcuacgccaccuaucacgaccugcuuaaggucggaaucaaacaggaagugcucgagaauccccugaacauggaaaugcuggaggauauuguuaagauccucaccguguuugaagacaaacgcaugaucaaggagcaacugcagcaguucuccggcguccuugauggcgcugugcugaagaaacucgagcggagacacuacacaggguggggacgccugucugccaagcugcuuguuggcauucgggacaaacagagccaucucaccauccuggauuaccugaugaaugacgacgggcucaacagaaaucugaugcaacuuauuaacgauuccaaucugagcuuuaagucuaucauugaaaaagaacagguguccacaacggacaaggaucuccagagcaucgucgcugaccuggccggaucuccugcgaucaagaaaggcauucugcagucccuuaagaucguggaugaacucgugagcauuaugggguaucccccgcaaaccaucguugucgagauggcccgggagaaccagacaaccgugaaaggcaagaauaacucccgcccuagauacaaaucucuggaaaaggcuauuaaggaguucggaagccagauccugaaagaacaccccacagacaaucaagagcuccggaacaauagacuguaucuuuacuaucugcagaacggcaaggauauguacaccgggcaggaacucgacauccauaaucuguccaacuaugauauugaccacaucgugccucagucuuuuauuacggauaacagcaucgacaaucugguccuuaccuccagcgccggaaaccgcgagaaaggcgaugacgugccuccccucgagauuguucggaagagaaaaguguucugggaaaagcuguuucaagggaaucugaugucuaaacgcaaguucgacuaccucacaaaggcugagagaggaggccugaccgaagccgauaaagccacauuuauccaucggcagcuugucgagacccgccagauuacgaagaacguggcuaauauccugcaccagagauucaacaaugaaacagacaaccacgggaauaacauggagcaaguucggaucgugaugcucaaauccgcgcuggucagccaguuccgcaagcaguuucagcuguacaaagugagagagguuaaugauuaucaucacgcccaugacgcuuaccuuaacggcguggucgccaauacccugcucaagguguauccccaacuggaaccggaguucguguacggagaauaucaccaguuugauugguucaaggccaacaaagcuacagccaagaaacaguuuuacaccaauauuaugcuguucuuugcgcaaaaggagcggaucauugacgaaaacggcgagauccucugggauaaaaaguaucuugagaccauuaagaaaguccuggacuaccgccagaugaacaucguuaagaaaacagaaauccagaagggggaguucucuaaagcuacgauuaagcccaagggaaauuccagcaaacucaucccuagaaaggaaaacugggaucccaugaaauacggcgggcuggacucuccuaauauggccuaugccgugauuaucgagcacgcuaaggggaaaaagaagauuguguuugagaaaaagaucauccggauuaccaucauggaacgcaaagccuucgagaaggaugaaaagagcuuucuggagaagcagggcuacagacaacccaaaguccuuacaaagcugccgaaguauacccucuacgaaugcgagaacgggcggagacgcaugcuggcguccgcuaaugaggcccagaaaggcaaccaacaggugcucaagggacagcugauuacacuucugcaucacgccaaaaauugugaagcuagcgacggcaagucucucgacuauaucgaguccaaccgggaaauguucggggagcugcuggcccauguuagcgaguucgcuaaaagauacacccuugccgaugcgaaucuguccaagauuaaccagcucuuugaacagaauaaggacaacgauaucaaagugauugcccagucuuucgucaaucugauggcuuuuaacgccaugggagcuccugccagcuucaaguuuuucgaggccacgaucgaacgcaaacgguauacaaaucucaaggagcugcuuagagcuaccaucauuuaccaauccaucaccggccuguacgaagcgcgcaaacggcuggacggguga

SEQ ID NO: 4119 - RNA, 4005 nt, Artificial Sequence
  Cas9 variant
augaagaaccccuacaccaucggccuggacauugggacaaauagcgugggaugggccguccucacggaucaguaugaccugguuaaaagaaagaugaaaguggcuggcaacuccgauaagaaacaaaucaagaagaauuucuggggagugcggcuuuuugacgagggagaaaccgccgcggaucgcagaaugaaccggacagcucgcagacggauugagcgcagacggaaucgcaucucuuaccugcaggaaauuuucgcccucgagauggccaacaucgacgcuaacuuuuucugcagacugaaugauagcuuuuaugucgacuccgaaaaacgcaauucucggcacccuuucuuugccaccaucgaggaggaaguggcuuaccauaagaacuauagaacaauuuaccaccuucgggaggaacugguuaauagcuccgagaaagccgaucuccgccugguguaucuggcgcucgcccauaucauuaaguacagaggcaacuuccugaucgagggggcucuugacaccaaaaauacaucugucgauggaguguacaagcaguuuauucagaccuauaaccaaguuuucaucagcaauauugaagagggcacgcuggccaagauggaagagaacaccacaguggcugacauccucgccggcaaauuuacccggaaggaaaaacuggagagaauccuucagcuguacccgggggagaaguccacaggaauguucgcgcaguuuauuagccucaucgucggcucuaaagggaacuuccagaagguguucgaucugguggagaaaaccgacauugagugugccaaggacuccuaugaagaggaucuggaagcucuccuggccaucauuggagacgaguacgcugagcuuuuugucgccgccaagaauacguauaacgcuguugugcugagcucuaucaucacagugaccgauacagaaaccaaugcgaaacucuccgccagcaugauugagcgcuucgacgcucacgaaaaggaucugucugagcuuaaagccuuuaucaagcugcaucuccccaaacaauacgaagagauuuucuccaacgucgccaucgacggcuaugcuggguacauugauggaaagaccaaacagguggacuuuuacaaauaucugaagacacugcucgagaauaucgaaggcgccgauuacuucaucgcgaaaauugaggaagagaacuuucugcggaagcagagaacguucgacaauggcgcuaucccucaccagcuucaccuggaggaacucgaggccauucugcaucaacaggccaaauauuaccccuuucuuaaggaggcuuaugauaagaucaaaagccugguuaccuuccgcauuccuuacuuuguggggccccucgccaacggacaguccgacuucgcuuggcugacacggaaggccgacggcgaaaucagaccuuggaauauugaagagaaagucgauuuugggaagucugcgguggacuucaucgagaaaaugaccaacaaggauacauaucugccgaaggaaaauguucuccccaaacacagccuguacuaccaaaaguauaugguguacaacgagcuuaccaaaguccgcuauaucgacgaucagggaaagacgaauuacuucuccggccaggaaaaacagcaaauuuuuaacgacuauuucaagcagaaacggaaggugagcaagaaagaucuggagcaguuucucagaaauaugucucauaucgaauccccuacaauugaggggcuggaggacagcuucaacucuagcuacgccaccuaucacgaucugcuuaaggucggaaucaaacaggaagugcucgagaacccccugaauaccgaaaugcuggaggacauuguuaagauccucacaguguuugaagauaaacgcaugaucaaggagcaacugcagcaguucuccgacguccuugauggcgcugugcugaagaaacucgagcggagacacuacaccggcugggggcgccugucugccaagcugcuuguugggauucgggacaaacagagccaucucacaauccuggacuaccugaugaacgaugacggccucaauagaaaccugaugcaacuuauuaaugauuccaaccugagcuuuaagucuaucauugaaaaagaacagguguccacgaccgacaaggaucuccagagcaucgucgcugaccuggccgggucuccugcgaucaagaaaggcauucugcagucccuuaagaucguggaugaacucgugagcauuaugggauaucccccgcaaacaaucguugucgagauggcccgggagaaucagaccacagugaaagggaagaacaauucccgcccuagauacaaaucucuggaaaaggcuauuaaggaguucggcagccagauccugaaagaacaccccaccgacaaccaagagcuccggaauaacagacuguaucuuuacuaucugcagaauggaaaggauauguacacgggccaggaacucgacauccauaaccuguccaauuaugauauugaccacaucgugccucagucuuuuauuaccgauaacagcaucgacaaccugguccuuacauccagcgccgggaaucgcgagaaaggagacgaugugccuccccucgagauuguucggaagagaaaaguguucugggaaaagcuguuucaaggcaaccugaugucuaaacgcaaguucgacuaccucaccaaggcugagagagggggacugacagaagccgauaaagccaccuuuauccaucggcagcuugucgagacgcgccagauuacaaagaauguggcuaacauccugcaccagagauucaauaacgaaaccgacaaucacggcaacaauauggagcaaguucggaucgugaugcucaaauccgcgcuggucagccaguuccgcaagcaguuucagcuguacaaagugagagagguuaacgauuaucaucacgcccaugacgcuuaccuuaaugggguggucgccaacacacugcucaagguguauccccaacuggaaccggaguucguguacggcgaauaucaccaguuugauugguucaaggccaauaaagcuaccgccaagaaacaguuuuacaccaacauuaugcuguucuuugcgcaaaaggagcggaucauugacgaaaauggagagauccucugggauaaaaaguaucuugagacaauuaagaaaguccuggacuaccgccagaugaacaucguuaagaaaacggaaauccagaagggcgaguucucuaaagcuaccauuaagcccaaggggaacuccagcaaacucaucccuagaaaggaaaauugggaucccaugaaauacggaggccuggacucuccuaacauggccuaugccgugauuaucgagcacgcuaaggggaaaaagaagguggucuuugagaaaaagauuauccggaucacaauuauggaacgcaaagccuucgagaaggacgaaaagagcuuucuggagaagcagggauacagacaacccaaagugcuuaccaagcugccgaaguauacacucuacgaaugcgagaauggccggagacgcaugcuggcguccgcuaacgaggcccagaaagggaaucagcagguucucaagggccaacugaucacccuucugcaucacgccaaaaacugugaagcuagcgauggaaagucucucgacuauauugaguccaaucgggaaauguucggcgagcugcuggcccaugugagcgaguucgcuaaaagauacacgcuugccgaugcgaaccuguccaagaucaaucagcucuuugaacagaacaaggacaaugauauuaaagucaucgcccagucuuucgugaaccugauggcuuuuaaugccaugggggcuccugccagcuucaaguuuuucgaggccacaauugaacgcaaacgguauaccaaccucaaggagcugcuuuccgcuaccaucaucuaccaaucuauuacaggacuguacgaagcgagaaaacgccuggacggcuga

SEQ ID NO: 4120 - RNA, 4005 nt, Artificial Sequence
  Cas9 variant
augaagaaccccuacaccaucggccuggacauugggacaaauagcgugggaugggccguccucacgaaccaguaugaucugguuaaaagaaagaugaaaguggcuggcaauuccgacaagaaacaaaucaagaagaacuucuggggagugcggcuuuuugaugacggacagaccgccgucgaucgcagaaugaaucggacagcgcgcagacggauugagcgcagacggaaccgcaucucuuaccugcaggaaauuuucgcuguggagauggccaauaucgacgccaacuuuuucugcagacucaaugauagcuuuuauguugacuccgaaaaacggaacucucgccacccuuucuuugcuaccaucgaggaagagguggccuaccaugauaauuauagaacaauuuaccaucugcgggaggaacuugucaacagcuccgagaaggcugaccugcgccucguguaucuggcccuggcgcacaucauuaaauacagaggcaauuuccucaucgaaggggcccuggauaccaagaacacaucuguugacgagguguacaaacaguuuauucaaaccuauaaucaggucuucaugagcaacaucgaggaaggagcucuugccaagguggaggaaaaccuggagguggcuuccauucucgccggcaaguuuacgcggagagaaaaauucgagcgcauccugcggcuuuacccgggcgaaaagagcaccgggauguuugcgcaguucaucucucugauugucggaaauaaaggcaacuuccagaagguuuuuaaucucguggaaaagacagauaucgagugugccaaggacuccuaugaagaggaccuggaagcucugcucgccauuaucggggaugaguacgcugagcuguucguggccgccaaaaacaccuauaaugcugucgugcuuagcucuauuaucacaguuaccgcgacggaaacaaacgccaagcuguccgcuagcaugaucgagagauuugacgcccacgaaaaggaucucggagagcugaaagccuucauuaaacuucaucugcccaaacaauaccaggaaaucuuuaauaacgcugccauugacggcuaugcgggguacaucgauggaaagaccaaacagguggacuucuacaaguaucucaagacaacccuggagaaugucgagggcgcugauuacuuuauuaccaaaaucgaagaggaaaacuuccugcgcaagcagcggacauuugacaauggcgugaucccucaccaacuccaccuggaggagcuugaagccauucugcaucagcaggccaaauauuaccccuuccucagagaggauuaugaaaagaucaaaucucugguuacguuucgcauuccuuacuucguggggccccuugcuaagggacaauccgaguuugccuggcugacccggaaggcugacggcgaaaucagaccuuggaacauugaggagaaagucgauuucggaaagagcgccguggacuucaucgagaaaaugacaaauaaggacaccuaucucccgaaagagaacguccugcccaagcacucccugugcuaccagaaguacaugguguauaaugaacucacaaaaguucgcuacauugaugaccaggggaagaccaacuauuuuucuggccaggagaaacaacagaucuucaacgaucuguuuaagcagaaacggaaggugaaaaagaaggaccuugaacuguuccucagaaauaucaaccauauugagagcccuacgaucgaggggcuggaagauuccuuuaaugcgagcuacgccacauaucacgaccugcuuaaagucggaaugaagcaggagucucucgauagcccccugaacgcugaaaugcuggaggacauugugaaaauccucaccguuuucgaagauaagcgcaugauuaaagagcaacugcagcaguuuuccgacgugcuugauggcgucgugcugaagaagcucgagcggagacacuacaccggcugggggcggcugucugccaaacugcuugugggaauccgcgacaagcagagccaucucacaauccuggauuaucugaugaaugacgacggccucaacagaaaucugaugcaacuuauuaacgauuccaaucugucuuucaaaagcaucauugaaaaggagcagguuuccaccacagacaaagaucuccagagcaucgucgcugaccuggccgggucuccugcgauuaagaagggaauccugcagucccuuaaaaucguggaugaacucgugagcauuaugggcuaucccccgcaaacgaucgucguggagauggcccgggagaaccagaccacaguuaaggggaaaaauaacucuagaccucgcuacaagucccuggaaaaagcuauuaaggaguuuggcagccagauccugaaggaacaccccaccgacaaucaagagcucaaaaacaaucggcuguaccuuuacuaucugcagaacggaaaggauauuuacacaggccaggaacucgacauccauaaccuguccaauuaugauaucgaccacauugugccucagucuuucaucaccgauaacagcauugacaaucugguccuuacguccucugccgggaacagagagaaaggaggcgaugugccuccccucgagaucguucgcaagagaaaaguguuuugggaaaagcuguaccaagggaaucugaugagcaaacggaaguucgacuaucucaccaaggcugagcgcggaggccugacagacgccgauaaagccagauuuauucaucggcagcuugucgaaacccgccagaucacaaagaacgugaccaauauucugcaccagagauucaacaaugagacggacaacuacgggaauacaauggaacaaguucggaucgugacccucaaauccgcucuggucagccaguuccgcaagcaguuucagcuguacaaagugagagaggugaacgauuaucaccaugcgcacgacgccuaccuuaauggcgucguugcuaacacacugcucaagguguauccccaacuggagccggaguucguguacggagaauaucaucaguuugauugguucaaggccaauaaagccaccgcuaagaaacaguuuuacaccaacaucaugcuguucuuugcccaaaaggaacggauuaucgacgagaacggcgaaauucucugggauaaaaaguaucuugagacaaucaagaaaguccuggacuaccgccagaugaauauugugaagaaaacggagauccagaagggggaguucucuaaagcgaccaucaagcccaagggaaacuccagcaaacucauuccuagaaaggaaaauugggaucccaugaaauacggcgggcuggacucuccuaacauggcuuaugccguuaucauugaacacgccaaggggaaaaagaagaucgugauugagaaaaagcugauccagaucaauauuauggagcggaaaauguuugaaaaggaugaggaggcuuuccuugaagaaaaaggcuacagacaccccaagguccugacaaaacucccgaaguauacccuguacgagugugagaaggggcgccggagaaugcucgccuccgcgaacgaagcucaaaaaggcaaucagcuggugcuuagcaaccaucugguuucucuccuguaucacgccaagaauugcgaggccagcgacggaaaaucccugaaguacaucgaagcucaucgcgaggccuuuagcgaacuucuggcucaggugucugaguucgccacacgguauacccucgcggacgccaaccuguccaaaauuaauaaccucuucgagcagaauaaggaaggcgauaucaaggcuauugcccagagcuuugucgaccugaugguguucaacgcuaugggggccccugccuccuuuaaauucuuugaggcuacgaucgauagaaagcgcuacacaaaucuuaaagaacugcugucuagcaccauuaucuaccaauccaucaccggacucuaugagucucggaagagacuggacgauuga

SEQ ID NO: 4121 - RNA, 4005 nt, Artificial Sequence
  Cas9 variant
augaagaaagaguacaccaucggccuggacauugggacaaacagcgugggaugggccguccucacggaaaauuaugaucugguuaagaaaaagaugaaaguguacggcaacaccgagacaaaguaucuuaagaaaaaucuguggggagugagacucuucgacgaaggggagaccgcugccgaucggcgccugaagagaacaacccggcgcagauacucccggcgcagaaaccggaucugccgccuucaggaccuguuuacagaagagaugaaucaagucgaugcgaacuucuuucacagacuccaggagucuuuccuggugcccgacgaaaaagaguuugaacggcaugcuauuuucggcaagauggaggaggaaguuagcuauuaccgcgaguuuccuaccaucuaucaccugagaaaacaucucgccgauacguccgaacaggccgaccugcggcuuguguaccuggcucucgcccacauugucaaguaccgcgggcauuuccugaucgagggagaacuuaauaccgagaacucuagcguguccgagacauuuagaaccuucauccagguuuauaaucaaauuuuucgggaaaacgaggugccgcuggcuguccccgauaauaucgaagaacucuucucugaaaaggugagcagagcccgcaaaguggaggcgauucuguccgucuacagcgaggaaaagucuacaggcacccuggcccaguuucucaaacugaugguuggcaaccaggggcgguucaagaaaacguucgaccuugaggaagauggaaucauucagaucccuaaggaggaauaugaggaggaacuggagacacuccuggcuauuaucggcgacgaauacgccgagaucuuuuccgcuaccaaaagcguguaugaugccguggcgcuuucugggauucuguccgucacagacggagacaccaaggccaagcucagcgcuucuaugguggagagauacgaagcccaccaaaaagaucugguucaguucaagcaguuuauccgcaaagagcugcccgaaauguaugcuccuauuuuccgggacaauuccgugagcggcuacgccggguacgucgagaacuccaaggugguuacccaggccgaauuuuauaaauacaucaagaaggcuauugagaaagugcccggagcggaguauuuccucgaaaagaucgagcaagaaacauuucuggauaaacagagaacguucaauaacggcgucaucccucaccagauucaucuugaggaacuggaggccaucauucaaaagcaggcuaccuacuauccguuucucgccgacaacaaagaggaaaugaagcagcuggugacauuccgcauccccuacuaugucggcccucuugccgauggaaauucucccuuugcuuggcuggagcggauuagcuccgaaccuaucagacccgggaaccucgccgaggugguugacaucaagaaaagcgcgaccaaguucauugaacgcaugacaaauuuugauaccuaccugccgacggagaaagugcugccuaagcacucuaugaucuacgagaaauauauggucuacaacgaacucacaaagguguccuauguugacgagcggggcaugaaucagagauucagcggggaagagaagaaacaaauuguggaggaacuguucaagcagucucgcaaagucaccaagaaacuucuggagaaguuucucagcaacgaguucggacugguggauguggcuaucaaaggcauugagaccuccuuuaaugccggguacggaacauaucaugacuuccugaagaucggcauuacccgggaacagcuugauaaggaggagaacucugaaacacucgaggaaaucguuaaaauccugacggucuuugaggacagaaagaugauucgggaacagcugaaaaaguacaccuaucucuucgacgaggaggugcugaaaaagcuggaacgcagacacuacacaggcugggggcggcuuagcgccaagcuccugaucggaauuaaagagaagagaacccacaaaacaauccuggauuaccuuauugaagacgauggcgggaagcaacccaucaaucgcaaccucaugcagcugaucaaugacuccgaucugagcuuuaaaucugagauugcugaagcccaguccgacaugaacaccgaggaucuccaugaggugguccagaaucuggcuggaagcccugccaucaagaagggcauucuucaaucucugaaaaucguggacgaacucguugauauuauggggucccugcccaagaacaucguggucgagauggcgcgggaaaaucagacgaccagcagaggccgcacaaacuccaaccccagaaugaaagcccuggaggaggcuaugcggaaucuucgcucuaaccuccugaaggaauauccuaccgacaaucaggcccugcagaacgauagacucuaccuguauuaccuucaaaauggaaaagacauguauacaggccuggaucucagccugcacaaccuguccucuuacgacaucgaccauauugugccgcagagcuucaccacggauaauucccuugacaaccggguucucgugagcucuaaggagaaucgcgggaagaaagaugacguccccuccaaggaagugguucagaaaaacaucacacugugggagacccugaagaauagcaaccucauuucucaaaagaaguaugauaaucugacaaaaggacuuagaggcgggcugaccgaagacgaucgggcucacuuuaucaagcgccagcucguggagaccagacagauuacaaagcaugucgcccggauccuggaccagcgcuucaacucccaaaaagaugaggaaggaaagacgaucagagcggugcggguggucacccugaaaagcucucuuacaagccaguuuagaaagcaguucgccauucacaaaguucgcgagaucaaugacuaccaccauggccacgaugcuuaccugaacggggugguggccaacucccuccugcgggucuauccucagcuccaacccgaauuuguguacggcgacuauccuaaguucaaugcuuacaaggccaacaaagccaccgcuaagaaacagcuguauacaaauauuaugaaguucuuugcggaggaugccguuaucauugacgaaaacggagagauccuuugggacaaaaagaauauugcuaccgugaagaaagucaugagcuacccccagaugaacaucgugaagaaaccggagauccagacgggcucuuucuccaaggaaacaauuaaaccuaagggggauagcgacaagcugaucuccagaaaaaccaauuggucucccaagcucuauggaggcuuugauagcccucaaguugccuacuccgugauuaucaccuacgagaaagggaagaaaaagguccgcgccaaggcuauugugggaaucacaaucauggaacagucucuguucaaaaaggaccccguuagccugcuugaggaaaaaggcuaugccaacccugaggugcugauucaucuccccaaguacacccuguaugagcucgaaaaugggcggagacgccugcuugcguccgcuaacgaggcccagaaaggcaaucaacugguccucccggccucucuggugacacugcuuuaccacgcuaaacagguggaugaagacagcggaaaauccgaggaguauguccgggaacacagagccgaguuugcggaaauccugaacuacguucaggcuuucagcgagacgaagauucucgccaauaagaaccugcagaccauccucaaacuguaugaagagaauaaggaggccgauauuaaagaaaucgcugagucuuuugugaaccuuaugaaguucuccgccuacggcgcuccuauggacuuuaaauucuuugggaagacaaucccccgcagccgguacaccucugugggagaacugcuguccgccacaauuaucaaccaaagcauuaccggccucuaugagacgagacggaagcuggucgauuga

SEQ ID NO: 4122 - RNA, 4005 nt, Artificial Sequence
  Cas9 variant
augagaaagcccuacaccaucggccuggacauugggacaaacagcgugggaugggccguccucacggaucaguauaaucugguuaaacggaagaugaaaguggcuggcuccgccgagaagaaacaaaucaagaagaacuucuggggagugcgccuuuuugacgaaggagaggucgcggcuggcagacggaugaaucgcaccacaagacggcgcauugaaagacggcgcaacagaaucgccuaccugcaggagauuuucgccgcugaaauggccgagguggaugcuaauuucuucuaucggcucgaggacucuuuuuacaucgaaagcgagaaacgccacuccagacauccuuucuuugccaccaucgaagaggagguugcguaucacgaagaguacaagacaauuuaucaucugcgggaaaaacuugugaacucuagcgauaaggccgaccugcgccucgucuaccuggcucuggcccacaucauuaaauacagagggaauuuccucaucgagggaaugcuggauaccaagaacacauccguggacgaaguuuuuaagcaguucauucagaccuauaaucaaaucuuugcuucugauauugaggagggcagccuuacgcggcuggaagagaacaaagaaguggccgagauccucuccgaaaagcugaccagacgcgagaaacuugacaagauccugaaacucuacacaggcgaaaagagcaccgggauguucgcgcgguuuauuaaucugaucauuggaucuaaaggcgauuucaagaaggucuucgaccuggaugaaaaagccgagaucgaaugcgcuaaggacacauaugaggaagaccucgaggcccugcuugcuaaaauuggggaugaguacgccgaaaucuuuguggccgcuaaguccaccuauaacgcggugguccugagcaauaucauuacgguuacagacaccgagacaaaagccaagcucucugcuuccaugaucgaaagauucgauaagcaugccaaagaccugaagcgccuuaaagccuuuuucaagaugcagcugccggagaaauuuaacgagguguucaaugauauugaaaaggacggauacgcuggcuauaucgaugggaagaccacccaggagaaauuuuacaaguacaugaaaaagaugcucgccaacauugacggagcggauuauuucaucgaccagaucgaagaggaaaacuuucugcggaaacaaagaacauucgauaauggcacgauuccccaccagcugcaccucgaggagcuggaagcuauccuucaucagcaggccaaguacuauccuuuucugcgcaaggacuacgagaaaauucggagccucgugaccuucagaauccccuauuuuauuggcccucuggccaacgggcaaucugacuucgcuuggcuuacacgcaaggccgauggagaaauccggcccuggaauauugaggaaaaagucgacuucggcaaguccgcuaucgauuuuaucgagaaaaugaccaacaaggacacauaccugccuaaagagaaugugcucccgaagcacagccuguguuaucagaaguacaugguuuacaacgaacugaccaaaauuagauauaucgaugaccaggggaagacgcaucacuucuccggacaagagaaacagcagauuuuuaauggccucuucaagcagcaacgcaaagugaagaagaaagaucuggaacgguuucuuuacacaaucaaccacauugagucucccaccaucgaaggggucgaggacgccuucaauagcuccuuugcgaccuaucaugaucugcagaagggaggcgugacacaggagauccucgacaacccucugaaugccgauaugcuggaagagauuguuaaaauccuuaccguguucgaagacaagagaaugauuaaagagcagcuccagagcuuuucugauguccuggacggcacaauccugaagaagcucgagcggcgccacuacacgggguggggaagacuguccgcuaaacuucugaccggcauucgggacaagcauagccaccucacaauccuggauuaucugaugaacgacgaugggcuuaauagaaaccucaugcaacugaucaaugacucuaaccugagcuucaaauccauuaucgaaaaggaacaggugucuaccgccgauaaagggauucagagcaucgucgcugaacucgccggcucccccgcgauuaagaaggggauccugcaaagccuuaaaaucguggacgagcugguuggcauuaugggauacccuccccagacaaucguggucgaaauggcccgcgagaaccagaccacgggcaaggggaaaaauaacucuaagccgcgguuuauuucccucgagaaagcuaucaaggaauuuggaagccagauucugaaagagcauccuaccgauaaucaaugccugaagaacgacagacuuuaucucuacuaccugcagaauggcaaggauauguauacagggaaagaacuggacauccacaaccucucuaauuacgauauugaccacaucaucccccaguccuuuauuaccgauaacagcaucgacaaucgcgugcugguuuccucuacagccaacagagagaagggagacaaugugccucuucuggaagucgugcggaaacgcaaggcuuucugggagaaacucuaucaagccaagcugaugagcaagagaaaauucgauuaccugaccaaggccgagcggggcgggcuuacggaagcugacaaagcgaacuuuauucagcgccagcucguggagacaagacagaucaccaagaauguugccaacauucuguaucaacgguucaauuguaaacaggaugaaaacggcaacgaggucgaacaggugcgcaucgugacacugaaguccacccucgucucucaguuuagaaagcaauuccagcuguacaaagugcgggagguuaaugacuaucaucacgcucaugaugccuaccuuaacggaguggucgccaauacccugcucaagguguacccccagcuggagcccgaauuuguuuauggcgacuaccaccaguucgauugguuuaaagcuaacaaggccacagcgaaaaagcaauucuauacgaauaucaugcgcuuuuucgcuaaggagaaccagauuaucgacaaaaauggggaaauucugugggauaacagauaccuugacaccaucaagaaagugcugagcuaucggcagaugaauauugucaagaaaacagagauccaaaagggagaguuuuccaacgccaccgugaauccuaagggcaacagcucuaaacucaucuccagaaaggccgauuggaauccgauuaaauacgggggauucgacggcagcaacauggcuuauucuaucguuauugaauacgagaagcgcaaaaagaaaacagugaucaagaaggaacugauucagaucaauauuauggagcgggucgccuucgaaaaagaccagaaggcguuucucgaggagaaaggguacuauucccccaaggugcugaccaaaaucccuaaguacacgcuuuaugaaugcgagaacggcagacgccggaugcugggaagcgcuaacgaagcccagaagggcaaucaaauggugcuccccaaccaccugaugacacugcuuuaccaugccaaaaauugugaggcuaacgauggggaaucucuggccuauaucgagaugcacagagagauguucgcugaacuccuggccuacauuagcgaguuugcgaagcgcuauacccucgccaaugaccggcuggagaaaaucaacauguucuuugagcagaauaagaaaggagauauuaaggucaucgcuaaguccuucgacaaacuuaagguuuuuaacgccuucggcgcuccuagagauuuugaguucuuugagaccacaauuaaacgcaagcgguacuacaauaucaaagagcugcucaacgccaccaucauuuaucagagcaucacagggcuguacgaagccagaaagcggcuggaggacuga

SEQ ID NO: 4123 - RNA, 4008 nt, Artificial Sequence
  Cas9 variant
augaagaacuacaccaucggccuggacauugggacaaauagcgugggaugggccgucaucaaagaugaccucacgcugguuagaaagaaaauuaagaucuccggcaacaccgauaaaaaggaggugaagaaaaaucuuugggggucuuuccuguuugaacagggagacacagcucaagauacccgggugaagcgcauugccagacggcgcuaugagagacggcgcuucagaauccgggaacuccagaaaaucuuugacaagagcaugggcgaggucgauuccaacuucuuucaccgccuggacgaaucuuuccuuguggaggaggauaaagaauacagcaaguaucccauuuuuagcaaugagaaggaagacaaaaacuacuaugauaaguacccuacaaucuaucaucugagaaaagaccucgcggauucuaaucagaaggcugaccugcggcugauuuaccucgcccuggcccacaugaucaaauaccgcgggcauuuccuuauugagggagaccugaagauggauggcaucagcauuuccgagagcuuucaggaguucaucgacucuuauaacgaaguuugcgcucucgaagaugagaaucuggaaaucauuuacaacgacgagcuucugacccaaaucgagaauauuuuuaaacaggauaucuccagaagcaagaagcucgaccaggccauugcucuguuccagggcgugaaacggcaaucucuguuugggaucuuccucacacugaucgucggaaacaaggccaauuuccagaaaauuuuuaaccuugaagaugacaucaagcuggaucucaaagaggaagacuaugaugagaaucuggaggaacuucuguccaacauugacgagggcuaccgcgacguguuccuccaggcgaagaacguuuauaaugccaucgaacugagcaagauucugaaaaccgaugggaaggagacgaaagcuccgcucucugcccagaugguggaacuguacaaccaacacagagaggaccuuaagaaauauaaggauuacaucaaggcuuaccugcccgaaaaauauggagagaccuuuaaggacgccaccaaaaauggcuacgcgggguauaucgauggaaagacaucccaggaggacuucuacaaauuugucaaggcccagcucaagggcgaagagaacggcgaauauuuccuggaggcuauugagaaugaaaacuuucuucggaaacaaagauccuucuacaauggggugaucccuuaucagauucaucugcaggagcucacagccgugcuggaucagcaagaaaagcacuacuccuuucugaaagagaaccgcgacaagaucauuucucuccugaccuuccggauccccuacuaugucggaccucuugcuaaaggcgaaagcagauuugccuggcuggagcgcuccaauagcgaggaaaagauuaaacccuggaacuucgauaagaucguugacaucgauaagucugccgagcucuuuauugaaaaucugacgucccgggacacauaccugccugaugagccggugcuucccaaaagaagccucaucuaucagaaguucaccauuuucaacgaacugacaaaaaucucuuacauugacgagcgcgggauccugcagaauuuuagcucccgggagaagaucgcuauuuucaacgaccucuuuaaaaauaagucuaaggugaccaaaaaccagcuggucaaguauaucgaaaacaaagagcaaauuaucgcgccugaaauuaagggaaucgaggauagcuucaauuccaacuacagcaccuauaucgaccuuucuaaaauucccgauaugaagaagcugcucgaaaaagacgaggaugagauccuggaagagauuaucaagauucugacaaucuuugaagacagaaaaaugcgcaagcggcagcuuaugaaauucaaggauaagcucuccgagaaagccaucaaucagcugagcaagaaacacuacacgggcugggggcagcugucugagaagcucauuaacggaaucagagacgaacaauccaauaaaaccauucuggauuaccuuaucgaggacaacggcuguccuaagaauaugaaccgcaauuuuaugcagcugauuaacgaugacacacucagcuucaaagaaaagauccggaaggcucaggauauuaaucaggugaacgacaucaaagagaucguuaaggaccugcccggcuccccggccauuaaaaaggggaucuaucaaucuauuagaaucguggaugaaauuauccggaaaaugaaggaccgcccuaagaauaucgucauugagauggccagagagaaccagaccacacaggaaggcaaaaauaagagcaaagcucggcugaagaaaauccaagagggacuugaaaaccucgauuccgugcauguugagaagcaggcccuggacgaagagaugcugaagucucccaaauacuaucucuacugccugcagaacgggaaggauauuuauaccggaaaagaccuugauaucggccagcugcaaacguacgacauugaucacaucaucccucgcagcuuuauuacagacaauuccuucgauaaccucgugcugaccagcucuaccgucaauagagggaagcuggacaacgugcccucccccgacaucguccggcagcagaaaggcuuuuggaagcagcuucucagagcgggacugaugagccaacgcaaguucaauaaccugacaaaaggcaagcucaccgauagagaccggcagcaguuuauuaaucgccagcugguggagacaagacaaaucacgaaacauguugcuaaccuucugucucaccaccucaaugaaaagaaagaggugggggaaauuaacaucguccugcugaaguccgcccuuaccagccaguuccggaagaaauucgauuuuuauaaggugcgcgagguuaaugacuaccaucacgcccaugaugcuuaccugaacggagugauugcccucaaacugcucgaacuguauccuuacauggcuaaggaccuuaucuauggcaaauacucuuaucacagaaagaucgagggggauaaagccacacaggcgaaguacaagaugagcaauauuaucgagcgguucucccaagaccugcucgccaacccggauggagaaauugcuugggagaaagacaaggaucugaauaccauccgcaaaguccugagcucuaagcagauuaacaucaucaaaaaggccgaagagggcaaggggagacuuuuuaaagagacaauuaacucccggcccagcaagaaaaccgaaaagcgcaucccuauuaaaaauaaccuggaccccaauaucuauggcggauacauugaggaaaagauggcuuacuauaucgccaucaacuaccucgagaauggcaagacgaaaaaggcgauuguggggaucuccauuaaagauaagaaagacuucgaaggacagaccacagaguaucugggcaagaucggguuuaacaaggccucuauuaucaauagcuucaaaaacuacacccucuuugagcuggaaaauggauccagacggaugauugugggcgcuucuaaggagaacgacagcaaaggggaacuucagaagggcaaucaaauguaucugccucagaaccuccuggaguucguuuaccaucugaaacacuauaaugaagaugagacaucccacaaguuuaucgucgagcauaaagccuacuucgacgaacuucugaacuacaucguggaguuugcuaauaaguaucucgaacuggagaacucuauugaaaagaucaaagaucucuaccacggaaagggccccgacguggaggagaaagaacuggucgagagcuucauuaaucuucuggccaucaccaagugugggccggccgcugauauuacguuccugggagagaaaaucuccagaaagcgcuaucggagcacaaacugccucuggggcucugaagugaucuuucaguccccuaccgggcuguacgagacaagacuucgccuggaauga

SEQ ID NO: 4124 - RNA, 4011 nt, Artificial Sequence
  Cas9 variant
auggacgauaacuaccagcugaugcacgccaagggcaaauauggguacggaaccagaaucuauagcgagggccaaacagcugccgaccggcgcggguucagaacgacccggcgcagacucaaucggcgcaaguggagacugcggcuucugcaggacuuuuucgaacccuacauucucccucaggaugaggcguuuuucauccgccagaaacaauccaaccuggugccgcaggauacaaagaaacaguaucccgaaucuguccuuuuugacgauaccagcgacaaggauuucuacacagaguauccuaccauuuaccaucugagacaggcucucaugacagaaaaucggcaauuugacauccgcgagguuuaccuggccauucaccauaucgugaaguauagaggacacuuccugaacaaugcccccgugaaaaccuuuaaguccggcaaccucgaucuggcuaucaaauucaaugagcuuaacgaagaguuuaagucugucuacccugaccuggaacuccaguucaaucuggaucagauugacgagaucaaaaagauucuucuggacagcacgaagucccgguuugaucgccagggggaggccgugaaacucaucuauaccguuucugaagugaagacaauugagaaacugcaaaacaagaucgucaaacaguuccugagcggcauucucggacugaauaccagauucgacgugcuuacaaacaccgaauccgaugacagcauguggaaguuuucucuggauuccgagagcucugacgaugcucucgacgaaaucaucgcccagcuggaugaccccgcgauucauguuguggagcuugucaaugagauccacuccagcauuacgcuggccggcaucgugccugaagggcaaggacucucugaguccaugguggaaaaauacgaggcucacaaggcccaucugcagcugcucaaggcugucgaaaaacugguugauaagaaagccgcggacaaacuugagguggccuaugaccaguacauuaacggcaaagauagcaagcaguucaucaaggaggacuuuuauaaagcugugcaauccgaaaucaagggggucgccggagaugagguggcugaaauuaaucagcugaucgagcucgaccaguucaugccgaaacagcggacaaaggaaaacggcgccauuccccaccaacugcaucagcacgagcuugauguuaucauugagaaccagucuaaauacuacgacuggcugggggaaaaggugggaaaugaguauaagcucgauaaacuggucagcuuuagagugccuuacuauguuggcccccugguggacaccgccuccaaggaaaagaaggaugagacacgcuucgcuuggaugguccggaaaaacccugagagcaccgaagcgaucacccccuggaauuuugaggacaucguggauaagaacgccucugcugaaaauuucauuaagagaaugacaacgaaagacaaguaccuccugaacgaggauguccuuccgaaaugcucccugcucacccaggacuuugaaguguauaaugagcugaacaauauccgcguuaacggcgagaaguucacagccgaacaaaaacagcugauucacgacgagcuuuuuaccaagcaugccagcgugucuaucaaacagcucaaggauuuccuggucagcgaacugauguacgugcgggacaaucucaagguugaggggcuggcugaugaaaagaaacuuauguccucucugagcacacaguuugacuaucaaaagauuaucccugaucagauuaacgacgugaaguacagagaggauaucgagcagaucauugaaugguccaccaucuucgaggacgccgcgauuuucaaaacgaagcucaaggaaaucgauuggcugacagacgagcaacgcaauaaacuggcuaacaagcgguacagaggauggggcagccuuucuaaacgccuccuggccugucuggucgaugaaaaugggcagcggauuaucgacauccucagagauuccagcgacaacuuuaugaugauugugaaccgccccgaguucaagcaggccaucuuugacgagaaugcuaaccugaccgaaaccaauucuaaaaaggauauguucgagaugauugacaacuuuuauacauccccucagaauaagaaagccauccggcaagugcuucugguuguccaggauauucagaacgcuaugggaggcguggcgccccagaagaucuucaucgaauuugccagagaggacgaggugaaugggcggcgcaccaacagcagauacucccaaauucgggaaauguauucuaaagucacagaugacgugaucaauaagacgguuagaggagagcucgaagccaacaaaggcagccugaauaaggagaagcuguuccuuuacuuucuccagggcgggauugaucuguauuccggaaaaaccaucaacauugacaauaucucuagcuacgauguggaccacguccugccccaguccuucaucaaggaugacagcauuaacaauaaagugcucguuaacgcuaagggcaaccgcgugaaaaaugacaacgucccuauggaacuguuuggggccaagauguauccgacauggaaacggaugguggauaccggaaucaugucuaaggcuaaguucaaaaaucuuacacugaaccccgacaauguugauaaguuuaaagccgagggcuucauuaacagacagcucguggagacccgccaaaucauuaagcuggucgcgcagauccugaaugacaaacuuggggaugacacgaagauuguguccgugaaggccaaccucacccaugauaugagagucuucuuugacuucccuaaaaaucggaacguuaauaacuaccaccaugcuuuugaugccuaccugagcgcuuucgugggcacauaucuguacaagcgcuaucccaaacuccagccuuacuuuguguauggagaguucaagaaaauggacaagcugaagaauaugaccucuuuugauuuccuuagagaccugaaacacacagauaaggucguggacaaagacaccggcgaaaucaucgccgauaagcucgccguuauuacgaacaugaauaaaaucuacgacuuuaagaaggugcuggucacacacgaagugcaugagaacuccggggcuauguaugaucaaacccuguaccccgcgaaacuugacaagagccugggacggaaaggcgccaagcagcucauuccgaaaaaggaugacaugccuacagcucuguacgggggauauaccggcucuaaggaugccuucaugagcaucguucgccucaaaaagaaagacgaaguguacuauaaggucauugggauccccgugagaaucgccgauuccguucagcacggcaaagagguggacgucgaggcucugacccaguuuauugaaacaaaguucacgaaagagaaccuuaauaagaagaccggagaaaucacacggaaaguggagugguucgaacuggugcucccuaagguccuguuuggccaagccguuuucgaugggggacagcccuuuaugcugggcagcucuaccuacccucauaaccuucgcgagcuggugcucacaaaagacuccgugaagaaaauugcggggaaggagagcaauaaguccuaucuggaugcuuacgacgaaaucauggaggccaugaacaaauauuucccccucuacgacaccaauaaguuuagagaaaaagucauugagggacggucuaaguucaucgaucugccggacaaagaugaguacgaaaacaauaaacuugugcagguuggcaagagcacgaucauugaccgcauguuuaucgggcugcacgccaacgcugccagaacagaucucaaaaauauuggcaucaccaccccuuucggauuuaugcagcaagcguccggcauuaagcugacaaaagacaccgugguccuguuccagucuagcacagggcuuuuugagcggaagguggcucugaaagaucucuga

SEQ ID NO: 4125 - RNA, 4011 nt, Artificial Sequence
  Cas9 variant
augaccaaggacuacacaaucggccuggauauugggacgaacagcgugggaugggccguccucaccgacgauuaucagcugaugaaaagaaagauguccguucacggcaauacagagaaaaagaaaaucaagaagaacuucuggggagcucggcuuuuugacgaagggcaaaccgccgaguuccgcagaacaaaacggaccaaucgcagacggcuggcgcgcagaaaguaccggcucucuaaacugcaggaucuuuuugcugaggaacugugcaagcaggacgauuguuucuuugugcgccucgaagagagcuuccuggugcccgaggaaaaacaguauaagccugccuccauuuuuccgacacuggaggaagagaaggaguacuaucaaaaauaccccaccaucuaucaucucagacagaagcuggucgacucuacggaaaaagaggaucuucggcugguguaccucgcccuggcucaccuucugaaguaccgcggccauuuccucuuugaaggguaucuggacaccgagaacacaagcauugaagaguccuucagaguuuuucuggagcaguacggaaaacagucugaucaaccucucaucgugcaccagcccguccugaccauccuuacagacaagcugagcaaaaccaagaagguggaagagauucucaaauauuacccuacggaaaagaucaauuccuucuuugcccagugccugaaacuuauuguuggcaaccaggcuaauuucaagcggaucuucgaucuggaggccgaagugaaacuccaauuuagcaaggagacauaugaggaagaccuggagucucugcucgaaaagauuggcgacgaguaccuggauaucuuccuucaggcgaaaaagguccaugacgccauucugcucuccgaaaucaucagcucuaccgugaaacacacacaggcuaagcuguccagcgggaugguggagcgcuaugagagacacaaagccgaucuugcuaaguuuaagcaauucgucaaagaaaacguuccccagaaggccaccguguuuuucaaagacaccacaaagaauggauacgcgggcuacauuaaagggaagacgacccaggaggaauuuuauaaguucgugaaaaaggagcugucuggagucgugggcuccgagccuuuucucgaaaagaucgaucaggagacauuccugcugaagcaacggaccuacacaaacgggguuauuccgcaucaggugcaccucaucgaacugaaagccauuaucgaccagcagaagcaacauuaucccuuucuugaggaagcuggaccuaaaaucauugcccuguucaaguuuagaauccccuacuaugucggcccucucgcuaaggagcaggaggccagcuccuucgccuggauugaacgcaaaaccgcugagaagauccaccccuggaauuucucugaagugguugauauugagaaaagcgcgaugcgguuuauccagagaaugacgaagcaggacacauaccugccgaccgaaaaagugcugccuaagaacucccuucucuaucaaaaguacaugaucuucaaugagcugaccaaagucagcuacaaggaugagcgcggcgugaaacaguauuuuucuggggacgaaaagcagcagauuuucaaacaacuguuucagaaggagcggggaaagaucacagucaaaaagcuccagaacuuccuguacacccacuaucauauugaaaaugcccacaucuuuggcauugagaaggcuuucaacgccuccuacagcacauaucaugauuuuaugaaacuugccaaaacgaaccaaaagucuaugcaggaauggcuggagcagcccgagauggaaccuaucuucgaggacauugugaagauccucaccaucuuugaagacagacagaugauuaaacaccaacugagcaaguaccaggagguuuucggggagaaacugcuuaaggaauuugcucgcaaacauuauacaggauggggccgguucuccgccaagcucauccacgggauuagagaucgcaaaaccaauaagacaauccuggacuaccugauuaacgaugacgaugugcccgcgaaucggaacagaaaucucaugcagcugaucaacgacgagcaccuuucuuucaaggaagagaucgcuaaagccaccgucuuuagcaagcauaaaucccugguggauguuauucaggaccuccccggaagcccugccaucaagaaaggcauuuggcaaucucugaagaucguggaggaacugauugcuaucaucggcuacaagccgaaaaauauugucaucgagauggcccgcgaaaaccagaagacgcaccggaccaaacccagacuuaaggcucucgagaaugggcugaaacagauuggauccacacugcucaaggaacagccuaccgauaacaaggcccugcaaaaagagcggcuuuaucuguacuaucuccagaauggccgcgacaucuacacaggggaaccccuggauauugagaaccugcaucaguaugagguggaccacaucaucccucggagcuucauuguggauaauucuaucgacaacaagguucuugucgcguccaaacaaaaucagaagaaaagagacgaugugcccaacaagcagauugugaacgaacagagaaucuuuuggaaucaacucaaggaggccaaacugauuagcccgaagaaauacgcuuaucugaccaagaucgaacucacgccugaggacaaagcccgcuucauucagcggcagcuggucgaaacaagacagaucaccaagcacguggcuaacauccuucaucaauccuuucaccaggaggaggaaggaacagauugugacggcguucagauuaucacccugaaggccacccucacaucucaguuccgccaaacguuugggcuguacaaagugagagagauuaauccccaucaccaugcgcacgaugccuaccugaacggcuucaucgcuaauguccuucugaagcgguauccuaaacucgcccccgaauuuguguacggaaaguauguuaaauacagccuggcucgcgagaacaaggccaccgccaaaaaggaguucuauuccaauauucucaaguuucuggaaucugacgagccuuucugcgaugaaaacggcgagaucuacugggagaaaagcuaucaccuucccagaaucaagaaagugcuguccagccaucaggucaaugugguuaagaaaguggaacagcagaaagggggauucuacaaggagacagucaacucuaaagaaaagccggacaaacucauugagcggaagaauaacugggaugugaccaaauacggcggguuuggauccccugugaucgcuuaugcgauugccuucgucuacgcuaagggcaagacacagaaaaagacccgcgccaucgaagggauuacgaucauggagcaagccgcuuuugaaaaagaccccacaaccuuccugaaggauaaaggcuuuccccagguuaccgaguucaucaagcugccuaaguauacacuuuuugaguucgacaauggaagacggcgcuuucuggccagccacaaagaaucucaaaagggcaacccguucauucucuccgaucagcuggugacccuccuguaccaugcgcagcacuaugacaaaaucacauaccaggagagcuuugacuaugugaauacgcaucuuucugauuucagcgcuauucugaccgaaguccucgccuuugccgagaaguacacacuggcugacaaaaacaucgaacggauucaagagcuguacgaggaaaacaaguauggggagaucuccaugauugcccagagcuuccuucagcugcuccaguucaaugcgaucggagcucccgccgauuuuaaauucuuuggcgugaccaucccuagaaagcgcuacacaucucugaccgaaauuugggacgccacgaucauuuaucaauccguuaccgggcucuacgagacaagaauccggaugggagaucugugggcuggcgagcaguga

SEQ ID NO: 4126 - RNA, 4011 nt, Artificial Sequence
  Cas9 variant
augaccaaggacuacacaaucggccuggauauugggacgaacagcgugggaugggccguccucaccgacgauuaucagcugaugaaaagaaagauguccguucacggcaauacagagaaaaagaaaaucaagaagaacuucuggggagcucggcuuuuugacgaagggcaaaccgccgaguuccgcagaacaaaacggaccaaucgcagacggcuggcgcgcagaaaguaccggcucucuaaacugcaggaucuuuuugcugaagaacugugcaagcaggacgauuguuucuuugugcgccucgaagagagcuuccuggugcccgaggaaaaacaguauaagccugccuccauuuuuccgacacuggaggaagagaaggaguacuaucaaaaauaccccaccaucuaucaucucagacagaagcuggucgacucuacggaaaaagaggaucuucggcugguguaccucgcccuggcucaccuucugaaguaccgcggccauuuccucuuugaaggggaccuggauaccgagaacacaagcauugaagaguccuucagaguuuuucuggagcaguauucuaaacagagcgaccaaccucucaucgugcaccagcccguccugaccauccuuacagauaagcuguccaaaaccaagaagguggaagagauucucaaauacuauccuacggaaaagaucaauagcuucuuugcccagugccugaaacuuauuguuggaaaccaggcuaauuucaagcggaucuucgaccuggaggccgaagugaaacuccaauuuucuaaggagacauacgaggaagaccuggagucccugcucgaaaagauuggcgaugaguaucuggacaucuuccuucaggcgaaaaagguccaugaugccauucugcucagcgaaaucaucucuuccaccgugaaacacacaaaggcuaaacugagcucuggcaugguggagcgcuacgagagacacaaggccgaccuugcuaaguuuaaacaguucgucaaggaaaacguuccccaaaaagccaccguguuuuucaaggauaccacgaaaaauggguaugcgggauacauuaagggcaagacaacccaggaggaauuuuacaaauucgugaagaaagagcuguccggggucgugggaagcgagccuuuucucgaaaagaucgaccaggagacauuccugcugaaacagcggaccuauacaaacggcguuauuccgcaucaagugcaccucaucgaacugaaggccauuaucgaucagcagaaacagcauuaccccuuucuugaggaagcugggccuaagaucauugcccuguucaaguuuagaauccccuauuacgucggaccucucgcuaaagagcaagaggccuccucuuucgccuggauugaacgcaagaccgcugagaaaaucaaucccuggaacuucagcgaagugguugacauugagaaguccgcgaugcgguuuauccagagaaugacgaaacaggauacauaucugccgaccgaaaaggugcugccuaagaauagccuucucuaccagaaauauaugaucuucaacgagcugaccaaggucucuuacaaagacgagcgcggcgugaagcaauacuuuuccggcgaugaaaaacagcagauuuucaagcagcuguuucaaaaggagcgggggaaaaucacagucaagaaacuccagaauuuccuguauacccacuaccacauugaaaacgcccagaucuuuggaauugagaaggcuuucaacgccagcuauucuacauaccaugacuuuaugaaacuugccaagacgaaucaaaaggcuaugcaggaauggcuggagcagcccgagauggaaccuaucuucgaggacauugugaaaauccucaccaucuuugaagauagacagaugauuaagcaccaacugagcaaauaucaggagguuuucggcgagaagcugcuuaaagaauuugcccgcaagcauuacacaggguggggacgguucuccgcgaaacucauccacggcauuagagaccgcaagaccaacaagacaauccuggauuaucugauuaaugacgaugacgugcccgcuaaccggaauagaaaccucaugcagcugaucaaugaugagcaucuuucuuucaaagaagagaucgccaaggccaccgucuuuagcaaacacaagucccugguggacguuauucaggaucuccccgggagcccugcuaucaaaaagggaauuuggcaaucucugaagaucguggaggagcugauugccaucaucggcuacaaaccgaagaacauugucaucgagauggcucgcgaaaaucagaaaacgcaccggaccucccccagacuuaaggcccucgagaacggccugaaacagauugggagcacacugcucaaggaacagccuaccgacaauaaggcgcugcaaaaagagcggcuuuaccuguauuaccuccagaacggacgcgauauguauacaggcgaaccccuggagaucgagaaucugcaucaguacgaaguggaccacauuaucccuagaucuuucaucguggauaacuccauugacaauaagguucuugucgccagcaaacaaaaccagaagaaacgggacgaugugcccaagaagcagaucgugaacgagcagagaauuuucuggaaucaacucaaagaagcuaagcugaucuccccgaaaaaguaugccuaccugaccaaaauugagcucacgccugaagacaaggcucgcuucauccagcggcagcuggucgagacaagacagauuaccaagcauguggccaacauccuucaccaaucuuuuaaucaggaggaagaggggacagauugugacggaguucagaucauuacccugaaagcgacccucacaagccaguuccgccaaacguuuggccuguauaaggugagagaaaucaacccccaccaucacgcccaugaugcuuaccugaauggguucauugccaacguccuucugaaacgguacccuaagcucgcucccgaguuuguguauggcaaauacguuaaguauucccuggcccgcgagaauaaagccaccgcuaagaaggaguucuacucuaacauccucaaauuucuggaaagcgacgaaccuuucugcgaugagaauggagaaauuuauugggagaagucccaccaucuucccagaaucaaaaaggugcugagcucucaccaggucaacgugguuaaaaagguggagcagcagaagggcggguucuacaaagaaacagucaauuccaaggagaaaccggacaagcucaucgaacggaaaaacaauugggaugugaccaaguauggaggcuuugggagcccugugauugcguacgccaucgcuuucgucuacgccaagggaaaaacacaaaagaaaacccgcgccauugagggcaucacgauuauggaacaggcugccuuugagaaggaccccacaaccuuccugaaagagaagggguuuccccagguuaccgaauuuaucaagcugccuaaauauacacuuuuugaguucgauaacggcagacggcgcuuucuggcgucucacaaggaaucccaaaaaggaaauccguucauccucagcgaccagcuggugacccuccuguaccaugcucagcacuaugauaagauuacauaccaggagucuuuugacuaugugaacacgcaucuuagcgacuucuccgccauccugaccgaaguccucgccuuugcugagaaauacacacuggccgauaagaacauugagagaauccaagaacuguaugaggaaaauaaauacggcgagaccagcaugauugcgcagucuuuccuucagcugcuccaguucaacgcuaucggggcccccgccgacuuuaaguucuuuggagugacaauuccucggaagcgcuacaccucccugacggagaucugggaugcuaccaucauuuaucaaagcguuacaggccucuacgaaaccagaauccggaugggggaccugugggccggagagcaguga

SEQ ID NO: 4127 - RNA, 4014 nt, Artificial Sequence
  Cas9 variant
augaagaacaugaaaaagcccuacaccaucggccuggacauugggacaaauagcgugggaugggccguccucacggaucaguaugaccugguuaaaagaaagaugaaaaucgcuggcgauuccgagaagaagcaaauuaaaaagaacuucuggggagugcggcuuuuugacgaagggcagaccgccgcggaucgcagaauggcucggacagcccgcagacggaucgagcgcagacggaaucgcauuucuuaccugcagggcaucuucgccgaagagaugagcaaaaccgacgcuaacuuuuucugcagacucuccgauucuuuuuauguggacaaugaaaagcggaacagccgccacccuuucuuugccacaaucgaggaggaagucgaguaccauaaaaauuauccgaccauuuaccaccugagagaggaacuugugaacuccucugagaaggcugaucugcggcucguuuaucuggcccuggcgcauaucauuaaguaccgcgggaauuuccucaucgaaggagcccuggacacacagaacaccagcguggauggcauuuacaaacaauuuauccagacguauaaucaggucuucgcuuccggcauugaggacgggagccuuaagaaacuggaagauaacaaggacguggccaaaauccucguugagaaggugaccagaaaagaaaagcuggagcggauccuuaagcuguaccccggagagaaaucugcuggcauguuugcccaguucauuucccucaucgucgggagcaagggaaauuuucaaaaaccuuucgaccugauugaaaagucugauaucgagugugcgaaagacuccuaugaagaggaucuggaaagccuccuggcccuuauuggcgacgaguacgcugagcuguucguggccgcuaagaacgccuauucugccgugguccucuccagcaucaucacaguugcugaaaccgagacaaaugcgaagcuguccgccucuaugauugaaagauuugauacccacgaggaagaccuuggggagcugaaggcuuucaucaaacuccaucugcccaaacacuacgaggaaauuuuuagcaacacggagaagcacggauaugccggcuacaucgauggcaaaacaaagcaggccgacuucuacaaguauaugaaaaugacccuggaaaacauugagggggcugauuacuuuaucgccaagaucgagaaagaaaauuuccuccgcaagcagcggacauuugacaacggagcgauuccucaucagcugcaccuugaggaacuggaggcuauccuccaucaacaggccaaauauuaccccuuccugaaggaaaauuaugauaagauuaaaucccuugugaccuuuagaaucccuuacuucgugggcccgcuggccaacgggcagagcgaguuugcuuggcucacccgcaaggccgacggagagauucggcccuggaauaucgaagagaaagucgacuucggcaagucugcuguggauuuuauugagaaaaugacaaacaaggacacguaucugccuaaagaaaauguucugcccaagcacucccucugcuaccaaaaguaccugguguauaacgaacuuaccaaagucagauacaucaaugaucaggggaagacaagcuauuucucuggacaggagaaagagcagaucuucaacgaccuguuuaagcaaaaacgcaaggugaagaaaaaggaucucgaacuguuccugcggaauaugagccacguugaguccccuaccauugaaggccuugaggacucuuuuaacagcuccuacagcacauaucaugaucuccugaaagugggcaucaagcaggaaauucuggacaaucccgucaacaccgagaugcucgagaauaucgugaaaauucugacggucuucgaagauaagagaaugaucaaggagcagcuucagcaauuuucugacgugcuggaugggguugugcucaaaaagcuggaacgccggcacuacacaggauggggcagacuguccgccaaacuucucauggggauccgcgacaagcagagccaucugaccauucuggauuaucucaugaacgacgacggacugaaccggaaucuuaugcagcugaucaacgauucuaaucucuccuucaaaagcauuaucgagaaggagcaggucaccacagcggacaaggauauucaauccaucguggccgaccuggcuggcucuccggccaucaaaaaggggauucugcagagccuuaaaaucguugaugaacucguguccgucaugggcuacccuccccagaccauugugguggagauggcuagagaaaaccagacaacgggaaagggcaaaaauaacucucggccucgcuacaagagccuggagaaagccaucaaggaauuugggucccaaauucugaaggagcaccccaccgacaaucaggagcucagaaacaaucggcuguaucuuuacuaucugcagaacggaaaagauauguacacaggccaagaccucgauauccauaaucugagcaacuaugacaucgaucacauuguuccccagucuuucaucaccgacaauuccauugauaaccugguccuuacaagcucugcggggaauagagaaaagggagacgacgugccuccgcucgagaucgugcgcaaacggaaggucuuuugggaaaaacuguaccagggcaaccugauguccaagagaaaguucgauuaucucaccaaagccgagcgcgggggccugacggaagcugacaaggccagauuuauucaccggcagcuuguggagacccgccaaaucaccaaaaacguugcuaauauucugcaucagagauucaacuacgagaaggaugaccacggaaauacaaugaaacaggugcggaucgucacacucaagagcgcccuggugucucaguuucgcaagcaauuccagcuguacaaaguuagagaugugaacgacuaucaucacgcccacgaugcuuaccuuaauggcgucguggcgaacacccugcucaagguuuauccccagcuggaaccugaguucguguacggggacuaucaucaguuugauugguucaaagccaauaaggcuacggccaaaaagcaauuuuacacaaacaucaugcuguucuuugcccagaaggaccggauuaucgaugaaaauggagagauucucugggacaaaaaguaucuugacaccgucaaaaaggugaugagcuaccgccagaugaacaucgugaaaaagacagaaauucaaaagggcgaguucuccaaagcuaccaucaagcccaaagggaauagcucuaagcugaucuccagaaaaaccaacugggauccuaugaaguacggaggccucgacagccccaauauggccuaugcggucguuauugaguacgcuaaagggaagaacaagcugguguuugagaaaaagaucauucgggugacaaucauggaacgcaaagccuucgaaaaggaugagaaagccuuucuggaggaacagggcuauagacagccgaagguccuugcuaagcugccuaaauacacgcucuaugagugugaagagggacggagacgcaugcuggccuccgcgaaugaagcucagaagggcaaccaacaggugcuccccaaccaccugguuacccuucugcaucacguggccaauugcgaggucucugacgggaaaagccucgauuacauugaguccaaccgggaaauguucgccgagcugcuggcucaugugucugaauuugccaagagauauacacuugcugaggccaaucugaacaaaaucaaucaacucuucgaacagaacaaggagggagacaucaaggcgauugcccagagcuucguugaucugauggcuuuuaaugccaugggcgcuccugccuccuucaaauuuuucgagaccacaaucgaacgcaagcgguacaacaaucucaaagagcugcuuaacucuaccauuaucuaccagagcauuacggggcuguaugaauccagaaagcgccuggacgauuga

SEQ ID NO: 4128 - RNA, 4014 nt, Artificial Sequence
  Cas9 variant
augaagaaauucgagaacuacuaucugggccucgacaucgggaccagcuccauuggaugggccgugacaaauucucaguacgauauccugaaguuuaacggcaaauauaugugggggacgagacuuuuccccgaagcuaauaccgcccaagagcggcgcauucacagaagcucccggcgcagacugaagcggcgcaaagaaagaauccagauucuccagaugcuguuugacaaggagaucgcgaagaucgauucuggauucuuucagcggcuuaaagacagcaaguacuauaaagaagauaagacagagaaacaaaccaacuccauuuuccaugacaaggauuacucugacaaggaguaucaccaggauuuuccuacaaucuaccaucugcgcaaauuccuccuggaaggcaauaagccgaaagacauuagauuugucuaccuggcucuccaccauauccugacccaccgggggcacuuccuuuuucccgauauggagguuagcaacgugacagaguucuccaauauuuuuagcgaacugaagcaguaucucuacgacgagauggaucuggacuucgaauggaaaaacggaaaacuuaaugagguggaaaacauccugaaagaccgcaaucucgccaagucugagaaggaaaagaagcugugcggcauuaucgagcuggagggcaaaaucgauaaccagagaaaggccaugauugggaugauguguggaugcaaaaagaaguucuccgaccucuuucaaaaugaaaacuaucgggagcuggaaaucagcucuuucuccuuugcugauagcucuuacgaggaaaaacgcgacgagcuugagggcauucuggccgaaaauauccucugucuggauuaucuuaagaccauuuacgacugggggaaacuguccgauauccuccagggagaggaaagcaucuccgucgcuaaggugaaaucuuaugaggaacaucagcuggaccugaaguaccucaagaacauucugaaacuuuacagccacaaggagaaagagaacguuuucagaaagaaagaaggcaaguauccuaaguacaucuccgggaaacugagccaggaggaauuuaauaagucuauuaaaaagauccucgaggagauuaaauccgugaagcaagaagaucggaaagucuucgacacgcugcuuaagagagccagcaacaaucugcucugccccaaacaggugaucaaagagaacggaguuaucccuuaucagauucauaaguuugaacuggagaaaauccugcgcaauauggcggauuucuuucccaugcucaaggaaaagaaggacggcaagacccugucugagaaaauuaucagcguguucacauuucggauuccuuacuaugucggcccgcuuaaccaaaauuccgacagagccuggcuggugaagaacaaagaugagaagaucuaccccuggaauuucgaagagauugugaaccucgaagagucugcugaaaaauuuauccagaaucugaccaacaaguguacauaucugguccuugaggacguucucccuaagagcuccauccuguacagcaaauucauggugcugaaugagcucaacaaucugaagauugauggggaagccaucucuguggaccuuaaacagaagauuuaccugaaccucuuccagaaauauaagaaggucacccugaaaaagcugaaaggauaccuuaaguccgagaacauccucauugauacgagcacacaaaucaccggcaucgacggggauuuuaaaucuucccugggaagcuaucuggacuucuacaauauucucggcgauaaggugaaaacagacuuugggaagaagcugaucgaaaacugcauucuuuggaucacccuguauaccggagagaaaaagcuccugaaaaauaagauuaucgcuaacuacaaaggcgaacuguccgaggaggaaaucaagaagauuguuaaucuuaaauauaaggauuggggccgccucucuuacgccuuccuggaggaaauccagagcgcgucccuggagacaggggagcuccggaacauuauccagaugaugugggaaacgaauaacaaucugauggagcuucugucuagcaacuaccaguuucucuccgaaauugagaaaagaaauagcguggucgccaucggaaaggaguucaacuaugaaaccauccugggcgacucuuacgcuucccccagcgugaaacgcaugauuuggcaaucucuguccguuguggaugagaucaagaagauuaugaaaaaggccccuaaaaagaucuuuauugaaauggcucggcaggaggacaugaaaaaggaaagaaaggagagccgcaaaucuacauuccuuacccucuauaagagcaucaaagaagaggggcgggacuggauuaaggagaucgaaaauugguccgauagcgaguuuagaucuaaaaagcuguaccuguauuacacacagaugggaaaguguauguauaccggcgaaaagaucucccucgaccagcuguucaacaagaauauuuacgauaucgaccacauuuacccccgcagcaaaacgaaggaugacuccaucgagaacauuguccuugugaaacggaacaucaaugccaagaaaacagaugaauauccgcuggagagaaacauccaacagaagcagcacgacuuuuggaagaugcuccauucuaaaaagcugauuggggauaaaaaguacgagcggcugacccgcaccacagaguucaccgacgaagaacuuagcgauuuuaucgccagacagcuggucgagacacggcaauccacgaaaauuguggcugacauccucaagaaucuguucccugagaccaagauuguuuaugugaaagcgaaccucacaucugauuucagaaagaauuuuaaaauccuuaagagccgcgacaucaacgacuaccaccaugcccacgaugcuuaucugaauauugucaccggcaacguguacaauaucaaauucacagacaacccccggaauuuuauuaaggauaagaaacuggaaggaaagaaauauaaccucaagguugagaaaaucuucgaauacagaaaggagaaugaauccuuuuggaacccuaagaccauggugacgaaaauugagaauuacaucuucaagaaacgcccccaguuuaccagauauucuuucgagcagcauggcggguuuuucgaccaaaacauugucgauaaggaaagcugcaaaaagggaacaggcuacauccccaucaaauccagcaacgccauucuguauaauaccucuaaguacgggggauauggcuccgugacagggaccuacuuuuuccugguggagcacacgaugaagggcaaacggauccgcacaauugaaaugaugccucuuuaucugagcaagaaaauccacucuaaggaggaacucgagaaauacuguaaggagaagcuggaacuccagaaaccguccguuagacuggcccggauuaaguacaacagccuucugaaaaucaauggauuccccuaucauaucaccggcaagacaaacgacucuuacuggauuauguccgcuauccagcuccugcugagcaaaaauuauuacgaguaucuucgcaagcuguacaucuuuugcaaggaagagagacucgaagaggagauugucggggagaaaaacauuaagcuguauaccuguauccucgaaaaacuggaaaaguccaucuacagccacaaacuucugaauauuaacuacaauggaaagucuaagaaccugaaagauauccucgagagcgagaaggaaaauuuccugcuucuguccgagaaaaagcaggcccaaauucucaucgaaauuuuuacccugcucgagucuaacaauuucggcgcgaaccuggagagcuuugggugcgggaaaaagugcggcaucacaaaaauuaauaagaacaucgacaaacuugaagaggugcugcugaucaaucaguccccuacgggacucuucgaaaacucuauugaucugaaaaagguguga

SEQ ID NO: 4129 - RNA, 4014 nt, Artificial Sequence
  Cas9 variant
augaagaaagacuacgugaucggccuggauauugggaccaacagcgucggaugggccguuaugacagaggacuaucagcucgugaagaaaaagaugcccaucuacggcaauacggagaaaaagaagauuaaaaagaacuucuggggagugagacuguuugaggaagggcacaccgcugaggaucggcgccuuaaaagaacagcccggcgcagaaucucccggcgcagaaaucggcugcgcuaucuccaagcguucuuugaagaggcuaugaccgaccuggaugagaacuucuuugccagacuucaggaaucuuuccuggucccugaggacaagaaauggcaucggcacccgauuuuugccaagcucgaagaugagguggcuuaccaugagacauaucccaccaucuaccaucugcgcaagaaacuggccgacagcuccgaacaggcugaucucagacugaucuaucuugcccuggcgcacauuguuaaguaccggggccacuuccucaucgaggggaaacugucuacagaaaauauuagcgugaaggagcaguuucaacaguucaugaucauuuacaaccagaccuuugucaauggagaaucccgccuugugucugccccucugcccgagagcguucucaucgaggaagaacugacggaaaaagccuccagaaccaagaaaagcgagaaggugcugcagcaauucccucaggaaaaggcuaacggccucuuuggccaguuccugaaacuuauggucgggaauaaggcugacuucaaaaagguguuuggacuggaggaggaagccaaaauuacauaugcgucugaguccuacgaagaggaucucgaaggcauccuggccaaggugggggacgaguauagcgaugucuuccuugcugccaagaacguuuacgacgcuguggagcugucuaccauccucgccgacuccgauaaaaagagccacgccaaacugucuuccagcaugauugugcgguuuacagaacaucaggaggaccugaagaaauucaagagauuuauccgcgaaaauugccccgaugaguaugacaaccucuucaagaaugagcaaaaagauggauacgcuggcuauauugcgcacgccgggaaggucucccagcugaaauuuuaccaguacgugaagaaaaucauucaagacaucgcuggagccgaauauuuccuugagaagaucgcccaggaaaacuuucugcggaagcagagaaccuucgauaauggcguuauuccucaucagauccaccucgcugagcugcaagccauuauccaccgccaggcggcuuacuauccguuucuuaaagaaaaccaggagaagauugagcagcuggugacguuccggauccccuacuaugucggcccucucucuaaaggggacgccagcacauuugccuggcugaagagacaauccgaggaacccauccgcccuuggaaccugcaggaaaccguggaucucgaccagagcgcuacagccuucauugagcggaugaccaauuucgauaccuaccugcccucugaaaaaguucuuccgaagcauucccugcucuaugagaaauuuaugguguucaacgagcugacaaagaucagcuacacggacgacagaggaauuaaggcuaauuuuucuggcaaagaaaaggagaaaaucuucgauuaccuguuuaagacccgccggaaagucaagaagaaagacauuauccaguucuauagaaacgaauacaauacagagauugugacccuuagcgggcucgaagaggaucaauuuaacgccuccuucucuacauaucaggaccugcugaaguguggacucacccgcgcggagcuggaucacccugacaaugccgaaaaacuugaggauaucaucaagauucugacgaucuuugaagaccggcagcggauuagaacacagcucagcaccuucaaaggccaauuuuccgcugagguccugaagaagcuggagcgcaaacauuacaccggguggggaagacuuagcaagaaacucaucaacggcauuuaugauaaggaaucuggcaaaacaauccugggguaccugaucaaggacgauggaguguccaagcacuauaaucggaacuucaugcagcucauuaaugacagccagcugucuuuuaaaaacgccauccaaaaggcucaguccagcgagcaugaagagacccuuuccgaaacaguuaaugagcuggccggcucucccgcgauuaaaaaggggaucuaccagagccucaaaauuguggaugagcuggucgccaucaugggauacgcuccuaagagaaucgugguugaaauggcccgcgagaaccagacgaccuccacaggcaaacggagaucuauucaacgccugaagaucguggaaaaggcuauggccgagauugggagcaaucuucucaaagaacagcccaccacaaacgagcagcugagagacacccggcuguuccucuauuacaugcagaacggcaaggacauguauacgggagaugagcugucccuucaccgccugagccacuacgacaucgaucauauuaucccccaaucuuucaugaaagacgauucccucgacaaucugguccuggugggcagcaccgaaaacagagggaagucugaugacgugccuuccaaagagguugucaaggauaugaaggccuauugggaaaaacuuuacgcugcgggacucaucagccagcggaaguuucagcgccugacaaaaggcgagcaagggggacugacccucgaagacaaggcccacuucauucagagacagcugguggagacacggcagaucaccaaaaauguggcuggcauucuugaucaacgcuauaacgccaauucuaaggagaagaaaguccagaucauuacgcugaaggccagccucacaucccaguuuagaagcaucuucgggcuguacaaagugcgggaaguuaacgacuaccaucacggccaggaugcuuaucugaauugcguggucgccaccacacuucugaagguguacccgaaccucgcgcccgaguuuguuuauggagaauacccuaaauuccaaaccuuuaaggagaauaaggcuaccgccaaagccauuaucuauacaaaccugcuccgcuucuuuacggaggacgaacccagauucaccaaggacggcgagauccuguggucuaauuccuaccuuaaaacaauuaagaaagaacugaacuaucaccagaugaauaucgugaagaaggucgaggugcagaaagggggauuuagcaaggaauccauuaaaccuaagggccccucuaacaaacucaucccgguuaagaaugggcuggauccucagaaauacggaggcuucgacagccccauuguggcuuacaccguccuguucacacaugagaaggggaagaaaccucuuaucaagcaagagauccugggcauuaccaucauggagaaaacgcgguuugaacagaaccccauucucuuccuggaagagaagggauuucucagaccucgcgugcugaugaaacuucccaaguauacacuguacgaguucccggaaggccggagacgccuccuggccuccgcgaaggaggcucagaaagggaaccagauggugcugccugaacaccuucugacccuccuguaucaugccaagcaaugucuccugcccaaucagucugagagccuuaccuacgucgaacagcaccagcccgaguuucaagaaauccuggagcggguuguggauuucgccgaggugcauacacuggcuaaauccaagguccagcagauugugaaacucuuugaagccaaccaaaccgcugacguuaaggagaucgccgcgucuuucauccagcugaugcaguuuaaugccaugggagcuccuagcacauucaaguuuuuccagaaagauauugaaagagcccgcuauacguccaucaaggagauuuuugacgcuaccaucauuuaccaaagcacaaccggccuuuaugagacacggagaaaaguggucgauuga

SEQ ID NO: 4130 - RNA, 4014 nt, Artificial Sequence
  Cas9 variant
augaagaaagacuacgugaucggccuggauauugggaccaacagcgucggaugggccguuaugacagaggacuaucagcucgugaagaaaaagaugcccaucuacggcaauacggaaaagaagaagauuaaaaagaacuucuggggagugagacuguuugaggaaggacacaccgcugaggaucggcgccuuaaaagaacagcccggcgcagaaucucccggcgcagaaaucggcugcgcuaucuccaagcguucuuugaagaggcuaugaccgaccuggaugagaacuucuuugccagacuucaggaaucuuuccuggucccugaggacaagaaauggcaucggcacccgauuuuugccaagcucgaagaugagguggcuuaccaugagacauaucccaccaucuaccaucugcgcaagaaacuggccgacagcuccgaacaggcugaucucagacugaucuaucuugcccuggcgcacauuguuaaguaccggggccacuuccucaucgaggggaaacugucuacagaaaauaccagcgugaaggaccaguuucaacaguucauggucauuuacaaccagacguuugugaauggagagucccgccuuguuucugccccucugcccgaaagcgugcucaucgaggaggaacugaccgagaaagcuagcagaacaaagaaaagcgaaaagguccugcagcaauucccucaggagaaggccaacggccucuuuggccaguuccugaaacuuaugguggggaauaaggcugauuucaaaaagguguuuggacuggaagaggaggccaaaauuaccuaugcgucugaauccuacgaggaagaccucgagggcauccuggccaaggucggggaugaauauagcgacguuuuccuugcugccaagaacguguacgacgcuguggagcugucuacaauucucgccgauuccgacaaaaagagccacgccaaacugucuuccagcaugaucguccgguuuaccgagcaucaggaagaucugaagaaauucaagagauuuauccgcgagaauugccccgacgaauaugauaaccucuucaagaaugagcaaaaagacggauacgcuggcuauauugcgcacgccgggaaggugucccagcugaaauuuuaccaguacguuaagaaaaucauucaagauaucgcuggagccgaguauuuccuugaaaagauugcccaggagaacuuucugcggaagcagagaacguucgacaauggcgugaucccucaucagauccaccucgcugaacugcaagccauuauccaccgccaggcggcuuacuauccguuucuuaaagagaaccaggaaaagauugagcagcuggucacauuccggauccccuacuaugugggcccucucucuaaaggggaugccagcaccuuugccuggcugaagagacaauccgaggaacccauucgcccuuggaaccugcaggagacaguugaccucgaucagagcgcuaccgccuucaucgaacggaugaccaauuucgacacauaccugcccucugagaaagugcuuccgaagcauucccugcucuaugaaaaauuuauggucuucaacgagcugacgaagaucagcuacaccgacgauagaggaauuaaggcuaauuuuucuggcaaagagaaggagaaaaucuucgacuaccuguuuaagacacgccggaaagugaagaagaaagauauuauccaguucuauagaaacgaauacaauaccgaaauugucacacuuagcgggcucgaggaagaccaauuuaacgccuccuucucuaccuaucaggaucugcugaaguguggacucacgcgcgcggagcuggaccacccugauaaugccgagaaacuugaagacaucauuaagauccugacaaucuuugaggaucggcagcggauuagaacccagcucagcaccuucaaaggccaauuuuccgcugaagugcugaagaagcuggagcgcaaacauuacacaggguggggaagacuuagcaagaaacucaucaacggcauuuaugacaaggagucuggcaaaaccauccuggauuaccugauuaaggacgaugggguuuccaagcacuauaaucggaacuucaugcagcucaucaaugacagccagcugucuuuuaaaaacgccauccaaaaggcucaguccugcgaacaugaggaaacacuuagcgagacggugaaugaacuggccggaucccccgcgauuaaaaagggcaucuaccagucucucaaaauugucgacgagcugguggccaucaugggguacgcuccuaagagaauuguuguggagauggcccgcgaaaaccagaccacaagcaccggaaaacggagauccauccaacgccugaagaucgucgagaaggcuauggccgaaauuggcucuaaucuucucaaagagcagcccacaaccaacgaacagcugagagauacgcggcuguuccucuauuacaugcagaacgggaaggacauguauaccggcgaugagcugagccuucaccgccugucccacuacgacaucgaucauauuaucccccaauccuucaugaaagacgauucucucgacaaucuggugcuggugggauccacagagaacagaggcaagagcgaugacguuccuucuaaaaaggucgugaaggauaugaaagccuauugggaaaaacuuuacgcugcggggcucauuucccagcggaaauuucagcgccugaccaagggagagcagggcgggcugacacucgaagacaaagcccacuucauccaaagacagcugguggagacccggcagaucacgaagaaugucgcugggauucuugaucaacgcuauaacgccaagagcaaagaaaagaaagugcagaucauuacacugaaggccucucucaccagccaguuuagauccaucuucggccuguacaaaguucgggaggugaaugacuaccaucacgggcaggacgcuuaucugaacugugucguggccacaacccuucugaagguuuacccgaaucucgcgcccgaguuuguguauggcgaauacccuaaguuccaggcuuuuaaagagaacaaggccaccgccaaaacaauuaucuauacgaaucugaugcgcuucuuuaccgaagaugagcccagauucacaaaggacagcgagauucucuggucuaacuccuaccugaaaaccaucaagaaggaacuuaauuaucaccaaaugaacaucgucaaaaagguggagguucagaaaggaggcuuuagcaaggaauccauuaaaccuaaggggcccucuaauaaacugaucccggugaagaacggacucgauccucagaaguacggcggguucgacagccccgucguggcuuacacagugcuguucacccaugagaaaggaaagaaaccucugauuaagcaagaaauccuuggcauuacgaucauggagaaaacacgguuugagcagaaucccauccuguuccucgaagagaagggguuucugagaccucgcguccucaugaagcugcccaaauauacccuuuacgaguucccggaaggccggagacgccugcucgccuccgcgaaggaagcucagaaaggaaaccagaugguucugccugagcaucugcuuacccugcucuaucacgccaagcaaugccugcuccccaaccagucugagagccuggccuacguggaacagcaccagcccgaguuucaagaaauucuugagcggguggucgauuucgcugaagugcauacacuggccaaauccaagguucagcagaucgugaagcuguuugaggcuaaucaaaccgccgacgucaaagagauugcggccucuuucauccagcucaugcaguuuaacgcuaugggcgccccuagcacauucaaguuuuuccagaaagauauugaaagagcucgcuauacguccaucaaggagaucuuugacgccaccauuaucuaccaaagcacaaccgggcuguaugaaacacggagaaaagugguugauuga

SEQ ID NO: 4131 - RNA, 4014 nt, Artificial Sequence
  Cas9 variant
augaagaaagacuacgugaucggccuggauauugggaccaacagcgucggaugggccguuaugacagaggacuaucagcucgugaagaaaaagaugcccaucuacggcaauacggaaaagaagaagauuaaaaagaacuucuggggagugagacuguuugaggaaggacacaccgcugaggaucggcgccuuaaaagaacagcccggcgcagaaucucccggcgcagaaaucggcugcgcuaucuccaagcguucuuugaagaggcuaugaccgcccuggacgagaacuucuuugccagacuucaggaaucuuuccuggucccugaggauaagaaauggcaucggcacccgauuuuugcuaagcucgaagacgagguggccuaccaugagacauaucccaccaucuaccaucugcgcaagaaacuggcugauagcuccgaacaggccgaccucagacugaucuaucuugcgcuggcccacauuguuaaguaccggggccacuuccucaucgaggggaaacugucuacagaaaauauuagcgugaaggagcaguuucaacaguucaugaucauuuacaaccagaccuuugucaauggagaaucccgccuugugucugcuccucugcccgagagcguucucaucgaggaggaacugacggaaaaagccuccagaaccaagaaaagcgagaaggugcugcagcaauucccucaggaaaaggcuaacggccucuuuggccaguuccugaaacuuauggucgggaauaaggccgauuucaaaaagguguuuggacuggaggaggaagcgaaaauuacauaugccucugaguccuacgaagaggaccucgaaggcauccuggcuaaggugggggaugaguauagcgacgucuuccuugccgcuaagaacguuuacgaugccguggagcugucuaccauccucgccgacuccgacaaaaagagccacgcuaaacugucuuccagcaugauugugcgguuuacagaacaucaggaggaucugaagaauuucaaaagauuuauccgcgaaaacugccccgacgaguaugauaaucucuucaagaacgagcaaaaggacggauacgcgggcuauauuacccacgccgggaaagucucccagcugaaguuuuaccaguacgugaaaaagaucauucaagauaucgcuggagccgaauauuuccuugagaaaaucgcccaggaaaauuuucugcggaagcagagaacguucgacaacggcguuauuccucaucagauccaccucgcugagcugcaagccauuauccaccgccaggcggcuuacuauccguuucuuaaggaaaaccaggagaaaauugagcagcuggugacauuccggauccccuacuaugucggcccucucucuaagggggaugccaauaccuuugccuggcugaaaagacaaagcgaggaacccauccgcccuuggaaccugcaggaaacaguggaccucgaucaguccgcuaccgccuucauugagcggaugaccaauuucgacacauaccugcccagcgaaaagguucuuccgaaacauucucugcucuaugagaaguuuaugguguucaacgagcugacgaaaaucuccuacaccgaugacagaggaauuaaggcuaauuuuagcggcaaggaaaaagagaagaucuucgacuaccuguuuaaaacacgccggaaggucaaaaagaaggauauuauccaguucuauagaaacgaauacaauaccgagauugugacacuuucugggcucgaagaggaccaauuuaacgccagcuucuccaccuaucaggaucugcugaaauguggacucacgcgcgcggagcuggaccacccugauaaugccgaaaaacuugaggacaucaucaaaauucugacaaucuuugaagaucggcagcggauuagaacccagcucucuaccuucaagggccaauuuagcgcugagguccugaaaaagcuggagcgcaagcauuacacaggguggggaagacuuuccaaaaagcucaucaacggcauuuaugacaaagaaagcggcaagaccauccuggauuaccugaucaaagacgauggggugucuaagcacuauaaucggaacuucaugcagcucauuaaugacucccagcugagcuuuaagaacgccauccaaaaagcucagucuuccgagcaugaagagacacuuagcgaaacgguuaaugagcuggccggaucccccgcgauuaagaaaggcaucuaccagucucucaagauuguggaugagcuggucgccaucaugggguacgcuccuaaaagaaucgugguugaaauggcccgcgagaaccagaccacaagcaccggaaagcggagauccauucaacgccugaaaaucguggaaaaggcuauggccgagauuggcucuaaccuucucaaggaacagcccacaaccaaugagcagcugagagacacgcggcuguuccucuauuacaugcagaacgggaaagacauguauaccggcgaugagcugagccuucaccgccugucccacuacgacaucgaucauauuaucccccagagcuucaugaaggacgauucucucgacaaucugguccuggugggauccacagaaaacagaggcaaaagcgaugacgugccuucuaaggagguugucaaagauaugaaggccuauugggaaaaacuuuacgcugcggggcucaucucccaacggaaauuucagcgccugaccaagggagagcagggcgggcugacacucgaagacaaagcccacuucauucaaagacagcugguggagacccggcagaucacgaagaauguggcugggauucuugaucaacgcuauaacgccaaaagcaaggagaagaaaguccagaucauuacacugaaggccucucucaccagccaguuuagauccaucuucggccuguacaaagugcgggaaguuaaugacuaccaucacgggcaggaugcuuaucugaacugcguggucgccacaacccuucugaagguguacccgaaucucgcgcccgaguuuguuuauggcgaauacccuaaauuccaaaccuuuaaggagaacaaggcuacagccaaagccauuaucuauacgaaucugcuccgcuucuuuaccgaggacgaacccagauucacaaaggacggagagauccuguggagcaacucuuaccuuaaaaccauuaagaaagaacugaauuaucaccagaugaacaucgugaagaaggucgaggugcagaaaggcggguuuuccaaggaaagcauuaaaccuaagggacccuccaauaaacucaucccgguuaagaacggccuggauccucagaaauacgggggauucgacucucccauuguggcuuacacaguccuguucacccaugagaagggcaagaaaccucuuaucaagcaagagauccuggggauuacgaucauggaaaagacacgguuugagcagaaccccauucucuuccuggaagagaagggcuuucucagaccucgcgugcugaugaaacuucccaaguauacccuguaccaguucccggaaggacggagacgccuccuggccagcgcgaaggaggcucagaaaggcaaucaaauggugcugccugagcaccuucugacccuccuguaucaugccaagcagugucuccugcccaaccaguccgaaucucuugccuacgucgagcagcaccaacccgaauuucaggagauccuggaacggguuguggauuucgcugaggugcauacacuggccaaaagcaagguccagcaaauugugaaacucuuugaggcuaaucagaccgccgacguuaaggaaaucgcggccuccuucauccagcugaugcaguuuaacgcuaugggggccccuucuacauucaaguuuuuccaaaaagauauugagagagcucgcuauacgagcaucaaggaaauuuuugacgccaccaucauuuaccaguccacaaccggacuuuaugagacacggagaaaaguggucgauuga

SEQ ID NO: 4132 - RNA, 4014 nt, Artificial Sequence
  Cas9 variant
augaagaaagacuacgugaucggccuggauauugggaccaacagcgucggaugggccguuaugacagaggacuaucagcucgugaagaaaaagaugcccaucuacggcaauacggagaaaaagaagauuaaaaagaacuucuggggagugagacuguuugaggaagggcacaccgcugaggaucggcgccuuaaaagaacagcccggcgcagaaucucccggcgcagaaaucggcugcgcuaucuccaagcguucuuugaagaggcuaugaccgaccuggaugagaacuucuuugccagacuucaggaaucuuuccuggucccugaggacaagaaauggcaucggcacccgauuuuugccaagcucgaagaugagguggcuuaccaugagacauaucccaccaucuaccaucugcgcaagaaacuggccgacagcuccgaacaggcugaucucagacugaucuaucuugcccuggcgcacauuguuaaguaccggggccacuuccucaucgaggggaaacugucuacagaaaauauuagcgugaaggagcaguuucaacaguucaugaucauuuacaaccagaccuuugucaauggagaaucccgccuugugucugccccucugcccgagagcguucucaucgaggaagaacugacggaaaaagccuccagaaccaagaaaagcgagaaggugcugcagcaauucccucaggaaaaggcuaacggccucuuuggccaguuccugaaacuuauggucgggaauaaggcugacuucaaaaagguguuuggacuggaggaggaagccaaaauuacauaugcgucugaguccuacgaagaggaucucgaaggcauccuggccaaggugggggacgaguauagcgaugucuuccuugcugccaagaacguuuacgacgcuguggagcugucuaccauccucgccgacuccgauaaaaagagccacgccaaacugucuuccagcaugauugugcgguuuacagaacaucaggaggaccugaagaaauucaagagauuuauccgcgaaaauugccccgaugaguaugacaaccucuucaagaaugagcaaaaagauggauacgcuggcuauauugcgcacgccgggaaggucucccagcugaaauuuuaccaguacgugaagaaaaucauucaagacaucgcuggagccgaauauuuccuugagaagaucgcccaggaaaacuuucugcggaagcagagaaccuucgauaauggcguuauuccucaucagauccaccucgcugagcugcaagccauuauccaccgccaggcggcuuacuauccguuucuuaaagaaaaccaggagaagauugagcagcuggugacguuccggauccccuacuaugucggcccucucucuaaaggggacgccagcacauuugccuggcugaagagacaauccgaggaacccauccgcccuuggaaccugcaggaaaccguggaucucgaccagagcgcuacagccuucauugagcggaugaccaauuucgauaccuaccugcccucugaaaaaguucuuccgaagcauucccugcucuaugagaaauuuaugguguucaacgagcugacaaagaucagcuacacggacgacagaggaauuaaggcuaauuuuucuggcaaagaaaaggagaaaaucuucgauuaccuguuuaagacccgccggaaagucaagaagaaagacauuauccaguucuauagaaacgaauacaauacagagauugugacccuuagcgggcucgaagaggaucaauuuaacgccuccuucucuacauaucaggaccugcugaaguguggacucacccgcgcggagcuggaucacccugacaaugccgaaaaacuugaggauaucaucaagauucugacgaucuuugaagaccggcagcggauuagaacacagcucagcaccuucaaaggccaauuuuccgcugagguccugaagaagcuggagcgcaaacauuacaccggguggggaagacuuagcaagaaacucaucaacggcauuuaugauaaggaaucuggcaaaacaauccugggguaccugaucaaggacgauggaguguccaagcacuauaaucggaacuucaugcagcucauuaaugacagccagcugucuuuuaaaaacgccauccaaaaggcucaguccagcgagcaugaagagacccuuuccgaaacaguuaaugagcuggccggcucucccgcgauuaaaaaggggaucuaccagagccucaaaauuguggaugagcuggucgccaucaugggauacgcuccuaagagaaucgugguugaaauggcccgcgagaaccagacgaccuccacaggcaaacggagaucuauucaacgccugaagaucguggaaaaggcuauggccgagauugggagcaaucuucucaaagaacagcccaccacaaacgagcagcugagagacacccggcuguuccucuauuacaugcagaacggcaaggacauguauacgggagaugagcugucccuucaccgccugagccacuacgacaucgaucauauuaucccccaaucuuucaugaaagacgauucccucgacaaucugguccuggugggcagcaccgaaaacagagggaagucugaugacgugccuuccaaagagguugucaaggauaugaaggccuauugggaaaaacuuuacgcugcgggacucaucagccagcggaaguuucagcgccugacaaaaggcgagcaagggggacugacccucgaagacaaggcccacuucauucagagacagcugguggagacacggcagaucaccaaaaauguggcuggcauucuugaucaacgcuauaacgccaauucuaaggagaagaaaguccagaucauuacgcugaaggccagccucacaucccaguuuagaagcaucuucgggcuguacaaagugcgggaaguuaacgacuaccaucacggccaggaugcuuaucugaauugcguggucgccaccacacuucugaagguguacccgaaccucgcgcccgaguuuguuuauggagaauacccuaaauuccaaaccuuuaaggagaauaaggcuaccgccaaagccauuaucuauacaaaccugcuccgcuucuuuacggaggacgaacccagauucaccaaggacggcgagauccuguggucuaauuccuaccuuaaaacaauuaagaaagaacugaacuaucaccagaugaauaucgugaagaaggucgaggugcagaaagggggauuuagcaaggaauccauuaaaccuaagggccccucuaacaaacucaucccgguuaagaaugggcuggauccucagaaauacggaggcuucgacagccccauuguggcuuacaccguccuguucacacaugagaaggggaagaaaccucuuaucaagcaagagauccugggcauuaccaucauggagaaaacgcgguuugaacagaaccccauucucuuccuggaagagaagggauuucucagaccucgcgugcugaugaaacuucccaaguauacacuguacgaguucccggaaggccggagacgccuccuggccuccgcgaaggaggcucagaaagggaaccagauggugcugccugaacaccuucugacccuccuguaucaugccaagcaaugucuccugcccaaucagucugagagccuugccuacgucgaacagcaccagcccgaguuucaagaaauccuggagcggguuguggauuucgcugaggugcauacccuggccaaauccaagguccagcagauugugaaacucuuugaagcuaaccaaacagccgacguuaaggagaucgcggccucuuucauccagcugaugcaguuuaaugcuaugggagccccuagcaccuucaaguuuuuccagaaagauauugaaagagcucgcuauacauccaucaaggagauuuuugacgccacgaucauuuaccaaagcaccacaggccuuuaugagacccggagaaaaguggucgauuga

SEQ ID NO: 4133 - RNA, 4017 nt, Artificial Sequence
  Cas9 variant
augcaggacuacuaucugggccucgauaucgggaccaacagcgugggaugggccgucacagacgagaauuacaaccugcuuagaaagaaaggcaaggaucuguggggaguuagacucuucaaagaagcucaacccgccacggagcgcagagggcaccgguccucucgcagacggaccauucgcaagagccugagaaaacagcuucugcgggaacucuuugaggaagagaucaaugcgauugacaaggauuucuuucugcgccuggacgaguccaaguauuggcucgaagauaaaaagaucgagggcaaauacucucuguucaacgacgaaaauuuuacagauaaggacuauuacgagaaauucccuaccauuuuucaucuuagaaaggcucugaucgagagcgaugacaaggaagauauccggcucuauuuccuggccauuaaccagaugaugaaacgcagagggcacuuucuuaucgacggaaagcuguccaauguggaggacauuacaccguucaaagaaugcauccagaaccucauuaaugaggaacuggauaccgagaucgagacagaauuuuacgacaaggccauuaaaaucgugucugauuacagccugaagaaaaccgagaagaagaaccucaucaaagaccuggucaaggaaacggauuccauugaggacagcaaaaagaucauuaauaucuucaaccuucugauuucuggcaaauccaaggugaauggcaucuuugaugacgaagagauccucgagaagauuaaagaagauaacaaggaggacuucuaucugaccagcgaaaaauacgaggaaaaucuugaguauuucucucaacugcucgauuaccgguuugagcugaucuccagccugaagucuauuuaugacuacaucauucuccaggaaguucugaaagggaagaaguaucuuuccuacgcucagguggagcgcuacaaaaaccauaaggaagaccugagaaaacucaagcagcugaucaaaaaguaugauaagaacggaaaaaucuacuaucaaauuuuccgggacgagaauuuuaagaaaggcuacgucgccuaucuuggguacuauaagaaaaacaagaaaaaugugcccguuaagaagugugauuacgacacauucagcaaaaacaucaaguccacccuggauaaaauuugcgacaaggaggauccucucuacaucgaacugauugacaaaaucgagaagggaggcuuucugcucaagcagauugugucuacaaauagcgucaucccccaccaggugcaugaacuggagcuugauaaaauccuggaaaaccucgagaagaauuauccuuccuucaaagagauuagcgacggggugucuaagaucgauaaaauuaagaugaucuuuaacuuccggauucccuacuaugucggaccucugaaugacuaccacaaggauaaaguuaacuccaauaccuggaucgugaagaacgaaggcuuugagaaugaaaacauccgcccguggaauuucagcaaaauuguggacgagcacgcuugugaagaggaguuuaucaagcggaugauuaacgaaugcucuuauauccccggcgagaaaguccugccuaagagcucccuucucuacucugaauauauggugcugaacgagcugaauaaccucagaguuaauggggacaagcugaaccccaaaauuaagaaagaaaucguggagaauaucuacaagaaagagcgcaaggucacgcuuaaaaagauucggaacuuccugaucauuaauaacuacguggauagcaagguugaauuuuccggacucagcgacggcaucaaagccaauaugucuuccuauauugauuucgcggagauccuggacgauaacuucgacaauaacaugguggaagaucugaucgagcagauuacaauccaugucgggaaugugaaacuucucaccgagaaaauuagcaacaaguacccuaaucuggaaaagaagcaaaucaacaagauugucaaccugaaauuuaaggacugggccagauucucucgcaaacuccuggugggaaucgagggcacagaaaaggagaccggggaaauuaauaccaucaucggauuucuucgggagacaaacgagaauuucauggaacugauguccaacagauauacguuuagcgaggaaauuuccgagaucaaaaagaaguacauucccaauaaacucucuaagcagaucguugaugaccuguaugugagcccggcugucaaaaagaugauuuggcaagugcugaacaucaaugaugaacuuaucaaaguucucggcaagcagccuaagaaaauuuucaucgagauggcccgcggcaaggaggaaaaacccgaggugaaggacucccggaaaaacaagcugauugaacuguacaagaaucucgggaaagagggaaaggaauggcugaacagaaucgaggauaaaaccgaggcugacuuucgcaaucgggcccuuuaucuguacuacacacagaugggcagauguauguauaccggggaaauuaucgacaucgagcggcucuacgauaaggaacuguaugaccuggaucacauuaucccucgcaaaaugaagaaagacgauucuauucauaagaaccuuguccucgugacaagaaauagcaaccaguacgagaagaaagacaauuaucccgugcccgagguuaucaagucccgggaaaacgucagacaccugugguacgcgcugaaaaagaaaggacucauuaccgaggaaaaguauaaccgccugacgcggaucaauccucuuagcgauaaggagcugucugaguucauugaaagacagcucguggagacacgccaaaccaccaaaguggucaaggaccuguuugaaaacuacuacacagauuccaaaaucgugaccguuaaggccggccuggugagcgagcuuagacgggacuucgaaguccugaaaugccgcgagaucaaugaucucaaccacgcucaugacgccuuucugaauauuaucgugggggacguuuggucuaagaaguucacauccaacccguauaauuuugugaaaaagaacagagaaaaauacacgcucaauaacauuuucaccaagaaucagaaagaucugcggggcaacgagaucuggaauugugcugagggaaagaagcgcauuaucaaaacacuuaacaagcccagcguccuguucucuguggaaaauuuugagcagaccggccaacucuucgaccagaacaucauugggaaacaggauuauaaggaaaagacaagcuacguuccuaucaagggagacgagagacugcaggauauuuccaaauauggcggguaccggggaaucagcggcgccuacuuuuucauuguggaacacaccgagaagaauaagcgcgucaaaacgaucgagucucugcccaucuauaugaaguccuacguggaagagaacgggcuucuggacuuuugcaccaacgaaaugaaacucguggauccuaagauuaucgucaaaaagcugaauuauaagagcgagauuaucguugacggcuucaaauaccucauuuccggaaagacagagaacagacugucucuugaaaccaaugaguaucuguacuggaaccauacacagaccacggauaucaaaaagauucucaauaucaacgagaaaaucgaacuggaaaaguauaauggcgacauugagagcgagcgggaaaacaucauuaaguacauccaaauuauccuggagaaauuuaaacuuaaacccuucaucaagcgcagaaaucugccgaacauugaaaucaauuuugccgauuaugagacagaaaaacuccugcagcuccuggugaaccuuauuccucugaccacaaaguacgugucccccgucgaccugaccgugaucucugggagcaaguacgcuggaaaaguucucauuccuaagaaaaucuccaaucugaacgaggugaucuucauuucuaagagcaucaccggcauuuaugagucccggagacgcaucauuuga

SEQ ID NO: 4134 - RNA, 4017 nt, Artificial Sequence
  Cas9 variant
augaagcaggaguacuuccugggccucgacauggggaccggaagccugggcugggccgugacagauuccacguaucaagucaugagaaaacacgggaaggcucuuuggggaacccggcuguuugaaucugccagcacagcggaggaacgcagaauguuccggaccgcucgcagacggcucgaccgcagaaacuggcggauccagguucugcaggagauuuucuccgaagagaucucuaaaguggaucccggcuucuuucuucgcaugaaggagagcaaauacuauccugaagacaagagagaugccgaggggaauugcccggaacugcccuacgcccucuucguggacgauaacuauacagacaagaauuaccauaaagauuauccuaccauuuaccaucugcggaagaugcugauggagacaaccgagauccccgacauucgccucgucuaccuggugcuucaccacaugaugaaacauagaggacacuuucugcucuccggcgauaucucucagaucaaggaauuuaaaagcacguuugagcaacugauucagaacauccaggacgaagaacuugaauggcacauuucccuggaugacgcugccauccaguucguugagcaugugcucaaggaccggaaucugacccgcagcacaaagaaaucuagacugauuaagcaacucaacgcuaaauccgccugugagaaggcgauccugaaucuucugagcggcgggaccgucaaacucucugauauuuuuaacaauaaggaacuggacgaguccgaacggccuaaagugagcuucgccgauucuggauaugacgauuacaucggcaucguugaggcugaacuugccgagcaguauuacauuaucgcuuccgccaaggcgguguaugacuggagcguccugguggagauucucgggaacuccgugucuaucagcgaagccaagauuaaagucuaccagaagcaccaggcugaucugaaaacacugaagaaaaucguuagacaauauaugaccaaggaggacuacaagcgcguguuuguggauacggaagagaaacucaauaacuacuccgccuauaucggaaugacaaagaaaaauggcaagaaagucgaccuuaagagcaagcagugcacccaggcugauuucuacgacuuccugaaaaagaacgugauuaaaguuaucgaccauaaggaaauuacacaagagaucgagucugaaauugagaaagaaaauuuucugcccaaacaggugaccaaggauaacggggucaucccuuaucaggugcacgacuacgagcucaaaaagauccuggauaaccuuggaacccggaugccguucauuaaagagaaugccgaaaagauccagcaacuguuugaguuccgcauucccuauuacguuggcccucucaacagaguggacgauggcaaagacgggaaguuuacaugguccguccggaaaagcgaugccagaaucuaucccuggaauuucacggaagugauugacgucgaggcuucugcggaaaaguuuauccgccggaugaccaacaaguguacauaccuggugggagaggauguucugccuaaagacagccucguguacuccaaguucaugguccugaaugagcuuaacaaucugagacucaacggcgaaaagauuucuguggagcugaagcagcgcaucuaugaggagcuguuuugcaaauaccggaagguuaccagaaagaaacuugaacgcuaucucgugaucgaggggauugccaagaaaggagucgagaucacaggcauugauggggacuucaaggcuagccugaccgccuaccacgauuuuaaagaacggcugacggacgugcagcucucccagagagccaaggaggcuaucgugcugaauguuguccuuuucggagacgauaagaaacugcucaagcaacggcugagcaaaauguaucccaaccugacaaccggccagcuuaagggcauuuguucucucuccuaccagggguggggacgccugagcaaaaccuuucuggaagagaucacagugccggccccuggcaccggggaaguguggaauaucaugacagcgcucuggcagacgaacgacaaucugaugcaacuucugucuagaaacuauggauucaccaaugaggucgaggaguucaacacacucaagaaggaaaccgaucuguccuacaaaacaguggacgaacuguacguuagccccgcugugaagcggcagauuuggcagacccuuaaagucgugaaggagauccagaaaguuaugggcaacgccccuaagagaguguuugucgagauggcccgcgaaaaacaagaggggaagcgguccgauucuagaaagaaacagcucguggaacuguaucgcgcuugcaagaaugaggaaagagacuggauuacggagcugaacgcccagagcgaucaacagcuccgguccgacaaacuguuccuuuacuauauccagaagggccgcuguauguacucuggagagaccauucagcuggaugaacucugggacaauacaaaauaugauaucgaccauaucuacccccaaagcaagaccauggaugacucccugaacaauagaguucuggugaagaaaaacuauaaugcuauuaagagcgacacauacccccuuucucucgauauccagaaaaagaugauguccuuuuggaaaaugcugcagcagcaaggcuucauuaccaaggagaaguacguccggcuggugcgcagcgacgaacucucugccgaugagcuggcgggguuuaucgaaagacagauuguggagacgcggcaguccacaaaagccgucgcuaccauccuuaaggaggcccugccugacacagaaaucguuuaugugaaagcuggaaacgugagcaauuuccgccagaccuacgagcuccugaaggucagagaaaugaacgaucugcaccaugccaaagacgcguaucuuaauauugugguuggcaacgccuacuuugugaaguucaccaagaaugcugccugguuuauccggaacaauccggggcgcucuuauaaccugaaaagaauguucgaguuugauauugaacggagcggagagaucgcuuggaaggccggcaacaaaggguccauugucacagugaagaaaguuaugcaaaagaauaacauccucgugacgagaaaggccuacgaggucaaaggcggacuguucgaccagcagauuaugaagaaaggcaaggggcaagugcccaucaaaggaaaugaugaacgccucgcugacaucgagaaguauggcggguacaacaaagcggccggaaccuacuuuaugcugguuaagagccuugauaagaaaggcaaggaaauucggacaaucgaguucgugccucuguaucucaaaaaucagauugagaucaaccacgaaucugcuauucaguaccuggcccaggagagagggcuuaauucccccgaaauccugcugagcaagaucaaaauugacacccucuucaaggucgacggcuuuaagauguggcuguccggacgcacaggcaaccaacucaucuucaaaggggccaaucagcugauucuuucucaucaggaggcugccauccugaagggaguggugaaauaugucaaccggaagaaugaaaacaaagaugcgaagcucagcgagagagacggcaugaccgaggaaaagcugcugcagcuuuacgauacguuucuggacaaacucuccaauacaguuuauucuauucgccugagcgcucaaaucaagacccucaccgagaaacgggccaaguucaucgggcuguccaacgaagaucagugcauugugcuuaaugagauccugcacauguuucagugucagucuggaagcgccaaccugaaacucauuggcgggccuggcuccgcuggaauccuggugaugaacaauaacauuacagccugcaagcaaaucagcgucauuaaucagucucccaccggcaucuacgaaaaggagaucgaccuuauuaaacuguga

SEQ ID NO: 4135 - RNA, 4017 nt, Artificial Sequence
  Cas9 variant
augaccaagcccuacagcaucggccuggacauugggacaaacuccgugggaugggccgucguuacggauggcuauaaagugccugcuaagaaaaugaaggugcucgggaauaccgacaaaucucacaucaagaagaaccugcuuggagcccuucucuucgauagcggcaauacagcgaaagacagacggcugaagcgcaccgcuagacggcgcuacacaagacggcgcaaccggauucuuuaucugcaggagaucuuugccgaagagauggccaaagcugaugaauccuucuuucaaagacucaaugagucuuuccugaccaacgacgauaaggaauuugacagccauccgauuuucgggaauaaagccgaggaggaagcucaccaucacaaguuucccacaaucuuccaucugcgcaagcaccucgccgauuccaccgagaaaucugaccugagacuuaucuaccuggcgcucgcccacaugauuaaguuucggggacauuuccugaucgaaggccagcuuaaagcugagaacacgaauguccagacccuguuugaugacuucguggagguuuaugauaagacaguggaagagagccaccucuccgaaauuagcgucucuuccauccugaccgagaaaauuagcaagucucgcagacuggaaaaccucaucaaauacuauccuacagagaagaagaauacccuguuuggcaaccuuauugcccugucccucgggcugcagcccaauuucaaaacgaacuucaagcugagcgaggacgcuaaacugcaauuuucuaaggacacauacgaagaggaucucggagaacugcugggcaaaaucggggacaauuacgccgaucucuucaucuccgcgaagaaccuguaugacgccauucuucugagcggaauccucaccauugaugacaacacaaccaaggcuccucuguccgccucuaugaucaaacgguacgaggaacaucaggaggaucuugcucagcugaagaaauuuauucgccagaaucuccccgaccaauauagcgagguguucuccgauaagaccaaagacggcuacgccggguauaucgauggaaagacaaaccaggaagccuuuuacaaguauaucaaaaauaugcugagcaagacggagggcgcugacuacuuccuggacaaaauugauagagaagacuuucuccggaagcagagaaccuucgauaacggcucuguuccucaccagauccaucugcaagagaugcacgcgauucuucgccggcagggggaauacuauccguuucugaaagagaaucaggacaagaucgagaagauucucacauucagaauccccuacuaugugggaccucuggcccgcaaaggcucccgguuugcuugggccgaauacaaggccgauaaaaaggucacccccuggaacuucgacgauauccuggacaaagaaaagagcgcugaggaguuuauuacaagaaugacccuuaaugaucucuaucugccugaggaaaaagugcugcccaagcacucucucguguacgagacguucaacgucuauaaugaacugacaaagguuaaauacgugaacgagcaagggaaggccaucuucuuugacgcgaauaugaaacaggaaauuuucgaucauguguuuaaggagaaccgcaaagucaccaaggacaaacuucugaauuaccucaacaaagaguucgaagaguuucggaucgugaaucugaccggacuggauaaggaaaacaaggcuuucaacagcucccuuggcacauaucacgaccucagaaagauucuggacaaaucuuuucuggaugacaagguuaaugagaagaucauugaagauaucauccagacccucacacuguucgaggaccgcgagaugauucggcagagacuucaaaaauacagcgauaucuuuacgacccagcagcugaagaaacucgaacgccggcauuauacaggguggggaagacuguccgccaagcugauuaacggcauccgggacaaacagagcaauaagaccauucuuggcuaccucaucgaugacggguauucuaaccgcaauuucaugcaacugaucaacgaugacucccugccguuuaaggaggaaauugccagagcucaggugaucggagagacagaugaccucaaucagcuggucagcgauauugccggcucuccugcuaucaaaaaggggauucuucagucccugaaaaucguggacgaacucguuaaggugaugggacacaaccccgccaauaucgucauugagauggcgcgggagaaccaaaccacggccaaaggcagacgcagcucccagcagcgguacaagagacuggaagaggcuaucaaaaaucuggaccacgaucuuaaccauaagauucucaaggaacacccuaccgacaaucaggcccugcaaaacgaucgccuguuccucuauuaccugcagaaugggagagacauguacacagaggauccccuugacaucaaccggcugucugauuaugacauugaucauaucaucccccagagcuuuauuaaagacgauuccaucgacaacaaggugcucgucucuagcgcuaaaaaucgcggcaaguccgacaacgugccuagcgaggauguugugaauagaaugcggccguucuggaacaaacugcugucuugcggacuuauuucccaacgcaaguacagcaaucugaccaagaaagaacucaagcccgacgauaaagccggcuucaucaagagacagcuggucgagacacggcagauuaccaaacacguggcgcagauccucgacgcccgcuuuaacacgaagagagaugaaaauaagaaaguuauucgggacgugaagaucaucacacugaaaucuaaccuugucucccaauuccgcaaggauuuuaaauucuauaaggugagagagauuaaugacuaccaccaugcucacgaugccuaucugaacgcugugaucgggaaggcccuccuggacguuuacccucagcuggaacccgaguuugucuauggagaguacccucauuuccacggcuacaaagaaaauaaggccaccgcuaaaaaguuuuucuauagcaacauuaugaacuuuuucaaaaaggaugacauccggacagaugagaauggggaaauuguguggaagaaagacgagcauaucucuaauaucaagagagugcuuagcuacccccaggucaacauugugaaaaagguugaaauccagaccgugggacaaaacggcgggcuguuugacgauaauccgaaauccccucucgaggucacccccagcaagcuggugccucucaaaaaggagcugaaccccaagaaauauggcggauaccagaagccuacaacggcguaucccguucuucugauuaccgacacaaaacagcucaucccgauuucugugaugaauaagaaacaguucgaacaaaacccugucaaguuccugcgcgaucggggcuaccaacagguggggaagaaugacuuuaucaaacugcccaaguauacccuuguugauaucggagacggcauuaaaagacugugggccuccagcaaggagauccacaaagggaaccagcucguggucuccaagaagucucagauucugcucuaccacgcucaucaccuggauagcgaccuuuccaaugauuaccugcagaaccauaaucagcaauucgacgugcuguuuaacgaaaucauuucuuucagcaaaaaguguaaacucggaaaggagcacauccagaaaauugaaaauguguauuccaacaagaaaaauucugccagcaucgaggagcuggccgaauccuuuaucaaacuucugggcuucacacagcucggggcuaccagccccuuuaacuuccugggcgucaagcucaaucagaaacaauacaagggaaagaaggauuauauucugccuugcacggagggcacacuuauccgccagucuauuaccgggcuguacgaaacccggguugaccuguccaaaaucggagaggauuga

SEQ ID NO: 4136 - RNA, 4017 nt, Artificial Sequence
  Cas9 variant
augagagacuacuauaucggccuggaucucgggaccggaagccugggcugggccgugacagaccgggaguacgaaauuaugcgcgcucacgggaaggcccuuuggggagucagacuguucgauuccgcgaacacggcugaggaacggcgcggcuuuagaaccgcccggcgcagacucgaccggcgcaauuggagaaucgagcugcuucaggaacuguucggggaggauauuggaaaaguugacucuggcuuuuuccuccggaugaaggagagcaaauauaugcccgaagauaagcgcgacgugaacggcaauugcccuaaacugccguacgcccuguuuguggaggauggguauacagacaaggauuaccauagacaauuccccaccaucuaucaccuccggaaguggcugauggaaacagaggagaccccugacauucgccuugucuaccuggcucuccaucacaugaugaaacauagaggacacuuucuguucuccggcaacaucgaaaagaucaaagaguuucaggaaacauuccggcaguacauugggaagaucagagaggaagaacuugauuuucaccuguguauugagggagaagaacuccgcgaaaccgagaauauccugaaagacaagaaccugacgcggucugccaagaaaaccagacucauuaagcugcuuggcgcucauacagccugcgaaaaagcggcccugaaucucguggcugggggaaccguuaagcugagcgacaucuucggcaacuccgagcuugaugccugugagaaacccaagcugucuuuugcugacgccggcuaugaugacuacgcggggaugauugaagaugagcucggagaacagcacgugaucaucgagacagccaaagcugucuaugacuggagcgugcuggccgauauucugggcgacuaccgcugcaucuccgaagcuaaggccgccguuuaugagaagcaucaaaaagaucuccggcaccugaaggagcuugugaaagaaaaucuggggagagacgucuacaaggagguguucgugaaaaccaacgaaaagcucccuaauuauagcgcuuacauuggaaugacgaagaaaaacggcgucaagucugagauggaggggaaacgcugugaucggaaggcguucuacgacuaucugaaaaagacaguugugaaugccauccccgacgaauccaagaccgaguaccuuagaaaagaaauggagacagaaaccuuucugccucgccaggugaccaaggauaacggagucauuccgcaccaggugcaucuccaggagcuggacgcuauccuggagaaucucagcggccggauccccgcccugaaagaaaacggcucuaagauuagagauaucuucacauuucgcauuccuuauuacguugggccccuuaacggaaucgugaaaggcggggagcggacgaauugggucagacggaagaaggccggacgcauuugcccuuggaacuucgacgaaaugguggauaccggcgcuuccgccgaggaauuuaucagacggaugacaagcaaauguaccuaucugauccacgaggacguucuccccaaaaauucuaugcuguacuccaaauucauggugcugaacgagcuuaauaacgucagacucaauggggaaccgauuagcguggagcugaagcaaaagacauaugaagaucuguuucagcgccaucggaaggucaccagacgcagacucacggacuacauccggcgcgagggcauugcgggaagagaugcugacaucacaggcauugauggggacuucaaaggaucccugaccgccuaccacgauuuuaaggaaaaacuuaccggcugcgagcugucucaggccgacaaagagaacaucauucucaauaucacacuguucggggaagacaaggcucugcuuaaaaagcggcucggagcccuguauccugcucugaccgagccccagaaaaaggccaucugugcgcucagcuacaagggcugggggcgccugucccaaagacuucuggaaggcauuacagccccugcucccgagacgggagagaucuggaccgugauucgggccaugugggaaacaaacgauaaucucaugcagguucugagcgagaaauauugcuuugcugccgcgaucgacgaagagaacgccggcgaggagcugaaggagauuaccuacaaaacaguggaacagaugaaugucucucccgcugugcgcagacaaaucuggcagucccuucagguuaucaaggagauuuguaaagugaugggagggccuccgaagcgggucuucguggaaauggcccgcgagaagauggaaagcaaaagaaccgagucucggaagaaaagacucaucgaucuguauaagaaaugccgcgaggaggagcgggacuggauugaggaacugggcaacacggaagagaccagacuccgcagcgauaagcuguaccuuuauuacacacagaaggggcggugcauguacuccggagaggugaucgaacuggaggaacucugggacaauagaaaauaugauauugaccauaucuacccccaaucuaagguuauggaugacagccuggauaaccgcguccuggugaaaaaggaguauaacgcugacaaaaccgaugaguacccuauccgggccgacauuagaggcaagaugcgcgccuuuuggcggauccuuagagaagagggguucauuuccaaagaaaaguauaaucggcucacacgcggcaccggauucgagcccagcgaacuggcuggcuuuaucgcgagacagcugguggagacgcggcaggggacaaaggccgucgcuucugugcucaaacagguuuucccugagaccgacauuguguacgccaaggcccgcgucgcuucccaauuuagacaggaguucgaucugaucaaagugcgggaaaugaacgaccuucaccacgccaaggaugcguauguuaauaucguggucggaaacguguacuacacaaaauuuaccagcaaugcugccugguauguuaaggaacaucccggcagaucuuacaaccugaagaaaauguucaccuccgagcgcgacguggcccggaauggggaaacagcuuggagagccggaaacagcggcacgauugcgaccgucaagcgcgugauggggaaaaauaacauccucgugacacggagauccuaugaggucaagggcggacuguuugaucagcagcugaugaaaaagggcaaggggcaaguuccgauuaaaggacgcgacgagcggcuugcugauaucgacaaguacggcggguauaauaaagccgccggaaccuacuucaugcuggcugaaucugaggauaagaaaggcgccaagauuagaagcguggaauaugugccucucuaccuguguaacugcaucgagaaggacgaagaggcugccaaaaaguaccuccagaaagagcgcggccugaagaaucccagaguccuuauugcgaaaaucaagaucgauacacuguuuaagguggacggguucuauauguggcucuccggacggaccggcaaccagcugauuuuuaaaggggccaaucagcugauccuuucugaaccugacaugcgcauucugaagaaaguucucaaguacgugaacagaaagaaggagaacaaaaaugcuguccugggagaacacgaucaacuccccgagacggaccugauccggcuuuaugauguguuccuggacaagauugagaacacaguuuaccaugugcgccucagcgcccagcagggcacccugaccaagaauaaagauacauuuugugaacuguccaacgaggacaagugcaucguccuuagcgaaauccugcacauguuccaaugucagucuggguccgcuaaucucaaacugauuaagggaccuggcagcgccggcauccucgugcugaacaauauuaucucuaaaugcaaccagguuuccauuauccaccagagccccaccgggaucuaugagcaagaaauugaucuuaagaagaucuga

SEQ ID NO: 4137 - RNA, 4020 nt, Artificial Sequence
  Cas9 variant
augaacaaggccuacacccugggccucgacaucgggacaaauagcgugggaugggcugucguuacggaugacuauagacugauggccaaaaagaugcccgugcacuccaaaauggagaagaaaaagauuaagaaaaacuucuggggcgcgcggcuuuuugaugaagggcagaccgcugaggaacgcagaaauaagcgggccacacgcagacggcugcgcagacggaaauaccgcauccucgagcugcaaaagauuuucucugaagagauccuuaaaaaggacagccacuuuuucgccagacuggaugaguccuuucucauuccugaagacaagcaguaugcucgguucccgaucuuucccacccugcuggaggaaaaagccuacuaucagaacuacccuacaaucuaucaccuccgccagaagcuggcugauucuaccgagaaagccgacauuagacuuguguaccuggcgcucgcccauaugaucaaguaccggggacacuuccuguuugagggcgaacuugauacagagaauaccagcgucgaagagacguucaaagaauuuauugacaucuauaacgagcaauucgaggaagggauuaucuuuuacaaggauauuccccugauccucaccgacaaacuguccaagucuaagaaaguggagaagauccugcaguauuacccuaaagaaaagacaaccggaugccucgcucaguuccugaaacuuauuguuggcaaucagggcaacuucaagcaagccuuucaucuggaugaggaagugaagauccagauuagcaaagagacauaugaggaagaccucgagaagcugcuucgcaaauccaaugaagagaugaucgacgucuuccuccaggugaagaaaguuuacgaugcuauucugcugagcgacauccugucuaccaagaugaaggauacgaaagccaagcucuccgcggggaugaucgaaagauaucagaaccacaaaaaggaccuggaggagcuuaaacaauuugugcgggcccaucugcaugaaaaggucacaguguucuuuaaggauagcucuaaagacggauacgcuggcuacauugaugggaagaccacacaggccgacuucuauaaauuucucaagaaagagcugaccggagugcccggcuccgaaccuaugcuugcuaagaucgaucaggagaauuuccugcucaaacaaagaaccccgacaaacggggucauuccccaccagguucaucugacggaguuuaaggccaucauugaccagcagaagcaauacuauccuuuccuggaaaagagcaaggagaaaaugauccagcuccugaccuuucgcauccccuacuaugugggaccucuugcccaggauaaggaaacaucuuccuucgcuuggcuggagcggaaaaccacagaaaagauuaagcccuggaaugcgaaagacgugaucgacuacggcgccagcgcuaccaaguuuauucagagaaugaucaacuaugauacguaccucccgacagagaaaguccugccuaaguacuccaugcuguaucaaaaauacaccauuuucaaugagcuuaccaagguggccuauaaggacgaucgcggcaucaaacaccaguucucuagcgaagagaagcuccggauuuuucaggaacuguucaaaaagcagagacgcguuacaaagaagaagcugcaacacuuucucuccgccaacuacaacaucgaggacgcugaaauccuggggguggauaaagucuucaauagcucuuaugccaccuaccaugacuuucuugagcuggcgaagcccuauacagagaaaauuaucgaacuccuggagcagccugaaauggaggaaauguucgaggauauugugaagaucauuacgaucuuugaggaccgggaaaugguuagaacccagcugaaaaaguaccagcgcauccuuggagaggaaauuuucaaaaagcucgugaagaaaaaguacacaggcugggggcggcuguccaaaagacugaucaacggcauucgcgaucaaaagaccaauaaaacaauccucgacuaucugauuaacgaugacgauuuucccuacaaucggaacagaaauuucaugcagcuuaucaacgacgaccaccugagcuuuaaggaggagaucgcuaaggaacucacccugucugauaaacagagccugcuugaggucguggaagccauucccggauccccugccaucaagaaagggauuuggcaaacgcucaagaucgucgaggaacugauugcuaucaucggauauaaaccgaagaauauugugaucgagauggcccgggagaaccagaccacaaccggcggcaagaaucgcucuaaacccagacucaagagccuggaagaggcucugaaaaacuucgacucccagcuucugaaggaacggccuguugauaaucagagccuccaaaaagacagacuguaccuguauuaccuucagaacgggaaggauauguauacaggagagucucucgacauugaucgccuguccgaauacgacaucgaucauauuaucccccggagcuuuauuguggaccacucucuggauaauaagguccucguguccagcaaagagaacagacugaagaaagacgauguuccugacuccaagguggucaaacgcaugaaggccuacugggagaaacuucugagagcgaaccucaucucugaacggaaauucagcuaucugaccaagcuggagcuuacggacgaugacaaagcccgcuucauccagagacagcugguggaaacacggcaaauuaccaagcauguggcugccauccuccaccaguacuuuaaucagacacaggagcuggaaaaagagaaggauauucgcaucauuacccucaaauccucucugguuagccaauucagacaggucuuuggcauccacaaggugcgggagaucaaccaucaccaucacgcucacgacgccuaucuuaaugcgguggucgcccuggcucuccugaagaaauacccccgccuggccccggaguucguguauggguccuuugcuaaguuccaucuuguuaaagaaaacaaggccaccgccaaaaaggaauuuuacagcaauauucugaaguucuuugagaaagaggaacaguucugugaugagaacggagaaaucuuuugggacaagagaaaacacauucaacagaucaagaaagugauuucuucccaucaggucaauaucgugaagaagguugaggugcagacaggcagcuucuauaaagaaacggucaacaccaaggagaaaccugauaagcucaucaaacggaagaauaacugggacgugacaaaguacgggggcuucggaucucccguuguggcuuacgcggucguguuuaccuaugagaaaggcaagaaucacaaaaaggccaaagcuauugaagggaucacaauuauggagcaagcccuguucgaaaaggauccuaucuccuuucucauugagaaaggauacagcaacgugaaucaguucaucaagcugcccaaguauacccuuuuugaacuggccaacggccagcgcagaaugcucgcuucucaucaggagcugcaaaaagccaauagcuucauucugccugagaaacuugucacgcugcucuaccacgcgaaccacuaugacgaaaucgcuuacaaagauuccuaugacuacguuaacgagcauuuuagcaauuuccaggacauccuggauaaggugauuaucuuugccgaaaaauacacaucugcuccccagaagcucaaccagauuaucgccaccuaugagaagaaucaagaagccgaccggaaaauuauggcgcacuccuucgugaaccugaugcaguuuaaugcucuuggggccccggccgauuucaaguuuuucgacaccacaaucaccagaaaacgcuacacaagccugacggagaucuggcaguccaccauuaucuaucagucugucacaggacuguacgagacccggagacgcauggcugaucucugggacggcgugcaauga

SEQ ID NO: 4138 - RNA, 4020 nt, Artificial Sequence
  Cas9 variant
auggagagauaccacaucggccuggacauugggaccagcuccaucggaugggccgugauuggcgaugacuucaagaucaaaaagaaaaaggggaaaaaccucauuggaacacggcuguuuaaugaaggcgcuacggccgcggagcgcagaggguuccggacccagcgcagacggcuuaaccgcagaaaguggcggcugaagcuccuggaagagaucuuugaucccuauauggcugaagucgacgaguacuucuuugcccgccuuaaaucuagcaaucuguccccuaaggauucuaacaaaaaguaucucggaagccugcuguucccggacaaauccgauucuaauuuuuacgacaaguaucccacaaucuaccaucucagacgggaucugauggagaaggacgaaaaauucgaucuucgcgagauuuaucuggccauccaccauauuguuaaguacagaggcaacuuucucgaaaaagugccugcuaagaauuacaaaaacagcggcgccuccaucggguuccugcuugaggaggugaauagccuguauaaggacauuaucggagaugaaucuauugcuauccucaacuccgagaaauuugaagacgucgagaagaucauucuggacgaagagacccggaaucuggauaagcaaaagagcgugggcaagcuccugguugaggacaaaaagaaaaagaacaucgugacagccuucucuaaggcgauuuuuggguacaaauucaauaucgaagaucuucugcucauugagaacgacgaaaagaauaaacugaccuucaacgaugagaacaucgacgauaucuuuaaugaacuuucccacagccuggacgauaagcagauggaccuccugacaaaaacccgcgagauuuauuucaaguuuaagcugaacaugaucguccccacgggauacacccucucugaguccaugauugaaaaauaugagaugcauaaggcccaccugaaaauguacaaggaguucaucaauacacuuaacaccaaagauagaaagauucugaagaaugcuuauagcgacuacaucaacacagagaaagccaaggcugccaaugcgcaggaaaacuuuuacaaaaccgugaagaaaaucauuaaggacaauaacuccgauacggccaaaaagaucauuguucucaucgacgagggcaauuucaugccuaagcagcggacaggggagaacggagugauuccccaccaacugcaucagaucgaacuugauagaauuaucgagaaucaggcuaaauauuacccuuggcuggccgaagcuaacccggucgagaagaaucgcaaauuugccaaguauaaacucgacgagcuggugaccuuccgggugcccuacuaugucggcccucugaucgauaagacagaaucuaacaagaacgagaaagaaaccaaguuugccuggaugguuagaaaagcuaagggcaccauuacacccuggaauuucgagaaccucguggaccgcacggaaagcgcgaaucgguuuaucaaaagaaugaccuccaaggauacauacauuaucggggaggacgugcugccugccagcucucuucuguaugagaaguucaaaguccucaacgaacugaauaacauuaaggugaaugagaaaaagcuggauaucgaacagaaacaagacaucuaccuuaaccucuuuaccacagcuaagaauguuaccaagaaaucccuggccacguaccugaacugcagcgccgauucuauuagcggacucuccgacggcgagaaguucaauucuagccuguccagcuauaucgaucuuaaagcuauucuggggaacaucguggacgacuguaauaagaacgaagaucucgagaaaauuaucgaguacucuacagucuucgaagacggaaauaucuauaaggagaaacuguccgaaauuagcuggcugaccgaugagcagaucgaaaaacuuucuaacauucacuuuaagggcugggggcgccucuccaaaaagcugcugacccagaucacaaacgagaauggagagcggauuaucgacgcccucuggaacaccagcaauaacuucaugcagaucauuaaugaugaauccauccaagcgaaacuggcugagauuaacggcaaguacgccggcaaaucugaccuugaagauauccugagcgaggccuauacaucuccccagaauaagaaggcuauuagacaggugaugaaaguuguggaggacaucgaaaaggccaugcaaugcgagccgacguccauuagcaucgaauuuacccgcaaaaagcagaaaucccggcucacaaacaccagauacaagaagaucagcgaugucuaugagaaaauugcugacgaagugaucucugaguacgagcugcgcaagcugcaguccgaacuugauagcaaugccaacaauaugcgggacagauacuaucucuacuucaugcagcuggggcgggauauguauacaggagagaaaauuaacaucgacgaacugcaucaacgcuacgacauugaucacauccucccucagucuuuuaucaaggacgauuccauuaauaacagaguccugacccggaaagacgugaauaacaaggaaaagagcgauaaaacggcggccgaccuuuaugcuguugaaaugucugauuucuggagaaagcugcgcaaacagggccucaucaccgagcagaaguacaaaaaccugcugacaaagagcgacuccauugauaaguaugccaaaaagggguuuaucaaacggcaacuuguggagaccagccaggucgugaagcucguugcuaauauucugcaggacaaauacucugauacaaagaucaucgaagugagagccaaacugaacuccaaucuccgcgaggaauacaagcugauuaagaacagagcggucaaugacuaucaccaugccaucgacggauaccuuaccacguucauuggccaguaucuguacaaaacauaucccaagcuccggagcuacuuuguguauaacgauuucaaaaagcuggacuccaauuaccugaaacacaugaagaaguuuaacuuccuuuggcaacugcaggaugacaaaaccaucgauauuuacgacaaugugaacaauaaguuuguucucaacgucccugagaugaaaaaguauauccagaaaauuuacaauuauaaguacaugcuggugucuaaggaagugacaaccaaaaacggggcuuucuaugaucagaccaaguacaaugccaaaacagucaaccucauccccaucaagaaaaauaagcccacgaacauuuauggcggauacaagggcaaagugagcuccuacaugaugcugguuaagauccgcaaaaagaaagaggugauuuauaaguucgucggggugccuagacuuuggaccgacgagcuggaucggcucaaagacacaaccgaacgcaagauccugcugaacgagauugcuaaaaauucucuuagcaagacagaacaagauuuugagguuauccuggacaagguguacuauggacagcucaucauugauggcaaccagaaauacacccugggguccucugaguauaaguacaaugccaugcaacuccaucugagcaaacacgcccuugaaguccuggcuaaggagaacgugaaggacgcggaaaucacggacaaagaucucguuuccguguaugaggaaauucugagcgucgugaauaaguacuucgagcuguacgacaucaacaaauuuagacagaaacuuaaugagggacuggaaauuuuccggaagcucccgguguauaacgucuacgagucuaauaagaucaagcagguuggcaaauuugaagugcugaaccgcauccucauggggcugcaugccaaugcuaugauuacagaucuuaaggugcugggcaucaaaaccaagcugggacagaugcaagucaacggcgggauuaaacucucccccgacgccaagcugaucuaucagagcccuaccggaauuuucucuagagccgugcggguuaaggaucuuggcuga

SEQ ID NO: 4139 - RNA, 4020 nt, Artificial Sequence
  Cas9 variant
augagccugaacaccaauaagaaauacaacaucggccucgacauugggacaacguccgugggaugggccgucaccgaugcugacggccagaagcugcuuaaagccaagaauaaaaaccuguggggaguuucucucuucgaggcggggaagacagcugccgaaagacggggcuaucgcagcaccagacggcgccugaaucacagaaaguuucggcuucgccugcucgaggauauguucgaaaaagagauccuguccaaggaccccucuuucuucauuagacugaaagaagccuuucucagcccuaaggaugagcaaaaacaguucaaggggaacauccuguuuaaugacaaggauuacacagacgcugauuauuacgagcaguauaaaaccauuuaccaucuucgguaugaccugaucucccagcaccgccaauucgauaucagagaaguguaccucgccauucaucaccugaucaaguaccggggacauuuuauuuaugaggaccagacauucaccacggauggcaaccagcuucagcaccacaucaaagcuauuaucaccaugauuaauucuauccugaaccgcaucauuaucccggaaacaauugacaucaauguguuugagaagacccuccuggacagaacaaugaaccggagcuccaaagucaaguuccugauugagcucaccggcgaagauaaacaagacaagccccugcuuaaggagcuguuuaaucucaucguggggcugaaagccaagccugcgagcaucuucgaacaggagaaccuugccacgauuguugaaacaaugaauaugucuaccgaacaggugcagcuggaucuccugacacuggcugacguccucgccgaugaggaauacgaccugcuucugaccgcucagaaaaucuauuccgccauuauccucgaugagagcauggacggauacgaauauuucgcggaggccaagaaagaaucuuaccgcaagcaucaggaggagcuggugcuuguuaagaaaaugcugaaguccaacgcuauuaccaacgaugaaagagccaaauuugaguauuucuacacagacuacaucggcgcuaagagcucuaauuaugaagaguccaaaaucauuaagaaggggcucagcgccgccuacggaaaauauuccaaggaagaacggcuguuuaaacacaucgagcugcuccuggcuaaggaaaacgugcuuacgaccgucgagcaugaucugcucgagaaaaauauuacauucgcgucucugcugccccuucagagaagcucccgcaacgccgugaucccuuaccaagugcacgagaaggagcucgucgcuauucuggaaaaucaggccaccuauuaccccuuucugcucgagcagaaggacaacauccacaaacugcuuacauuccggauuccuuauuacguuggcccgcuggccgaccagaaggauagcgaauuugcuuggauggugagaaaacaagccgggaagaucacccccuucaauuuugaggaaaugguggacaucgaugcgucuuccgaggcuuucauuaaacgcaugacgaacaagugcacauaccucauccaugaggacgucauuccuaaacacagcuuuucuuaugccaaguucgaagugcugaaugagcugaacaagauccggcuugauggaaaacccauugacaucccucucaagaaaagaaucuuugaaggccuguuccuggagaagaccaaaguuacccauacaagccucaagaaguggcuggccgaauacgagcacaugaccguguccgucgugcagggcacacagaaagagacggaauuugcuaccucucuucaggccuuucaucgcuucguuaagauuuuugaucgggagacagugagcaaucccgcuaacgaagagauguucgagaaaaucauuuauugguccaccgucuuugaggacaagaaaaucaugagacgcaagcugagcgaguacccgcaacucacagaacagcaacaggugcaacuggcccagguccgguucagaggguggggacgccugucucagcggcuuauuaauagaaucaagaccccuguguccggcgaugaggaccacaaacucagcaucaacgaaauucuguggcagacgaaugagaacuuuaugcaaaucauucggaacaaggauuaucuguucaaaaagaucauugaggaacaguuugagaaugaaaccgcgcuccugaacaaacagcgcaucgacgagcuugccacaucucccgcuaauaagaaggggaucuggcaagccauuaaaaucguuaaggaacuggagaaagugcuccagcagccugcugagaacauuuucaucgaauuugccagauccgaugaggaaagcaagcgguccacccccagagacaaauucauugagaaggcguacgcccagcugaaaaaggaaacagacaccuuuaaucuggagcaccuuaaggagcucaaacaacgcucuaagcagcugagcucccagcggcuguuccucuauuucauccagaacggaaaauguauguacucuggcgaacaucuggauauugagagacuugacagcuacgaagucgaucacauccugccccaauccuauaucaaggacaauagcauugagaaccucgcucuggugaaaaagguugaaaaucagcgcaagaaagauucucugcuucugaacuccagcaucauuaaucagaacuacucuagaugggagcagcucaagaaugccgggcugaucggagagaaaaaguuucggaaccucacgcgcacaaaaauuaccgacagagauaaggaaggcuucaucgcucggcaacugguggagacacgccagaucaccaagcaugucacccagcuucugcaacaggaauauaaagacacaacgaagguguuugccauuaaagccacccucguguccgaucugagacggaaguucgaguuuaucaaaaaucgcaacguuaacgacuaccaccacgcucaggaugcguuccuggucgccuuucuuggcacaaauauuaccagcaacuauccuaagaucgagauggaauaccuguucaagggguaucagcauuaccucaaugaggugggaaaaucugcugccaagccgaaauuuacauucauuguggaaaaccugagcaagcaacaguacaauuccaccacgggcgaggucaaauggaaccccgaaguggacaucgccaagcucaagagaauccugaauuuuaaacagugcaacauuguucggaagguggaggagcagagcggggcucuuuucaaagaaacaaucuauccugucgaggaaucuuccagcaagaccauuccccugaaaaagcaccucgauaccgccaucuacggaggcuauacagcggugaauuacgcuuccuaugcccugauucaauucaaaaaggggcgcaagcugaaaagagagaucauuggcaucccucuugccguucagacccggaucgacaacucugaaacaagccugcagacguacauugcugagcagaucaaguccgagguggaaauucucaauggaagaauccugaaauaucaacucauuucuaacaauggcaaccgccuguacaucgccgggccccgggagagacauaaugcgcgccagcuuaucgucagcgacgaagcugccaaggugauuuggcugaucuccaccaaacaggccguugaggcuacauuucugaagcacuacacccucgaacaucuggaggccguguucgaggaacuuauucggaagcaggcugccgauuaucaaaucuuugagaaccugauuaaaaagaucgaagucaacaaagcguacuucuauucuuguacauacaaugagaaggugaaagugaucgaggaacuccugaagauuacccaggccaacgcuacgaauggagaccucaagcugcuuaaaaugaccaacagagagggccgccuggggagcgucuccguugcccuggauuuuaagaucauuaaucagagcgugacaggacucuaucaaucuaucgaagacuacaacaauuga

SEQ ID NO: 4140 - RNA, 4020 nt, Artificial Sequence
  Cas9 variant
augagccugaacaccaauaagaaauacaacaucggccucgacauugggacaacguccgugggaugggccgucaccgaugcugacggccagaagcugcuuaaagccaagaauaaaaaccuguggggaguuucucucuucgaggcggggaagacagcugccgaaagacggggcuaucgcagcaccagacggcgccugaaucacagaaaguuucggcuucgccugcucgaggauauguucgaaaaagagauccuguccaaggaccccucuuucuucauuagacugaaagaagccuuucucagcccuaaggaugagcaaaaacaguucaaggggaacauccuguuuaaugacaaggauuacacagacgcugauuauuacgagcaguauaaaaccauuuaccaucuucgguaugaccugaucucccagcaccgccaauucgauaucagagaaguguaccucgccauucaucaccugaucaaguaccggggacauuuuauuuaugaggaccagacauucaccacggauggcaaccagcuucagcaccacaucaaagcuauuaucaccaugauuaauucuauccugaaccgcaucauuaucccggaaacaauugacaucaauguguuugagaagacccuccuggacagaacaaugaaccggagcuccaaagucaaguuccugauugagcucaccggcgaagauaaacaagacaagccccugcuuaaggagcuguuuaaucucaucguggggcugaaagccaagccugcgagcaucuucgaacaggagaaccuugccacgauuguugaaacaaugaauaugucuaccgaacaggugcagcuggaucuccugacacuggcugacguccucgccgaugaggaauacgaccugcuucugaccgcucagaaaaucuauuccgccauuauccucgaugagagcauggacggauacgaauauuucgcggaggccaagaaagaaucuuaccgcaagcaucaggaggagcuggugcuuguuaagaaaaugcugaaguccaacgcuauuaccaacgaugaaagagccaaauuugaguauuucuacacagacuacaucggcgcuaagagcucuaauuaugaagaguccaaaaucauuaagaaggggcucagcgccgccuacggaaaauauuccaaggaagaacggcuguuuaaacacaucgagcugcuccuggcuaaggaaaacgugcuuacgaccgucgagcaugaucugcucgagaaaaauauuacauucgcgucucugcugccccuucagagaagcucccgcaacgccgugaucccuuaccaagugcacgagaaggagcucgucgcuauucuggaaaaucaggccaccuauuaccccuuucugcucgagcagaaggacaacauccacaaacugcuuacauuccggauuccuuauuacguuggcccgcuggccgaccagaaggauagcgaauuugcuuggauggugagaaaacaagccgggaagaucacccccuucaauuuugaggaaaugguggacaucgaugcgucuuccgaggcuuucauuaaacgcaugacgaacaagugcacauaccucauccaugaggacgucauuccuaaacacagcuuuucuuaugccaaguucgaagugcugaaugagcugaacaagauccggcuugauggaaaacccauugacaucccucucaagaaaagaaucuuugaaggccuguuccuggagaagaccaaaguuacccauacaagccucaagaaguggcuggccgaacacgagcauaugaccguguccgucgugcagggcacacagaaagagacggaauuugcuaccucucuucaggccuuucaccgcuucguuaagauuuuugaucgggagacagugagcaaucccgcuaacgaagagauguucgagaaaaucauuuacugguccaccgucuuugaggacaagaaaaucaugagacgcaagcugagcgaguauccgcaacucacagaacagcaacaggugcaacuggcccagguccgguucagaggguggggacgccugucucagcggcuuauuaauagaaucaagaccccuguguccggcgaugaggaccacaaacucagcaucaacgaaauucuguggcagacgaaugagaacuuuaugcaaaucauucggaacaaggauuaccuguucaaaaagaucauugaggaacaguuugagaaugaaaccgcgcuccugaacaaacagcgcaucgacgagcuugccacaucucccgcuaauaagaaggggaucuggcaagccauuaaaaucguuaaggaacuggagaaagugcuccagcagccugcugagaacauuuucaucgaauuugccagauccgaugaggaaagcaagcgguccacccccagagacaaauucauugagaaggcguaugcccagcugaaaaaggaaacagacaccuuuaaucuggagcaucuuaaggagcucaaacaacgcucuaagcagcugagcucccagcggcuguuccucuacuucauccagaacggaaaauguauguauucuggcgaacaccuggauauugagagacuugacagcuacgaagucgaucauauccugccccaauccuacaucaaggacaauagcauugagaaccucgcucuggugaaaaagguugaaaaucagcgcaagaaagauucucugcuucugaacuccagcaucauuaaucagaacuauucuagaugggagcagcucaagaaugccgggcugaucggagagaaaaaguuucggaaccucacgcgcacaaaaauuaccgacagagauaaggaaggcuucaucgcucggcaacugguggagacacgccagaucaccaagcacgucacccagcuucugcaacaggaauacaaagacacaacgaagguguuugccauuaaagccacccucguguccgaucugagacggaaguucgaguuuaucaaaaaucgcaacguuaacgacuaucaccaugcucaggaugcguuccuggucgccuuucuuggcacaaauauuaccagcaacuacccuaagaucgagauggaauaucuguucaagggguaccagcacuaucucaaugaggugggaaaaucugcugccaagccgaaauuuacauucauuguggaaaaccugagcaagcaacaguacaauuccaccacgggcgaggucaaauggaaccccgaaguggacaucgccaagcucaagagaauccugaauuuuaaacagugcaacauuguucggaagguggaggagcagagcggggcucuuuucaaagaaacaaucuacucugucgaggaauccagcuccaagaccauuccucugaaaaagcaucucgauaccgccaucuauggaggcuacacagcggugaauuaugcuucuuacgcccugauucaauucaaaaaggggcgcaagcugaaaagagagaucauuggcaucccccuugccguucagacccggaucgacaacagcgaaacaucccugcagacguauauugcugagcagaucaagucugagguggaaauucucaauggaagaauccugaaauaccaacucauuagcaacaauggcaaccgccuguauaucgccgggccucgggagagacacaaugcgcgccagcuuaucgucuccgacgaagcugccaaggugauuuggcugaucucuaccaaacaggccguugaggcuacauuucugaagcauuacacccucgaacaccuggaggccguguucgaggaacuuauucggaagcaggcugccgauuaccaaaucuuugagaaccugauuaaaaagaucgaagucaacaaagcguauuucuacagcuguacauauaaugagaaggugaaagugaucgaggaacuccugaagauuacccaggccaacgcuacgaauggagaccucaagcugcuuaaaaugaccaacagagagggccgccugggguccgucagcguugcccuggauuuuaagaucauuaaucagucugugacaggacucuaccaauccaucgaagacuauaacaauuga

SEQ ID NO: 4141 - RNA, 4020 nt, Artificial Sequence
  Cas9 variant
augaagaaagaguacaccaucggccuggacauugggacaaacagcgugggaugguccguccucacggaugacuauagacugguuucuaagaaaaugaagguggccggcaauaccgaaaagagcuccacaaagaagaacuucuggggagugcggcuuuuugaugagggacagaccgcugaagcccgcagaucuaaacggacagcgcgcagacggcuggcucgcagacggcaacgcauccucgagcugcagaagauuuucgcccccgaaauccuuaaaauugacgagcacuuuuucgccagacugaaugagagcuuucucguccuggaugaaaagaaacagucccggcauccuguguucgcuaccaucaagcaggagaagucuuaccaccaaacauauccgaccaucuaccaucugcgccaggcccucgcugacagcuccgaaaaagccgauauuagacugguuuaucuugcgauggcccaucugcucaaguaccggggccacuuucugaucgagggggagcuuaacacggaaaauagcucugugaccgagacauuccgccaguuucuguccaccuauaaccagcaauucagcgaagcugacgauaaacagacagagaagcucgacgaagccgucgauugcucuuuuguguucaccgagaaaauguccaagacgaaaaaggcugagacacugcugaaguacuuuccccacgaaaagagcaauggauaccucucucaguucauuaagcugaugguuggcaaccagggcaauuucaaaaacguguuugggcuugaggaagccaagcugcaauucuccaaagagaccuaugaagaggaccucgaggaacugcuugagaagaucggagaugacuacauugaccuguuuguccaggcgaagaauguguaugaugccgugcuccugagcgaaauccuguccgacucuaccaaaaacacaagagcuaagcucagcgccggcaugauucggagauacgaugcucacaaagaggaccugguccuucugaagcgcuucguuaaagaaaaucucccuaagaaguaucgggccuuuuucggggauaacuccgugaauggauacgccggcuauaucgaggggcaugcuacccaggaggacuuuuacaaauucgugaagaaagaacugacaggaaucagaggcagcgaggucuuucuuacgaagauugaacaagagaacuuccugcgcaaacagcggaccuuugauaacggcgugaucccccaccagauucaucucacagagcugagagcgaucauugccaaucagaagaagcacuacccuuuccugaaagaggaacaagaaaagcucgagucucugcuuaccuuuaaaauccccuauuacguugggccucuggcuaagaaacaggaaaacuccccguucgccuggcucauccgcaagagcgaggagaaaauuaagcccuggaaucugccugaaaucguggacauggagggaucugccguccgguucauugaaagaaugaucaacacagauauguauaugccccacaauaaggugcugccuaaaaacagccuucucuaccagaaguuuuccauuuauaaugagcugaccaaaguucgcuaccaggacgaacggggccaaaugaacuauuucucuagcaucgagaagaaagagaucuuucaugaacuguucgagaagaauagaaaggugacgaaaaaggaucuccaggaauuucuguaccuuaaauacgacauuaagcacgcugagcuguccgggaucgaaaaagccuucaacgcgagcuauacaaccuaccaugacuuucucaccaugucugagaauaagcgcgagaugaagcaguggcuggaagaucccgagcuggcuuccauguucgaagagauuaucaaaacacuuaccgucuuugaggaccgggaaaugauuaagacaagacucagccaccaugaggccacgcugggaaaacacaucauuaagaaacugaccaagaagcacuauacaggcugggggcggcucucuaaagaacugauccagggaauccgcgauaagcaauccaacaaaaccauucuugacuaccugaucaaugaugacgauuucccgcaucacagaaaccggaauuuuaugcagcucauuaacgacgauagccuguccuucaagaaagagaucaagaaagcccagaugauuacagacaccgaaaaccuggaggagaucgugaaggaacuuacgggcucuccugcuaucaagaaaggcauucuccagagccugaagaucgucgaugagauuguggggaucaugggauaugaacccgccaauauuguuguggagauggcuagagaaaaccaaaccacaggccgcgggcugaaauccucucggccuagacucaaggcccuggaggagagccuuaaagacuuuggaucccagcugcucaaggaauaccccaccgauaauagcucucugcagaaggaccgccuguaucuuuacuaccuccaaaacggcagagacauguauacaggggcgccccuggauauccaucggcuguccgacuacgauaucgaccacauuaucccucgcagcuucaccacggauaauucuauugacaacaaaguccucguguccagcaaggagaauagacugaaaaaggaugacguuccgucugaaaaaguggucaagaagaugcggagcuucugguaugaucuuuacuccagcaaacugaucucuaagcgcaaacucgacaaccugacaaagauuaaacugaccgaggaagauaaggccggcuuuaucaagagacagcuuguggagacacggcagaucaccaaacacguggcugggauucugcaucaccgcuucaauaaggccgaggacaccaacgaacccaucagaaaaguucggauuaucacacucaaguccgcucuggucagccaguuucgcaauagauucggcauuuauaaagugcgggagaucaacgaauaccaucacgcccaugaugcguaucucaaugggguggucgcccuggcccuucugaagaaguacccucaacucgcucccgaguuuguguacggagaguaucugaaauucaacgcucacaaggccaauaaagccacgguuaagaaagaauuuuacuccaacauuaugaaguucuuugagucugacaccccugugugugacgaaaacggcgagaucuucugggauaaaagcaaguccaucgcucaggucaagaaagugauuaaucaccaucacaugaacaucguuaagaaaacagaaauucagaaagggggauuuucuaaagagaccguggagcccaagaaggacagcuccaaacugcuuccgagaaagaauaacugggauccugcgaaauauggcgggcugggcucucccaaugucgccuacacaguggcuuucaccuaugaaaagggaaaagcccgcaagcggacgaacgcccucgagggcaucacaauuauggaaagagaggcuuucgaacagagcccuguucuguuucucaagaauaaaggguacgagcaagccgagaucgaaaugaagcugcccaaauaugcgcuuuucgagcuggaaaacggacgcaagcggaugguggcuuccaauaaagaggcccagaaggccaacagcuuucuccugccugaacaucuggucacccuucuguaccacgcuaagcaguacgacgagaucucucauaaagaguccuucgauuaugugaaugaacaccacaaggaguuuagcgaaguguucgccagaguccucgaguuugcgggcaaauacacccuggcugagaagaacauugaaaaacucgagaagaucuauaaagaaaaucagacagacgaucuggccaaacuugccucuuccuucguuaaccugaugcaauuuaaugcuaugggggcccccgcugacuucaaguuuuucgaugugaccauuccgcgcaaacgguacacaagccugacggagaucuggcagucuaccauuauccaucaguccaucacaggacucuaugaaacccgcauuagaaugggcaaguga

SEQ ID NO: 4142 - RNA, 4023 nt, Artificial Sequence
  Cas9 variant
augaagaaagaguacaccaucggccuggacauugggacaaacagcgugggaugguccguccucacggaugacuauagacugguuucuaagaaaaugaagguggccggcaauaccgaaaagagcuccacaaagaagaacuucuggggagugcggcuuuuugaugagggacagaccgcugaagcccgcagaucuaaacggacagcgcgcagacggcuggcucgcagacggcaacgcauccucgagcugcagaagauuuucgcccccgaaauccuuaaaauugacgagcacuuuuucgccagacugaaugagagcuuucucguccuggaugaaaagaaacagucccggcauccuguguucgcuaccaucaagcaggagaagucuuaccaccaaacauauccgaccaucuaccaucugcgccaggcccucgcugacagcuccgaaaaagccgauauuagacugguuuaucuugcgauggcccaucugcucaaguaccggggccacuuucugaucgagggggagcuuaacacggaaaauagcucugugaccgagacauuccgccaguuucuguccaccuauaaccagcaauucagcgaagcugacgauaaacagacagagaagcucgacgaagccgucgauugcucuuuuguguucaccgagaaaauguccaagacgaaaaaggcugagacacugcugaaguacuuuccccacgaaaagagcaauggauaccucucucaguucauuaagcugaugguuggcaaccagggcaauuucaaaaacguguuugggcuugaggaagaggccaagcugcaauucuccaaagaaaccuaugaggaggaccucgaggaacugcuugaaaagaucggagaugacuacauugaccuguuuguccaggcgaagaauguguaugaugccgugcuccugagcgagauccuguccgacucuaccaaaaacacaagagcuaagcucagcgccggcaugauucggagauacgaugcucacaaagaagaccugguccuucugaagcgcuucguuaaagagaaucucccuaagaaguaucgggccuuuuucggggauaacuccgugaauggauacgccggcuauaucgaggggcaugcuacccaggaagacuuuuacaaauucgugaagaaagagcugacaggaaucagaggcagcgaagucuuucuuacgaagauugagcaagagaacuuccugcgcaaacagcggaccuuugauaacggcgugaucccccaccagauucaucucacagaacugagagcgaucauugccaaucagaagaagcacuacccuuuccugaaagaggaacaagagaagcucgaaucucugcuuaccuuuaaaauccccuauuacguugggccucuggcuaagaaacaggagaacuccccguucgccuggcucauccgcaagagcgaggagaaaauuaagcccuggaaucugccugaaaucguggacauggaaggaucugccguccgguucauugagagaaugaucaacacagauauguauaugccccacaauaaggugcugccuaaaaacagccuucucuaccagaaguuuuccauuuauaaugaacugaccaaaguucgcuaccaggacgagcggggccaaaugaacuauuucucuagcaucgagaagaaagaaaucuuucaugagcuguucgaaaagaauagaaaggugacgaaaaaggaucuccaggaguuucuguaccuuaaauacgacauuaagcacgcugaacuguccgggaucgagaaagccuucaacgcgagcuauacaaccuaccaugacuuucucaccaugucugagaauaagcgcgaaaugaagcaguggcuggaggaucccgaacuggcuuccauguucgaggagauuaucaaaacacuuaccgucuuugaagaccgggagaugauuaagacaagacucagccaccaugaagccacgcugggaaaacacaucauuaagaaacugaccaagaagcacuauacaggcugggggcggcucucuaaagagcugauccagggaauccgcgauaagcaauccaacaaaaccauucuugacuaccugaucaaugaugacgauuucccgcaucacagaaaccggaauuuuaugcagcucauuaacgacgauagccuguccuucaagaaagaaaucaagaaagcccagaugauuacagacaccgagaaccuggaggaaaucgugaaggagcuuacgggcucuccugcuaucaagaaaggcauucuccagagccugaagaucgucgaugaaauuguggggaucaugggauaugagcccgccaauauuguuguggaaauggcuagagagaaccaaaccacaggccgcgggcugaaauccucucggccuagacucaaggcccuggaggaaagccuuaaagacuuuggaucccagcugcucaaggaguaccccaccgauaauagcucucugcagaaggaccgccuguaucuuuacuaccuccaaaacggcagagacauguauacaggggcgccccuggauauccaucggcuguccgacuacgauaucgaccacauuaucccucgcagcuucaccacggauaauucuauugacaacaaaguccucguguccagcaaggaaaauagacugaaaaaggaugacguuccgucugagaaaguggucaagaagaugcggagcuucugguaugaucuuuacuccagcaaacugaucucuaagcgcaaacucgacaaccugacaaagauuaaacugaccgaagaggauaaggccggcuuuaucaagagacagcuuguggagacacggcagaucaccaaacacguggcugggauucugcaucaccgcuucaauaaggccgaagacaccaacgagcccaucagaaaaguucggauuaucacacucaaguccgcucuggucagccaguuucgcaauagauucggcauuuauaaagugcgggaaaucaacgaguaccaucacgcccaugaugcguaucucaaugggguggucgcccuggcccuucugaagaaguacccucaacucgcucccgaguuuguguacggagaauaucugaaauucaacgcucacaaggccaauaaagccacgguuaagaaagaguuuuacuccaacauuaugaaguucuuugaaucugacaccccugugugugacgagaacggcgaaaucuucugggauaaaagcaaguccaucgcucaggucaagaaagugauuaaucaccaucacaugaacaucguuaagaaaacagagauucagaaagggggauuuucuaaagagaccguggaacccaagaaggacagcuccaaacugcuuccgagaaagaauaacugggauccugcgaaauauggcgggcugggcucucccaaugucgccuacacaguggcuuucaccuaugagaagggaaaagcccgcaagcggacgaacgcccucgaaggcaucacaauuauggagagagaggcuuucgaacagagcccuguucuguuucucaagaauaaaggguacgagcaagccgaaaucgagaugaagcugcccaaauaugcgcuuuucgaacuggagaacggacgcaagcggaugguggcuuccaauaaagaagcccagaaggccaacagcuuucuccugccugagcaucuggucacccuucuguaccacgcuaagcaguacgacgagaucucucauaaagaauccuucgauuaugugaaugagcaccacaaggaauuuagcgagguguucgccagaguccucgaguuugcgggcaaauacacccuggcugaaaagaacauugagaaacucgaaaagaucuauaaagagaaucagacagacgaucuggccaaacuugccucuuccuucguuaaccugaugcaauuuaaugcuaugggggcccccgcugacuucaaguuuuucgaugugaccauuccgcgcaaacgguacacaagccugacggaaaucuggcagucuaccauuauccaucaguccaucacaggacucuaugagacccgcauuagaaugggcaaguga

SEQ ID NO: 4143 - RNA, 4023 nt, Artificial Sequence
  Cas9 variant
augaagaccgacuacuucaugggccuggauauggggacaggaagccucggcugggccgugacggacuccucuuaucaccugugcagagcucaugggaaagaucuuuggggaguccggcuguuugagaccgcccagacagcggaagaacgcagaguuuuccgguguaaccgcagacggcucgaccgcagaaagcggcgcauccaacugcuucaggauauuuuugcucccgaaaucuacaaaauugacccuggcuucuuucugagacucaaggagagccgguaucugccggaagauaaaaagaaucuggaggggaagacccccgagcucccuuacgcccuguucguggacaaaaaguauacagauaaagacuuucacaaggaauaccccaccaucuaucaucuucgccugagacucaugcaggaucggaccccugccgacgugcgccuggucuaccuugcucugcaccaucucauuaaacacagaggacacuuccuguuugccggcaucgaggcugauaaggugacagacuucuccgccgcguuuucugaguuccugcggaucguucaggagcaagagcucgacauuagcuuuacgcccgaugaagaguccucucagaucauuaaggaaacccugcagaacacaaauuucaccagaagcaaaaaguccacagagcuuaucaaaggccugaaggccagcaccgggugcgaaaaagcucuccugaaacuuauuucuggauguaaagugaagcuguccgccgucuucgacgauccuggcugcgacgcuuacgagaagccccagguguguuuugccgagagcucuuaugaagauuacgcggccauccucgaggacgaacuggaggaucgcuucauuguuaucgcugccgcuaaagcccuguaugacugguccgugcucgucaacauccugggggaagccagcacggugucugaggcuaaggugggaauuuacgagaaacaucggagagaucuuaaguaucugaaacaccucgucaagacaaaucugacccgcgaagacuaccaagaucuuuuuguuaaggcgggcgccaaaaagaacaauuauugcgcuuacaucgggaugacaaagaagaacaauaaaaagguggugcuggaggaaaagcgguguaccaaagaggacuucuacgccuaucucaagaaagaaauuuacuccaagguccaggagaacccggaggccgaauaucugcuggaggaacucgagaaaggaaccuuucugccuagacaggugagcaaggacaauggcguuauccccuaccagcuucaauuccuggagcuccagaagauucugaaaaacgcuguggaauaucugccuuuucuuaaggaggaauccgagaaaauccagcaaaucaugacauuccgcauucccuacuaugucggcccgcucaaugggaagaaagaaggacagaacacguuugccugggcggugcggaagaauaacgagccuguuuaccccuggaacuucgaggaagugaucgauaccgaggcuucugccgaacaguuuauuagacgcaugacaaauaaaugcaccuaccugccuggcgaggacguccugcccaaggaaagccuccuguauuccaaguucauggugcuuaacgagcugaauaaccuccggaucaaugggacaaaaauuagcgucgagcugaagcaggaacuguacgagaaacuuuuucaaagauaucgcaaggugucugccaaaaagcuccgggauuaccugguuagaaacggaaucaccgaaaaggacgcugagaucuccggcauugauggggacuucaaaggaacgcugcgggccuaucaugauuucaaggaaaaacucacaggcguggagcugaccgaggcugaaaaggagaccaucauucuuaauaucacacuguuuggcgaagacaaaguccuccugaagaagcgcaugcagagacugcuucccaaccucaccgaggggcagaaaaaggccauugugacacugaauuacagcggauggggccggcugucuagagaguuccucgaagagguucaggcgccuaacccggaaagcggggagauccuguccauuauccgcgcccuuugggaaacgaaugcuaaccugaugcaacuccugucuaaucaguauggauaccaggagauccuggagcagaugcgggccgauuggaccggccacaaacuugacuaccaaacaguggaggaacucuaugucagccccgcugugaagagacagauuuggcagacccuccaggugguuaaagaacugaagaaggucaugggcggggagccuaaacgcguguuucucgaaguggccagagagaagauggaguccggacggacagucagccgcaaaaagcaccugaaagaucuuuaccugucuuguaaguccgaagagagaaacuggcucgcggaacuggaccggcaugaggaacacagcuaucgcucugauagacuguuccuuuacuauacccaaaaaggccggugcauguacugugggaagcccaucgaccugggacaucucugggacgugaauauguaugauauugaccacaucuacccucaguccaagguuauggaugacagcauucgcaacagagugcugacgugccggaccugcaacgccgagaaaacagaucauuacccccucaaggcugagauccgccagaaaaugagaccguuuugggacucccugaaggccggcaauuucaucgaagaggaaaaauggaagcggcuuauuagaucugaggaguuuaccagcacagaacuggcuggguucaucgagcgccaacucgucgaaacccggcaguccacgaaggccguggccgauauucugaaacaggcuaugccugagacagaaaucguuuaugugaaggcgaaaaacgucucugccuuuagacaggacuucaauuuugugaagaaccgcgauguuaaugacuuccaccacgcuaaagaugccuaccugaacauuguggucggaaauaccuauuuugugaaguucacaaagaacgccagcugguucaucgagcggaaucccggcagauccuacaaccuuaaacgcauguuuaccagcgacuaugaugugaugucuaauggggagaucgcuuggaaggccggcaacuccggaaccauuacaacgguccggaaaaugaugaagaaaaauagcguucuguucaccagacgcucuuuugaaguguccggcgggcuguucgaccaacagcugaugaagaagggaaaaggccagguguacgucaagagcggggacgagcggcucagaucuaucgaaaaauauggaggcuacaacaaggcgacaggggcuuacuuuaugcugguggagagcgaaggcaaaaagggaguuaagaaacggaccauugaguucgugccucuuuaucgcaaggccgagcuggaagccuccgaggagaaaaugcucgaauaccugagaacagaaaucggccugaaggagccccauguccuucugcacaaaauuaagaccgauacgcucuuucaggcugacggguucaaaaugcaucugagcggacggacaggcaagcaacucguguuuaagggggccaaucaguuccugguugcggaggauuaugaacgccuucugaaaaaggugggaaaagucaccgagcagcugaagaccaacaaaaacuacaagaucaaugacuaugauggcaucacagaagaggggcucaaggcucuguacucugaguuucuuuccaaacugcagaaggccccuuauggcaacagacucggaacccaagccgaaacacuggagaauggcaaagaaaaguucgacaaacucagccuggagaacaagugucaggugcuuuccgaaauucugcaccuguuccagugcaauucuagcgcugccgaucucuccaagcugggagggcccggccacgggggaauccuuguucugucuaacgagauuacgaaauguaauaagaucagcauuauccaucaauccccggcuggcauuuacgagcaggaaaucgaccucaaaacccuguga

SEQ ID NO: 4144 - RNA, 4023 nt, Artificial Sequence
  Cas9 variant
auggagcaggaauacuaucugggccucgacauggggaccggaagcgugggcugggccgucacagauuccgaguaccacguucugagaaagcaugggaaagcucuuuggggagugcggcuguucgaaucugccagcacggcggaggaacgcagaauguuucggaccucccgcagacggcucgaccgcagaaacuggcggaucgagauucugcaagagaucuucgcugaagagauuucuaagaaagaucccggcuuuuuccuucgcaugaaggaaagcaaauauuacccugaggacaagagagauaucaaugggaacugcccggagcugcccuaugcccucuuuguggacgaugacuucacagauaaggacuaccacaaaaaguuuccuaccauuuaucaucugcggaaaaugcugaugaauacagaagagacccccgauauccgccucgucuaccuggccauccaccauaugaugaagcacagaggacacuuccuucuguccggcgacauuaacgaaaucaaagaguuuggcacaaccuucucuaagcuccuggaaaauauuaagaacgaggagcuugauuggaaucuggaacucgggaaagaggaauacgcugugguugagagcauccugaaggacaacaugcugaaucgguccacgaaaaagacccgccucauuaaagcccugaaggcuaaaagcaucugugaaaaggccgugcuuaaccugcucgcgggaggcacagucaagcugucugacauuuuugggcuugaggagcugaaugaaaccgagagaccuaaaaucuccuucgccgauaacggauaugacgauuacaucggcgaaguggagaaugaacucggggagcaguuuuauauuaucgagacagcuaaggccguuuacgacugggcugugcuggucgaaauucugggaaaauauaccagcaucucugaggccaagguggcgacguacgaaaaacauaaguccgaucuccaguuccugaagaaaauugugcggaaguaucuuacaaaagaggaguacaaggacaucuucgucagcaccucugauaaacugaagaacuacuccgccuauaucggcaugacaaagauuaauggcaaaaagguugaccuccagagcaaaagaugcuccaaggaagaguuuuacgauuucaucaaaaagaacgugcugaagaaacuugaagggcaacccgaguaugaauaccugaaggaggagcucgaacgcgagaccuuucugccuaaacaggugaaccgggacaauggagucauuccguaucagauccaccuguacgaacucaagaaaauucugggcaaccuuagagauaagaucgaccugaucaaagagaaugaagacaagcucgugcagcuguucgaguuucgcauucccuauuacguugggccucugaacaagaucgaugacggaaaagagggcaaguucaccugggcugugcggaaaucuaaugaaaagauuuaccccuggaacuuugagaaugucguggauaucgaagccagcgcugagaaauucauuagacgcaugacaaacaaguguacguaucuuaugggggaagacguucucccuaaggauucccugcuguacagcaaauauauggugcucaaugagcugaacaaugucaaacuugacggagagaaacugucuguggaacucaagcaacggcuguacaccgaugucuuuugcaaauauagaaaggugacaguuaagaaaaucaagaacuaccugaaaugugagggcauuaucuccggcaauguggaaaucaccgggauugacggagauuucaaggccagccuuacagccuaucaugacuuuaaagagauccucaccggcacggagcuggcuaagaaggauaaagaaaacauuaucacaaauauuguccuguucggggacgauaagaaacuccugaagaaacgccuuaaccggcuguacccccagaucaccccgaaccagcucaagaaaaucugcgcgcugucuuacaccggauggggcagauuuagcaagaaguuccuggaggaaauuacagccccugaccccgagaccggggaaguguggaauaucauuacagcucuuugggaguccaacaauaaccucaugcagcugcugucuaaugaguaucgcuucauggaagagguugaaacguacaacaugggcaaacaaaccaagacacucagcuaugagaccguggaaaauauguacgucuccccuagcgugaaacggcagaucuggcagacacugaagauugugaaagagcuugagaagguuaugaaggaaucucccaaaagagucuuuaucgagauggcccgggaaaagcaagaguccaaacgcaccgaaagcagaaagaaacagcugaucgaccucuauaaggccuguaagaacgaggagaaagauugggugaaggaacugggagaccaggaggaacagaaacugcggucugauaaacuuuaccucuauuacacgcaaaagggcagaugcauguacuccggggaggugauugagcugaaggaccugugggauaauaccaaguaugacaucgaucacauuuacccccagagcaaaacaauggacgauucccucaacaaucgcguccuggugaagaaaaaguauaacgcuaccaaaucugacaaguacccucuuaaugaaaacauccggcacgagagaaagggauucuggaaaagccugcucgauggcggguuuauuuccaaggaaaaauaugagcgccugaucagaaauacagaacugucuccggaggagcuugccggauucaucgaacggcagauuguugagacccgccagagcacgaaggcgguggcugaaauccugaaacaagucuuucccgaguccgaaauuguguacguuaaggccggcacagugagcagauuccggaaagacuuugagcuccugaagguccgcgaggugaacgaucuccaucacgccaaggacgcuuaucugaacaucguugugggcaauucuuacuacgucaaauucaccaagaacgccuccugguuuauuaaagaaaauccugggagaacauauaaccuuaagaaaauguucaccagcggauggaauaucgagcggaacggcgaaguggcuugggagguggggaagaagggaaccauugucacaguuaaacagaucaugaauaagaacaauauccuggugacgcgccaggugcaugaagccaaaggcgggcucuuugaccagcaaauuaugaagaaaggaaagggccagaucgcgauuaaggagaccgaugagagacuggccucuaucgaaaaauacgggggcuauaacaaggcugccggagcuuacuucaugcuggucgaguccaaagacaagaaaggcaagacaauucggaccaucgaauuuaucccccuuuaucugaagaauaaaauugagagcgaugagucuaucgcccucaacuuccuggaaaaggggcgcggacucaaagagccuaagauucugcuuaaaaagaucaaaauugacacacuguucgauguggacggcuuuaagauguggcucagcgggagaaccggagaucggcugcuguucaagugugcgaaucagcuuauccuggacgaaaagaucauuguuacgaugaagaaaaucgugaaguuuauucagagacgccaagagaaccgggaacucaaacuguccgauaaggacggcaucgauaaugagguccucauggagauuuacaacacauucguggacaagcuggaaaacaccguuuauagaauccgccuuagcgagcaggccaaaacccugauugacaagcagaaagaauuugagcggcugucucucgaagauaaguccagcacacuguucgagauccuucacaucuuucaaugccaguccucugcugccaaucugaaaaugauugggggccccggaaaggcuggcauccucgugaugaacaauaacauuagcaaguguaauaaaaucuccauuaucaaccagucuccgaccgggaucuucgagaaugaaauugaccugcucaagaucuga

SEQ ID NO: 4145 - RNA, 4023 nt, Artificial Sequence
  Cas9 variant
augggcgaggaauacuuccuggggcucgacaugggaaccggcagccuggggugggccgugacagaugacaaguaucagauccuuagacggcacggaaacgcucuguggggcguccgccucuuugagacggccaauaccgcggaagagagacggauguuccgcacaaacagacggcgccuggauagacaaggguggcggauuaaaauccuucaggaacuguuugcugaggagauuugccgcguugaccccggauucuaccucagaaugaaggaauccaaauauuacccugaggauaagcgggacgccaauggcgaauguccggcccugcccuaugcucuguuugccgaugcucaguacaccgacaaagauuaucaucgcgaguucccuacaaucuaccaccucagaaagaugcugauggagaccgaaacaacccccgacauucggcuuguguaccuggccuuucaucacaugaugaagcaucgcggccacuuccuccugucuggggauaucagccaggugacggaguuuagaaacaccuuccuucaaaugaucgcgaauauuaaauccgaagaacuggacuuuucucucgaaaucgaggagacacagaugggacagauugaagccguccugaaggaucacaaacugacccggagcgagaagaaaagacgccucacacagauccugaagccugcuaccgccugcgaaaaggcuauuuucacgcuucuguccggcgggacagugaaacucucugacaucuuuggaaaggccgagcuggacgaaggcgagcggcccaaaauuagcuucgcggauaacggguaugacgauuacuccgccagcguugaggcugaccuuggagaacaauauuacaucaucgagucugccaaggcuguguaugauugguccguccugagcgacauucucggcgauucuguguccaucagcgacgccaaaguuaagcuguacgaaaaacauaagaaggaucuggccuaucucaaaaagguggucagagagaaucugccucgcgaaguguacaaccagguguucgucaauaccgacgagaaacuuuguaacuacugcgcuuauauuggcauggcgaagaaaaaugggcggaagguugcccuggagggaaagagauguacacgcgaagaguuugaaucuuuccuccggaaaaagaucgugaacaaaauugaggauaaggagauccaggaauaccuguccgaggaaaucgagaaaggcaccuuucuuccgagacaggugaccaaggacaauggggucauucccuaucaaauccaccuguacgaacuccgcaagauuaucgacaaccugagcccucggaugcccuucauuagagauaauggagacaaaaucauccagcuguuuacauuccgcauuccuuauuacgugggcccccucgggaagggagagggcuccgagaaauuuucuugggcuguucggagaacggaugaagccaucuauccguggaacuucaaggacgugauugaugucgaggccagcgcugaaaaauuuaucugccggaugaccaacaaguguacauaccuguacggcgaggacgugcuuccuaaggauagcccccuguauuccaaauucaugguucucaaugaacugaacaaucugaagcucgacgggcagucuguguccgucgagcucaaacaacgcauuuaccaggagcuguuuugccauaccagaaaggugacacagaaaaagcuggucagcuaucucgugcgggaaggaaucaccggcaaaaacguugagauuucugggaucgauggagacuucaaggccagccugacggcguaccacgauuuuaaggaaaaacuuacaggcguggagcugucccagcaagaacaggaggagaucgucagaaauauugugcuuuucggggaagacaagaaacugcugaagcagcgccuugagggccgguucccucagcucacccaaaaacagaucucuguuauugcuacccugagcuauaagggauggggcagacugucccgcgaauuucucgagaacaucacagugcccgcccccgggaccggagaggucuggaauauuaucacagcccugugggaaacgaacgauaaucuuaugcagcugcucuacggcgaguauggguuccagaccgaaaucgaguguuuuaacgcuaaggagaaaaagaaaagccugucuuacgagacaauugaggaauccuacgugagcccuucugugaagagacaaaucuggcagacccugcagguugucaaagagcuuaagaaggugaugcggggagacccgaaacgcguguucauugaaauggccagagagaaucaggaauccaagcggacagagagccgcaaaaagacccuccuggaccuguauaaaaacugcaagaaggaggaacccgaguggaucgcugaacucacggagcaccuggaaaaacuugaugacucccaacugagaaaggauaaacucuuucuguacuauacccagaagggccgguguauguacucuggggagcgcauugagcuggaagaccuuugggauaauacaagauaugacaucgaucauaucuacccucagagcaaaaccauggacgauuccgucgacaaccgggugcucguuaagaaagaguauaaugccaagaagacagauguguaccccauugcggccgacauccgcggcaaaaugucuccuuucuggaagaaacugcuggauaacaagcucauuagcaaaaagaaguacgacagacugguccggaccgaagaacuuacgcccgaggaacuggcuggauuuaucgacagacaacucguggagacacgccaguccaccaaaguuguggccgaaauucugaaggaggcuuucccggauacagaaaucgucuaugugaaagccggcaacguuagcaauuuucggcacauguucgacaucgugaaggucagagagcugaacgaucuucaucacgcgaaagacgccuaccugaauauugugguggggaacgcuuauuacgucaaguuuaauaagaacgccgcuugguucaucaaagagaauccuggacgcucuuauaaccucaagcggauguuugauuacgacauuagacgcaauaacgaaguugccuggcuggccggcuccaccgggaccaucagccaggugaaaaauauggugucuaagaaccauauucucgucacacggaaauccuaugaggugacgggaggccuguucgaucagcaacuuaugaagaaggggaaaggccagguucccgugaagaccagcgacgaaagacugggaaauaucgagaaauacggcggguacaacaaggcuucuggagcguauuucaugcucgucaaaagcaagaauaagaaaggcgaggagcagcgcacaauugaguacgugccuaucuaucugaagcacuacaucgaagaguccaaagaaaacgcccuggauuaucuuaagaacgagcggaaacugaaugaacccgagauucuccuggacaagaucaaaaaggauacccucuuuagaguuaacggguucuacaugugccugagcaagcggacaggaaaacagcuugcuuuuaagggcgccaaugagcugcuccugccugaacccgagacccugcuucugaaaaagauuacgaaauauauccaacgcagaaaggaaaacaaggaccucaaacugacaaagcaggacaauauuaccgagaaagagcuccuggaacuuuacgauguguucaccgagaagcugaaccacucugucuacgccgugugccuggggacacagggcaaaacccucguucagaagaagccggcuuuuguggcccugccugucgaagagaaauguaucgugcuuuccgaaauccugcaucucuuccaaugccagagcggauccgcgaaucugaagcucauuggcgggcccgcuucugccggaauccuguaucuuaacagcaauauuuccgacgccggcgagauccugauuaucaaccagucucccagcgggaucuuugagaaacggauugaucugcuccgccuguga

SEQ ID NO: 4146 - RNA, 4023 nt, Artificial Sequence
  Cas9 variant
augaagaaagaguacaccaucggccuggacauugggacaaacagcgugggaugguccguccucacggaugacuauagacugguuucuaagaaaaugaagguggccggcaauaccgaaaagagcuccacaaagaagaacuucuggggagugcggcuuuuugaugaggggcagaccgcugaagcccgcagaucuaaacggacagcgcgcagacggcuggcucgcagacggcaacgcauccucgagcugcagaagauuuucgcccccgaaauccuuaaaauugacgagcacuuuuucgccagacugaaugagagcuuucucgucccugaugaaaagaaacagucccggcauccgguguucgcuaccaucaagcaggagaagucuuaccaccaaacauaucccaccaucuaccaucugcgccaggcccuggcugacagcuccgaaaaagccgauauuagacucguuuaucuggcgauggcccaccuucugaaguaccggggccauuuucucaucgagggggagcugaacacggaaaauagcucugugaccgagacauuccgccaguuucuuuccaccuauaaccagcaauucagcgaagcuggagacaaacagacagagaagcuggaugaagccgucgacugcucuuuuguguucaccgagaaaauguccaagacgaaaaaggcugagacacuccugaaguacuuuccucacgagaaaagcaauggcuaccugucucaguucauuaagcucaugguuggcaaccaggggaauuucaaaaacguguuuggacuggaggaagaggccaaacuucaauucuccaaagaaaccuaugaggaggaucuggaagaacuccuggaaaagaucggcgacgauuacauugaccuuuuuguccaggcgaagaauguguaugacgccgugcugcucagcgagauccuguccgauucuaccaaaaacacaagagcuaagcugagcgccgggaugauucggagauacgacgcucacaaagaagaucucguccugcuuaagcgcuucguuaaagagaaucugcccaagaaguaucgggccuuuuucggagacaacuccgugaauggcuacgccggguauaucgagggacaugcuacccaggaagcguuuuacaaauucgugaagaaagagcucacaggcaucagaggcagcgaagucuuucugacgaagauugagcaagagaacuuccuucgcaaacagcggaccuuugauaacggggugaucccucaccagauucaucugucugaacucagagccaucauugcuaaucagaagaagcacuaccccuuccugaaagaggaacaagagaagcuggaaucccuccugacauuuaaaaucccuuauuacguuggaccgcuugccaagaaacaggagaacagccccuucgccuggcugauccgcaagucugaggagaaaauuaagccuuggaaucuccccgaaaucguggacauggaaggcagcgcuguccgguucauugagagaaugaucaacaccgauauguauaugccucacaauaaggugcugcccaaaaacucccugcuuuaccagaaguuuucuauuuauaaugaacucacaaaaguucgcuaccaggacgagcgggggcaaaugaacuauuucagcuccaucgagaagaaagaaaucuuucaugagcuguucgaaaagaauagaaaggugaccaaaaaggaucugcaggaguuucucuaccugaaauacgacauuaagcacgccgaacuuagcggaaucgagaaagcguucaacgcuucuuauacgacauaccaugauuuucugaccauguccgagaauaagcgcgaaaugaagcaguggcucgaggacccggaacuggccagcauguucgaggagauuaucaaaacccugacagucuuugaagaccgggagaugauuaagaccagacuuucucaccaugaagccacacucggcaaacacaucauuaagaaacugacgaagaagcacuauaccggguggggacggcuguccaaagagcucauccagggcauccgcgauaagcaaagcaacaaaacaauucuggacuaccuuaucaaugaugacgauuucccucaucacagaaaccggaauuuuaugcagcugauuaacgacgauucccucucuuucaagaaagaaaucaagaaagcucagaugauuaccgacacagagaaccuggaggaaaucgugaaggagcugaccggcagccccgccaucaagaaagggauucuucagucccucaagaucgucgaugaaauugugggaaucaugggcuaugagccugcuaauauuguuguggaaauggccagagagaaccaaacgaccgggcgcggacugaaaucuagccggcccagacugaaggcgcucgaggaaucccugaaagacuuuggcagccagcuucugaaggaguaccccacagauaauucuucccuccagaaggaccgccuguaucuguacuaccuucaaaacgggagagauauguauaccggcgccccucucgacauccaucggcugagcgacuacgauaucgaccacauuaucccgcgcucuuucacaaccgauaauuccauugacaacaaaguccuggugagcucuaaggaaaauagacucaaaaaggaugacguucccagcgagaaaguggucaagaagaugcgguccuucugguaugaucuguacagcucuaaacuuaucuccaagcgcaaacuggacaaccucacgaagauuaaacugacagaagaggauaaggcuggauuuaucaagagacagcugguggagacccggcagaucacaaaacacguggccggcauucuucaucaccgcuucaauaaggcugaagacaccaacgauccuaucagaaaaguucggauuaucacccucaagagcgcccuggucucccaguuucgcaauagauucgggauuuauaaagugcgggagaucaacgaauaccaucacgcgcaugacgccuaucugaauggaguggucgcucucgcccugcuuaagaaguacccccaacuggcuccugaguuuguguacggcgaguaucucaaauucaacgcccacaaggccaauaaagcuacaguuaagaaagaauuuuacucuaacauuaugaaguucuuugagagcgauacgcccgugugugacgaaaacggggagaucuucugggacaaauccaagucuaucgcgcaggucaagaaagugauuaaucaccaucacaugaacaucguuaagaaaaccgaaauucagaagggaggcuuuagcaaagagacaguggagccgaagaaggauuccucuaaacugcugccuagaaagaauaacugggaccccgccaaauaugggggccuuggaagcccuaaugucgcuuacaccguggccuucacauaugaaaagggcaaagcccgcaagcggaccaacgcucuggaggggaucacgauuauggaaagagaggccuucgaacagucccccguucucuuucugaagaauaaaggauacgagcaagcggagaucgaaaugaagcucccuaaauaugcucuguucgagcuugaaaacggccgcaagcggaugguggccagcaauaaagaggcccagaaggcuaacucuuuucugcuccccgaacaucuggucacacugcuuuaccacgccaagcaguacgaugagaucucccauaaagagagcuucgacuaugugaaugaacaccacaaggaguuuucugaaguguucgcgagaguccuggaguuugcugggaaauacacccucgccgagaagaacauugaaaaacuggagaagaucuauaaagaaaaucagaccgaugaccucgccaagcuggcuuccagcuucguuaaccuuaugcaauuuaaugccaugggagcuccggccgauuucaaguuuuucgacgugacaauuccucgcaaacgguacaccucucugacagagaucuggcaguccacgauuauccaucagagcaucaccggccuguaugaaacacgcauuagaauggggaaguga

SEQ ID NO: 4147 - RNA, 4023 nt, Artificial Sequence
  Cas9 variant
auggagcaggaauacuaucugggccucgacauggggaccggaagcgugggcugggccgucacagauuccgaguaccacguucugagaaagcaugggaaagcucuuuggggagugcggcuguucgaaucugccagcacggcggaggaacgcagaauguuucggaccucccgcagacggcucgaccgcagaaacuggcggaucgagauucugcaagagaucuucgcugaagagauuucuaagaaagaucccggcuuuuuccuucgcaugaaggaaagcaaauauuacccugaggacaagagagauaucaaugggaacugcccggagcugcccuaugcccucuuuguggacgaugacuucacagauaaggacuaccacaaaaaguuuccuaccauuuaucaucugcggaaaaugcugaugaauacagaagagacccccgauauccgccucgucuaccuggccauccaccauaugaugaagcacagaggacacuuccuucuguccggcgacauuaacgaaaucaaagaguuuggcacaaccuucucuaagcuccuggaaaauauuaagaacgaggagcuugauuggaaucuggaacucgggaaagaggaauacgcugugguugagagcauccugaaggacaacaugcugaaucgguccacgaaaaagacccgccucauuaaagcccugaaggcuaaaagcaucugugaaaaggccgugcuuaaccugcucgcgggaggcacagucaagcugucugacauuuuugggcuugaggagcugaaugaaaccgagagaccuaaaaucuccuucgccgauaacggauaugacgauuacaucggcgaaguggagaaugaacucggggagcaguuuuauauuaucgagacagcuaaggccguuuacgacugggcugugcuggucgaaauucugggaaaauauaccagcaucucugaggccaagguggcgacguacgaaaaacauaaguccgaucuccaguuccugaagaaaauugugcggaaguaucuuacaaaagaggaguacaaggacaucuucgucagcaccucugauaaacugaagaacuacuccgccuauaucggcaugacaaagauuaauggcaaaaagguugaccuccagagcaaaagaugcuccaaggaagaguuuuacgauuucaucaaaaagaacgugcugaagaaacuugaagggcaacccgaguaugaauaccugaaggaggagcucgaacgcgagaccuuucugccuaaacaggugaaccgggacaauggagucauuccguaucagauccaccuguacgaacucaagaaaauucugggcaaccuuagagauaagaucgaccugaucaaagagaaugaagacaagcucgugcagcuguucgaguuucgcauucccuauuacguugggccucugaacaagaucgaugacggaaaagagggcaaguucaccugggcugugcggaaaucuaaugaaaagauuuaccccuggaacuuugagaaugucguggauaucgaagccagcgcugagaaauucauuagacgcaugacaaacaaguguacguaucuuaugggggaagacguucucccuaaggauucccugcuguacagcaaauauauggugcucaaugagcugaacaaugucaaacuugacggagagaaacugucuguggaacucaagcaacggcuguacaccgaugucuuuugcaaauauagaaaggugacaguuaagaaaaucaagaacuaccugaaaugugagggcauuaucuccggcaauguggaaaucaccgggauugacggagauuucaaggccagccuuacagccuaucaugacuuuaaagagauccucaccggcacggagcuggcuaagaaggauaaagaaaacauuaucacaaauauuguccuguucggggacgauaagaaacuccugaagaaacgccuuaaccggcuguacccccagaucaccccgaaccagcucaagaaaaucugcgcgcugucuuacaccggauggggcagauuuagcaagaaguuccuggaggaaauuacagccccugaccccgagaccggggaaguguggaauaucauuacagcucuuugggaguccaacaauaaccucaugcagcugcugucuaaugaguaucgcuucauggaagagguugaaacguacaacaugggcaaacaaaccaagacacucagcuaugagaccguggaaaauauguacgucuccccuagcgugaaacggcagaucuggcagacacugaagauugugaaagagcuugagaagguuaugaaggaaucucccaaaagagucuuuaucgagauggcccgggaaaagcaagaguccaaacgcaccgaaagcagaaagaaacagcugaucgaccucuauaaggccuguaagaacgaggagaaagauugggugaaggaacugggagaccaggaggaacagaaacugcggucugauaaacuuuaccucuauuacacgcaaaagggcagaugcauguacuccggggaggugauugagcugaaggaccugugggauaauaccaaguaugacaucgaucacauuuacccccagagcaaaacaauggacgauucccucaacaaucgcguccuggugaagaaaaaguauaacgcuaucaaaucugacaaguacccucuuaaugaaaacauucggcacgagagaaagggauucuggaaaagccugcucgauggcggguuuaucuccaaggaaaaauaugagcgccugaucagaaauaccgaacugucuccggaggagcuugccggauucauugaacggcagaucguugagacacgccagagcaccaaggcgguggcugaaauucugaaacaagucuuucccgaguccgaaaucguguacguuaaggccggcacggugagcagauuccggaaagacuuugagcuccugaagguccgcgaggugaacgaucuccaucacgccaaggacgcuuaucugaacauuguugugggcaauucuuacuacgucaaauucacaaagaacgccuccugguuuaucaaagaaaauccugggagaaccuauaaccuuaagaaaauguucacaagcggauggaauauugagcggaacggcgaaguggcuugggagguggggaagaagggaaccaucgucaccguuaaacagaucaugaauaagaacaauauucuggugacacgccaggugcaugaagccaaaggcgggcucuuugaccagcaaaucaugaagaaaggaaagggccagauugcgaucaaggagacggaugagagacuggccucuauugaaaaauacgggggcuauaacaaggcugccggagcuuacuucaugcuggucgaguccaaagacaagaaaggcaagaccauccggacaaucgaauuuauuccccuuuaucugaagaauaaaaucgagagcgaugagucuauugcccucaacuuccuggaaaaggggcgcggacucaaagagccuaagauccugcuuaaaaagauuaaaaucgacacccuguucgauguggacggcuuuaagauguggcucagcgggagaacaggagaucggcugcuguucaagugugcgaaucagcuuauccuggacgaaaagauuaucguuaccaugaagaaaauugugaaguuuauccagagacgccaagagaaccgggaacucaaacuguccgauaaggacggcauugauaaugagguccucauggagaucuacaacacguucguggacaagcuggaaaacacaguuuaucgcauuagacuuagcgagcaggccaaaacccugaucgaccggcagaaggaauuugagagacugucucucgaagauaaauccagcacccuguucgagauccuucacauuuuucaaugccaguccucugcugccaaucugaagaugaucgggggccccggaaaagcuggcauucucgugaugaacaauaacaucagcaaguguaauaagauuuccaucaucaaccagucuccgacagggauuuucgagaaugaaaucgaccugcucaaaauuuga

SEQ ID NO: 4148 - RNA, 4026 nt, Artificial Sequence
  Cas9 variant
augagauuccagaacaagaaaaccggcgacuacuuuguggggcuggauaucggaacaaauagcgucggcugggccguuacgaacgagaaguaugaaauucuccgggcuaaaaaucaccgcauguggggguccagacuguucgaggaaggaaagaccgccgaggaacggcgcgugcauagagcgggccggcgcagacuuaaccggcgcaaugacagacugaugauccucgaggaucuguuugcugaggaaauuucuaaaguggacaaggccuucuaccaacggcuucacgagagccaguaucgccaggaacauaagacagucuccgggcccuacuuucuguucaacgauaaagaguuuaccgacgaggauuaucacaucgacuacccuacaauuuaucaucucagaguggcccugaugaaggcuccggccaaagauguucggcuccuguuccuggcuauccaccacaucauuaaguaccgcggaaauuuucuucaugaaggcgagaccuucaaaacaaccggcgggcugacggacauccuccagagagugcuggccugcaacgaauuuucuggacuuaagcaacacauugaugacaccgcgcuggucaagcuccugacaaauaaaggcaucacccggagcgauauugccaagcagaucuccgagcuggcuacagacaaacucuacagaaagcaggccaaggcuuucgccucucuggugcuugggcugaaggcgaaccucgacgaucuguuuaaugaacccgaguauaaagagcuugacagcgaaauucgcaccguugaguucuccggaaaggaauacugggaggaacgggauaaguaugagccuuaccugggcgagagccucuucgcccuggacggguguaaaacgcuguaugauacacuccugcuuucuaacaucaagcccgacggaaaauaccuguccgaagcuaagguggagaccuuugaaaaacaucacgagcaccucgaaagccugaaggaucuucugaagucuaauaaagcccucuauaacagaguccugcgcgacgaugagaagaaucugaacaacuacaucacauacauuggcaaauccgaguucaauaagcggugcagcagagacgaauuuuauaaauuccucaagcagaccaucaaggauauuucugacaacgagaauaaagcugaaaucgugcaacugauggagcuugacuccuuucugccucuccugcgcgugcgggagaacggcgucauucccuaccagauccaugaagaggaacuggagcagauccuuaauguuagcuccgaaaaguauccuuuccucaacaaagccgaugggucuggauuuaccauugcccagaagauccugaaacugcucacauuccgcauuccguacuuugugggcccccugaauccugcucacaaggacagagauaacggguucgcgugggugguccggaaggcccccggaaaaguguauccuuggaauuuugaggacaagguugauaucagcgcuuccgccacggccuucauugagaaccuuaccaauaaauguacauaccugaucggcgaagacgugcuccccaaguauagccuggcuuacucuaaauuuucccugcuuaacgagcucaauaaccugagauacgaugggaagccgcugagcuaugaaaccaaacaaucuuucaucaaggacugcuucgagaaggaacaucgcaaaaugacagagaagcggauuagagaguuucucaaacaccugggaggcaccgauggcaagggggcccuuacgggacuggacgucgauaucaaaagcgaccucaaguccuaccgggauauggugcgcauucugggcgacggguucgacgaaacaauggcggagagaaucauucgguauguuacccuguuuggagaagcuaagaaagugcuucucucuacccuggagaucgaguucggcgaugaccugagcgauacacagaagaaacagauucucaagcugcaauacagagacugggggcgccuuuccgccacccugcucaaaggcaucaagggagucgccggcgauaauccugaauguagcauccuggagugcauggaacagcagccccugaaccuuauggaggugcucucuucccauaacacauaucuggcugccauugaagaguuuaauaaggagcggacggaaccuaccgacaucgucgauuacaaacugguggacgaucucuauauuagccccgcuguuaagagaucuguguggcagacacugcgcauccuugacgagauuaccaaacugagaggguccguccccaagaaaguguucguugaaguggcccggacaaaccgcgcggagaagaagaaaaccgauagcagaaaggaacggcuccugcaacuguacaaaacgaucaaggacgagggacgcaauuggaccgaggaaaucaaacagagagaugccggcgacuuuaacuccaagaaacuuuuccuguacuauacacagcaggggcgguguauguacucuggagagaagauuaccagcaucggcgaccucuuuacauccaaguaugauauugaccacaucuacccucgcucugucaccaaagauaauagcugggacaaccuggugcucgugaaggcugaacugaauagagagaaaaaggauauuuauccgaucgaaaaagacacgcaagaucggugcaucucccuuuggaagcagcugcucgagcaggggcugauuagcgagcgcaaguacgaaagacugguucggacaacaccccuuaccgccgacgagcuggcugauuucgucaacagacagcucguggaaaccaaucaaucugugaaagccgucaccaaccugcucaagcgccuguauccugacacaacgaucuguuacgugaaagcggagaauguuuccgauuuucggcaggaaagagaguucgugaaacuucgcagccugaacgcccaccaucacgcuaaagacgccuaccucaauauugucgugggcaacguuuaucaugagaaguuuaccaauaacccccggaacuucaucaagaaugcuagaucugacaaaaagcgcccuuacucccugaaccacauguucgauuaucugcuucaggugggaaauaaagaaauuuggaaccccaagacagacaauaaccuggucaaaaagaugaugcggaauaacgaugugcagguuaccagaaugcucguggagcaaacaggcgcccuguacgacgccaccaucuauaaggcuagcgucacgaaaucugaaagcuacgugccgcucaaguccagcgaugcgauccugucugacgugaaaaaguaugggggauuuacauccauuaaaaucgccuacuacagcauuuuccgcuuuuauaagaaaaauuccgaggaguucgaaacccacaucauuucuaucccuguccuuaaagcuggcacccugaacagcaaggaggauuacguugccuauggggaagagauuaugaauaaacagaaguuugaccggguggaacugguguacaaaaagcucugcaugaacucccuggucagaaucaauggagugauguauuaccuuggcgggaaaacaaacaauucucuguauaucgauagcgccauuucccucguucugcccgacaacaucgcuaagaagauuaaagccguggagaaguacaucgcgcgggucgcugagaacggcaauuacaaaccucagcccgaucaagugucuccugaauuuaacaugauuaucuauaaggcccucaccgagaaaaugaagcagcccgccuucguuggacugaagacaaaucgcgaaaacgagcuugaaaaagagacgaccaucacagcuuucauugccaugacccugaucgagcaguguaagaugcugauggaaauucucaaucugcuuacacagcaaaagaccacguacgcgcugaagccgaucggcgugagcgcuuccagaagcacccucgggaugaacauuacaggacugucugaguuuaccaucaucacacaguccgucaccggccuccaggaaaaagagauucggaucauuuga

SEQ ID NO: 4149 - RNA, 4026 nt, Artificial Sequence
  Cas9 variant
auguggggcagcagacuguucgaggaagccuccaccgcucaggaccggcgcgagcacagaucuaaccggcgcagacucgaacggcgcaaguacagacuggaucuucuggaggaacucuuuguggaggagaucaauaaaauugaccccgaguucuuuauccggcugcgcgagagcaaguuccauuuugaagauagaucccuuaaaaacacauucauucuguuuaaugacaagauggaagggggauauaacgauaaagucuucuuuucuaaguacccuacgaucuaucaccuccggagcgcccugauuaauggcaacaaggaggacguucgcgcgguguuccuggcuauccauaauauccucaaaaacagagggcacuuucugcuugccggaaaugauauuaacaucucccugucucucaaugacacccugacagaucuuuucgaauaccugaagauucaucucggcaucgagguggaauuugagaacaaacugaaggacauugaaaagaucgcccuggauaagaaucucagcaaguccgacaaacaaaagaaaauuguccagcugcuugagaccgauuauaagaaacagcuggcugacguguucaagcucagccuggggcuuacagccaacauggagaauaucuucggaaaagaaaacgagcagggccuggaauuuaucaacgcugagaauaagauuaagaaaauccaauucgacucuuccuacgaagagaacauugccgaguuugaucaguucuauggcgaauacuuugagaucauugacaucugcaagaaaaucuacgaugcgauuagccucucucagauccugguugacgggaagggacuguccgaaagcaaagugcucucuuaugagaagcacaaggaagaucugaaacuucugaagaaaguccucaagaauauugacaaagccuacgauaacaagggcgaggaccggcugguguauaagguucuuaaagaggauaaggacaaagggaccaauuacgugaacuauuccaagcugagcaauaacggaacagcuaccacgaaagaagaguucuacaaguuucucuccaagaaucuggaucugaaaaaguucggcaaacucaacaaggaagacaucgagacccuggacuauauuaauucugagauccuucuggggcgcuuucucccgcugcagaaagaaaagaucaacggagucauucccuaccaacugcagaugaaagagcuuacacagauccucaauaacgccagcaaguaccugccuuuccugaauaagauugaagauggcaugaccgugaaagacaagaucauuucccucaucaaauuucggauucccuauuacgugggcccucugaacgaguauaacagaaucgaaaaugggaacggauucgcuuggaucgagaagaaaaagaaugagaagauuuuucccuggaacuucaaugaugucguugacaucgaaaagagcgccgagaaguucauuaacaaucuuacaaacaaauguaccuacaucaaggaagagacggugcugccuaaaaauucuauuaucuauuccaaguuuauggugcucaacgaacugaauaaccugcaguacggcaauaagaaacuugauaucgagcucaagaugaaaauguauacagaccuguuccuggagaagaaagauaacagaaaggucaccgaaaagcgcauucucgaguacuuucggaucaaugggauuaacgacggaaaagaaaagcugacaggccuuaacaaugagauccacgcggauaugaaaagcuacagagacaugugcgaaauuaugggggagaacuucaauaucaacguggccgagaauaucauuaacuggaucaccguuuuucauggagaaaagaaaauucugaucaauaagauuaaaaacguguauggcaagauguucaaugaugagcaaaucucuaagcucagcaaacugaacuacuccgacuggggccgccugucuaagaaacuucucaccgauaucaaguguuauauugacgcugacgggaucaauuuuccggucagcauucuggaagccauggagguguccaacaaaaaucugauggagcuccugagcaacaaguacgaauuuaucucuugcauugaugacaucaauaacaaguauuuuggagaucgggacauuuccgcuagcgagcuuaucgaugaacuguacguuucucccgccgugaaaagaggcaucuggcaguccguccgcauucucgaggaaaucgugagcauuaucgggcacaacccuaagaaaauuuucaucgagaugacacggcauaaugaggaaaagguccagaaauccucuagacgccacaaccuggaggaacuguauaaggccauccggaaggaccccgaguacguggaacuuauuaaagaguuugauagcacgaccgacacagauuccuucaagaucaaaaagcucuaccuguauuuuaugcaacugggaaaaugugcuuacucuaaggagaagauugacuucgauaaacucuucaccgacagcuaugauaucgaccacauuuacccuagauccaagacaaaagacgauagcauccauaauaaccugguucuugugaaggcgaaauauaaucgcgaaaagaccgacgucuaccccaucgauauuaacauccagaagaauaugaacucuuuuuggaauuuccuguauacgaaaaaguuuauuacagaggaaaaauacaagcggcucaucagaaccuccgaccugaccgaugaggaacuggccaaauucauuagccggcagcuuguggagacaucucaguccaccaaggcuacagccgagguucugaaacaaaucuacggcgacagcgauauuugcuaugugaaggccgaaaacgucucugacuuucgcuacgggagcuccagacagaaggauaaaaaugacauccagaaacucuucgugaaaugucgggaggugaaccacuuucaucacgcuaaggaugccuaucugaauaucguugucggcaacguguacgacgugaaauucacgaagaauccggucaacuuuauuaagaaaaauaagaugggaaacaaaagcaacuauucucucaaucauauguucugcuuugacguggaaagaaacggcuacaaggcgugggauuccagcgagaccaucaaaacaguugggcgcaugaugaaguccaaugacgugcggauuaccaagcacguccacccuacaagaggagagcuguaugaugcuaccaucuacaaagccaagauugccaaaacgggcucuuacaugccccuuaagagcuccaaaaacaccccucugucugacgugacaaaguaugggggauacaccaagaucaaaaucgcuuauuacagcguuuauaaguacaaauucuccgauaagaaucucauuaaaacagaaauccgccugauucccauccccauuuaucugucuaagaacgacgaugacaucaaagaguacgugaagaauuaccuuaacgauagagucaauagcaagcugaucgacuucaccaaaauuuaugauaagcucuacgugaacucccugaucaaaauuaauggcuaucucuacuaucuugggggcaagacgaacgaccggguuuggaucgauaaugccgugagcauuguccuggacgacaaaaucgaauaccugauuaagcgcaucucuaacgauaucaaguauggauacgagauuaauguguccgacgaugaacucauggacaucuacgagagccuggcugagaaagccaacaagaaaauuuucuauaacagacugucugauuucgaaaagaucuuuuccaauauggacgugaaaaagaaguucgucaaacuugagaagaacgauaaaugucggguucugcuccagcugcucaaugugcugacagacagccaaaccacauacaaacuugaaauggugggccugaaacauucucgcuccaacauugggaugaagaucagcaaucuggaggaauuuaaggucaucaacuccagcauuaccggacucuauucuaaugagaucgauauucugaacaucuga

SEQ ID NO: 4150 - RNA, 4026 nt, Artificial Sequence
  Cas9 variant
auggagaaggacuacuaucugggccucgauauggggagcggauccgccggcugggcugugaccgacgaucaguaccacguccugagagcccaugggaaagcgauguggggaacacggcuuuucgaaucugcuaacacggccgaggaacgcagaaucaaucggaccgcccgcagacggcugaagcgcagaaaccaacggauugaguggcuccaggaaaucuuugcugaggagauuaauacaaaagacagcggcuucuuucgcagaaugaaggaaucccgguauugggccgaggauaaacgcgacgaaaacgggucuugccccgagaugccuuacagccuguucaucgaugaggacuuuaccgauaaggaauaucacgagaaguucccgacaauuuaccaucuuagaaaauaucugaugaccacagaagagacccccggaauccggcucguuuaccuggcuuuucaccauaugaugaagcaccgcggccacuuccugcucaauggcaacaucgaagagauuagaaaauuucggaagacguucgaccaguuucuggagguggugagaaaugaagagaugggguucgccggagaaaucgaggaagagaccuacaaaaagauugagaugacacuuaaggaugucaaccugacccgcuccgcgaaaaagacaacccucaucaaaucucugaaggugacgcggguugaagagaaagaacuucuggcccucauuagcggcuguacagugaagcuguccaauaucuuuaacgacaaaagccuggaugagaccgaaagaccuaagauuucuuucgcugacgccggguucgacgauuaugaggcugagauccaguccaaucucaacgaaaaguacuauaucauugagagcgccaaagcggucuacgacugggccgcucuggccgauauccuuggagaauauucuugcauuuccgaggcuaagguggcccuguacgagaaacaucacaaggaccucaaacgccugaaggaucuuguucggaauaacaucagcucugaaguguauaaggagauuuuugucgacguguccggcaaauacaagaauuacugugccuauaucgggacaaccaacaucaacggaaagaagaaagauuucgaaggcaagaagugcaccaaagaggacuuuuacgcuuaucugaagaaaagcgugauugaauguaucaaugauuccgagaagacagacuggcucaaacuggagcuggaaaagggcaacuuccuccccaagcaacugacgggggaaaauucugucauuccuuaccagguucaucuuuaugagcugaacgcgaucauuaccaaucuccaggagagaaucccccugcuuaaacgcgauggagaaaagauccggcagauuuuuacauucagagugccuuacuaugugggcccgcugaacgggaucagcauugacggcaaaaagaccaauugggucaaacgcaaggagggagugaucuaccccuggaacuuuuccgacauuguugaugaggaaagcucugccgaguccuucauccggagaaugacaaauaaaugcaccuaccucauucacgaagacgugcugccuaaguauagccugcucuacucucgcuuugagguccugaacgaacuuaauaacgugcggcugaauggggagcuccugagcguugagcugaagcagaaaaucuaugaagauguguuccagagauaccggaaggucacgcagaaacgccuuaagagauaucuccugacagagggaaucauugacgaaaacaccgugaucaccggccuggauggcgacuuuaaagggucccucacagcuuaccacgauuucaaggagaagcugaccggacuuaaucugacagagcgggaaaaagaggaaauuauccucaacauuacgcuguuuggcgacgccagaucucugcuucgcaagcggaucgggaaaaucuguagccagcucuccgauaagcaaaaagagaaccugagcaagcugucuuaucagggauggggcagacucuccaagaaauuccugaaugggauugccaucagcguccagggcgaagaggaguggaccauuaucaaggcucuuugggaaacacaagacaaccugucucagcucaugggagccaaauacaccuuccgcaaugcgguggagaaggaaaacggcgagcuggaaaauagagagauuuccuacgagacaguuaaagaucugagcaucucccccucugugaagcggcaggucuggcagagccuucucaucgugaaggaaauuugcaaaauccaaaagaaaccuccccgcaagguuuuuguggaggucgcuaaagaaaagaccaacuccgggagaacggagucucggaaaaagcgccugcaggacuucuauaaguacuguagcaaauaugaaaaggagcuguacgaugaguccauucagaauaaacucgaaaagugcagcgagucugaccugagauccgacaaacuuuuucuguauuacaugcagaugggacgguguauguauaccggccaaccgaucgauuucgacgaacucuggaacaaucagaaguacgauauugaccauaucuacccucagagcaagacaauggaugacucuaucgauaaccgcgugcuggugaaaagaauuuccaaucaggagaagaccgacguuuaucccauccgggccgauauucgcgagaaaagacggggguuuuggaaggaacugaaaaacgucggacuuaucagcgaggaaaaguacaagagacucacacgcgccaccgaguucgaaccugcugagcuggccggcuuuauuucucggcaacugguggagaauagacagacgacaaaaguggucgcuagcauccucaagcaggccaugcccgacaccgaaauuguguauguuaaagcgcgcacaguguccgaguuccggcacaaguuuaacuucaucaaagucagagaaaugaaugauuuucaucacgccaaggacgcuuaccugaacgugguuguggggaacaccuaucuugucaaguucaccaaaagccccgugaauuuuaucgagaaccauucuaaucgcuccuacaaccugaagaaaauguucacagauggccggguugaaagaaauggagagauugccuggaucagcggcgagaacgggacgauuggaaccgugcgcaauaucaugaagaaaaacaauauucucgucacacggagagcucacgaagccaccggcggguucuuugaccagcaacugaugaagaagggaaaaggccaggugccugugaagggguccgacgagcggcugcuugauaucgaaaaauauggcggauacaacaaggagacaggcgcguacuucguccugguugaaucugacgagaaaaaggggaaaaagaagcgcaccaucgaguaugugccgauuagacucaaaaagcagcuggaaaauaaccggaaagcccucgagaauuaccugugcgaacaacgcggacuuacgaaccccgugguccugaucgauaagauuaaaauggacagccucuuuagaguggauggcuucuuuauguggcuguccgggcggacaggaaaucagcugcuuuucaagugcgcuaaccagcugguucucucuaccgaggacgaggccacccugaagaaaaucgugaaguuugucaacagacgcaaagaaaauaaggagauuaaaaucuaugaaagcgauaagcucaacgaggaaaugcugaaucggcuuuacaacacauuccuguauaagcuccaaaauuccaucuacggcaacagacugggggagcaagcuaaaacccugucuagcaagaaagagaauuuugacaaacuucagauugaagagaaaugucuggugcucuaugaaauccugcacauguuccagugccaguccgccacaagcgaucuccaacugauugagggcccuggaaaggccggcacgcuucgccugaacucuaauaucaccaaguacaaaaacauuaauaucauuaaccagucccccacagggaucuacgaacagguuaucgaccugcagaagauuuga

SEQ ID NO: 4151 - RNA, 4026 nt, Artificial Sequence
  Cas9 variant
augggcaagggguacuaugugggacuggacaugggcaccgggagcgucggaugggccguuacagaugaguccuaccagauccucagacggcacggcaaagcuauguggggagugcgccuguucgaaucugccaagacggcggaggaaagacggauguuucgcaccggaagacggcgccuugacagacggggcuggcgcauugagauccugcaagaaauuuucgcugaggagaucagcagaguggaucccggcuuuuuccuccggaugaaagaauccaaguauuacccugaggacaaacgcgauauucaggggaacugcccggaacugcccuauacacuuuuugucgacaagaccuucacagauaaggacuuucauaaaaaguacccuaccaucuaucaccugagaaaaaugcucauggagacagaggauacccccgacaugcggcugguguaccuggcccuccaucacaugaugaagcaucgcggacacuuccugcuuucuggcgauaucagccagguuacggaauuuaaaaauaccuucaaccaguuuauugagaauaucagaaacgaagagauggacuucgaaauugagcuggaugaguccgccgugcaaaugaucgaagagacacucaaggacaagaaucugacccggucugcuaaaaagagcaaacuugucaaggggcugaacgccaaaaaugugagagacaaggcuuuucucacacugcuguccggaggcaccguuaaacucagcgaucuguucgggauggaagaacuuaacgaaggagagcgcccuaagauuucuuucgccgacaauggcuacgaggaauaugcggccguggucgagauggaacugggcgagcucuacuauaucguggaauccgcuaaggccguguacgauugggcuauucugagcgacauccuugggggaucuacguccgucagcgaugccaaaguucgggcguaugagaagcacaaagccgaccugaaguaccucaaagcuguggugaaggaguauuuucccaaggaagucuacaacgccguguucguugagucuuccgauaaacugaauaacuacccugcuuauaucggcaugacaaagaaaaaugggaagaaagugagccuggaaggaaagagauguucccgcgaggaguuuauggacuuccucaagaaaaacauugucgugaagcugccggaugaagaggccaaaauguaccuucagucugaacuggagaaggacagcuuucuccccaaacagguuaauaaggauaacggcgugaucccuuaucagguccauaaguacgaacugaaaaagauucuugacaaccugggggacaaaauccccuuccucaaggagaaugccgagaaaauugaaaagcuguuuuccuuccggaucccuuauuacgugggaccccugagaaccggcaacggcgagaauagcaaauuugcuugggcggaacgcaagucuacagagaagaucuauccguggaacuucgaaaaugucauugauguggagcaauccgccgagaacuuuauccggagaaugaccaauaaaugcaccuaccucauuggggaagacguucugccuaaggauagccuucuguacucuaaauucauggugcucaacgagcugaauaaccugcgccuugacggacagaagaucagcgucgaacucaaacagaagauuuaucgggauguguuuuguagaucccgcaagguuacacagaaaaagcugaaaucuuaccugauccgggagggcaucgcugggaagaauguggaacucacgggaauugacggcgauuucaaagggagccugaccgccuaucacgacuucaaggagaaacuuaucgaugucgagcugacacaaaaggaaaaggaggaaauuauccucaacauugugcuguuuggcgacgauaaaaagcugcuuaaacagagacucaagaagaaauucccccagcugaccgagaagcaaaucaauacagugaccgcccuguccuacaaaggauggggccggcucagcaagaaacugcuugaggaaguuacggucccugcucccgagacaggggaaguguggaacauuaucaccgcccugugggagaccaaugacaacuuuaugcagcuccugucuaaggaauaucaguucuccgaucgcaucgaggaguuuaacgaagagaaagcggaccccgaagugagcuaccagacaauugaggaccuguaugucucuccugcugugaagagacaaaucuggcagacccuucagauuauccaggaaauugagaagguuaugggagagaaaccgaagcggguguucgucgaaauggccagagagaaacaagaaaauaagcgcacagagucccggaaaaagacgcucagcgaucuguacaccaagugcaaaaaggaagaacccgaguggaucgaagcccuguguacaucccucgagaaacaugaggagcaccagcugagaucugacaaacuuuaccuguauuacacccagaagggccgcugcauguauagcggggagccuaucgaucucgaagaccugugggauaacacaaaguacgacauugaucacaucuauccccaguccaagaccauggacgauucucugaaaaauagagugcuuguuaagaaagaguacaacgcuaagaaaagcgacacguauccuauugccgcugauauccaaaagaagaugaugcccuuuuggaaaucccuccugaccggaggcuucauuccgaaggaaaaauacgaccggcuggugcgcaauaacccucucgaugccaaugagcuggcgggguuuaucgaaagacagaucgucgagacacggcagagcaccaaggccguggcugagauucuuaaaaagauccugcccgacacagaaauuguuuacgugaaggccaaaaccgucucuaaguuccgccaggacuuugauuucaucaaagugagagacaugaacgaucuccaucacgcuaaggacgccuaucugaauauuguggucggcaacguuuacuuugugaaauucacgaagaaugcggccugguucgugaaagagaacccuggacggacauauaaucuggaaaagauguuuaucugggaugucgcucgcgacggcgagaucgccuggaaggcugggaaauccggaagcauugugcaaguuagagccaugauggaaaagaaccauauccuugugacccggcgcucuuacgaggucaaaggcgggcuguucgaucagcagauucucaagaaaggaaagggccaagugcccguuaaggaguccgacgaaagacugcgggauaucgggaaauauggcggauacaauaaggccgcuggcguguauuuuaugcucgucagcucuaaagacaagaaagggaaggagcagagaacaauugaguucgugccuaucuaccugaaggaucgcguugagaaagacauggaaagcgcgcggaacuaccuuauggaggagagaggacugcgcgaacccaagauucucaucaaaaagaucaaaauugacacccuguuuaagguggauggcuucuauauguggcuguccgggcggaccagcaaccagcuuaucuuuaagggagccaaucagcugauucucucuaaagaggacaugaagacacugaaaaaggucgugaaauacauccaaagacagaaggaagauaaaaacgugaagauuuccaugcgcgacggcaucacggaggaggaacuccugaaacuuuaugagaccuuccuggauaagauccggcacagcauuuacggggcuagacucuccucucaggaaaagacacuggucaauggcaaagagaaguuuaucgaccugagcguugaagccaaaugucaggugcuuuaugagauucugcaucucuuccaaugccaguccggagccgcuaaccugaagaugaucggcgggccggccucugcggggauucucgugaugaauaacaauaucagcaaguguaaaaacaucuccauugucaaucagucuccuaccggcaucuacgagaaggaaauugaucugcuucgcguguga

SEQ ID NO: 4152 - RNA, 4026 nt, Artificial Sequence
  Cas9 variant
augacccagaaggugauccccuacaacauuggccuggacaucgggacaaauagcgucggaugggccguuacggauaacgagaauaaacuccugcacauuaagggccauaacgggaucggagugagacuuuucaaagaaggccaauccgcugccgagcggugcggguuucgcaccacaagacggcgccugucuagacggaaguggcgccucagacugcuuaaugaaauuuucgcggacaaaaucgcuaagguggauccuagcuuuuucgcccggcugaagcaguccaacgucucuccgaaagaccccaauaagaccauguuuggaaacauccucuucgauaauggcaaccugaaugacaaauccuuucacgaugaguauaagacaauuuaccaucugcgccaguccaucauugaccacccugaaaagaaguucgauaucagacucauuuaucuggccaugcaucacaucauuaaguaccggggccacuuucuuaaccaggcuaaugugcaagacuucaaagggggaaagaucgaucuggaggagucuuuuaaagaccucaacagcaucuucgaaaaucagggccgcgaucugagacuuguuaccgaggacgccaacaaguaugugaaagaacuguccgacaacagcaagacacggaaugaucgccagaaagagcucucuaagguccuguacauucccaucgacaagaacuccgauaaaaauaacaagaaagugaccacggagauuaucaaggcuauucuggggaugaaagccaaguuugacguuaucuucggaaucgaugcggaaaaugccaaggaguggagccucaccuucaacucugacgauuuugacgauaaaauugaaggccuguccgcucagaugacagacgaggccggggaaauccuucugauucucaaggagcuguauuucgcucuuaaucugagcgauauccucaacaauucugugaccgacaaaaacgccaagacacuguccgaggcgaugauuaauagauacgacgaucauaaagaacaacugaccaugcucaagcaggucaucgacaacagcgauaagaaacacgccaaggcucugaaagccgcuuacuccgccuauaucgacggagagaauaacaagaaaauuucuuuugaagaucuucggaagagaauccagaagaaucuggacaacagcgagacguccaaaaagauuaacgaucuccuggaacaugacuacuuccuuccuaaacagcgcagcaaggagaauggcgccaucccccaccaacugcagcagcaagagcucgauaaaauuaucgaaucucagaagcacuauuacccuuuucuggcugagcugaacccgaaugaaaaacgguccagacaggcgaaguauaagcucgacgagcugguggccuuccgcgugcccuacuaugucggcccuaugguuaaagcuacagaaaacaaucagagcaacaaugggaaguuugccuggaugauuaaaaacgauaauaucucugacaaacuuaaaaaggaggagaucacccccuggaacuucgauaagaaaguggaccggacagaaaccgccaccaaguuuauuacaagaaugacgaccacagacaccuaccugaucggagagccugugcuccccaaaaauagccugcuguaccaaaaguucgucgugcuuaacgaacucaauaaccugaaaauuaauaagcagccgaucacaccugagcagaagcaguauguuuacgagcaugugaugaaacaaaccaagcgcgucucccugaaaaagauugcugaugcccucgugaucaaaggcgacuaucccuacgcgccugaaaucacggggacaaccgaucagaagaacaugaacaauggacugucuaccuauauugaccuugcuaagaucuuuggcgaugagcuggacgauauugaccggaaagaagauuucgagaagaucauugaauggagcacaaucuuugaggaccagcacaucuucgcccucaaacugaaggagauuaaauggcugaccgaagaucagagaaagcaaguugugaaacuucgcuaccagggguggggaaagcucuccaagaaacugcuggccgaccucgucgaugacaacggccagcggaucauugaccugcuuugggauagcaagcaggacuucaugcaaaucgugaaucagaacucuuuuaaacaggcuauugccgagcauaauggcgcucaccuggaagagaaggaucucaaagacaucaucaacaaucuguauacaagcccccaaaacaagaaggccauuagacaggucauccuggugguugaugacauuauccgcgcggugggguacgaacccgucaauauuaugauggaguucgcccgggaggauagcaaagaccauagacuuacgaacucucggucccgccagcucgaaaagguguacaaagauaucaccaauagcugguuugacgaugacaacguuaaggacgagcugaaagauaagauuaaggacaaagcuaaguucacagauagacuguaucucuacuuuacccagggaggcaaagaccuguauacaggggaaccucuugauaucgacaaucuguccaacuaccaaaucgaucacauucucccgcagucuuucauccuggacaauagccuggauaaccgggugcuuaccuccaagauuaacaaucagaucaaaaaggacaaccuccccggagaguuuuucggcucuaagaugcacaauuuuuggaaacaucugaaggaacugcaccucauuagcaacaaaaaguauuacaaucugacgcuuaccccuaacuccaucagcaaauucaauaaccaggggagauuuaucaaucgccaacuggucgagacaagacaggugauuaagcucgccgcugagauccugcauaaccgguauucugaagagaauggcaccaacauugugacaguuaaggccaaucugacccaccacaugcgcgaaaaauucaacuuuuacaagaauagaaacgucaaugauuaccaucacgcguucgacgccuaucuugcugccuucgugggaaacuggcugcuccagcaguaccccaaacugaagccuuauuuuguguacggcgauuucgcuaaaacggagaucgacaaccucaaguccuuuaaucugauuuauaaauucgagcaagcccaucagcuuaacgaagaggacgggaagaucgccaaggauacagacgcucugcucggauacaugaaaaaugucuaucacuuuaagaaaaugcuggugaccaaggaacuggagacaaaccauggcaaucuuuucaaacagacccuguaccccagccacgggaagaugaagaaccucaucaauccgaaagaaaaccggucuuccgauauuuacggaggcuauagcucugagaccggggcguacguuagccugaucaagguguuuaaaaagaauaaaauugagaacaagaucauuaagaucccucuccuguauauugacaaacuuaaucgccaagccaacgcuaagcaguucaucagaaauuuuaucauuaaagaugacuccaacaaguucgauauccugagcgagaaaauuuuucucaaucagcuggucaucgacggcgaugaacuguucacaauuucuggauccggcgaccggcagaacgcccaacagcuuauccugagcgauaagucccucaagauccugucuaaaaacauuaaugugaucagcaagaacgaccucauuaucauuuucaaugaaaucaucgaugacauuuguaaauacaugaagauguaugagguugaaaacuccgacgagacgaaagccaaguuugaggaaaucaaugauaaagaccgcaugcugaagauuaucaacgaucuucugcuggggcuccacgcuaaugccucuagaagcaaccuguccucuauuggacuuagccccuccuucggccgguuuuucagcgggaaugcgggaaucaagcugucugagaacgcuaaauuuauuuaccaguccccuaccggccucuucagccgcaaggugaaaaucucugaccuguga

SEQ ID NO: 4153 - RNA, 4032 nt, Artificial Sequence
  Cas9 variant
augaccuacuaucugggccucgacauggggacaagcuccgugggaugggccgucacggaugagaacuacaaucugauccacagacaucggaaggaccuuuggggcauucgcgaguucgaggaagcuaaaaccgccguugagagacggacacagcgcaucucuagacggcgcagacaacgggaaguggcgcgcauugggcugcucaaggauuauuuucacgacgagauccagaaaguggaucccaacuucuaccagagacuggacaauagcaaguauuuuccugaggauaaagaagaggucgugaagggaaagaacggcauuuucgcugacgaaaauuacaccgaucgggacuauuuugccgaguacccgacaaucuuccaucuucgcagagagcugcucaacuccaaagaaccccacgauguucggcugcuguaccucgcccugcuuaauauguauaagcaucgcgggcacuuucugaacaccacacucggaaccgacggcgagaauagaaaacugucugauguguaccgggacuucgucgugaagacggaagagguucuuggccugaccuuuccucaggaaacagacaacgggaaaaugcaagagaucaugugcagcagagaguucucccgcaagcggaaggcugaacuccugugugcccugcucgagauugauaaaaagcagaaacaacagguggcucugaucgaaugcguccuuggacuggacaagucugugaaacagauguauggcaccgccgugcccgaugacuuugauaagagcgucaaaguuaauuucuccgacagcucuuuugaggaaaagguguccgagguggaggaacuccuggaugaggaaaaguacgagcuuauucuguguaugaaagaacucuaugacacagcgguccugaaccagaucaugggggauugcaauuaccugagcgaggccagagugcaggaguaugaaaagcacaaagaggaccucaagcugcuuaaacgcaccguuaagaaguacggaacggcugaagaguaccaguuccuguuccggucuuccgagaaagccagcuauaacgcuuacgugcauucugucaauuccggcgaaaagauuagacgcaacauggaugggcggagcagagacgaccucuauacagugcugaaaaagaugcuuaaaaacuacccucaagaggaugccgacuguaaguauauccuggaagagauugaaaaggagcaguuucuccccaaacagcugguuuccgauaauggagugaucccuaaccaaauccacuacaaggagaugaaaaagauucuggaaaaugcggagcaguaucuccauuuccugcgcgaaaaagacgagucuggcuacaccgucgccgaacggauccuuaagcuguuugcuuuccagauuccguacuauaucggccccacaagcgagaaguccgggaaaaacggaggcaauggguggguggucagaaaggagcagggacaagugcucccuuggaacauugaagagaaaaucgauaugaaggccaccagcgaaaccuuuaucucucgcaugguucggagaugcacauaccuguccgacgagauggugcugcccaaagcuagccuugaauaugagucuuucuguguccucaaugagcugaacaaucugcggauucgcggcgugaagcucccuaucacgguuaaacaggauauuuacaaggaccuguuugaaagagggaagcgggugaccagaaaacagaucgucaacuaucuuaagggagugggcauucugcaggagggcgaagaggaugagcucacagggaugauggacaccuucaauagcucccuggccucuuacggaaaauuuaagagcauccugggcgaaaagauccaagaggauuccugcaaacgcaugguggaacagauuaucuucugguguacaauuuauggggacgccaagaaauuucuuaaggagcagcucgaagagaaauacggagauguucugacccgggagcagaucaagcgcauucugggcuucaaacucaaggacugggggaaccugagcaagaaauuucuugaacugaauggcugcgacagaaacacgggagaggucaugucucucaucagaaugcugugggaauccgaugacaaucugauggagcuucucaaggauagcucuuacacauaucgggcugaacuggaggagcaacaggaaaaacugaccaagacccucacagagauuugucccgaagaccuggagggcuacuauuucuccgcgccggugaaacgcaugaucuggcagacccuucugauccucaaggaaguggagaaggucaugggggagccucccaaaagaguguucguugaaaugacacgggagcacgaugaacgcagagagaugaaggacagccggggcaaaaaguuucaggagcuguacaaaaacauuaaggaugaagaacacaacuggaaagccgaaaucgaggacgcugaaaaggauggacgcauuagauccaagaaaauguaucuguaccuuacgcaacgggggcgcugcauguauaccggaaauccuaucgaccucgaggagcuguucacaaccaaguacgauauugaccauaucuaccccagacacuuugugaaagaugacaaccuggacaauaaccucguccugguggaaaaggagaaaaaugcccauaagucugaucaguauccccuuggcgacgauaucuacacagggcggcugagcugguggaaggaacuccacagagagaaacugauuaacgacgaaaaguauaaacgccugaccggccgggccccuuucuccgaugagcagaaggcuggauuuaucgccagacaacuuguugagacgucucagggcaccaaagggguggcgagcauucugaaggaaguccucccggagacaaccacaaucguguacgcuaaggcccgcaauguuuccgacuuccggaacaccaaugaacugcucaaagccagaagcgugaacgauuuucaucacgcucaggacgccuaucugaauauugucgugggaaacguguacuaugucaaguucacgaauaacccccuuaauuuuguucgcucuggcgagggguacaaccuggauggaguguuccggaaaaacgugaucagaggccaggaaaaugcuuggaucgucaagccugagaaaggggagaagaugacacucgaaaccgugaagcgcguuauggccaaaaacacaccccugcugacccggcuuuccuuugagggcagaggaggccuggcgaaucaaacccucuacagcgccaaggaagcugccggggagggauaugugccucugaaaucuuccgacagccggcuccaggaugucacaaaguacggcggguucacgucugugaccacagcuuauuuuauucugguugagcacgacaugaaaaagaagcgcgugagaaccaucgaaagcguccccauucuuuggaaagagcggaucgaaaaggaguccggacagcuggaaauuuacugccgcgaggcccucggccuggugaacccggacaucagaguucggaaaauccugauucagagccuugugaagaaagauggguucuauaugcaucugucuggcaagacaggaaauagauucaucaugcgcaacgcggucgagcucugucugaaacaagaauggauuaauuacuccaagaagcucgagaaagaaggcugcgacgagagcaucaccaaggagaaaaacgaggagcuguaugaaauucuuaaggagaaacacaucaaugggauuuaccggaagagaccuaaccccaugggagaaaagcugcauauccgccaggagacguuucggaugcugacacucgaagaacagaaaaaggugcugcuuucccugcucaaucugaccaaaaucggcccuguggaggccaaccucgaacugauuggggagucugcucacaccggaaagaugcuuaucagcaaaaauauuacagaagucaaggaguucuaccugauccaccaguccguuaccggcauuuaugagaagcaagugaaccugcucacaguguga

SEQ ID NO: 4154 - RNA, 4032 nt, Artificial Sequence
  Cas9 variant
auggccaccaagaaagaguacaacaucggccuggacauugggacaacgagcgugggaugguccgucguugaaaccgauaaucagaaggugaugagaaaaggcaacaaggcucucuggggagugcggcuguucgaggaagccacaaccgcggagucucgcagaaugcaacggagcacacgcagacgguaugaccgcagacgggaacgcaucaaacuucugcaggaggaguuuuccgaagagauuaauaaggucgauaagaacuucuuucagaaacucaaggaaucuaaauacguggagaaugacaagaucaacaaaaagauuguucugaccaaggaggaaaaacaggagcuuaaggauuaucaaaauaaauacaagacaaucuaucaccugagagacgaacucaucaacaaucccgagaaaaaggauauucggcugguguaccuggcuauccaucacauuaucaaauaucgcgggaacuuccucuaccagaaugccaacuuuaauauugacaaccuggauaucaaggacaaacuuaaugaacuguucagcauucucuccaacaacauccaggagcuggagaucccugaagauuacauuaauaucauugacuuugaugagcuugaagccgaccugcucaaggacaccaagaacgaugucaaagcucugcugaucgacaaucucacggagcugaccaacaagucuagcgccacagaguucggcaaacuuaugguggggaauaagggaaacauuaauaagcugcucaugcuggagaccgauaacaaaaucgagaucuccuuuagcggcacagacuaugaugacaaguacgaagaguaucaggaagcucuuggcgagaauauugaaauccuggauauucucaaacaaaucuacgacugcauuuuccugaagaaaaucuuuaaggggaacaagaauaccucuaucuccagccugaugguuaaaucuuucgagcagcauaagaaagaucucaacuuucugaaggagcuuuucaaagacaauagagaacuguauaacgagauuuuccggacgaagaaggaucucugucuguacgaaaaauauaucacaaauaagauugacugcgacgaguuucgcaaagagaucaacaaacuucuggaaucccucuucagcgaugagaacauuaagcagaaucugcuggacgaauacaaccucgaggugaaggaaagaaucgagaauggaaccuuucugccgcggauuacaaccaccgauaacggcaaauaccccuaucagcuuaauaagucugagcugaucaagaucauugaaaaccaagggaaauacuauccuuuccuccugaauaagcugaacgacaauaaaacauacaagaucgucaaacuucucgaguuucgcauucccuauuacgugggaccucugguguccgaaaagagaagcgagaacuccuggcuggaacggaagaucaauaacgucaaaauuacgcccuauaauuucgaugacguuguggauaaggagaaaaccgccgagaaguuuaucaaaagaaugaucucucacuguacauaccuccuggacgaauacgcgcuugccaacaauagcauucuguauuccgaguucaaggugaugaacgaacucaagcagauccgcgucaacgaucggaaacuggagcugaaguuucagcaacagauucuugaagacuucuuuaaaaagaccagcggcacaaucaccgagagaaaauucaagaauuaccucauuucuacgggggaguauuccauggaaggaggcaacuuucgcaucacaggcuacagcgcugaugggaaguucgccaauaacaugcagucuuauguggacuucuuuggagagaauggcaucuucgcugauaccgacuacaaccuggaaaaugccgaggagauuaucgaauggauuaccaucuuugaggacaaagauauucuggaaaagaaaguucgggacaacuauagcaagcucaaugagaaccagaucaaaaaggugcuggcgaaaaaguacuccggguggggaucucuuagcaagaaacugcucaagacaaaauacuauaaggauaaagccaccgaacuguacaaguccauccuggaccuuauguaugagacagauaagaauuucaugcaaauuaucaacgacgauaaauacaauuuucaggagaugauuaagaaauucaacaauaaggaagagaacaaaaagcucaacuauagcaucgucgaagaacuggcuacgucuccugccaccaagagaggcauuuaccaggcucugaaagugguugaggaacucguggacuauaucggguacgagccgaagaauauuuccaucgaaauggcccgcagcgaggaagagaaaguccggaaggauucuagaaaagacuacaucaacaaucuguauaagggaugcaaggauuccauugaaaacuacaaaaagcugaaacaugagcuugacagccacgagaucacaucccagcgccucuuucuguauuucauucaagaaggcaagugucuguacaccggcacaccccuuaauaucgaggauauugaaaaccagucucucuaugagaucgaccacaucauuccucggagccugaucaaagacgauuccauugacaauaaggcccuggugcucaaggagugcaaccaggauaaaaaggcuucuuacguccugcccagcaaauuuagaaauuccaagcagaaaaccugguggaagcaucuuaaagacaacgggcugaugagcgcgaagaaguuccacaaucucauccgggaaaaauauaacgaggaagauauuaauggauuuaucaaccgccaacugguggagacgagacagaucaccaagcauguugccaauauucugaacaaucuuuacaaagacacaaacgugaucuaccugaaggcugaucucucucacaacuaucgggaaaaauacgaccuguucaaguuuagagauauuaaugacuaucaccaugcccacgaugccuaccucgcugccguccugggcgaguauaaggagcgcuucaugaaacggaagaucaacuucgacauggugaaagaacuuaauuccaagauuguugagauggacgaagggaaaagacgcaaccugagauuuggauacgugaucaauagccucgaugagaaccugaaugacauuguccugaagaucucugaaaaccuuguggauaaugagaccggcgaggugcuguucgacgcgcaugaauuuaacaagcggguugaggauacacucuaucgcaaugacauccugauuuccagaaaaaccgaaauccggacggggcaguucuacaaggagacaauuuacaaaaagggcaaaggaaccaucccuauuaaguuuggcaugcccacagauaucuaugggggauacagcaacaccaaugcucgcaagcucaugcugaucgaauauaacgagucuaaaaugaagauuaucggccuuccgauggcccuggccgucagaaauaacgacgcugagauuaacgauuacaucaaaacccagauuaaucucaagaaaaacagcacauucaagaucaaaaaguguuccaucccuuuugaaacggagauuaucuauaauaaccaaaauguguucauuaagggguacagcaucggacacaaaaacugcgaaauuucuaaugccauccagcugaagauugcuaaagacaagaugaaacauuggaaguaugcccugcaguaccuucugaacgauaagaaacaauacaucgacuuugcggagaaguaugugaaugagaucuacgauuuccucauuaaccuggaccucuuuccccuguucaauaaagaacuugacaagaucaaaaacaaggucaauuucgaggaucuggcccuggaccagcagaagaaaauuaccaaggaacucuuuaaaaugcugcacuguaacuccgugaaugcuaaccuuagcgaguucggccugggggaucggaugggccgccucuccggauauaacaucacagacggcauuaucaucucuaagagcguuaccgggauuagagaaucccgguacgaguuuuga

SEQ ID NO: 4155 - RNA, 4035 nt, Artificial Sequence
  Cas9 variant
augagccagaacaauaacaagaucuacaauauuggccuggacaucggggaugccuccgugggaugggcugucguugacgagcacuauaaccuccugaaaagacauggcaagcacaugugggggucucggcuuuucacccaagccaauacagcgguggaacgcagaagcucccggucuacgcgcagacgguacaacaaacgcagagagcggauucgccugcucagagaaaucauggaggauauggugcuggacgucgaucccaccuuuuucauucggcuugcuaaugugagcuuucuggaccaggaagauaagaaagacuaucucaaggagaacuaccauuccaauuauaaccuguucaucgauaaggacuuuaaugauaaaacauacuaugacaaguacccuaccaucuaccaucugcgcaaacaccucugcgagucuaaggaaaaagaggauccgagacugauuuaucuugcccugcaccacaucguuaaguaccggggaaacuuccucuaugaaggccagaaguuuagcauggacguguccaauauugaggacaaaaugaucgauguccugcgccaguucaacgagauuaaucuuuuugaauacguggaggacagaaagaaaaucgaugaaguucugaacgugcucaaggagccccugagcaaaaagcauaaagccgaaaaggcuuucgcccuguuugacacaaccaaggauaacaaagcugccuauaaggagcucugugcggcccuggcugggaauaaauucaacgucacaaagaugcuuaaagaggccgaacugcacgacgaggaugaaaaggacauuucuuuuaaguucuccgaugcuaccuucgacgaugccuuuguggagaaacaaccucuccugggagacugcguggaguucaucgaccuucugcaugauaucuacagcugggucgaacuccagaauauucugggcucugcgcacacguccgagcccagcaucucugccgcuaugauucagcgguaugaagaccacaagaacgaucugaaacuccugaaggacguuaucagaaaauaccuuccuaagaaguacuuugagguguuccgcgaugaaaaauccaagaaaaauaacuauuguaauuacauuaaccaucccagcaagaccccuguggacgaguuuuauaaauacaucaagaagcugaucgaaaagauugaugacccggaugucaagacaauccucaauaaaauugagcuggaguccuucaugcuuaagcagaacucucggaccaauggcgccgugcccuaucaaaugcagcuggacgaacucaacaaaauccuggagaaucagagcguuuacuauuccgaucugaaggacaacgaagauaaaauuagaagcauccucacauuucgcaucccuuacuacuucgggccccugaauauuaccaaggaccggcaguuugacuggaucauuaagaaagagggaaaggagaacgaaagaauccuuccuuggaacgcuaaugagauuguggaugucgacaaaacggccgaugaguucaucaagcgcaugcggaacuuuugcacauauuuccccgacgaaccggugauggccaaaaauucucugaccguuuccaaguacgaagugcucaacgagauuaauaagcugagaaucaacgaucaccugaucaaacgcgacaugaaggauaaaaugcuucauacacucuuuauggaccacaagagcauuucugcuaaugcgaugaaaaaguggcuggucaagaaccaauauuucagcaauaccgaugacaucaaaauugagggcuuccagaaggaaaacgccuguuccaccucucugacaccuuggaucgauuuuacgaaaauuuucgggaagaucaaugagagcaacuacgacuuuaucgagaaaauuaucuaugaugugaccgucuucgaagacaagaagauucuccggagacgccugaaaaaggaauacgaccuugaugaggagaaaaucaagaaaauucugaagcucaaauauuccggauggagccggcugucuaagaagcugcuuuccggcaucaaaacaaaguacaaagacagcaccagaacacccgaaaccgugcucgagguuauggaacggacgaauaugaaccugaugcaagugaucaaugaugagaagcugggguuuaaaaagacaauugacgaugcuaacucuaccuccgucagcggaaaguucuccuacgccgaagugcaggagcucgccggcucuccugcuaucaaacgcggcauuuggcaggcccugcuuaucguugacgagauuaagaaaaucaugaagcaugaacccgcgcacguguauaucgaguuugcuagaaacgaagaugagaaagagcggaaggacagcuucgucaaucagaugcugaagcucuacaaagauuaugacuuugaagaugagaccgaaaaggaggccaacaaacaccugaagggggaagacgccaaauccaagauuagaucugagcgccugaaacuuuacuauacacagaugggaaaaugcauguacaccggcaagagccucgacaucgaucggcuggacacauaucaaguggaucauauugugccccagucccugcucaaagacgauagcaucgacaauaagguucugguccuuucuuccgagaaccagagaaaacuggaugaccucgugauuccuagcucuauccgcaauaagauguacggguucugggaaaagcuguuuaacaauaaaauuaucuccccgaagaaauucuacagccugaucaagacggaguuuaacgaaaaagaucaggagagauucauuaaucggcaaaucguggaaacccgccagauuacaaagcacgucgcucagaucauugacaaccauuaugagaauaccaaagugguuacagugagagccgaucuuucucaccaguuccgggagcgcuaccacaucuauaagaacagagacaucaaugauuuucaucacgcucaugacgccuacauugcgaccauccucggaacguauauuggccaccgguucgaaagccuggacgccaaguacaucuauggggaguacaaacgcauuuuuagaaaccaaaagaauaaaggaaaggaaaugaaaaagaacaacgauggcuucauccucaauuccaugcggaacaucuacgcugacaaggauaccggcgagauugucugggaccccaauuauaucgaucgcauuaaaaaguguuuuuacuauaaagacugcuucgugacaaagaaacuggaagagaacaaugggaccuuuuucaacguuacagugcugccuaaugauaccaacagcgacaaggauaauacgcuugccacaguccccgugaacaaguacagaucuaauguuaacaaauauggaggcuuuuccggggugaauagcuucaucgucgcuauuaagggcaaaaagaaaaagggaaagaaagugaucgaggugaacaagcugaccgggauuccucucauguacaaaaaugccgacgaagagaucaagaucaacuaucugaaacaggcggaagaucuggaggagguccagauuggcaaggaaauccuuaaaaaucagcugauugagaaggacggaggccucuacuacaucguugcccccacagaaauuaucaacgcuaagcaacugauccucaacgagucccagaccaaacuggugugugaaauuuauaaggccaugaaauacaagaauuaugauaaccuugacucugagaaaaucauugaccuguaccggcuccugaucaauaagauggagcuguauuacccggaauauagaaagcagcuugugaaaaaguuugaggaucgcuacgaacaacugaaagucauuagcaucgaggaaaagugcaacaucauuaaacagauccucgcuacccugcauuguaauuccucuauugggaagaucauguacagcgacuucaagauuuccacaacgaucggacggcucaacggcagaaccauuucucuggaugacaucagcuucaucgccgaguccccuacagggauguauagcaaaaaguacaaacuuuga

SEQ ID NO: 4156 - RNA, 4035 nt, Artificial Sequence
  Cas9 variant
augaagaaaaccaaccccuacauccugagccucgacauuggcacagccuccaucggguaugcuugcauggaucuggacuucaauauucuuaaguaccacgauaaagacgccaucggagugcugacguuugagggcgcggauaccgcugccgaaagacggggguuccgcacaucuagacggcgcaagaacagacggauuaaacgccucggacugcuucaggagguccuggccccucucguuaagaauccgaacuauuaccaacugcugaaucuccauaaguggaaaaacagcaaugaagacuuuaagcacagaucccugucugaggugcuuaaaauccugggcaagaaccccaaaaccuauccuacaaucuaccaucuccagcaggauauucagaaucaccccgaaaagaaguucgagccugagcugaucuuucuugcucuguaucaucucgugaaauaccgggggcacuuccuguuuaacaaucugagcuucgacaagggaaaaaccgucgauaacgaagcccaacucuccgagcugcuugaacaguaccagucuauuaaucccuaugaggacagcaucuccaacaaggauauuaaugugaucguugacacacugaaagaugaccagcucacccgcaacgacaagagcaaagagcugaagagaaacgugucuaagacgcacgcugaacuuuuuaaaaugcuggucggccucaaguucaaacaauccauucuguuugagaauauggaaaacgccgaggauaucaaggaaagcgcgaccggcucugacgccaucucccugagcgaugacuacuaugagaaucucucugaguuccugacagaugaacagcuuaacuuuauugaguccgcuaauaccuucuucauggggaucaugcuggaccggauucucaaaggagccacaagcaucuccgcugccaaggugcgcgauuacaagauuuuuaaaaaccagcugaagaucaucaaagacauuguuuaucagaauaaguacgauaaauaucaugaguucuuugugaccucuaaggaggacaugagagcguaccaagaaaacccugaugccaagacguucggcaaacuuagcaaguuugaccaguaccugauccacccgaaagaccaguaugcuaagcucaugaaagaucugaaggggauuguccccaagaaauacacagaggugcugaaucucaucgacgagcaaaaguuccuggugguccagaacaccacagauaaugccuccauuccuuaucagaacaauguuuuugaagcugagaacauccuucggaaucagcaaaaauacuaucccgaaaucaccgaggaaaugauuggaaaggugaucaaccugauuagcuuccgcaucccuuacuaugugggcccccucaccaacaaaaaugggcagucugacuuugccuggaugauuagaaaguccgaugagcagacacugccguggaacuucgacaaagucaucgauaagagcaagucugccgagaaauuuauucggagaaugacgagcaaguguaccuaccugcuugaagaggacgugcucccuaaacauucccugcuguaccaggaaauggagguucucaaugagcugaacaaugugcaacuucgcggagaaaacgagcccaagcaccggauccacagacuggauccuaaagucaagcaguucaucuaucauaaucucuuucagaagaaaaagaacgugacacacaaagaccugauuacccugcuucaaaauucugaacaucgcaacacacucaauaagaccagcggccaaaaacugaagguuuucggcacgcagaacgauuccaaguucgcuagcaaacugucuacauacaaugacaugaaggcgaucuuuggguccguggagaacaaacggcagaugauugaagaacucguccuguggaucaccauuuucgaggauaaggccauccuuaaacagaagaucggagaaaaguaucccaauauuaccgagaaacaacugaaccagaucgugaagcucaacuacagcggcugggggagacugucugaaaaacugcuuacaaaggaggucaauggacgcucccucauugaccugauguauagcaccgaaaacaauuuuauggagaucauuacagacaaaacgcugggcuucgauugcuuuaucaagaacuccaauaaagugaagaacgcuaagaucucuuacaaagacguugccgagcuccggaccagccccgcccugaagaaagggauuuggaaugcuaucaagauggugagagaaauuuccgaucuuuucggagccccugagaaaaucauuaucgaauuugcgacagaggaccaggucaagggcaagcgccaaaaaucucggagcgaacugugggaugaccucgugaagaaaaacaaucugaagagaaacaaaaaguucaagggccuguuugaggagcuuaaggcuuauccggaucucgacuucuccaaucccaagcuguggcuguacauccaccagaacgggaaauguauguacaccaagaaaccuauugaucucgaacgccugaugagcgacacaaauaaccagcuuuaugagaucgaucauauucugccccggaccuuuguuaaggacgauucuaucaauaacaaggugcucgucauucaguccgccaaccagaaaaagagcggagacaaaaugccucuggaaaucuucgacaaucacgugcuggugcccuuuuggaagaugcuuuacgagaacgaucugauuucuuccagcaaacucucuaagcugaugaagaaagaguucaaugaccucgauaaggaaggcuucauccagagacagcugguugagacgcggcagaucauuagccacgucuccgacuuucuuaccgaagaguauccgagcacaaccguggugccuaugaaagccaacgucgugucugaacugcgcagaaaguucgauauccccaaaauucggcaacucaaugacuggcaucacgcuguugaugccuaccugaacggguuuguguaucaggcugccagagucuucuacccuaaggugaaucuguuugaguucaacuuuaaaugggagaagguucgcgaaaaguggcggcagcuuggagaguucacagaaaauaacaaaaagagagaguuuuuccuguuuaaacgcauggaaaauuaugugaacgagcauggcgaggggaugaucuccaagcucauuuucgaccuggauaauuucaaauuuaacuacagcagaaaggucgaauccaccgagucugcguucuacaagcagagcgccuuuucccccaaaaauacgacagcucaauaugacucugauaagaacaaaaccgccaucuacaaggaaaugaaaaauaagcggggcaucgugguuagcuauacauacgugaagaaagaccaggagcucauuggauauggcgucuucaacgaaaccguguuugaguacgugaacaaugcugacgucgauaugaacacccgcgcccugaagaucguuagaaaagcguucccuaaacuugacauuaaaaaggcccaguaucuguuuuccaucaauaagggggaugcucuccuggugaacggacaccccuuccuguuugugucugccaaagagcggauuaauggcaagcaacuugaguucgacaucaacaugcagcgcagacugaaaaaggcucuccggccguacaauaaaaugacagaacaggaaaaggucgggguguacaaccaguuugccgagaaaguugugcaagaguaugaaaauagccugggagccaagacgcgcaacgagaagcucgaacugaucagaaaucaguucaacgaguccgauaaaagcaaugaagcucuuauucagugcauccuggagguccugaagaugaccaaagugucugcggagcgguccguuaagcucaaaauucgcuggggcagccagacaccuaacacccugaucgacauuaauaacaaggccaagaucauguacaacucuauuacagggcuuaaacaaaccagacugaaguccaucuauaaacucgcugaaagcaagaaugagcuguga

SEQ ID NO: 4157 - RNA, 4035 nt, Artificial Sequence
  Cas9 variant
augaacaagaauuacuauaucggccuggacauggggaccaacagcgugggaugggccgucacagaucaggaguacaaucucauuaaacugaagggcacgcacgcuuggggagccagaaucuuccaagaagcgaaagacaagaaagggacccgggcuauucgcuccucuagacggcgcauggauagacggaaguaucgcauccaucuucugaaccagcucuuugcccaggagauucaggccaucgacagcacauucuuuaucagacuggcuuacuccgccuauugggaaguugauaagaaagacaagggcauugggcggaauauccuuuucaaaaccaagcaagaggaaucucaguuuuacaaaaaguaucccacaauuuggcaucugcgcaagagccuccuggagaaccagccugaugcuuucuccgaccugagauacguguaccucgccuuucaccacaucaugaaauaucggggaaauuuccugcaugagggcgaaauuaagaccaacgagcuucaggugcaacagaucgaacagcugaaucaguuucucauuaacaaauacaaggagaucuaugauaaugacgucgaggaacgcacauucaucgcgaaccaccaaauugaugcccugaaagagauccuucugaauaagaacaccaauaaaacgaccaaggaaaaggagauuaaaaagcucuuugacuacgcugauugcgaaucucuggagccguauaucagcuguuucuccaaacuggccgugggcgggaaguuugaccucagcaaacugggauacgagggcaacauucaguucucugaccccuccuucgaagagaaggcuagcauccuucaggaugacuuuagacugaucgccauugcgaaggaaauguaugauuucguuauccucaacgaccugcuuaaagaucaaccuaaucugucuacagccauggugcacgucuacgagacccaucggcaggaccucaagaaacugaaggauauuaucauugacaucgaugcuaacaaagggcugcagaauaacgaccgcugguacuuuaaacucuucaaggauaaaaaugcccccaagaacuauuccgcuuuuauccacaaaaauagcaaccagaagagaccuucuauugacgaguucaaugacgagaucaaaaagauucugaucgagcaucggaacgaugugucccuugaaaagcaagacgaucugaaaaugcucuuugagaagguugaaaauaaaacacugcuuaagaccauugccauccagagcacguccgugauuccccaccagcugcaccucgacgagcuggaaaagaucaucgauaacgccucuacaaaguacccuuuccugagcaauauuagagacaaacucguccugcuuuuuaccuuccgcgugccguauuacuauggaccccugaacgauaaguccccuuacagcaauguggagcggaagcaguuugcuacagucacccccuggaacuucgacgagaucuuugaugaaaacaaaaccagagagaaguucaugaaaaagcucacaaauaacugcacguaucugucuggcgaaaccguuaugccuaaaaaggcgcuggccuacgaggacuaccuuauuuaugaucgccucaaugugcugcuggugaacggggaguaccucucccugcaagaaaaggagaaaaucuaucauuaccuuauuagccggcccaagacaacccuggaccagcucaaaaaggaacuggcuaaauggcacaaucagucuccgaucgauaucauuuucagcaacauccaugaggaaauuccuuuugaggccuccucucacgcccaucugaugaaguccuucgaccuugagaagcagaaagaagaacucgaaagauauaucacacuggcuaccauuuacgccgacgauaagaaaagccugaaggagcuccugaaaaaugaaagccuucuggacgagaaccaaaagaaugucauccucacgcugcccacaaagaaaugggcgccucugucuuauaaacuucuccagaacaucguguacaccgaugacuacggaguugugcacuccauucuggauaucaugaaagagaccaaucagaacuuucagaugguccugcacaaugaacaauaucauuucaaggagcucauugaacaggagaaccagaaauuuacacaagaaaagaccaucgaggaccugauugaggaaaaacuugagagcauccccucucugacacagcgcuccauccggcagacgcuccugauuaucgaugacauuaucaaggcuagccaccagaaggugcccgaaaagauuuucaucgagguuaccagaaauaacgaugacaagcgcaaaggccaagauggcaaccagcuggcccgggacaaggagcuuaauagauuucucacaaaccugcugaaagaugaaaaggccaaucaguucugugacgugucccagcuccugaaggaccuugaggaagucgauaaagugaagcugaaagggaagcauauuuaccucuauuuuaaacaacugggaaucgaccuguacaccggcaagaagaucguccuuaaccagcugcucacaucuaccaaauaugauacggaccacauuaucccucagagccugauuaaggaugacucccucgauaaucuggugcuuguugagcgcgaagugaaccugaaagucaaggggaaucacuacccggugcccucucggauccaggacgagcagaaaaagcucuggcauuuccugcugcaaaagaaagcuauuagcgagaagaaauauggaaaccuuaccagaacauccaagaucaaacuggaagagguugaagauuuuguggcccggcagaucaaugucauuaacuacagcaaugugaucauucgcgacauccucaagcugaaguacccucacaccgauauuaucuucucuaaaucccaauaucccagcuuuaucagaaagcaucucaaaauugugaagaaccgggacguuaaugacgcucaccaugccgucgaugcguaccugaacguggugucuggcaaucuucuguccacaaccuucagcaaagccuauaucagaaagaaauacauucagauccaggacggggagaaggaaacguucaacauggagacaauucucgagaacuauuuuaagaauaacgaaaaucagcugaaaaucaagaccaacugccugcgccgggaugcucuuauuacauucaaagucgacuacuuuucuggagaguucuauggccaaaccagacugccuaagggcaaugaaaaccucauccccaucacccugaaugaggauaacccgaugagcgacacauccaaauacgggggauacacgaaucucgcccaggcuuaucuguuugccgugagcuaccaggaagauggcgagaugaagaaggcgauucuucgcguuccuuaucuguacgacacccuguauaaaaacgauucugacaagcuccuguccaaagugcuugauaaucccaaggccacaaacauccagauucugagaaaaauccaccucaaucaaaagauucgguucaacgacgggaucuaccugcucuauaccaaugagaaggaucgcaacaaauacaagauggcuuaccagaauuauaucgacaacgacuaccuguauuaccuucacugggccaacaaacaucuggaggaacugcucgauaaucaggaaaagcagacauuuauuuauaacagcaaaaaugaccaauucgaggucuccaaggcuaagaacaaagagaucuuucaguaccugcuucagaagaccaaagccaagguguaugauacguguaauuacauuguuaaagccagagaaacaaacaucgagauuuucgaacagcugacccucaaggagcaaaucaccaugaucaaucaguggauuaaaaugaugucucgggacugcgaaaaggugaaguuugaugcucgcuucacaaacuucagcaauugucugcucagacuguccaacaauaucaacccuaaagacucuauuaccaucauuuacgagagccccacaggacuuuuuaagcacgaggucaaaaucuga

SEQ ID NO: 4158 - RNA, 4035 nt, Artificial Sequence
  Cas9 variant
augaagaaaaccaaccccuacauccugagccucgacauuggcacagccuccaucggguaugcuugcauggaucuggacuucaauauucuuaaguaccacgauaaagacgccaucggagugcugacguuugagggcgcggauaccgcugccgaaagacggggguuccgcacaucuagacggcgcaagaacagacggauuaaacgccucggacugcuucaggagguccuggccccucucguuaagaauccgaacuauuaccaacugcugaaucuccauaaguggaaaaacagcaaugaagacuuuaagcacagaucccugucugaggugcuuaaaacccugggcaagaaccccaaaacauauccuaccaucuaccaucuccagcaggauauccagaaucaccccgaaaagaaguucgagccugagcugauuuuucuugcucuguaucaucucgugaaauaccgggggcacuuccuguuuaacaaucugagcuucgacaagggaaaaacagucgauaacgaagcccaacucuccgagcugcuugaacaguaccagucuaucaaucccuaugagggcagcauuuuuaacaaggacaucaaagugauuguugauacccugaaggacgaucagcucacgcgcaaugacaaauccaaggagcugaagagaaacgugagcaaaacccacgcugaacuuuucaagaugcuggucggccucaaauuuaagcaaucuauccuguucgagaacauggaaaauguggaggacauuaaagaauccgccacagggagcgaugcgaucucucuguccgacgauuacuaugagaaccucagcgaguuucugaccgacgaacagcuuaauuucaucgagucugccaacacauucuuuaugggaauuaugcuggaucggauccucaagggcgcuaccuccauuagcgccgcuaagguucgcgacuacaaaaucuucaagaaucagcugaaacuuauuaaggauaucguguaucagaacaaauacgacaaguaucaugaauuuuucgucacguccaaggaggauaugagagccuaccaagaaaauccugacgcgaaaacauuugggaagcugucuaaauucgaucaguaccucauccacccgaaggaccaguaugccaaacugaugaaggaccugaagggaauugugcccaaaaaguacaccgaggugcucaaccugaucgaugagcaaaaauuucuugucguucagaauacaaccgacaacgcuagcauuccuuaucagaauaacguguucgaagccgagaauauccugcggaaccagcaaaaguacuaucccgaaauuaccgaggaaaugaucggcaaagugaucaaucucauuuccuuucgcaucccuuacuaugucgggccccugacaaacaagaacggacagagcgauuucgcuuggaugauuagaaaaucugacgagcaggcccugccguggaauuuugauaaggugaucgacaaguccaaaagcgccgagaaguucauucggagaaugacgucuaaauguaccuaccuucucgaagaggauguucugccuaagcauagccugcucuaccaggaaauggaggugcugaacgagcuuaauaacguccaacugcgcggcgaaaaugagcccaaacaccggauccacagacucgacccuaaggugaagcaguuuauuuaucauaaccuguuccagaaaaagaaaaauguuacacacaaggaucugaucacccuucuccagaacuccgaacaucgcaauacacugaacaaaaccucuggccaaaagcugaagguguucgggacgcagaaugacagcaaauuugcuuccaagcucagcacauacaacgauaugaaagcgaucuucggaucugucgagaauaagcggcagaugauugaggagcuggugcuuugggucaccaucuuugaggacaaagccauucugaagcagaagaucggcgaaaaauaucccaacauuaccgagaagcaacucaaucagaucgugaaacugaacuacuccggguggggaagacugagcgaaaaacuucucacaaaagagguuaacggccgcucucugaucgaucugauguauuccaccgaaaauaacuucauggagauuaucacagacaagacgcucggguuugacugcuucauuaaaaauagcaacaaggugaagaaugcuaaaaucuccuacaaggaugucgccgagcugcggaccucucccgcccuuaaaaagggaauuuggaacgcuaucaaaauggugagagaaaucagcaaucuguuuggcgccccugagaagauuaucauugaauuugcgacagaggaccagguuaagggcaaacgccaaaagucccggucugaacucugggaugaccuggugaaaaagaacaaucugaaaagaaacaaggaguuuaaggggcuuuucgaggaaaucaaggcuuauccggaucucgacuuuagcaaucccaagcuguggcuguacauucaccagaacggaaaauguauguacaccaagaaaccuaucgaucucgagcgccugcuuuccgacacaaauaaccagcuguaugaaaucgaucauauucucccccggaccuucgucaaggacgauagcaucaauaacaaggugcuggugauucagucugccaaccagaaaaaguccggcgacaaaaugccucuggagaucuuugauaaucacguucuuguccccuucuggaagaugcuguacgagaacgaccucauuucuagcuccaaacugagcaagcucaugaagaaagaguucaaugaccuggauaaggaaggguuuauccaaagacagcuuguggaaacgcggcagauuaucucucacgugagcgacuuccugaccgaggaauauccguccacaaccgucgugccuaugaaagccaacguugugagcgagcuccgcagaaaguuugauauccccaaaauucggcaacugaaugacuggcaucacgcugucgaugccuaccugaacggauucguguaucaggcugccagaguuuucuacccuaaggugaaucuuuucgaguuuaacuucaaaugggaaaagguccgcgagaaguggcggcagcugggcgaauuuacagagaauaacaaaaagagagaguucuuucucuucaaacgcauggaaaauuaugugaacgagcauggggaaggcaugaucucuaagcugauuuucgaccucgauaauuuuaaauucaacuacuccagaaagguugagagcaccgaauccgcguuuuacaagcagucugccuucagccccaaaaauacgacagcucaauaugacuccgauaagaacaaaaccgccaucuacaaggagaugaaaaauaagcggggaauuguggucucuuauacauacgugaagaaagaccaggaacugaucggcuaugggguguuuaacgagaccgucuucgaguacguuaacaaugcugauguggacaugaacacccgcgcccuuaagaucgugagaaaagcguuuccuaagcuggacauuaaaaagguccaguaucucuucagcaucaauaagggagauacacugcuggugaacggccaccccuuucuuuucguuuccgccuacgaacggauuaaugggaaacaacuggaguuugacaucgcuaugcagcgcaagauuaaacaggcccucucuccguacaacaauaugacggaacaggagaagguggaguucuauaaccaauuugcugaaaaagucaucgaggaguucagaaauagcaucggacugcagucccgggaucgcaaggugaaccucauuaaaaaucuguucaacaauaccgaaaagagcaacgacucuaugacacaguccauccuugaaguucugaagaugaccaaagugagcgccgaaagaucuaaggagcugaaaauucgguggaauggccagacaccuaacaccuuuaucgauacgaagaacaaugccgaaauucaauacaaauccaucacagggcucaagaccaccaagcccaaaagcauuuucaagcuggcugagucuaaaaacgaacuuuga

SEQ ID NO: 4159 - RNA, 4038 nt, Artificial Sequence
  Cas9 variant
augaagaaacccuacagcaucggccuggacauugggaccaacuccgugggaugggccgucguuacagaugacuauaaggugccugcuaaaaagaugaaagugcucggcaauacggauaagucucacaucaagaaaaaccugcuuggggcccuccuguucgacagcggaaauaccgcggaggauagacggcugaagcgcacagcuagacggcgcuacaccagacggcgcaaccggauucuuuaucugcaggaaaucuuuuccgaggaaaugggcaaagucgacgauucuuucuuucauagacucgaggacagcuuccuggugacagaagauaagcgcggggagagacacccgauuuuuggaaaucuggaggaagagguuaaauaccaugaaaacuuccccaccaucuaucaccuccggcaauaccuggccgacaauccugagaagacagaucuucgccugguguaucucgcccuggcucauaucauuaaguuuggcggccacuuccuuaucgaggggaaauuugacaccagaaacaaugauguccagcggcuguuccaggaauuucucgccguguacgacaacacguucgaaaauuccucucugcaggaacaaaacguucagguggaggaaauucugaccgacaagaucagcaaauccgcuaagaaagaucgcguccucaagcuguuucccaaugagaaaagcaacggaagauucgccgaguuccuuaagcugauugugggcaaucaggcggacuuuaagaaacacuucgaacucgaggaaaaggccccucugcaguuuucuaaagauaucuacgaggaggagcuugaggugcugcucgcucaaauuggggacaacuaugccgaacuguuccuguccgcuaagaaacucuacgauagcauccugcuuucuggaauccugacagucaccgacguuuccacaaaggcuccccucagcgcgucuaugauucagcgguauaacgagcaucagauggaucuggcccagcuuaagcaauuuaucagacagaaacuguccgacaaguacaaugaaguguucagcgauguguccaaagacggcuaugcuggguacauugauggaaagaccaaccaggaggccuuuuauaaauaccucaagggccugcugaauaagaucgaaggcucuggguacuuccucgacaaaauugagcgcgaggacuuucugcggaagcaaagaacguucgauaacggaagcaucccucaccagauccaucuucaggaaaugcgcgcuauuauccggagacaggccgaguuuuauccguuccuggccgacaaucaagaucgcauugaaaagauccucacauuucggauucccuacuaugucggcccucuggcuagagggaaguccgacuucgcguggcugagccgcaaaucugccgauaagaucacccccuggaacuucgacgagaucguggauaaggaguccagcguugaagccuuuauuaaucggaugacaaacuacgaccuuuaucucccuaaucagaaagugcugcccaagcacucucugcucuacgagaaauucaccgucuauaacgaacugaccaaggugaaauacaagacagagcagggaaaaacggccuuuuucgaugccaauaugaagcaggaaaucuuugacggcguuuucaagguguacagaaaagucaccaaggauaaacuuauggacuuucuggagaaggaguucgaugaauuucgcauuguggaccucacagggcuggacaaagagaacaaggcuuucaaugccagcuauggaaccuaccacgaucugcggaagauccuugacaaagauuuucucgacaacuccaagaaugagaaaauucuggaagauaucguccugacacucacccuguucgaagacagagagaugauucggaagcgccuuaaaaacuauucugaucugcucacgaaggagcaacugaagaaacuggaaagacggcauuacacaggcuggggcagacuuagcgcggagcucauccacgggauccgcaacaaggaaucccggaaaaccauucuggacuaucugaucgaugacggaaauagcaacagaaauuuuaugcagcucauuaacgaugacgcucugucuuucaaggaggaaaucgccaaagcccaggugauuggcgagaccgauaaucuuaaccagguuguguccgacaucgcugggagcccggccaucaagaagggcauucugcaaucucucaaaaucgucgacgagcuggugaagauuaugggacaucagccugaaaauaucguuguggagauggcucgcgaaaaccaguucacaaaucaggggagacggaacucccaacagcgccugaaaggccuuaccgauagcauuaaggaguuuggaucccagauccucaaagagcaccccgucgaaaauucucaacugcagaacgacagacuguuccucuacuaucugcagaauggccgggauauguacacaggggaggaacuugacaucgauuaccugagccaguaugacauugaucauaucauuccucaagccuuuaucaaggacaacuccauugauaaucgcgugcucacgucuagcaaagagaacagaggaaaguccgacgaugugcccagcaagaacguuguccggaaaaugaagucuuacugguccaaacugcugagcgcgaaacuuaucacccagcgcaaauucgacaaucugacaaaggccgaaagaggcgggcucaccgacgaugacaaggcuggauuuaucaaacggcagcugguggagacacgccagauuaccaagcacguggccagaauccucgaugagcgguuccacacggaaaccgacgagaacaauaaaaagauuagacaagucaaaaucgugacacugaagucuaaccuuguuuccaauuuucgcaaggaguucgaacuguauaaagugcgggaaauuaacgauuaccaucacgcucaugacgccuaucucaaugcggucaucggcaaggcccugcuggggguguacccccagcuugagccugaguuuguuuauggcgauuacccgcacuuccacggacauaaagaaaacaaggcuaccgccaaaaaguuuuucuacagcaauauuaugaacuucuuuaagaaagacgaugugagaacagacaagaauggcgagaucaucuggaaaaaggaugaacacauuucuaacaucaaaaagguccugagcuauccccaggugaauauuguuaagaaaguggaggaacagaccgggggauucuccaaggagagcauccucccuaaaggcaacucugacaagcugauuccccgcaaaacgaagaaauuuuacugggauacaaagaaguaugggggauucgacuccccuaucgucgcuuacagcauccucgugauugccgacaucgagaaaggcaaguccaaaaagcugaaaaccgugaaggcccuugucgggguuacaauuauggaaaagaugaccuuugagcgggaucccguggcuuuccuggaaagaaaaggcuaucgcaaugugcaagaggagaacaucauuaagcucccgaaauacucucuguuuaagcuggaaaacggacggaaaagacuucuggcgagcgcccgcgagcuccagaagggcaaugaaaucguccugccuaaccaucucgggacccugcuuuaucacgcuaagaauauccauaaaguggacgagcccaagcaccuggauuacguugacaaacacaaggaugaguucaaagaacugcucgacguggucuccaacuuuucuaagaaguacacacuggccgagggaaaucuugagaaaauuaaggaacuguaugcccagaacaauggcgaagaucucaaagagcuggcuagcuccuucaucaaccuccugacguuuaccgccauuggggcgccugcuacauucaaguuuuucgacaaaaauaucgaucggaagagauacaccucuacaaccgaaauucuuaacgccacgcugauccaucaaagcauuacaggacuguaugagacccggaucgaccucuccaaacugggcggggauuga

SEQ ID NO: 4160 - RNA, 4038 nt, Artificial Sequence
  Cas9 variant
auggagaacuacaauaucggccuggacauugggaccacaagcgugggaugggccgucguuaacgaugcuacgaauaaggugaugagaaaaggcgggaaggcccucuggggagugcggcuguucgaccccgcggucaccgcugaagaucgcagagccaaacggggcacacgcagacgguaugaccgcagacgggagcgcaucaaacuucugcaggaugaauuuaaagacgagauuaacaagguggauuccaauuucuuucucaagcuggaagagucuaaauacaccagcaaggacaucaaaaacaagacaguucuuauuuccauggaggaagagaaagccaucaagaaguauaaucaagaauacccuaccaucuaucaccugagacagaaacucaugaacucuaaugagcagauggauauucggcugguguaccuggcuauccaucacauuaucaaguaucgcgggaacuucauuuacgagggaaauagcuuuuccgucaacaaucucaacaucgacaauaaacugaaggaaauuuuccuuucucugagcgaggauguggacgaacucgauaucuccgaggaaugcaucaacaacauuaauuacaaacagcuggccaacaucuuuaaugagcaaagcaagaacgaccuuaaaguuaagcugacaucugagcucaccuccuauagccugaauaagaacuucauuucugaauuuuguaaacugaucauuggcaauaaguucuccgcuaaaaagcucuuuaaccuggagacggacaaugaugugagccuuucuuucgacggcaccgauuuugaagacaaagccggggaucuggagucccuccugaacgacuaccuugaaguccuggagcagcucaaggagcuguaugauaugguguuccugaagaaaaucuucggaggcagcaaggaaacaaccaucuccgggcucaugguggagagauacaaucagcauaaaaaggaccugaaacuucugaaggauacauuuucuagcgaccggaagauuuauaacaaaaucuuccgcuccaagaaagauauuaaggacgacaaagauaugugccucuacgaccuguauauccacaauaaacuugaaaccacggauuuucugaaggagauuaaaaaguacgucaacacagacaauuucaucaucaccgaugaagacuuucucaaaagacuggagaacaacgagguucugccgcggauuacaagcaaggaaaauggaaaauaccccuaucagcucaacaaggaugagcuggugucuaucauugaacaucaaggcaaacacuacccuuuccuucugaauaagaccgacgaugggaucuauaagcucgugagacugcuggaguuucgcauucccuacuucgucggaccucuuguguccaaagacaugagcgagaacgcguggaugcuccggaaugaaggcaugcagggcguucacaucacccccuauaacuuuaagaaagugauuaaucuggauaagacagccgagaucuucaucaaaagaaugauuucucauuguacguaccugcucgacgaagaggcucugccuaacaauagcauccuuuauuccgaauuuaagguccugaacgagcucaagcagauuaaagugaauggggagcaccugaccaaggaugaacagcauaaaaucauugaggaacuguucaugaagacaucuggaaccaucacagagaacaaauuucgcgaguuccuucucaauacccuggacuacaacuucuacgaaaaugagcugaagaucacgggcuauagcgccgacugcaaguuugcuaacaacaugcaauccuacauugauuucuuuggggaaaauggaaucuucgagggcacaagcuauaacaccaaugacgccgaaaagauuaucgaguggauuaccaucuuugaugacaaggauauccucaaacggaagguugaaaacgaguacccggagcugaaaucuaaucaggugaagaacauucuuaauaagaaauauuccggguggggaagacugagccgcaagcuccugcuggaccuucggguccucgauaaagaaacagacauccccaagucuauuauggaucugauguacgagaccgacgaaaacuucaugcagaucauuaauaacgauaaauauaauuuucaaaagcugaucgcgaaagagaacaagaucgagaauacauccaacgaccucagcuacgauguggucgaaaaucuggccacguccccugcuaccaagagaggcauuuaccaggcccuuaaagugguuaaggagaucacaaccuauaugggcuacgaacccaaaaacauuaugguggagauggcucgcggggacgaaaagaaaauccggaaggacgauagaaagaaauaucugcagaagcucuacgacaacauuaaagaugaggucgacucuaauuauaagaaccugaaaaaggagcuggccaaggaagagaaaaucgauacagacaaacuuuaccucuauuaccugcaggaaggaaagugucuguacugcggcaagccuauuaauguggaugaccucaacaccaaaaauagccuguaugagaucgaucacauccuuccccgcacgcugauuaaggacaacuccugggauaaucggguucucguguguagagggugcaaccaaaagaaagccgcuucucugguccugccgaaggaguuccggaaugacuacaccaaaagcaucuggauucgccuuaagaacaauaaacugauguccaacaagaaguuuuauaaucucacaagaaaaagcuacucugaagaggacaucaagggauucauuaaccggcagcugguggaaaccagacagaucacaaaacacguggcgaauauccucaacuguuuuuauccuaagaccaaaauuguuuaccugaaggccaauaucucccauagcuaucgcgauaaauacgaccuuuucaaguuucgggauauuaacgacuaccaccaugcucacgaugccuaucuggccgcuacgcucggcucuuaccaggagaaguaucugcauuacgaccuggauuauaacaaaaucaaugaguucaacgaaaaacuuauuaagaaugaagacuacaagagacugcacuaugggaucgucgugaacucccucgaugaggaguuccaaagcgccuuugcggaaaucgcuccccgccugauuaaugaggaaacaggcgagcuccuguucaacgccaaaaaguuuaaugaccuuguggaggauacccuguacagaaacgacauccucauuucucggaagacagaaauccgcaccggaaaacuguacaaggagaccauuuauaaaagaggcaaggggaauaucaaaauuaaggaaaacaugccuacagagacguacggaggcuauagcaauauggaaaccuccuaccugacacuugucaaguaugggaacaaaaccaagcugaucggaauccccaugagcauugccaauaacaaagaugugaagguuaaacucgacuucaucaaggagcaccuggaccucaagucucuggauaauauugugauccuuaaagacaacauucccuacgaugucuccaucaacuauaagaaucaggacguguacguuaaaggcuacagcacagcuaacaagaauugcgagcuguccaacgcccaucagcugaaaaucaagaaagauaugaugaagaaguguaaauaugugcucaauaaggucuacaaaaacaaguaugacgauauuaccaauauggacaucgaaaacgcuauuacguuuaucaauuaccuguucgagauuaaaaucgaauuuccucuuuucucuaaggagaucacaaagauucaggauaacaucaaucugaccgaaugcagcuuugagcaacucgccaacauuaucaaacagcugcucauuaucuaucacugcaauuccaagaacgggaaucugaaagaguucggccuuucugaccggauuggacgccugagcggcgcgaacgugaccgggggagauuuuaucuucacauccguuaccggccugaaggaaaagacagccucuuacgacggggaguga

SEQ ID NO: 4161 - RNA, 4038 nt, Artificial Sequence
  Cas9 variant
augguggagaaguacggcaucgggcuggacauuggaaccagcacacucggcuggacguccgucgaugaaaacgggaaaauccagagacugaagggacaaaccgcccuuggcacacggcuguucaaugaggggcagaccgcugaagaacgcagaggauuucggacaacccgcagacggauucagcgcagacgguggcgccucagacugcuucgggaaaucuucgacgagcccauuggcucuguugaugccggcuuuuucgcgcgccagaaaaugagcucccugucuccucaagacgauagauuugaggacacauaucggcuuuucaacaaucagaccgauaaggcuuuucacgacgaauacccgacgaccuaucaucugcgccaggcccugaugaacagcgauagacaguucgacauccgggagaucuaccucgccauucaccauaucgugaaauauagagggaauuuucugcgcuccggaaagcccgcugauuucaagacaggcaaacuugaccugaaggaaaaauuugaggagauuaacgccgauuggcaaacccucaucucugaagacgcuccucagcugcccguggacgaucuuacaaccauuaaggccguccugguggacgggagccgguccagaagcgaucgccagcggggacucguuaaacuguggauggcgaaugagacgguggaaaagaacuggaagccugucaugacagagcuggccaaagcuauccucggccugaagaccaaacuuuaccugcucacagggcuggaccuucccaaggaagaucagaaagccuggaccuucucucuggacacccucgaggaucaccaaggagacauugauuccuuuuucgacgaucaugcucagcagcugaucgacagacuggccgagcuccgcgcgaugauccaacugacagaaauuaucccuagcggccuuaauuucucucaguccauggugcagcgguaugaggcccacagaagccaccuggaaauguacaagcaguacgcucucgaccaaacggauccgaaacgcaccaaggcccugcgggcugccuauaacgccuacauugaccagcaugagaucgcugaugacuuuuauacagcgguuaagagagugaccaaagaugaccagucugaaacagccgaggagauuaaucgccuuaucggccuggaacaguucaugcccaagcaacggaccaaagagaacggggucaucccuuaccaggugcaccagcaggaacucgaucaaauuaucgcucaucagaagaaauauuaccccuuucugggaacggagaauccugugauugaccacagagaaucccagcccuauaugcuggaugagcucgucagcuuccggguuccguacuacgugggcccuaugguggccgccaaccccgagcugaagacaaccgaaaauccuuuugcuuggaugauccgcaaggcccagggggagauuacccccuggaacuucgacgaaaaagucgauagaaagggauccgcgacagcuuuuaucgagcggaugaaaaccacagacacguaucuucugggcgaggaugugcucccccaacagucucugcuguaccagagauucaugguucuuaacgaacucaauaacauccgcauugacgacgagcugcugaccacaaaucaaaagcaguggguguuugaucgggucuucaaagggaagggaaccaucagcgccaagcaccuccaggacgcccugaaacaucacggcgaaacagauggccuuccuaagauuuccgggcuggcugacccgaccaaauuuaacagcgcccucacgucuuauagagauuuccagaaguggcugcccaaugacaucgaucgcaaagacagaaccgcugauauugagacaaucauuaacugguccaccguguuugaagacacacauaucuucguugagaagcugaaggagaucgaauggcuuaccgccgaucaacggcgcagaauugcgagcaaucgguaccgcggauggggcagacucucuaaacaucugcugacggagaucaaggacgaacaggggcucagcauuauggaucagcuguggcggacacagcacaacuucaugcaaaucgugcacgagccugacuaugccaaacagauugaagcugccaauaccgucggaauggcuaagcaggacaucggcacagugaucaacgaucuuuacaccucuccccagaauaaaaaggccauucgccaaguccuggcggugguuaaagacauccagaacgcccaccaugggguggcuccuuccuggauuuuuauggaggccgcuagaggcgccgaucagaauccccaacggagccgccagagacagcggcagcuccaagaccuguaugccaagaccgcugcggaucuggucgacacagaggugcagcaggaacuuacggauaagaucaaagacaaggccaacuucaccgauagacucaugcuguacuuucugcagaauggacaagacauguacuccaaagagaagcucaacauugaucgccugagcgaauaugacaucgaccacauccuuccgcaggcucugauuaaagaugacucucucgauaaccggguucuggugcaucaguccaucaauagaaacaagagcgacacauucgccucugagaaguacggcgccaaaaugcagggggcuuggcaccaauggcgcgccgcgggacugauuuccgcucggaagcucagaaaucucgaaaugcgcccugaugagaucagcaaauaugccaccggcuuuauucggagacagcuggucgagacacgccaggugaucaagcuggugaccgaaauccucucccaccaguacaaccccgaggaaacgaaacugguuucugucaaggccgggcuuagccaugagcugcggagagaggcuggacucccuaagcugcgggaccugaaugauuaucaccaugccauugacgcguaccuugcugcccgcaucggcacauaucugcucaaaagauacccccggcuggaacgcuucuuuguguacgggcaauuccagaccuccagacucgaucugcggagauuuaacuucauucacgaccuugugaagucuaaacagggcgucaucguggauagcgacaccggagagauucugugggaucgccaaaaggacaucgacuauauuaaacaucucaugggccugaagcaucugcuuguuacacacgaaguguacgauuccgccgcugagauguaugcccagaccaucuuuaaggcuagcgacaaugauucuaaaguccugaucccuacaaagaacgaccggcccacggccauuuacgggggauauaccaaaagacgcaauggcuaccucgcgauccugaagauuacagagaaaaaggccgagaccuaucgggugguuggggugccgacacucuacaugucccagcuggcuaccgccagaagccacucugucgaggcugaaaaagcccuucugaagucccucauggccccugagauccugagcgaaucuaaggugguuagcuucgagguggucgugucccacgugcaucugaaccagcuuguccgcgauacgguuuuuggacccgcucacuacuucggccuggggcccuuccgguaugugagaaauuuucaucaacucgugcugccuuucaaagaccaggaaauucucgucaagcgcaccccgacagaugaggagcugaacaccguguuugaagacaucugcuggcagguugagaauuacuucgcgguguuugauaucaacggcuucagaaaugcccuuaaaaagagcauugacaaauuugaacagcugcccaucgagaacgucuucaaggauaagaaacuggugacacaaggaaagaaagaaguucucgcuuuugugaugcagggccugcacgccaacgccucuuaucggaaucuuaaggucucccuggggauuaaaaccccucucggacagcugcagcucacaaaguucaugcugagccgcgacgcugagcuuaucgaugagucccccaccggccuguuuagacggauucgcagacugaaggaccucuga

SEQ ID NO: 4162 - RNA, 4038 nt, Artificial Sequence
  Cas9 variant
augggcaacaagcugagaaauguggacgauuacuaucucgggcuggacaucggaaccgagagcgucggcugggccguuacagauaaauacuaugugauucccaaguucaaagggaacgcuauguggggagugcaccuuuuugacgaaggcgagacguccgucaagcggcgcggguucagaucugcccggcgcagaacccagcggaaacgcgaaagacuggcgcuccuggaggcucuuuuugaugaagagaucugcaagaaggacuguacauucuuucggcgccugcaugagagcgaucucuggccugaagacaaauccggagaugacaaguacgccguguucgccgaugagaauuauaccgacaaagauuuucacaaggaauacccgacaauuuaucaucugagauacgagcugaucaaaaacaaggagccccacgacguuaagcucguguuccuggcucuccaucacauuaucaaaaaucggggccacuuucuguucgacucucucagcuccgccgaagauuuuaacucugcuuacgagaccaugugcagcuaucuguccgacaaugaaauccaacuuaacuguagcgauauugagcaguucaaggccauccugaaagaccgcagacagggcaagauugaaaagacaaagaaucucgcgucucuguuugggaucaccaaaaaguccgauccugucagcuacgccgugauggcuguucugucuggauccacggugaagaugugcgaccucuucggcgaugacgagcugaaaaccgucgagaagaacaauauuagcuucgccucuggguaugaagagaacgaagagaucuacgcuuccgugcuuggagaucgguuugaacuggugaaaauucucaaggccgucuaugacugggcgguucuggccgauauccuugacggcaaaaaguacaucagcgaggcuaagguggccguguaugagaaacauaagaaugaccugaaaacacucaagaaauacgucaagaccuaccugcccgaaaaguauaacgagauuuucaaaaucuccgaugggaagaaagacaauuacguggcuuauucuggacacauuaaggaaagcggcaaaacaggcgagcugaagaagaccuguaacuccgaaaacuuuugcgccuaccucaaaaagacgcuggggaaaaaugccgaucuuagcuauaaggagauguucgacgagaucgaaaacaaaacauuuaugccuaagcagguuaccaaaucuaauggagugguccccaugcaagugaacgaggaggaacugaaggcuauucucgauaaugcgaaggacuaccuguccuuccuuaacagcugugaugagaauggcguuucuguguaugacaaaaucaucaagauuuuugaauaccgcaucccuuacuaugucgggccgcugaacacacauaccgagaauagcuggcucaaaagaaaggauggagugaaaauuuaccccuggaacuucgacgaugucguggacaucgauuccucugccgaaaaguuuauuaauaaccugaccagcaagugcacauaucugccugagugugacguuauccccaaaugcucccuccuguacagcaaguucacggugcuuaaugaaaucaacaaucugaaacucaacggcgaggacauuccugucgagcugaagcaggggaucuauaaagaucuguuuaugacccggagaaaggugacaguuaagcagauuaaagacuaccuuaaggcucgcggauguuaugauaacaaugacgugcucucuggcaucgauaccacagucaaauccagccugaagucuuacuucgacuuuaaaggcuucgaaucccugaccuucgaugacaaggagagcauuaucgccuccucugugauuuuuggggaugacaagaaacuccugaagaaacggcuuaagaaacuguuccccgaaaagcucacggaugaggacaucaaaaagaucugcaagcugaaauacacaggauggagcagacuguccaaggaauuucuuugcgauguggaguucaccuauaaaaagaccggcgagguuaugaacgucauuacagcccucugggaaaccaauuacaaccugaugcagauccuguauucugaggacuuuuguugcgacggggaugagaaaaagaaucucaacgacaagcuggaugaacuuagcuacacaggagaccaacacucccugcgcaaagcuguggaugcccucuaugugagcccgaaggucaaacggccuauucugagagcgcugcuuaucgcuaaggaaauugagaaaauccaggagagacccccuaagaagaucuucguggaaguugcccggggcauugacaauagagaggaacgccaccgggauucucgcaaaaaccgccucauggagcuguacaagaauuguaaaaaggaggccgaaaaauuuugccccuauuucgacgcucuguccaagaagcucagcgaugaggacgaaucuaaacugcggagagauaaacuuuacuuuuacuauauccagcuggggaaauguauguacacgggcgaggaaauuucccucggagagcugaugaacggcaaugggcgguucgacaucgaccauauuuauccccgcagcaagaucaaagaugacucucugaccaacaaggugcuugucaauaagacagugaacaauaacaaaaccaacguuuacccuaucgaugccgcuauucagagcaagauguccccguauuggcaaaugcucagaagcucuggacugaucuccgaggaaacauacaaacggcugaccagaaagacgccccucaccgacgaugagcugagcgccuuugugucccgccagcuuacagaaacccagcaaucuacaaaagcggucgcccacauucuggagcagcucuauccuaagcccaaaaccgaaaucguguacguuaaggcugcccuggugcaugcuuuccggcagagcaaugacaugcugaagugcagagaggucaacgaucuucaccaugccaaagacgcguaccugaauauuguggugggcaacgccuauaaugucaagguuacgcacaacaaagugaauuuuaucaaggggcuccagaacaaugauaaaggauacacagugaacccugagaaguucuucucccacgacauccccggcgcuuggucugucaaggauagcaugaauaccgugcgcagauuuaugaacaaaaauaacauucgguauacacgcuucccgagaaagaaacaagggggccuguuuaagaucaauccucucaaaaagggaaacggccagguuccccugaaggccuccggggcucggucuuguauugaaaaauacggaggcuaugacaaggccaccagcgccuacuucuccuauguggaguacaccgauaaaaaggggaaagcuguccgccagauguuuccugugaaccuuuacgaaguuaaggaguaugaagcggacaugcagggauucgugacaagcagaaucgccgaggcuucuaaugucaagauucugauccccugcgugaaauacgacgccuguauuuccuuugauggcugccggauguucaucacgaagaaaaccgggaaccgcaucggcuauaagccuggaaugcaacucguucugggcuacaaauaugagaaguacauuagaaauaucgaaaacuaucugacaaaacauaaggaccgggagauuaucccccgcgauaauauuagcgccgaagagaacaucgagcuuuacgacauccugaccgggaagaugcucaauacagugcugucugucaaauuuuccggaauuggcaagaaacucgaaaagagacgggagaaauucgugcuguguagcccggaggaacagugcugcgugcuuaacgaaauccugaagauucuccacgcuaauguccugucuggggaucugucccuuaucggagagagcccuaacaccggcacgaugaagacaaaugccaaauuuuccgagauuaaggacguucauagcaucaaacugaucaaccagucugugaccgggcuuuucgaacaggagauugaucugcucaaguga

SEQ ID NO: 4163 - RNA, 4038 nt, Artificial Sequence
  Cas9 variant
augggcaagcccuacagcaucgggcuggacauuggaaccaacuccgugggcugggccgucguuacagaugacuauaaagugccugcuaagaaaaugaaggugcucgggaauacggauaaacagucuaucaagaagaaccugcuuggagcccuccuguucgacagcggcgagaccgcggaagcuacaagacugaaacggaccgcccgcagacgguacacacgcagaaagaaucggcuucgcuaucugcaagagauuuuuaccggggaaaugaacaaagucgaugagaauuucuuucagagacucgacgauuccuuccugguggacgaagauaagcggggagagcaccauccgaucuuuggcaacauugccgcugagguuaaauaccacgacgauuuccccacaaucuaucaucugcgcagacaccucgccgacaccucuaagaaggcugaucugcggcuuguguaccuggcccucgcgcauaugaucaaauuucgcggccacuuccuguaugaaggggaccuuaaggccgagaauacggacguccaggcucuguuuaaagauuucguggaagaguacgacaagaccauugaggaaagccaccucuccgagaucacaguugaugcccugucuauucugaccgaaaaagugagcaaguccagcagacucgagaaccugaucgcucauuacccuacagagaaaaagaauacccuuuuuggaaaccugauugcccucucucuggaccuucaccccaauuucaagacgaacuuucagcuguccgaagaugcgaaacuccaauucagcaaggacacauaugaggaagaucuggagggcuuccugggggaagucggagacgaguacgccgaucucuuugcuucugccaaaaaucuguaugacgcuauccuucuguccggcauucucaccguggaugacaacagcacaaaggccccucugucugccuccauggugaaacgguacgaggaacaucagaaggaccuuaagaaacugaaggauuucaucaaagucaaugcucccgaccaguauaacgcgaucuuuaaggauaaaaacaagaagggguacgccagcuauauugaguccggaguuaaacaggacgaguucuacaaguaccucaaaggcauccugcugaagauuaauggcucuggggauuuucucgacaaaaucgaucgcgaagacuuccugagaaagcaacggaccuuugauaacggaagcauuccucaccagauccaccuucaggaaaugcaugcuauccugagacgccagggcgagcacuauccguuccucaaggaaaaucaagacaaaauugagaagauccugaccuuucggauucccuacuauguggggccucuggccagaaaaggaucccgcuucgccugggcugaguacaaggccgaugaaaagaucacacccuggaacuuugacgauauucuugacaaggagaaaagcgcggaaaaguucaucacgcggaugacccucaaugaccuguaucugccugaggagaaggugcuccccaaacauucuccgcuguacgaggcuuuuacagucuauaacgaacuuaccaaggugaaauacguuaaugaacagggcgaggccaaguucuucgauacaaacaugaaacaggaaaucuuugaccacguguucaaggagaauagaaaggucaccaaagauaagcugcucaacuaccugaauaaagaguuugaagaguuccgcauugugaaccugacggggcuugacaaggaaaauaaagccuuuaacuccagccucggaacauaucaugaucugcggaagauccuggacaagucuuuccucgaugacaaagcuaaugagaagaccauugaagauaucauucaaacccugacacuuuuugaggacagagagaugauccgccagcggcugcagaaauacagcgauauuuucaccaaggcccagcucaaaaagcuggaaagacgccacuauacaggcuggggccggcuguccuacaaacuuaucaacgggaucagaaacaaagagaauaagaaaacgauucucgacuaucugaucgaugacggauacgcuaaccggaauuuuaugcaacugauuaacgacgaugcccucucuuucaaggaagagaucgcgcgcgcccagauuaucgacgauguugacgauaucgcuaaugugguccacgaccugccuggcagccccgccauuaaaaaggggauccuucaguccgugaaaauugucgaugaacuggugaagguuaugggacauaacccugcuaauaucauuaucgagauggccagagagaaccagaccacagacaagggccggagaaauagccaacagcgccucaaacugcugcaggauucucuuaagaaccucgacaaucccgugaacaucaaaaaugucgaaaaccagcaacugcagaaugaucggcuguuucucuauuacauucagaacgggaaggacauguacaccggcgagacacuggacaucaacaaucuuucccaguaugauauugaccacaucauuccccaagcguucaucaaagauaacagccuggacaauagagugcucacccgcucugauaagaacagaggaaaguccgacgauguuccuagcaucgaagugguccaugagaugaaauccuuuuggucuaagcugcugagcgugaaacuuauuacgcagcggaaguucgacaaucugaccaaagccgagcgcggcgggcucacagaagaggauaaggcuggauucaucaagagacagcugguggaaacccggcaaauuacaaaacacguugcccagauccucgacgagcgcuuuaacaccgaauuugauggcaauaagagacggauucgcaacgucaaaaucauuacgcugaaguccaaucuugugucuaacuuuagaaaagaguucgagcuguacaaggugcgggaaaucaaugacuaucaccaugcucacgaugccuaccucaacgccgucguggggaaugcucugcugcuuaaguauccgcagcuggagcccgaauuuguuuacggagaguauccuaaauacaacagcuaccgcuccagaaagagcgcgacagaaaaauuccucuuuuauucuaauauccugcgguucuuuaagaaagaggacauucagaccaacgaggacggcgaaaucgccuggaacaaggagaagcauauuaaaauccucagaaaggugcuguccuacccccaagucaauauugugaaaaagacagaggaacagaccgggggcuucagcaaagaaucuauccuuccuaagggagaguccgauaaacugaucccccgcaagaccaagaacagcuauugggacccgaaaaaguacggcggguuugauucuccuguuguggcuuauagcauucucgucuucgccgacguggagaaaggaaaguccaaaaagcugcggaagguucaggauauggugggcaucacaauuauggaaaagaagagauucgagaaaaaucccgucgacuuucuggaacagcgcggguaccggaacgugagacuugagaagaucauuaaacugccuaaguauagccucuucgagcuggaaaauaagcgccggagacuccuggccucugcuaaagagcuucaaaagggaaacgaacuggugaucccccagcgcuuuacgacccugcucuaccacuccuaccggaucgagaaagauuaugaaccugagcauagagaguacgucgaaaagcacaaagacgaguucaaggaacugcuugaguauauuagcguuuucucccggaaguacgugcuggccgauaauaaccucacaaaaaucgaaaugcuguucucuaagaauaaagacgcggaggugagcucccucgcuaagucuuuuauuagccugcuuaccuucacagccuuuggcgcccccgcugccuucaacuuuuucggggagaauaucgaucgcaaaagauauaccuccgucacggaaugccugaacgcgacacugauucaccagucuaucaccggccucuacgagacccggauugaccugagcaaacuuggagaagauuga

SEQ ID NO: 4164 - RNA, 4038 nt, Artificial Sequence
  Cas9 variant
auggaccagaaguacagcaucggccuggauauugggaccaacuccgugggaugggccgucguuacagacgauuauaaagugcccgcuaagaaaaugaaggugcucggcaauacggacaaacaaucuaucaagaagaaccugcuuggggcccuucucuucgauagcggagagaccgcggaagcuacaagacugaaacggaccgcccgcagacgguacacacgcagacggaaucgccuuagauaucugcaggagauuuuugccgaagagaugaacaaggucgacgaaaauuucuuucagcggcucgaugacuccuuccugguggaugaggacaaacgcggcgagagacacccuaucuuugggaacauugcugccgaaguuaaguaccaugaugacuucccgaccaucuaucaucugcggaaacaccucgcugauaucucucagaaggccgaccugcgccuuguguaccuggcgcucgcccacaugauuaaguuuagaggacauuuccugaucgagggccaacuuaaagcugaaaauacaaacguccaggcccuguuuaaggacuucguggagguuuaugauaaaaccguggaggaaagccaccucuccgagaugacggucgacgcucugucuauucugaccgaaaaggugagcaaaucccggcgccucgagaaucugaucgcccacuaccccgcggaaaagaaaaacacacuuuuuggcaaucugauugcccucagccuggggcuucagccuaacuucaagaccaauuuucagcugucugaggaugcuaagcuccaauucuccaaagacacauacgaggaagaucuggagggacugcucggcgaaaucggggacgaguaugccgaucuguucgcuagcgccaagaaccuuuacgacgccauucugcucucuggaauccugaccguggaugacaauuccacgaaagcuccccuuagcgcgucuauggucaagagauaugaagaacaucagaaagaucugaagaagcucaaagacuuuaucaagguuaacgccccugaccaguacaacgcuauuuucaaagauaagaauaaaaagggcuaugccggguacaucgagaacggagugaagcaggacgaauuuuauaaauaccugaagggcauucugcuccaaaucaauggcuccggggauuuccuggacaaaauugaucgggaggacuuucuuagaaagcagcgcacauucgauaacggaagcaucccccaccagauccaucugcaagaaaugcacgccauucuccggagacaggaggaacacuacccuuuucugaaagagaaucaggacaagaucgagaagauucugaccuuccgcaucccguauuacgugggcccccuugcucggaaaggguccagauuugccugggcggaauauaaggcugaugagaaaauuacaccuuggaacuucgacgauauccucgacaaggaaaaaucugccgagaaguuuaucacccgcaugacccugaaugaucuguaccuccccgaggaaaaaguccugccuaagcauagccuucuguaugagacauucacgguguacaacgaacucaccaagguuaaauaugugaaugagcagggagaagccaaguuuuucgacgcuaacaugaaacaagagauuuucgaccacgucuuuaaggagaaucggaaagugacaaaggauaagcugcugaacuaccuuaauaaagaguucgaggaauuuagaaucguuaaccucaccggccuggacaaggagaauaaagccuucaacuccagccuggggacauaccaugaucuccgcaagauucuggacaaaucuuuucuugaugacaaggcuaacgaaaagaccaucgaggauauuauccagacgcugacacucuucgaggaccgggaaaugauuagacagcgccugcagaaauauuccgauaucuuuaccaaggcccaacugaaaaagcuggagcggagacacuacaccggauggggccggcucagcuauaaacugaucaauggcauucgcaacaaggaaaauaagaaaacaauccuggacuaccucauugaugacggguaugcgaacagaaauuucaugcagcugaucaacgaugacgcccuuucuuuuaaggaggaaauugcucgggcccagaucaucggagacguggaugacauugcuaaugucgugcaugaucugcccggcagcccggccaucaaaaaggggauucuccaguccgucaaaaucguggacgagcugguuaaggugaugggacacaacccugcgaauauuaucaucgagauggccagagaaaaccaaaugaccgauaaaggccgcagaaauucucagcagcggcugaaacuucuccaggacagccugaagaaccuggauaaucccgucaacauuaagaauguggagaaccaacagcuccagaacgaccgccuguuccuuuacuauauccaaaaugggaaggauauguacacaggcgaaacgcuggacauuaacaaucucucccaguacgauaucgaccacauuaucccucaggcuuuuaucaaagacaacagccuggauaauagaguucugacccggucugacaagaaccgcggaaaauccgaugacgugcccagcauugaggucgugcaugagaugaagucuuucugguccaaacuucugagcgugaagcucaucacacagagaaaguuugauaaucugaccaaagccgaacggggcgggcucacagaggaagacaaggcuggauucauuaaacgccaacugguugagaccagacagaucacgaagcacgucgcccagauucuugaugaacgguucaacaccgaguuugacggcaauaagcgcagaauccggaacgugaaaauuaucacacugaaguccaaucucgugucuaacuuccgcaaagaguuugaacuguauaaggucagagagaucaaugauuaccaucacgcccacgacgcuuaucugaacgcggugguugggaaugcccuucugcucaaauacccccagcuggaaccugaguucguguauggagaauacccgaaguauaacagcuaccgguccagaaagucugcuaccgagaaauuucucuucuacagcaacauucugcgcuuuuucaagaaagaggauauccaaacaaaugaagacggcgagauugccuggaacaaggaaaaacauaucaagauucuucggaagguccuguccuauccccaggugaauaucguuaaaaagaccgaggaacagacagggggcuuuagcaaagagucuauccucccuaagggagaguccgauaaacugauucccagaaagacgaaaaacagcuacuggaauccuaagaaguauggcggguucgacucucccguggucgccuacuccauccugguguuugcugacguugaaaaaggaaagagcaaaaagcugcgcaaagugcaggauauggucggcauuaccaucauggagaagaagcgguucgaaaaacacccgguggacuuccuugagcaaagaggguaucgcaacgugcggcucgagaagauuaucaaacugccuaaguacucucucuuugaacuggagaauaaaagacgccggcuucuggccagcgcgagagaacugcagaagggaaacgagcucgucaucccccagcgguucacaacccugcuuuaucauuccuaccaaauugaaaagaauuacgagccugagcaccgcgaauauguugagaaacauaaggaugaauuuaaagagcugcucgaauacaucagcguguucucuagaaaguaugugcuggcugacaacaaucucaccaaaauugagaugcuguuuuccaagaacaaggaugccgaggucagcucccuugccaaaucuuucaucagccugcugacauuuacggcuuucggcgcccccgcggcuuuuaauuucuuuggggaaaacauugaccggaagcgcuacaccuccgugacagagugccucaaugccacccugauccaccagucuauuacaggccuuuaugaaaccagaaucgaucugagcaaacucggagaggacuga

SEQ ID NO: 4165 - RNA, 4038 nt, Artificial Sequence
  Cas9 variant
augaagaaagaguacagcaucggccuggacauugggaccaacuccgugggaugggccgucaucacagaugacuauaagguucccgcuaaaaagaugaaagugcucggcaauacggauaagcagucuauuaagaaaaaccugcuuggggcccugcucuuugacagcggagaaaccgcggaggcuacaagacugaagcggaccgcccgcagacgguacacacgccggaaaaauagacuucgcuaucugcaagaaaucuuuaccgaggaaaugaacaagguggaugagaauuucuuucagagacucgacgauuccuuccuggucgaggaagacaaacagggcucuaaguacccuauuuuugggacacugaaggaggaaaaagaguaucacaagaaauucaagaccaucuaccaucuccgggaggaacuggccaacagcaaagagaaggcugaucuucgccugguguaucucgcccuggcucacaugaucaaauuuagaggacauuuccuuuacgaaggcgaccugaaggccgagaauacggauguucaggcgcucuuuaaggacuucguggaagaguacgauaaaaccauugaggaaucccaccugucugagaucacagucgacgcccugagcauucucaccgaaaagguguccaaaagcucucggcuggagaaccuuaucgcucauuauccgacagaaaagaaaaauacccuguuuggcaaccucauugcccugucccuugggcugcaacccaauuucaagacgaacuuucagcucagcgaggacgcuaagcugcaguucucuaaagauacauacgaggaagaccuggaggaacuccugggagagaucggcgaugaauaugccgaccuuuucgcguccgccaagaaucuguacgaugcuauucuccugagcgggauccuugccguugacgauaacaccacaaaagcuccucugucugccuccauggugaagcgcuaugaggagcaccagaaagaccucaagaagcugaaagauuuuaucaaggucaaugcccccgaccaauacaacgcuauuuucaaagauaagaacaaaaagggauaugcgggcuacaucgaaagcgggguggagcaggacgaauuuuacaaguaucugaaaggcauucuccugaagaucaauggcuccggcgacuuccuugauaaaauugacugcgaggauuuucugagaaagcagcggaccuucgacaacgggucuaucccucaccagauccaucuccaagagaugcacgccauucugcgcagacagggagaacauuaccccuuucugaaagagaaucaggauaagaucgagaaaauucuuaccuuccggaucccuuauuacgugggaccgcucgcuagaaaggggagccgcuucgccugggccgaauauaaggcugacgagaaaauuacacccuggaacuucgaugacauccuggauaaggaaaaauccgccgagaaguuuaucacgcggaugacccugaaugaccucuaccugccugaagagaaaguccuucccaagcacagcccucuguaugaaacauucaccguuuacaacgagcucacaaaggugaaauacgugaaugaacaaggagaggcgaaguuuuucgauaccaacaugaaacaggagauuuucgaccacgucuuuaaggaaaauagaaaagugacgaaggauaagcugcugaacuaucuuaauaaagaguucgaagaguuucgcaucguuaaccucacaggccuggacaaggaaaauaaagccuucaacucuucccuggggaccuaccaugaccuccggaagauucuggauaaaucuuuucuugacgauaaggcuaaugagaagaccaucgaggacauuauccagacacugacccucuucgaagauagagagaugauucgccagcggcugcaaaaauauagcgacaucuuuacaaaggcccagcugaagaaacuugaaagacgccacuacacgggauggggccggcucagcuauaaacugaucaacggcauuagaaacaaggagaauaaaaagaccauccuggauuaccucauugacgauggguaugcuaaccgcaauuucaugcagcugaucaacgacgaugcccuuuccuuuaaggaggaaauugcucgggcccagaucaucggagacguggaugacauugcgaaugucgugcaugaccugcccggcucuccggccaucaaaaaggggauucuccaaagcguuaaaaucguggaugagcuggucaaggugaugggacacaacccugcuaauauuaucaucgaaauggccagagagaaccagacaaccgacaaaggccggcgcaauucccagcagagacugaaacuucuccaagauagccugaagaaccuggacaaucccgucaacauuaagaauguggaaaaccagcagcuccagaaugaucggcuguuccuuuacuacauccaaaacgggaaggacauguauacaggcgagacccuggauauuaacaaucucucucaguacgacaucgaucauauuaucccucaggcuuuuaucaaagacaacucccuggauaauagaguucugacgcgcagcgacaagaaccggggaaaaucugacgaugugcccuccauugaggucgugcacgaaaugaaauccuucuggagcaagcugcuuucuguuaagcucaucacccaaagaaaguuugacaaucugacaaaagccgagcgcggcgggcucaccgaagaggauaaggcgggauucauuaaaagacagcugguggaaacacggcagaucaccaagcacgucgcccagauucuugacgagcgcuucaacacggaguuugauggcgcucaaagacggauccgcaaugugaagauuaucacacugaaaagcaaccucguguccaauuucagaaaggaauuugagcuguauaaaguucgggaaaucaacgacuaccaucacgcccaugaugcuuaucugaaugccgucguggggaacgcccuucugcucaaguacccccagcuggagccugaguucguguauggagaauacccgaaauacaauucuuaucgcagcagaaaguccgcuaccgagaaguuucucuucuacagcaacauucugcgguuuuucaaaaaggaagacauccagacaaaugaggauggcgaaauugcguggaacaaagagaagcacaucaaaauucuucgcaagguccugucuuauccccaggugaacaucguuaaaaagaccgaggaacaaaccgggggcuuuuccaaggagagcauccucccuaaaggagaaucugacaagcugauucccagaaaaacgaaaaauuccuacuggaacccuaagaaguauggcggguucgauagccccguggucgccuacucuauccugguguuugcugacguugagaagggaaaaagcaagaaacuucggaaggugcaggauauggucggcauuacaaucauggagaaaaagagauucgaaaagaauccgguggacuuccuggagcagcgcggguaucggaacguuagacucgagaaaauuaucaagcugccuaaauacucccucuuugaacuggaaaauaagcgccggagacuucuggccagcgcccgcgagcugcagaaaggaaacgaacucgugaucccccaacgguucaccacacugcuuuaccacucuuaucagauugagaagaauuacgagccugaacauagagaguaugucgaaaagcacaaagacgaguuuaaggaacugcucgaguacaucuccguguucagccgcaaauaugugcuggcugauaacaaucucaccaagauugagaugcuguuuuccaaaaacaaggacgccgaagucucuagccuugcgaaauccuucaucucucugcugacauuuaccgcuuucggcgcccccgccgcuuuuaauuucuuuggggagaacauugaucggaagagauacacgagcguuacagaaugucucaaugccacccugauccaucaguccauuaccggccuuuaugagacacggaucgaccugucuaagcucggagaggauuga

SEQ ID NO: 4166 - RNA, 4041 nt, Artificial Sequence
  Cas9 variant
augaaccagaccaagaauuacgacaucggccuggauauuggggugggaagcgucggcuggacaaucacggacucccaaucucagaaaguucucaaggugaaagggaagcagggaauuggcgugcaccuguucaacgaggggcagaccgccgaagagagacggcaauuucgcacaaauagacggcgccuuaaaagacggaaguggcgccugagacuccugcgggaacuuuucgaugagcccaucagcuccauugacccugaauuuuucgcucgccugaaguauuuuaacgagucuagcaaagauccgaagaauaaaggauaccagccccagcuccaugacgaucugaaggacgucgauuucuauagacaguacccuaccaucuaucaucugcggcacgcccucaugacacaaaaagagaaguuugacauccgcgauauuuaccuggcgauccaccauauugugaaguauagaggccacuuccuuaugaacggccacuccucuagcuuuuccguugcucagaccgacuggaaagccgaucugacaaaacucuucgaacugauccaggagacccggacgaaucuugacuuuagcuucgaccugaccgaaauugauacaaucaaaucucuccuguuugacaagaaccugucccgcaaugauagacagaaagagauuguggggcucaucaacaauaacagccaacuggacaagaaagauaaggcccuuaccaagcagcuggucgagucugugguuaaaggaaucgugggcaugaagacacggaccgacauucuccugggguacgaagucgauaauaaagagcaguccaaggcuuggaacuucagcaucgacgaacuugaugaccaaauggccacgauugaucccgcucugucucaaaauucccaggcccaugacaucauuacacucauccagaaacuguacaugaccgugcagcuggcgcagaucgugccugagggacagagcgucuccgaaaugaugauuaacagauauaaccucuacgccgagcagcugcaacagcuuaaggacuauaagaaaaucaaucuggagacaggccuccugcuucgcgaagccuacgaugagcugaugaccaaggcccucaccgcugcccccgggaaaacaauucacgacacguucuauaacaagguuaaaaagauccugaaggaucaggacaauaaacaggcgcugucuauuaagcaagccaucgaagauagcaacuaccucaucccucugcggauuaaauccaauggagugaucccguaucagcuucaucagagagagcuggacgcuauuaucgaaaaccagaaggaguuuuaccccuuccucgccaccccuaaucccguggauggccaccaagaggcucugccuuacaaacuggacgaacuuauuggcuuuaagguccccuauuacguggggccgaugguugauccugagguggacagcgaucagaacuucgccuggaugguccgcaaggaaaaaggagagaucacacccuggaauuuucacaacaagguggacauuacccagucugccgauaauuucaucaaacggaugaagacaaccgacacguaucucaucggcaaagacguucugccucaaaacucccugcucuaccagagauauacagugcugaaugaacuuaacgggauuaaggucgcuaauaaaaagcugaccaucgagcagaagcagcgccucuacgaucaacuguuuaaaaagaaaaagaccgugaaaaagcaggacauucugaacaaccuugucgcggccggagagauccaugaagaugacaaucucacaggccugagcaacgggaccacauucaauaacaaucugggaucuuauauugauuacugcaagaucaucggccaggacaaacucgaggaugcuagcaagcaggccgacauugaacggaucauugagugguccacgaccuuugaggaugccaacaucuuccugacaaaacuugcugaaauuaauuggcugaccgaggaccaaagacagaagcucucucagauccgcuaccggggcugggggcaguuuagcaaaacacugcugaccgauaucaaggacaacaaggauaauuccauuaucgacaaccuuaugagcacgaaaaagguguucaugcaaauuaucaaugacaccacaauuaaacagaagaucgaugacuauaaccaguaccaccucaaucaugccgaucugaaagacaccaucgcgaaccuguuuacaucuccccaaaauaagagagcuauuaaccagacccuccugguuaucgaagauauuaucaacgccgugggacacaagcccaaucgcauuuucaucgaguccgccaaagacaaccggaaugcuaagaaccagcuuacgcagagcagacugaaacggauugucaagcaauucgaagauaauaaacagcauguggaccagucuguuuaugaggagcucaagcagcuggaugacggcucccacgccagcaucgaugaccgccugcuucucuacuuucugcaaaacgggaaagacauguauacaggacagccuaucgauauuucccagcugucuaccagccaguaccacaucgaccauauucucccgcaagcuaaggugauggauaaugcccuggacaacagaguccuuguguccucuaaggcgaauacagaaaagagcgaucgguuccuguccgagaucccccaguuucagcagagaagccucugggccgaacuggagcgcaugggcuuccugaccaaggcuaaaaaggaacggcuucugaugaccucugacgaguuuaaacaaaacuccgugagauucauugcccgccagcucguugagacaagacagaucaucaagcuggucaaucaacucauuauccaggaacacccugaggugaagcuggugaacauuaaagcugaucuuacgaaugccuuucggaagaaauucaacuuugucaagaaucgcaacgcgaacgacuaucaucacgccuucgaugcuuaccugaccagccucaucgggucucaucugcugaaaucccaccccaagugggaaccucuuuuuguguacagcgacuaugauaagauuaaauucgacaaugcuccccagggcguuaacaucaugaaggaguuugaacagucuaaacuggcugaugagaauggagagaucauuuggaacaaggacgaaaugauggccuaccucgagagacuguauaauagccggcaaauccucauuacaaagaagguguacgcccgccacggcaaccuguucaagcagaccaucuucaaagcuggggaauccgacaaucuuauuccggucaagaacaauagaagcgauaucgcgauuuauggaggcuacaaaucuaaacagguguccuauuacgcccugaucagccuccauaacaaaaagcggcagaagcgccugguugcuguguaccugaucgacauucaaaaacuucagaaucugaacgaguccgauuauuuuaagacacuccacaccaucauuaaagagagacauaauaucaagccugaguucgacauucuggccgauaaaaucuaccagaaccagcucaucauugacaauaagaacgggucuaaucggcccuuucgcaucgaaggagauuucaaaaacgacagacaacuguaucuuccucugcaguaccagcgguggcuggccagcaaggaacccacggaugagaagcucaacagaauuuuugaccacaucugugaacaacuggcugauuauuucccucuuuuugccggcaaugcgugcgacaaacugcucgauaaccgcgacaaguucuaccagcuguccauuaaaucugaguuuaaugacaaggggaaacucaucgcugagggcaagcugagcgucaucgauaaacuucugguggccaugcacgccgacucccggaacucuaaucuggcuguuauuggacucagcuccagcuggggcagauucaagcugcaugggggaaacgaagccaucggcacaucugugcagcuuauucaccagucccccaccgggcuguuuaagcgcauccaacgguucaauuga

SEQ ID NO: 4167 - RNA, 4041 nt, Artificial Sequence
  Cas9 variant
augcugagcgccggcgugaugcucggggacgucuccgcucugaagucuagcagaaacucccuuuuccagaaaucuaagaaacugaucgagaauagcuccucugaucucaccaagguugacuacagcaaaaugcgggaaauucugcuuuccauccgcaacauugccaucagauuuuucaauaacgaggauuuuaaggaaagcgacuauuacaaggaguuccccacaauuuggcaucugcggaaaaaucucauggaaucugauaagaaagcggacauccgccugguguaucuggcucuccacaacaucgugaaguacagaggaaauuuucugcaagagaacaauaaagaucuucgggccgccaacgcuaaugccggcgcugccgcgauugaccuguccaacgcccucgaggaauauuucagccugcacgaggaugaaucugcucuuacgugcgucccuaauguggccgaccugcagaugacccucgagcagccggggcugcgcaacggagagagacuggaucggaucguugcugcccucaauaugcccgaccgcgcgagagccaagcuguuugcuaaggccuguauuggccagaaaguggaguucuccaagcuggcucuggggauggagaaacaagaaggaacaaacgccuacaucugggaugacgacaaguaugaugagcucgucgcccugugcccugaagacuuuuuccccgugcuugagacccugaaaaacgcuuacagcgcguacguucucucugaucugcuggccggcaagcucuccauuagcgcuucccugaucgacucuuaugagcagcaucagaaugaucuuaaaauugugaaggaacugguccgggaguaccucggccagaaggaauaugggcgccuguuuagaggaccuaaauucgccaacggcgacuacaauuuuaacaagguggccaaacccagcuauacauccuacauccuuggggagagccuguguaauaagcaaggaaccacacgggaagaacucgugaaagagcugaagcgcgucuucgaugacugcucugcuauccaggccgauaagagauaucagaaaauuaagcagcggcuggaagacgauccuaaauuccucaucaagcaaaagaccagagcgaacggcgcuauuccguaccagcugcaccuugaggaaaugcaucagaucauugagaagcaagggaaguacuaucccuuucugguugaacagcaggaccucaucgagaaacugguguccagccgcaucccuuacuaugugggaccccugaauggcggccacgacccuaaccaccccuacccgacgaauccuauugaucccaagcggaaauucgccuggucugucagaaagccugggauggagcaugaaaaagccuaucccuggaacguggacgagguuaucgauagcgaagagaccgcugagcgcuuuauucggagaaugacaggaaccuguacauaccuuuauggcgaacccguggucccucgcugcucccuccuguacgaggaguucugugugcugaaugaacucaacggggcccgguggggagaaggcaauggggacacccacagauuugauucuagcgaccgcacggagauccuggagcagcuuuucaagaagcggaaaagaguuacacauaaggcuauugccaccuggcuggaaaucaaccacggagugacaaaugucaaaaucuccggcacccaagcggagaacgccuuugaaagcaagcucucuuccuacaacgauuucugcaaucugcugggcguggacgggcuugaggaugucuguccgcucaccaaagacgauauugaacagaucauucugugggugacaguuuuugaggacaagaaacugcuccugcagaaacuucagcgcgcuuucggagauaagcugagcgagaaacaaaucgccucuauuaugcggaagcccuaugcuggcugggggagacucuccagcaaacugcugacgggaaucaagcgggaaaccccuuuuggccgcauuuccauccuugacgugaugagagacggggauccccggccuggccaccaucucgacgccaugaacuucauggagauccugagagaaaaagauuuuggauuccaggaccgcauugaugagaucaauaaggaacggacaaaggagucuggccugcuccugagcgucgaggaccuucccggguccccggcgcugagacgcucugugaaccaggccaugcacauucucaaagaaaucguuagcauugcuggaaaggagccuuccagaaucgugaucgaagucacccgggaucccgacgaggagaaacgcggccauagaacagauacccgguacaagcagcugagcgaagcccuggcugccauuaaaacggacaucgugcaauucgauucuucccuucucgccgagcugaaggaacgcaaggacagccuggauucugagagacucaugcuguauuuucagcagugcgggaaaucccuuuacagcggaaagccucuggacauuaaucggcucucugaauaucagguggaccacaucauuccccaauguuacaucaaagaugacagccuggauaacaaggcucugguuuucgcguccgagaaucagaucaaacuugacagccugcuccuggauaagucuauuauccgcucccagaagggcagauggcaagagcuccaucgggccgggcugauuagcaacaaaaaguuucgcaaucuuacaugcaccgaaaucuccgacagaaugaugaaaggcuucauuaaccggcagcuggucgagaccucucagaucgugaaguuugugagacagaugugcgaacaacgcuaugagagcuccgaagucaucucucuccgggcuagccugucccacaaucugagagaucgcuguggauucauuaaaugccgggagcuuaacgacuaccaccaugcccacgaugccuaccuggcuugucagaucgccagauuuauuggcauccgcuauccucgguggcaggacgggauuucuagagaguucaucaauaaguacauuaaacagcucgugaagaagggaaaaagcuccggcaaguuuuucgcggggaaaagcggauuuaucaucgauucuuucaugcaugacggcuuugaccgcgaaacaggggagauuuuccgggauggcugggacgcuaccuucgaaaucacaagaaugcggcgcguucugggauauaaggauugcuuuauuacgagaaugcccgaggaacaaaccggcgccuacugggaggagacaaucuauuccccgcucgacgccaaaaacgggaagaaucugcagauuccucuuaagcagagcggaaaagaaggcuaccuggaucccaagaaauaugggggaaccaacacagcuuucaacgccuacuuuuucgcguuuguggcuaaggacgcccggggccgcgauaaauacuucuuugaggggguccccguguaucucgccaagcagcugaaugaacaaccucagauccugguugacuucgcuaacucuaucgccgcuaccaagaaauguuccacggccaagauucuuagaagcaaagugccgcugcggcagaaguuucuccuggauggcaccucuuucuaccucggaggcagaacagggaauaaaaacgucauccuguccggaguggaguuugcgugcggcauugacauggccaagaugaucgauaccgcuauuaagcaccccgaggaacuuagccaaaaagagcugaucuccaucauucagaugcuggccgacacaaucgaacgcaauagcgaucggcaggcuucucucauuaacuucagacgcuucgacgacaagcugcggaauaucgaugccauugccgcuagcagaaucauuaaaaaccuucuuaauuccaugaacgggguuaagcagucuugugaccucagcgaucugggaggcuccaaacaaucuggcuuuaugcagagcaauaucgcgacccucuucgagcgcaucacguggugcuauuccucuauuacagggauguuugaacagcgggugagcuucgaggaccugaagaacggaaucuga

SEQ ID NO: 4168 - RNA, 4041 nt, Artificial Sequence
  Cas9 variant
augaagaaaagaaaccgggaggaauacuaugugggccuggacaucgggaccagcuccgucggaugggccguugcuacacccgauuaccgcauuccuaaguucagaggccacaaaaugugggggucucggcucuuugccgagggaaagcgcgcggcugaaagacggcaguuccgcacgaauagacggcgccuggccagacggcgcgacagacuucaaauccuggaggaacucuuugccgaggagauggcuaaaguggauaacaccuucuuuaugcggcugaaggaaagcaaguucuuucuugaggacaaaacagugaaggaaaaacauauucuguucuccaccgauaaguuugacgccgaucgcuucuauaaagacaauccgacaaucuaccacgucagaaagcggcucauggaggaggaaccccaggauauuagagagcuguuucuggcugugcaucacauccucaaguaucgcggccauuuccuguuugccgggucucuugaacagaacggagacagcaucgaggaacugguucggacccucuucggcaaacagggccuggcgauucuugaugacacaaucgauuccaaugagauggugaacauucugaagaauaacgagaaaaccaagucugacagaaagaaggccguccaagaacucuggaauccucugaaagacaaggugaagaaagcucaggccgcugagauggccgggguugugcugggacucaacagcgauaucuccaagcuguucgacaauagcgauuacaaagaccuuaagauuaacuuuucuuccggcgauuaugacgaaaaacgcgaugacuacgcgaauagcaucggggaugacauuguccugcucgauacgaugaaggcccuguacgacacccuuauccugucucagauccuccagggaaagcaauccauuagcgaggcuaaaguggaagacuauaacacacacaaggagcagcugcgggcccugaaagcuauccucaagccccacaaaagacuguacaaugagauguuccgcgaaaacaacaagaaggaucuuucuaauuauguggccuacauuuccagcuauuccgagggcaaacgggucaacagagaaggguuuuacaaguauguucaggccgugcugaaacagguggacgauucugacagcaagcaagcuauccucgaggcgauucgccuggaaaccuuccuuccucugcuccgggucaaagauaaugccgugaucccccaucagauccaccaggcugagcuggaggccauucuggaaacagccagaaagaaguacaaauuucucaacgacguuuccgagggagugagcgucaaggauaaaaucauucaacuguucaccuuucgcaucccuuacuaugugggcccgcuuaauccccauucuggcgaaacgguugcugaccggaagcaggggacaggauggguggucagaaaacagcggggcaagguguacccuuggaacuucgccgauauggucgacgugaaagcguccgcugaggccuuuauuaccaaucugacaaacaagugcaccuaucucaucggggaggauguucugcccaagcgcagccugcuuuacucugaguucaugcuccugaaugagcugaacaugaucaaauaugacggacacgaacucccuguggagauuaagagacuguacaucgaacaggucuuuaaacaagagcacaagaaacagaccaagggccgggugcuugauuuccugaagagaaaugggcucauuacaggaagcgccacggcuguuaucaccggcauggacgacuccauuaaaggcgaucugcagucuuaucgcgacauggugcggaucuuugggacaggauucgaucauagcauggccgagagaauuauccgcugggucacccuguucggcgaagcuaaggacauccuugagaacaaaauuagagaaguguacggaaauuccaucagcgauucucagaugcgggccauuaagaaacucaaguacgcggacugggggcgccugucccaagccuuuuucaucaagauuaucggcugugauaaaagcgggguggagagaaacaucauuacaugccugcgggaaucuucccagaaucucauggagauccugagcgaccagggcaccuauauuaagcagaucaaggcuuggaaccaccaacauacgacaaacaugauggauacccuugacuaccagcugguugaugaccucuaugucgcccccuccgugaaacgcucuauuuggcagagccuguguaucguggaggaacuggucaaaaucaugggacaggcuccgaagaagauuuuuguggagguuaccagaacaaaucaagccgagaaaaccaagaaagauucccggaagaaacgccuuguggaacucuacacagcgaucggcaaggaaggggccgcuuggaaaaaggagauugagaagcaccaggccggagacuucagacggaaaaagcuguaucuguacuauacgcagaugggccgcugcauguacucucaugaaccuaucgcuauggacgcccucuuuaccagcgaguacgauauugaccacaucuauccccaaucccugacaaaagaugacagcugggauaaccuuguccuggugaagucucagcucaauaaagaaaaguccgaccaguacccucugagacccgccauccgggagaagaacaaagcguauuggcaguaccuguguagagcuggguucauuagcgagaagaaauaugaacgccuuaugcggaccacagagcucaccgccgaagaacugucuggauuuaucgcuagacaacugguugaaacgucccaggccaccaaggccgugauuggccuccuggagcgcaucuacaaacacacagauauuugcuucgucaaggcugagaccgugagccaguuucggcaucagcacaauuucaucaagauuagagaacuuaacaauuaucaucacgccaaagacgcguaccugaacaucguuguggggaaugucuaccacgagaaguuuaccaaaaacccccgcgaguucaucgcucggucuacagaaagacgcccuuauaaucucaaccggauguacgauuuugaccugcugaagcaaggcagagugauuuggcaagugccgaaaagccuugaaacgguccaggccaugaugaaguccaaugauguucggaucacaaagaaacugcucgugcagaagggagagcuguaugacgccaccauuacaaaagcucauaagaccaaagagggcauguacuucccccucaagggggccgacgcgcgccugagagaugugcaccgguauggaggcuacgaaaagaucaaaauugcuuauuacagcgucuucucuuguugcgagaaggccuccgacaccauccauacacuuaucauuccuauccccguguacgccgcugggcugcuccagacggaagccgaucugaccgcuuaugccuggcagacaaaacagaagaccaaaccuauuaaggacaucuacagcaugauuacacccaucuauaaaaagcuguguaucaacaccguugugaagauugauggauuuaaauacuuccuuggcgggcgcacggaggacuauaucugccuguacccggcgauuccugucgugcucgaugaacaagccgcugccuaucugaaggcuguuuccaaagugggcagagccgacgaugucgagaauacagcccaggcuaucgaccucauuaccgcggaggccaacgaggcuuuuuacgaugugcugcuuaagaaaauggaagccaagaucuucguuaaggccuaccaggaacggguggagaaacuggcuucugagaccgccagagaacgcuuucggaagcucagcauuggagcgcaguguuccugccugcuggagauccuuaaccugcucgcuaauaacaaaacaaccucuaaucugaagaaauggcucggcgucacaaugagcagacgcaagcaacccauggaccugacgaaacuugaagagugcaucguguaugaaaccuccauuacagggcuguacgagaaagccgugucucugcucuga

SEQ ID NO: 4169 - RNA, 4041 nt, Artificial Sequence
  Cas9 variant
augguggagcacuacgccaucggcuucgacauugggaccggaagcacaggcuuugcuggggucgaucccaacggaaagcugguuagaaugcggggcaaaaauguguaugggguguaccgcuucaagggaggcgaagccgcggcugacagacggggcuuucgcacgaccagacggcgcaucaaaagacggaaguggcgccucagauuccugaaauccuuuuucgagccuuauauugccccgaucgaucccgaauuuuuccuucggcagaaguacucugccgacagcccucuggaucccaaggggauucgcgcugacaaaggacuccuguccgauaugucugaccaagaguuucaugccaaguauccuacaaucuaccaccuuagauaucagcugaugcaugaaaaacggcaguucgauguccgcgagaucuaccucgcuaugcaccauauuaucaaguacagaggccacuuucugauugaggacggggccgauaacuucgacgcgaaacagaucgauuucuucgaccaauuccagcggauggccgcugugaccgccggacugcccgaacucgagacacugguugugccugacgaaacccagagcgaugcuuuuaagagaguccuuuucgacgagucccagacaaagucugaucgccaaaaagugcuggccagccagcuccuggacauucaggauaaucaguccaaggcgaucaaagacuuuauugccgcucuuaccaaggccguugugggcaugaaagcuaaccuggccacgcucaccagcacagccaucgagucuaccgauaagaaugacuggacaaaaccgcuggggcaacuggaugacuuccuccugaagcacgaagaggaucuugacgaagacggauaugcucugaucgaugcggccaaccagauguacuccgcugccguccucgccgcucuggugcccgagggcaugggcuuuagcgaagccaugauggcgcgguaugcucagcauaagaaacaacuugcccuguacaaacaggugauugccucucucccugacaagacccagagacacgagcugaaggaugcuuaugccgacuacaucgagcaugcugcccagaauccccgcgaugcguucuauaaacgggucacgaagguucuggaagggguggacuccgccgaugcuagaacagugaugaccgccauuagccacgacgaguuucuccugaagcaacgcacacuuucuaacggaaaaaucccuuaccagaugcagcagcacgaauuugaugcuauuaucgagaaucaaaaggccuacuaucccuggcuggcgaccccgaacccugucgaagccgacgcuaaacggcuccccuacuaucuggaugagcuuaucggcuuuagagugccuuacuauguugggcccauggugaccgagaagcagucccaguucgccuggaugauucgcaaagcugacggagaacugacacccuggaauuucuucgaugucguggaccgggagaagacggccaacagauuuauccagcgcaugcaaaccacagacaaguacauucucggcgaagauguucugccuaaacauagcauccuguaucagcaguucgaggugcucaaugaacugaacaauauucgggucgagaagcacccgcuuaccacagagcagaaacaauucaucuaccagagacuguuuguggaccagcaacggaagaccaucacgaaaaagaaccuccaggauacacuggucgccaugggggaauuugacaaggcucccgauauuggaggccuggcgaaagaggacgugaugauguccucucuugccaccuuugcugauuacagcaagauccucccugaagccauuuccgaccccacccgccagaacgauaucgaggacauuaucgccuggagcacaauuuucgaggauacccagaucuuuuucgacaaacugaagacaguugauuggcugacgacccaacagagaaaacggcucgcuucuaucagauauacaggcugggggaagcuguccaaacgccuucugcagcagauuccuaccagcaagcauacaaaugugauggccgcgcucugggcuaccucugacaacuuuaugcaaauccugcaggacgaacaguuccaggagggacuguacgaugccaaucggcuucccgaagagacgcucaccccggacgaacaagucgagaagauucuggaugaggccuaucugagcccugcugacaaaaagggcgccagaaaagugaucaagguuaugaacgauauugugcgcgcgaaucacgggguccuccccgaacagguguuucuggaguccgcugacgauccucagaaaaacaagagacggucugugagccgcuccaagcaacuugaagagaaauacagacaggccgcccagagcuucaucgacgaagcuguuaaggaggagcugaaugcccagaucgucaacucugcugaauuuaaugaucggcucgugcuguauuucacacaaaacggacgcgacauguacaccggcaaaagacuggauauugagaaucuuggguccuaucagaucgaccauauucucccccagagccuggugaaggacgauucucuggacaaccgggcccucacagcgcgcgauaucaaugccgaaauguccaaccaguuugucagcgagagauucggccugggaccucgggcuuucuggcaacagcuuaaaaauaacggccugauuuccgggcgcaaguuuagaaaccucgugaugcagcgggacgaaaucgauaaguacgcccccggauucaucaauagacagcugguugagacccgccaaauuaucaaaacgguggagcagauuauccaccggcuguggccggacauucagaucgucacaaucaaggcuaaccuuacccaccaggugagaucugaacucggcuuuccuaaaguucgcgagcugaaugauuaccaucacgccuucgacgcccugcucgcugcgcggauugggcaauaucugcuugaacauuacgccggacugaagcccuuuuucacauauggcgaguuuaaaagaggggauaccaagaaguacggcaccacaaacuuccuccgccggcugacgaaagacaauaaggauaaaaagggagagcugcuucccgaagugagcgacuggaucgauuccauugacucuaucuauaacuacaaaaagauuccugucgugugggagaauaccacaaacaugagcgcucuguuugaccagaccaucuauccgagacccgaucgcgacacaaccaaacggaagcucauuccuacgaagcuggauaaacccacagacaucuacggcggguacuccagcgccaagaccgccuauauggcuguuaugagagugcagaccaaaaagggaacagaauacccugucuucaauauccccgugucuauugccucccaacucaaccggaucaccgaucagacaaugcugaaacaacaggugaagcaguuuauuaucaaugcggagcagagcgcuucuaagaaaaagcuguaugaauccggcgacgucauucuuagccgcguugcccucgggcagagauucacggauaaaaacuacggagagguguuccugaucucuaauauggaggugcagaacccucaaagccuguggcuuggccgggccucccagcagcgccugaccagagaacccgaggggaaugaaaagccggagacaagccucgcugacaucuaucagcaaauucugaaacaggucgaucgguacuuucucgccuucaacaucagacagcaacgccagaagcugcuuggcacccuggaccaguuuacaucucucccugugggacggguuaacgaacagaccagaacggaucaaaaucagcgcuccauuaucgcgcgggugaugauuguccugggcaaggggagcagagaggagaaauuccccgaauuuggacuguccgcucuuggccgccuggugcggaccgggggaaucacacucucugaggacgcccagaucauuuaucagagcccuaccggccuguucgaaagacgcguugcccucaaggaucuguga

SEQ ID NO: 4170 - RNA, 4041 nt, Artificial Sequence
  Cas9 variant
auggccaagauccugggccucgaccuggggaccaacagcauuggaugggcuguggucgauaucgagaauaacaaugaguucacacuuauugagaaaggcguuagaaucuuucaggaaggggugaagauugagaaaggaaucgaaggcuccaaggccgcggagcggacgaccuaccgcucugcuagacggaucaaauaucgcagaaagcugcggaagauucaacuccugggggugcuuagcgagaacggauacugccccuuccuguccaaagacgaacucgauucuuggcgcuauaagaaagucuacccuacaaauaagagcuuucugaacuggcagaaaaccaaugagauccagcuggaaaacccguauuucuacagagcccuccugguggagaagaagcucaaucugaacauugaggaagaccgguuuaaaaucggccgcgccuucuaucaccucgcucagagacggggcuuucuguccaaucgcauggaggggacaaaggaaaacgauggaaccguuauuaaaucuaucacagagauuagcaccgccaagggcgacaaaacgcuugggcaauacuucuacgaaagauauaagaaaggagagaagauccgggauaccuacacacaucgcgaggaacacuaucuggaggaauuugugagaaucugugaguuccagcagcucgacaauaaguuugcugaaaaaguccggaaggccauuuucuaccagagaccccugaaaucccaaaagggccugaucgggaaaugcguguuugagccuaaaaagagccgcuguucuguuucccggcccgaguucgaagaguauagaaugcucugcuuccugaacaauauuaaaaucaagaccccuagcgaugaaaaccuucgcuuucugacagacaacgagaaagaaaagcucaaaccccaguucuuucggaagucuaaggaucauuucgacuuugaggaucuggugaaacagcuugcgccuaagaaucaguucaaauuuuacaaguccagagacauucugccgggaaacuggcuuuucaauuauagcaugaacaccacggucucuggcugucccaucuccgcccgccugaaagaccuguuuggcgagaauuucauggauaucaaguuugacuacauucgggaaaaggaugggaaaaagagcgugaucgacauucacgauaucuggcauguccucuucacauacgacuccgaggaaaaacugaaggaguuugcuagaaaccgccuuaaucuggaugacauuaaaaucaaggaguuccaacggauccagcucaaaaaggaauaugccgcucugucucuuaaggccauuagaaaaauccugccuuuccuccgcgagggacugauuuacagccacgcgguguuuaucgccaacauggaaaccgcuauucccuccgagaucuggaauaacuauacaaaucggaacauuaucaagaaugaaaucuacaacauuaucagcaaucagaccgaggauaaacaaguuguggacauugugaacggcaucauuaagucuuccagaaucgagaacagcgucuggucuaaugaagccguggaguucuuuaaaaaggaucugaacagcaagaucaaaaauuauuacgggauuaagaccuauaacgacuucccugaagagaaaaagauccggauugaaacauacgcuuuuaaucucuucaaacagcagaugaugaagaacuuuggacgcggcgaguucgccgccguucagagaaucgacgagcggcugaaacuuuuucugacggauaauuucaacauugaccccauccuccugaagaagaucuaccacccguccgcuauugaaguguaucaaccucccgucagaaagaaugaugggaagcuguaccuuggaucuccuauggugagcuccauccgcaaccccauggcgaugcgggcccuccaucagcugagaaaacugauuaaugagcucauccgcaaggaacugauugacagcaacaccaagguuaauaucgagauggcuagagaacuuaugaacgccaaugagcggaaagccuaucagaacuggcagaacgaucgcgagaagaucagaaaagaauacgcucugaagauuaaacaacaccucgacguggauaaggagcccucugacgucgauauccugaaauaucagcugugggaggaacagaaucauaagugcauuuacacaggcaaggagaucaacauuuccgacuuucuuggcagcaauccuaaauucgauaucgaacacaccauuccgcggucuaucuccuuugacaacagccaguccaauaagacacucugugagaacuauuucaaucgcucugugaaaaagaacagaauccccgccgcgcugccuaaucacggggaaauuaucgagcggcuggaaaacuggaaacucaaguacgaggagcuggaaaagcaaauucaguacgcuguccgccaggccaaaggagccggcgauaaggacagcaaagacagagcuauccagaagcggcauaaacuuaaguucgaguaugauuacuggaagaauaaauaugaccgcuuugugauggaagauguucccgagggguucaagaacucccaacugguggacaccggaauuaucacgaaauacucuagaauguaucucaauacacuguuugauaaggucuacaccgugaaaggcaacaccguugccgacuuccggaagcugugggggauccaggaugaauaugagaagaaagcuagagugaaucacagccaucacugcgucgacgccauuacaaucgcguguauuaccaaguccaacuacgagaaccuugccaaauuuuaccaugauugggaggaacuccacgugaagggcaucgaccagcugccucccaugaauaaaccguggaagacauucacggaagauauuaaggcuauccaauaugagauccuggugagccacuacaccccugacaaccuccccaaacagucuaagaaaauucugcgcaagaaaggacggauccagaagaaugaaaacggcaauccuauuuaucuuaaaggggauacaguuagaggaucccugcaucagcaaaccuuuuacggcgccaucgagaagacagaggucaacaagaaaggggaacccgagaaggugauuaaauaugugguccgcaagagccucgacgugcuggacgauucuuccguuaaaaauaucguggacgauauugucaaggaaaucgugcagaacgcucggaucaaggagaaagacuucauuaaggagcuggaaauccagaaaagaaaacuugccaaggcggaggaaaauaagguugugcagauucaagccgagaucgauaagcucaacaaacaggucgcugaccuguacaccaugccuaauaagaacggaaaucccauuccgaucaaaaaggugcgcaucuuucagacgagcguuaccaacccuauucaccugaaacagcaacgggauaagucucagaagacaagcaaaccccauaaggaguucuauuacgccgcuaaugacuccaacuacaugauggccaucuaugaaggcaaagaugagaaggggaaagugaagagagacuuuaaacuccugaauaaccuugaagccggcgaguucuucaaguacagcguccacaaggaucugaaagaaaagaaccucgagaauauucgcaacgugauccccgacaaagugucugcuggaaagauugaaaucccucugaaagcgaucauuaagaccggcacaauggucauccugugggaaaauuccccggacgagguuugggaucuuaccauuagcgaaguggacaagcggcuguauaaaguggucgggauguccgugaacagaaucaagucugauguuaaaacguuugaguucggaaauauugugcuccggcacaacaaggaagccagccccgcuacacugcucaaaauccaggacggcgaguuuaaguccgaugaaaauuacauugcccaacgcaagcugucucauaaccaguucaaugcccuugucgaggggguggacuuuagccuguccguucucggagagaucaaaagacugaaguga

SEQ ID NO: 4171 - RNA, 4044 nt, Artificial Sequence
  Cas9 variant
augggcgaggacgggaagcccgugagagucaaaggaaagaccgccaucggcgcucggcuguuccaggaagggcacguugccgcggaucgcagaauguuucggacaacgcgcagacggcucaaccgcagaaaauggcggcugaaacuucuggacgagauuuucgauccuuacaucaccccgguggacagcacauuuuucgcucgccucaaacaauccaaucugucucccaaggauagcagaaaggaauuuaaaggauccaugcuuuucccugaccugaccgauaagcaguaucaugaggacuaccccacaauuuaucaccuccggcgcgcccugaugaccgaagauaaaaaguuugacaucagaaugguguaccuggccauucaucacaucgucaaauaucggggcaacuuccucaauucugcuacaguggauaccuuuaaggccagcaagguugacuucaaaaaguccuuuaaccagcugaaugagcuuuacucugcuaucaacccugaggaugccuuccagguggacaugaauaaaagcgacgaaacggggcgccuguuucucgauuccagcauuagaaaguucgacaaacaaaagcagaucucuaaacugauucccgucgugguugaggauaaggaagcgaagaaacuuaacggaaagaucgcccuggagauuaccaaagcuauccucggcuauaaguccaaacugaauguggucacacagaccgagccugaagacccgaagaagugggccgugaaauucgaugacgaggauauugacagcaagcugaacgauauccuccccgaaauggacgagaaucagcaaucuaucguggaaauuauccaggaucuguacucccaggucacacuuaaccagauuguuccuaauggcaugagccugucugacuccaugaucaaaaaguacaacgaccaucacgagcaccucaaacuguauaagaaacuuauugauaauaucagcgacaccaaaaagcgguccgcucugaaaacggccuacgauaaguaugugggggacgauggaaaaacaaucgagcaagacgaauuuuacucuaacgugaagaagaaccucgaugacagcgaucuguccaaacagauugcggaccugaucgaggccgaaaaguucaugcccaaacagagaaccagccaaaauggcgucauuccucaucagcuccaccagcgcgagcuggaugaaaucauugagcaucagucuaaguauuaccccugguuugcugaggccaacccgaauaaacacgaccuucaccuggcuaaguauaaaaucgaggagcucguggccuuccggaucccuuacuacguugggcccaugauuacaccugaagaucaagagaaguccagccagaccaucuuugccuggaugaagagaaaagaacccggacagauuacccccuggaacuucgacgagaagguggaccgcauggagucugcuaaucgguuuaucaaaagaaugacaacgaaggauaccuaucugauuggcgaagacguccuuccugaucagagccugcucuacgagaaauucaaggugcugaacgaacugaauaugguucgcgugaacgaccauccgcucaaggucuccgagaaacaagcgaucuaucgggaucuguuugagaaucagaagagaauuucugugaaaaaccuucagaauuacgucaagagcaaauccgggcugcccacaggaccuaagaucagcggccucucugaccccgaucacuucaacuccagccugggcaccuauaaugacuuuaagaaaauguucggggauaagguggacgauccugaccugcaggaugacuuugaaaagaugaucgaguggucuacaauuuucgaagacaagaaaauccuucgcgccaagcucgaugagguugcuuggcuguccgacacccaaaagaacgaguucaaagaaauucgguaccagggauggggcagacugagcaagaaacuccugacggggaucguggauggaaauggccagcgcauuaucgacgagcuuuggaacacaaacaagaauuuuaugcagauccaauccgaugacucuuucgccaaacggauucaugaagccaacgcuaaucagaugaaggccaccgaugucgaggacgugcuggcggaugcuuauaccagcccccagaacaaaaaggccaucagacaaguugugaaggucguggacgauauucagaaagccaugggaggaguggcuccgaaguuuaucuccauugaguucacacggucugaagaccgcaauccuagacggaccaucagcagacagcgccagcucgaaaacacacugaaagacacggcccaagcucugguuaaguccaucaaucccgauauucuuagcgagcucgacaacgccucuaaauccaagaagggccugaccgaucggcuguaccucuacuuuacacagcugggcaaagacauguauaccgggaagccuaucaauauugaugagaucagcaacuacgacauugaucacaucuucccccaggcguuuaucaaagacgauucucuuaauaacagaguccugguguccaaggccggaaauaacggcaaaagcgcuaaugugccucucaagcuguucggggccaagaugggaggcuauuggaaacagcuggcugacgccgggcuuauuggccaacgcaagcucaaaaaccugcagacaaaccccgauaccaucucuaaguuugcgaugcauggauucauuagacggcagcuggucgaaacgagccaggugaucaaacucguugccaauauucugggcgacaaguaccgcaacgaugacaccaagaucauugagaucacagcuagaaugaaucaccaaaugcgggacgaauuuggguucaucaaaaaccgcgagauuaaugauuaucaccaugccuuugacgcuuaccuuaccgccuuccugggacacuaucucuaccauagauacaucaagcugcggccguauuucguguacggcgauuuuaaaaaguuccgcgaagacaaagucacaaugagaaacuuuaauuuccugcacgaucuuaccgacgauaagcaggagcggauugccgacacggagacaggggaagugaucugggaucgcaagagauccauucagcaacuccgggacguuuaucacuacaaauuuaugcugaucagccaggagguguucucucugaacaaggaaauguuuaaacagaaacucuucccugcuacccuggcgaagaaguccaaacuuauccagauuaagaaggauaaacccgucgacaucuauggaggcuacagcaauaacacagaugccuaucugaccgugguuaagcucaaaggguccaaggaggacaaauacaagauugugggcguccccaugagagcucuggacaaucugaagcaugccgagaaagaaucuccucaaagcuacaccgccgagcuucgcaaggcucuggaaccgcaguuuacaaaaaucaagaaaaaccggaagacgggagagguguccaagguggucaccaauuucgauauuguucucggcagacuguuuuaucgccagauggugaucgacgggucugaaaagagccucaucgccuccucuguguaccaguauaacgcgaagcaacugguccuuagcgaucaggcuauucggacaaucuccgaccaggagggaauugaugaguucgaacugagcucucaguacgacaaaguguaugaugagaucguucaaaagguggaaaaacuccugcccauuuuccagcacagacauuuucaggagcgccugaauaacggcaagucccuuuucgucaaccugccugugcacgacguuuacgaagggaauaagcucgaacagguggggaaaaagcauaucauuaacagcauccugggcgggauccacgccaaugccgaucggcccgacauugaucucuuuggcaucaaaaaccugggacaauucucuuccaccagcggcauuaaucuuucuuccgacgcuaucauuugcuaucagagcccuacagggcuguuugagagacgcgucgugcucaaggaccuguga

SEQ ID NO: 4172 - RNA, 4044 nt, Artificial Sequence
  Cas9 variant
augaccaagagagaggaacccuacaacgugggccuggacaucgggagcuccucugucggaugggccguuguggauaauaacuaucaccuccugaauauuaaaaagaacaaucuuuggggcgcucggcuguucaaagaggccgaaacagcucaggugacgcgcgggcauagaagcaugcggcgcagauaccggcgcagacggaaccgccucaauuggcuggacgagcuuuuugcggaugaacuggccaagaucgacccuuccuuccuccugagaaugaaaaacucuugggucagcaagaaggaguccacccggaaacgcgauccguauaaucuguuuauugacgagaaguacaacgauguggacuauuucaaucaauaccccacaaucuuucaccucagaaaagaacugauuaccgaggauaagaaaguugacauccggcuuaucuaucuggccauucauaacaucauuaaguaccgcggaaauuucacacucgaaaaccagaauuuugauaucucucagcugagcuccaacuucagccagcaaauuucugacuuuuucgcucuguuuuccgauuucggcgugaucaugccugaggacuuugaccccgauaagauuagcgacauccugcucaacccuaaucugucucccuccgggaaagucagcgaggccaucgcuaccauuucuccuaagacaaacgugaaagccaagaucaaaauuauccugcuccugcuuguuggaaauaacggcgaucugaagaaacucuucgaccuggaaaccacggagaagauugcggugaaacuuuccagcagacacaucgauuccgaacugccgaucauucucucugagcugaaugaacagcaggagaacaucauuaccaucgccaauagcauuuucggcuccaucauccugaaagacuuucucggggaugagacaagcauuucugcugccaaggucaucuccuucgaagaccauaaacaggaucugcaaaaacuuaaaaccauguggcgggagacaagcaacaaggaagcugugaaggccggaaagaaggcguacgaggacuauauuggccacgaagauucugagaccuuuuacaaaaagaucaaaaaguuccuggagaaggcccagcccguggaccucgcuaauaaagcccuggcugaaauugagcuugaaaacuaucugccuaagcagagaaaucgcaacaauacggucauccccuaccagcucaacgagaaugaacugauugccauccuggaccaccaagagaaauauuacccuuuucucaaggagaaccgggauaaaauccugagccuucugacauuccgcauucccuauuacguugggccgcuccaggacuccaacaauaacagauuuucuuggaugacccggaaggccagcggagcuaucagaccuuggaauuucuccgaaaaggugaacguggagcagagcucuaaugauuuuauuaaacgcaugcgguccacagacaccuaccugaucggcgaacccguccugccuaagaaaagccuuauuuaucaaugcuacgaggugcucucugagcugaacaauaccagaguuaaggauggguccagcaaccccaaacgccuggacgugacaaucaagcagcggaucuauaaugaaauuuucaaaaaccagaaguccgucucugugaagguucuccagaauuggcugaucaaagagagcuacuuuaagucccccgaaauuucuggacuugcggauaaaaagaaauaucugagcucccucagcacguacaucgacuucaagaagauuuuuggccaaagauucguggaugacccugucaacucuccgcagcuggaggaacuggccgaguggcuuacccucuucgaggauaaaaagauccugcugaucaaacuccaaaauuccaaguauagcuacgaccaggcuacaauuaacaaacugucuaccaugcgcuaccagggcacagggaaacuuuccaagaagcugcucguggaucugaagaccacgaaaaagagcaucggaaaaucuggcgccgaaagccuguccauucuugaccucauguggagcacaaaggacaauuuuaugcagaucauucaugaugccgacuauaccuucgagcagcagaucaaggaauuuaacuacgauaccgaggacgaacugacaccccuggagaaagucgcuaaccuccacgggucuccugcccugaagcggggacuuaaucaauccaucaaagugguugcggauauugugaaguucaugggccaugaccccgagaaaaucuuuauugaguucaccagaagcgaugacuuuuccaagcugacaaucucucgguaucgcagaauuaaaaagcaguaccucgaaaucgcuaaggccauuaaaaagaucccugccgaguucaaagauaucaaggaauaucagacgcagcuggaagagaacaaagggaagcuggcuagcgagcggcuuaugcucuacuuucugcaauguggacacucccuguauucuaauaagcccauugaccucaacaugaucaauagcuccaaauaccacgucgaucauauucugccgcagucuuacaucaaggacgauagccuugaaaacaaagcccuggugcucgcuuccgagaaugaaaacaagauugacaauaugcugaucagccacgacaucauugccaccaaccugccuagauggcaggcgcuuaaagaucaaaaucugaugggcucuaagaaguucgccgaccucacacgcaccacaguuaccgagaaccagaaaaagggcuuuauccagcggcagcuggugcaaacgucccagauugucaaaaauaucacccucauucugaacgaucuuuauaagaauacaagcugcaucgagaccagagcuacacugucuuccgaguuccgcaaagccuuuagcaacuucgacgaaaccacguaccauuaucaguuccccgaauuugugaagaacagagaugugaaugacuuccaccaugcucaggaugccuuucucgcguguguuaucggggaguaccaacugaagaaauauccuaaggacaaccugcggcuugucuacgaucaguauucuaaauuccuggacucccucaagaaagauacacgcaagaagaauggaagaaugccccgguacacccagaacggcuuuauuaucgggagcauguucaauggaaaaacauacguggacgacaacggcgaaauuaucugggaucagaagauuaaagaguccauccgcaagaccuuuaauuaucaccaauucaacguggucagacagaccauugagcagcacgggaaacuguuuaaugacacaauccaaccucauagcgaucgguacaagcucaucccccugaaaacgaaccgcgacccggccauuuauggcggauacaauaacgauaauaacgcuuauucugugguucuugacguggauggcaagaagaaaaucaaugggauuccuaucagaauugccaaccagcuuaagagcgacgaacucgaucuguccucuuggcuggagaauaacaucaaacacaagaaacccaugaccauccuuauugacaagguccccaaguaccagcggaucauuaacgaagagacaggagaucugcucaucaccagcgcuaaugaagugauuaacaauguucagcuguuccucccuuccauguauacagcccugaucucucuucuggacagcaccaaaacggagauguacuccaagcugcucucuaacuacgaggccaauauccugauugauaucuaugacuaccuucugacaaaacucaagaacaauuauccgcuguaccgcaaagaaugggcuaagcucgcggagcauagagacgauuuuauugaaagcgaccuggugacccaagccuccacccuucagcagcugaucaaguucaugcacgcugaucccagcaacgucaaucugaaauucggcaacuuuaaggggaaucgguucggaagaaagaacggcaauauuaagcucucuaaaacagacuuuaucuaugaguccccuaccgggcuguucaagagcauuaagcacaucgauuga

SEQ ID NO: 4173 - RNA, 4044 nt, Artificial Sequence
  Cas9 variant
augaaguccgagaaaaaguacuauaucggccuggacguggggaccaacuccgucggaugggccguuacagaugaguucuacaauauucucagagcuaaaggcaaggaccuguggggagugcggcuuuuugagaaagccaagacggcggcugauacccgcacauucagaucugggcggcgcagaaacgaccggaagggcaugcgccugcagauccucagagaaauuuuugaggaugaaaucaaaaagguggacaaagauuucuaugaccggcuggaugagagcaaguuuugggccgaggacaaaaaggucuccgggaaguacucucuuuucaaugauaaaaacuuuagcgacaagcaauauuucgaaaaauuucccaccauuuuccaucugcgcaaguaccucauggaggaacauggaaaaguggauaucagauauuacuuucuggccaucaaucagaugaugaagcggcgcggccacuuccugauugacggccagaucucccauguuacagacgauaaaccucucaaggagcagcugauucuucugaucaacgaccuccugaagauugagcuugaagaggaacugauggauucuaucuuugagauucucgcugacgugaaugagaaaagaaccgauaagaaaaacaaucugaaggaacugaucaaagggcaagacuucaacaagcaggagggaaauauccucaacagcauuuucgaauccaucgucacaggcaaggccaaaauuaagaauaucauuagcgaugaggacauccuggagaaaaucaaggaagauaacaaagaagacuuugugcuuaccggggauucuuacgaggagaaucugcaguauuucgaagagguucuccaggaaaacauuacgcuguuuaacacccuuaaguccacauacgacuucgugauccugcaaagcauucucaagggaaaaucuacccuguccgacgcucaggucgagcgguaugaugaacacaagaaagaccuggagauccucaagaaagugauuaagaaguacgaugaggacggcaaacuguuuaaacagguguucaaagaagauaaugggaacggauaugucagcuacaucggcuauuaccuuaauaagaacaaaaagaucacagccaaaaagaagauuucuaauaucgaguuuaccaaauacguuaagggcauucuggaaaaacagugcgacugugaggaugaggcggugaaguaucuccuggggaaaaucgaacaagagaacuuccuucugaagcagauuuccagcaucaauuccgugauuccgcaucagauccaccucuuugaacuggacaagauccuggagaaccucgccaaaaauuaccccucuuucaacaauaagaaggaagaauuuacgaagauugagaaaauccgcaagacauucaccuuucggauuccuuauuacgucggaccccugaacgauuaucacaagaauaacggcgggaaugcuuggaucuucagaaacaaaggagaaaagauuagaccuuggaacuucgagaaaaucguggaccuucacaagagcgaagaggaauuuaucaaacgcaugcugaaucaaugcacauaccuccccgaggagaccguucugccuaagagcagcauucuguauucugaauacauggugcuuaacgagcucaauaaccugcggaucaagggcaaaccgcuggauaccgacgucaagcucaaacugauugaggaacuuuucaagaaaaagacaaaagugacgcugaaguccaucagagauuacaugauucgcaauaacuuugccgacaaggaagacuucgauaauagcgagaaaaaccucgagaucguuucuaauaugaaaagcuauaucgacuuuaacaauauucugggggauaaguucgaacuggagaugguggaagaccuuaucgagaagauuaccauccacacaggaaacaaaacccuccugaagaaguacauugaggaaacauaucccgaucuguccucuagccagauccagaaaaucauuaaucucaaguacaaagacuggggccggcuguccagaaaacuucuggauggcaucaaggggcgcaacaagaccgacgaugucaauacggugauuaacuuuaugcggaacagcucugacaaucucaugcagaucauugagggaaagaacuauuccuucaaugaauacaucgauaaccugcgcaaaaaguauauuccucaagagaucagcuacgaagucguggagaaucuguacguuucucccuccgugaaaaagaugaucuggcaggucauuagagugacagaggaaaucaccaaaguuaugggcuaugacccugauaagauuuuuaucgagauggcuaagagcgaagaggagaaaaagaccacaauuucccggaaaaacaaacuucucgaccuguacaaggccaucaagaaggacgaaagagauucucaguaugagaaacugcucaccgggcugaauaaacuugacgaaagcgagcugcgcuccaagaagcucuaccuguauuacacacagaugggacgggauauguauacgggcgagaaaaucgaccuggauaaacuuuucgacucuacccauuacgauaaggaccacauuaucccccaaagcaugaagaaggaugacuccauuaucaacaaucucgugcuggucaacaaaaaugcgaaccagacaaccaaggggaauauuuacccggugccuagcucuaucagaaacaaucccgauaucuauaacuacuggaaauaucugauggaaaaggaauuuauuuccaaagagaaguacaaccggcucauccgcaauacaccucugaccaacgaggaacuuggcguguucauuaauagacagcugguugagacgcggcagagcaccaaggccaucaaagaacucuuugagaaguucuaucaaaaaucuaagauuauccccgucaaagccucccuggcuagcgaccugagaaaggacaugaacacacuuaagucucgcgaggugaaugaucugcaccaugcucacgacgccuuccucaacauuguggccggagaugucuggaaucgggaauuuaccagcaaccccaucaauuacgugaacgagaauagagaaggcgacaaaguuaaguauucccugagcaaauacuucacacgcccuagaaagucuaaagggaaggugaucuggaccccggagaagggacggaaacucauugucgauacgcugaacaagcccuccgugcuuaucagcaaugaaucccauguuaaaaagggcgagcuguuuaacgcuacaauuucugggaaaaaggacuacaaaaagggaaagaucuaucucccucugaaaaaggaugaccgccugaaagaugugagcaaguacggcggguauaaagcgauuaauggcgccuucuuuuuccuugucgagcacaccaaguccaagaaaagaauccggucuaucgaacuguuuccccuccaucugcucagcaaguucuacgaggacaaaaacacagugcuggauuaugcuauuaauguucuucagcugcaggacccuaagaucauuaucgauaaaauuaacuaccgcaccgaaaucaucauugacaacuuuuccuaucucaucucuaccaagagcaaugacggauccauuacagugaagcccaacgagcagauguacuggagagucgaugaaaucagcaaucugaaaaagauugagaacaaauacaagaaagacgccauccugacggaggaagaucggaagauuauggagucuuauaucgacaagaucuaccaacaguucaaagccggcaaguauaaaaaucgcagaaccacagauaccauuaucgaaaaguacgagauuaucgaccuugauacacuggacaacaaacagcucuaucaacugcucguggcuuuuauuucccugagcuacaagaccucuaauaacgccguggauuucacggucaucgggcuuggaacagaauguggcaaaccgcggaucaccaaucugccugacaacaccuaucugguuuacaaguccauuacagggaucuacgagaagcgcauuagaaucaaauga

SEQ ID NO: 4174 - RNA, 4047 nt, Artificial Sequence
  Cas9 variant
augaagaaacccuacaccaucgcccuggacauuggcacaaacagcguggggugggucguugugacggaugacuauagagugccuaccaagaaaaugaagguccucggaaauacagagcggaaaaccaucaagaagaaccugauuggcgcccuucuguucgauuccggggacacagccgaaggaacccgccucaaaagaacagcgcggcgcagauacacccggcgcaagaauagacugcgguaucuuaaagagaucuuuacggaagagauggcuaagguggaugacggcuucuuucagcgccuggaagauucuuucuacguucucgaggacaaagaggggaacaagcacccgauuuuugccaaucuggccgaugaaguggcuuaucauaagaaauaccccaccaucuaucaccugagaaaggagcucgucgacaacccucaaaaagccgaucugcggcuuaucuaccuggcuguggcccauauuaucaaguuccgcggacacuuucucauugaaggcacacugagcuccaaaaauaacaaucuucagaagucuuucgaccaucugguugauaccuacaaccuccuguuugaggagcagagacugcucacagaaggcaucaaugcgaaagagcugcuuagcgccgcucuguccaagucuaagcggcucgaaaaccugauuagccuuauccccgggcagaaaaagaccggaauuuucggcaauaucaucgcccugucccucgggcugacgccuaacuuuaaagcuaauuucggacugagcaaggacgugaaacuccaacuggccaaggacacauaugcggaugaccuugauucucugcucgcccagauuggcgaccaguacgcugaucuguuucuugccgcuaagaaccuguccgacgccauccuccugagcgauauucugaccgagucugacgaaaucacacgcgcuccccucuccgcuagcauggucaaaagauaucgggagcaccacaaggaucuggugacccuuaaaacccugauuaaggaccagcucccugagaaauaccaagaaaucuuccuggauaagacaaagaacggguaugcgggauacaucgagggccaggugucucaggaagaguucuauaaauaccugaagccgauucuugccagacucgacggcuccgaaccccugcugcucaaaaucgaccgcgaggauuuucugcggaagcagagaacguucgacaaugggagcauuccucaucaaauccaccuugaggaacugcaugcuauucuccgccggcaggaggucuuuuaccccuuccugaaagauaacagaaagaagaucgaaucccugcuuaccuuucgcaucccuuauuacguuggaccccucgcccggggccacucuagauucgccugggugaaacgcaaguuugacggggcuauucggccguggaauuucgaggaaaucguggaugaggaggccagcgcgcagauuuuuaucgaaaagaugacaaagaacgaccuguaucugccuaaugagaaaguccuccccaagcacucccugcuuuacgaaaccuucacaguguauaacgagcugaccaaaguuaaguacgcuacggagggaaugacaagaccucaauuucucagcgccgaucagaagcaggccauuguggaccugcuguucaaaaccaaucgcaaggucaccgugaaacagcuuaaggaaaacuauuuuaaaaagaucgagugcugggauucuguugaaauuacaggcguggaggacuccuucaaugcuagccucgggaccuaccaugaucugcugaagaucauccaagacaaagauuuccucgacaaccccgacaaucagaagauuaucgaagauauuauccugacacuuacgcuguuugaggacaaaaagaugauuucuaaacggcucgaucaguacgcccaccuguucgacaaggucgugcugaacaaacuugagagacaucacuauaccggauggggccggcucagcggcaaacugaucaaugggauccgcgauaagcaguccggaaaaacaauucuggacuuucucaaggcugauggcuucgccaacagaaauuuuaugcaacugauccaugacucugaacuuagcuucauugaugagaucgcgaaagcccaggucauugggaagaccgaauacuccaaggaccuggugggaaaccucgcuggcagccccgccaucaaaaaggggaucucucagacaauuaaaaucguugaugagcuggugaagauuaugggcuaucugccucagcaaaucgucauugaaauggcucgggagaaccagaccacggcccagggaaucaaaaaugcgagacagcgcaugcggaaacuugaggaaaccgccaagaagcugggcuccaacauccucaaggagcacccgguggacaauagccaacugcagaacgauaaaagauaccucuauuaccugcagaaugggaaggacauguauacaggagacgaucuugacauugauuaccugucuuccuacgacaucgaucacauuaucccccagagcuuuauuaaaaacaauuccaucgacaacaagguucucaccucucaaggcgcuaaucgcgggaaacuggauaacgugccuagcgaagccauugucagaaagaugaagggauauuggcagucccugcuucgggcuggcgccaucucuaaacagaaguucgacaaucugacaaaagccgagcgcgggggccucacccaaguggauaaggcuggauuuauccagagacagcugguggaaacgcggcagauuacaaaacauguugcgcaaauccucgacagccgcuucaacaccgaguuugaugaccacaauaagcggauuagaaagguccauaucauuacacugaaauccaaacuugugagcgacuuccgcaaggaguuuggccuguacaagaucagagauaucaaccacuaucaccaugcccacgacgcuuaccucaaugccguggucgccaaagcuauucuggggaaguauccccagcuggccccugaauuuguguacggagauuaucccaaguacaacucuuucaaagagcggcagaaggcgacccagaaaaugcuuuucuacuccaacauccugaaguucuuuaaagaccaagaaagccuccauguuaauucugauggcgaggagauuuggaacgcuaauaagcaucugccgaucauuaagaacgugcucuccaucccucaggucaauaucgugaaaaagaccgaaguucagacagggggauucuauaaagagagcauucugucuaagggcaacagcgacaaacuuaucccccgcaagaauaacugggauacgagaaaauacgggggcuuugacuccccuaccguggccuauagcguccuggugauugccaagauggaaaagggaaaagcuaagguucugaaacccgugaaggagauggucggcaucacaauuauggaacggaccgccuucgaggagaauccugugguguuucucgaagcgagaggguaccgcgagauccaagaacaccugauuaucaaacuucccaaguauucucuguucgagcucgaaaacggacggagacgccugcucgcuuccgccagcgagcugcagaagggcaaugagcuuuuucugccggucgauuacaugacauuccuguaucucgccgcucacuaccacgaacugaccggguccucugaggacguucuucggaaaaaguacuuuguggauagacaucugcacuauuucgacgauaucauucagaugaucaacgacuucgccgaacgccauauucucgcuagcuccaaucuggagaaaaucaaccacacguaccauaauaacucugaccucccugugaacgaacgggccgagaauauuaucaacgucuuuacauucguggcgcugggagcccccgcugccuuuaaguucuuugaugcuaccaucgacagaaaacgcuauaccagcacaaaggagguucuuaaugccacccugauucaccaguccgugacaggccuguacgaaacgcggaucgaucucucucaacugggggagaacuga

SEQ ID NO: 4175 - RNA, 4047 nt, Artificial Sequence
  Cas9 variant
augaaaagcgagaaaaaguacuauaucggccuggacguggggaccaacuccgucggaugggccguuacagaugaguucuacaauauucucagagcuaaaggcaaggaccuguggggagugcggcuuuuugaaaaagccaagacggcggcugauacccgcacauucagaucugggcggcgcagaaacgaccggaagggcgugcgccugcagauccucagagaaauuuuugaggaugaaaucaaaaaggucgacaaagauuucuaugaccggcuggaugagagcaaguuuugggccgaggacaaaaagguguccgggaaguacucucuuuucaaugauaaaaacuuuagcgacaagcaauauuucgaaaaauuucccaccauuuuccaucugcgcaaguaccucauggaggaacacggaaaaguugauaucagauauuacuuucuggccaucaaucagaugaugaagcggcgcggccacuuccugauugacggccagaucucccaugugacagacgauaaaccucucaagcagcaacugauucuucugaucaacgaccuccugaagauugagcuugaggaagaguuuauggauucuaucuucgaaauucuggcugacgucaaugagaaaaagaccgaaaagaagaacauccucaaagagcugaucaaugcccaggauuucaacaagcaggaggggaagauucuguacagcaucuuugaauccauugugacaggaaaagcuaagaucaaaaauauuaucagcgacgaggauauccucgaaaagauuaaagaggacaacaaggaagauuucguucugaccggcgacucuuaugaggagaaucuucaguacuuugaagaggugcugcaagaaaacaucacccucuucaauacgcugaaguccgccuaugauuuugucauucuucagagcauccugaaagggaagucuacacucuccgacgcccagguggagagauacgacgaacacaaaaaggaucuggagauucugaaaaaggugaucaagaaauaugacgaggauggaaaacucuucaaacaggucuuuaaggaagacaacggcaacggguacguuagcuauaucggauacuaccugaauaaaaacaagaaaauuaccgcgaagaagaaaaucucuaauauugaguucacaaaguaugugaaaggcauccuugaaaagcaaugcgauugugaggacgaggaugugaaauaccugcucggcaagauugaacaggagaacuuucugcuuaagcagaucuccagcauuaauuccgucaucccgcaucaaauccaccuguucgaacucgacaaaauucuggagaaccuggcuaaguauuaccccucuuuuaauaacaaaaaggaagaguucaccaaaaucgagaagauucggaagacguuuacauuccgcaucccuuauuacguggggccccucaaugauuaucacaaaaacaauggaggcaacgccuggauuuucagaaauaagggggaaaagauccggccuuggaacuuugagaagaucguugaccugcauaaaagcgaagaggaguucauuaagagaaugcuuaaucagugcaccuaccugcccgaagagacagugcucccuaaguccagcauccuguacucugaauauaugguccugaacgagcuuaacaaucuccgcauuaacggaaaaccgaucgauaccgacgugaagcugaaacugauugaggaacucuuuaagaaaaagaccaaaguuacacugaaguccauccgggauuacaugaucagaaauaacuucgcugacaaggaagacuuugauaauagcgagaaaaaccuugagauugugucuaauaugaaaagcuauaucgacuucaacaauauucugggcgauaaguuugaacucgagauggucgaagaccugaucgagaagauuacgauccacaccgggaacaaaaagcugcuuaagaaauacaucgaggaaacauaucccgaucucuccucuagccagauucagaagaucauuaaucugaaauacaaggacuggggacgccugucccggaaacuccuggauggcaucaccggcacaaacauugagaccggggaaaucgacacggugauuaauuuccuuagaaacagcucugauaaucugaugcaaaucaucggaucccagaacuauagcuuuaacaaugacauugauaagcuccgcaagaaauacaucccucaggagauuucuuacgaagucguggagaaccuguauguuucccccagcgugaagaaaaugaucuggcaggucauucggaucacagaggaaaucaccaaggugaugggcuacgacccugauaaaauuuucaucgagauggccaaguccgaagaggggaagaaaaccacaauuucuagaaagaauaaacugcuugcgcucuauaaggccaucaaaaaggacgaacgcgacagccaauacgagaagcugcugaccggacucaacaaacuggaugacuccgaucuucggucuagaaagcuguaucucuacuauacacagaugggccgcgacauguacacgggggagaaaauugaucuggacaagcuguuugauagcacccauuacgacaaagaucacaucaucccccaguccaugaagaaagacgauagcauuaucaauaaccuuguucucgugaauaagaacgcuaaucagacaaccaagggcaacauuuauccggucccuucuuccauccggaauaaccccaaaauuuacaauuauuggaaguaccugauggaaaaagaguucaucagcaaggaaaaauauaacagacugauucggaauacaccucucaccaacgaggaacugggaggcuuuaucaaccgccaacuuguggagacgagacagucuaccaaggccaucaaggagcuguucgaaaaauucuacaagaaauccaagauuauccccgugaaagcuauucucgccagcgaccugcggaaggacaugaauacacugaagucuagagagguuaacgaucuucaccaugcccacgacgcuuuucugaauaucgucgcgggggauguguggaaccgcgaguucaccagcaaucccauuaacuaugugaaagaaaaucgggagggagacaaggucaaauacucccucagcaaguacuuuacaagaccucgcaaaucuaagggcaaggugaucuggaccccggaaaaagggagaaagcugaucguugauacgcucaacaaacccuccgugcugauuagcaaugagucccaugucaagaaaggagaacuuuucaacgccacaaucgcuggcaagaaagacuauaagaaggggaaaauuuaccugccucucaagaaagaugaccggcugcaggaugugucuaaguauggcggauacaaagccaucaauggcgccuuuuucuuucugguugagcacaccaagagcaagaaacgcauuagauccaucgaacuuuucccccugcaucuccugucuaaguuuuaugaggacaaaaacacagugcucgauuacgcuaucaauguccugcagcuucaagacccuaagauuaucauugauaaaaucaacuaucggaccgagauuaucauugacaauuucagcuaccugaucuccaccaagucuaacgacgggagcaucacagugaagcccaaugaacagauguacuggcgcguugaugagauuuccaaccucaaaaagaucgaaaacaaauauaagaaagacgccauucugacggaggaagauagaaagaucauggagagcuacauugacaagaucuaucagcaauuuaaagcgggaaaguacaaaaaucggcgcaccacagauaccaucauugagaaguaugaaaucauugaccuggauacacuugacaacaaacagcuguaccagcuccugguggcuuucaucucucucuccuauaagaccagcaauaacgccgucgauuucacggugauuggccuggggacagaguguggaaaaccgagaaucaccaaucuuccugacaacaccuaccugguguacaagucuaucacaggcauuuaugaaaagcggauccgcauuaaauga

SEQ ID NO: 4176 - RNA, 4047 nt, Artificial Sequence
  Cas9 variant
augaaaagcgagaaaaaguacuauaucggccuggacguggggaccaacuccgucggaugggccguuacagaugaguucuacaauauucucagagcuaaaggcaaggaccuguggggagugcggcuuuuugagaaagccgauacggcggcuaacacccgcaucuucagaucugggcggcgcagaaaugaccggaagggcaugcgccugcagauucucagagaaaucuuugaggaugaaauuaagaaaguggacaaggauuucuaugaccggcuggaugagagcaaauuuugggccgaggacaagaaagucuccgggaaguacucucuuuucaacgauaagaauuuuagcgacaaacaauauuucgaaaaguuucccacaaucuuccaucugcgcaaauaccucauggaggaacacggaaagguggauaucagauauuacuuucuggccauuaaccagaugaugaaacggcgcggccacuuccugaucgacggccagauuucccauguuaccgacgauaagccucucaaagagcagcugauccuucugauuaaugaccuccugaagaucgagcuugaagaggaacugauggauucuauuuuugagauccucgcugacgugaacgaaaagagaacagauaaaaagaauaaccugaaagagcugaucaaggggcaagacuucaauaaacaggagggaaacauucucaauagcaucuucgaauccauugucaccggcaaggccaagaucaaaaacauuaucagcgaugaggacauccuggaaaagauuaaagaggauaauaaggaagacuuugugcuuacaggggauucuuacgaggagaaccugcaguauuucgaagagguucuccaggaaaacaucacccuguuuaauacgcuuaaauccaccuacgacuuccugauucuccaaagcauccugaagggaaagucuacacuguccgacgcucagguggagcgguaugaugaacacaaaaaggaccucgagauucugaaaaaggucaucaaaaaguacgaugaggacggcaagcuguuuaaacagguguucaaggaagauaacgggaauggauaugugagcuacaucggcuauuaccugaacaaaaauaagaaaauuaccgccaagaaaaagaucucuaacauugaguuuacaaaguacgucaaaggcauccucgaaaagcagugcgacugugaggaugaggacguuaaauaucugcuugggaagauugaacaagagaauuuccugcucaaacagaucuccagcauuaacuccgugaucccgcaucagauccaccuguuugaacuggauaagauucucgagaaucuggcgaagaacuaccccucuuucaauaacaaaaaggaagaguuuaccaaaaucgagaagauucgcaaaacguucacauuuagaaucccuuauuacgugggaccccuuaaugacuaucacaagaacaauggcgggaacgccuggauuuuccggaacaagggagaaaagaucagaccuuggaauuucgagaagaucgucgaucugcauaaaagcgaagaggaauuuauuaagcgcaugcucaaccaaugcaccuaccugcccgaggagacagugcugccuaaauccagcauccuuuauucugaauacaugguucucaaugagcugaacaaucugcggauuaacggcaagccgcucgacaccgaugugaagcugaaacuuaucgaagaacuguucaagaaaaagaccaaagucacacucaaguccauuagagacuacauggugcgcaauaacuuugcugacaaagaagauuucgacaauagcgagaagaaccuggagaucgccucuaauaugaaaagcuauaucgauuuuaacaauauucuggaagacaaguucgauguugagaugguggaagaccuuaucgagaagauuacgauccacaccgggaacaaaaagcuccugaaaaaguacauugaggaaacauaucccgaucuguccucuagccagauccagaagaucauuaaucucaaauacaaggacuggggacggcuguccagaaaacuucuggauggcaucaagggcaccaaaaaggagacagaaaagaccgacacggucauuaacuuucuccgcaacagcucugauaaucugaugcagaucauugggucccaaaacuauagcuucaaugaguacaucgacaaacugcggaagaaauauauuccucaggaaaucucuuacgagguggucgagaaccuuuacgugucccccagcguuaagaaaaugaucuggcaagugauuagagucacagaagagaucaccaaggugaugggauaugauccugacaagauuuuuaucgaaauggcuaaauccgaggaagagaagaaaaccacaauuucucgcaagaauaaacuccuggaccuguacaaggccaucaagaaagaugagcgggacagccaguaugaaaagcuccugaccggccuuaacaaacuggaugacuccgaucucagaucucgcaagcuguaccuguauuacacacagauggggcgggacauguauacgggagagaaaaucgaucuugacaaacucuucgauagcacccauuacgacaaggaucacauuaucccccaguccaugaagaaggacgacagcauuaucaauaaccugguucuggugaauaaaaacgcgaaucagacaaccaagggcaacauuuacccggucccuucuuccaucagaaauaaccccaaaaucuauaauuacuggaaguaucucauggaaaaagaguuuauuagcaaggaaaaguacaaccggcugauccgcaacacaccucuuaccaaugaggagcuugggggcuucauuaacagacagcucguggaaacgcggcaaucuaccaaagccaucaaggagcuguuugaaaaauucuaucagaaguccaaaauuauccccgugaaggcuagccuggccucugaucuuagaaaggacaugaauacacugaaaagccgcgagguuaacgaucuccaccaugcucacgacgccuuccugaauauugucgccggagauguguggaaccgggaguuuaccuccaaucccaucaacuacgugaaggaaaauagagagggcgacaaagucaaguauagccucucuaaagauuucacacgcccuagaaaguccaaggggaaagugaucuggaccccggaaaagggacggaaacugauuguugacacgcuuaacaagcccagcgugcugaucuccaaugagucucaugucaaaaagggcgaacucuuuaacgcuacaauugcggggaaaaaggauuacaagaaaggaaagaucuaccugccucugaaaaaggacgaucgccuucaggacgugagcaaauauggcggguacaaggccauuaauggcgcuuucuuuuuccugguugagcacaccaaguccaaaaagagaauccggucuaucgagcucuuuccccugcaucuccugagcaaauucuaugaagauaagaacacagugcuugacuacgccauuaauguccugcagcuccaagacccuaaaaucauuaucgauaagauuaacuaucgcaccgagaucaucauugacaauuuuuccuaccugaucucuaccaagagcaacgauggauccauuacagugaaacccaacgaacagauguauuggagaguugacgagaucagcaaucugaagaaaauugaaaacaaguacaaaaaggaugccauccuuacggaggaggaccggaagauuauggaaucuuacaucgauaaaaucuaucagcaauucaaggcuggcaaauacaagaaucgcagaaccacagacaccauuaucgagaaauaugaaauuaucgaucuggacacacucgauaacaagcagcuguaccagcuccugguggccuuuauuucccuuagcuauaaaaccucuaauaacgcggucgacuucacggugaucgggcugggaacagaguguggcaagccgcggaucaccaaucugccugauaacaccuaccucguguauaaguccauuacagggaucuacgaaaaacgcauuagaaucaaguga

SEQ ID NO: 4177 - RNA, 4047 nt, Artificial Sequence
  Cas9 variant
auggagaagaacuacuaucugggccucgaccuggggagcaauuccgugggaugggccgcuaccgaugaagacuacaacuuccuuagacugaaaggcaagacagccuggggagcgcggaucuuuucugaggcuaaagauugcaaggaacgcagaacguaucggagcaauaaacgcagacucgcccggcgcaaguacagacugguccuucugaagcagcucuuugccgaggaaaugaccaaaguugacaagacauuuuuccugcggcuggcuaacuccaccuauugggaggaggauaaaacaaaggacucugaugggaaugaaauuggcaaaaaccucaucuuuaagacccacgaggaagagaagcaauacuauacaaaauaccccaccauuuggcaucugcgcaaggcccuuaucgagaaugacgaagaggcucugagcaaccucagauacguguaucuggccauucaccauaucgugaaauaccgggggaauuuccuuacggaaggagagaugggcaacgauaucccuccgauuaccacaaucgaagagauuaaucagacccugucccuccuggaggucgacucuagcgaagaugcgacagacaagaccacguauaucaaacccgaguccuacaacgaacuguuuacaauucucgagaauaacaaucugaacaaggugaaaaagcagcaggaaaucgauaagcuguucauuagcucuaaagagcgcuccgagaacaucaagaauuauaucaaccuguuuaaaaccauuaucguuggcgggagcuucucucucaagaaaauuaaugaagacacagaggacaucuccguggauuuuaccaaggacuucgaaaacagcgaggccgauauuucuaaggcucugggagacuccuuuaaucuuguccugaucgccaaaaaguacuaugauuacaucauucucaaagaacugcugggcaagaacaaagagaucagcgaggcuauggugcaaauuuacgaagaacacaaggacgaucucaagucccugaaaaccauccuuaaggaccuggauaauaaacucgggaacgacggaaaggauagaauuuauuacucuguuuucaaacaggaaccuacagagaaguucaaggagacgaauuaucugagcuuugugcagggcgggaaacuugaagaacugaacaaguacaucaaaaagauccucgaaaauaacgagaaagacauugacgauaaggaaaccuauaaugcccuguacgagaaagcguguaagggagaccuguucaagaaacaggccaacgcuugcacaucccucaucccccaucaauuucaccuucgggagcuuaagaaaauucuggaaaaugccggccgcaaguauagcuuccucaacgauaucucugacaaaauuaucaagauuuuuaaguucagagucccuuacuacuauggcccccugaacaaugaguccaacgcucacagcuggguggugaaaaaggaagggcaggagaaagccaagaucaccccuuggaauaucaacgaaauuaucgauacaccgaaaacccgggacaauuucuucaagaagcugacgaacucuuguacauaccuugucggagagaccguucuccccaaaaccagccuguauuacgagaaguaucuggugcucgauagacugaauaaaaugcaagugaacggcgacuaccuuuccgccucugaaaagaaugauguccugaaauuuauucucagccgcaagacaaccacaaucgagcagauucggacguaucuguccaagaacaaaagcaccaaggcuaaugacaucucuaucuccaacauuaaagcgacagauccuuucaaugccgugagccaugcuuuuuacgggaagcaccccgaccugaacaucaaucuuugcgaggagcucauuaaauucgccaccaucuacgccgaugacaagaaagaacugaagaaguuuguuucuuccaacuucaaccugacagacgaguucauuaaagaguaucucaauaccccuacgaacaaguggggaagacugagccgcaaauuucuuuguggcggggaucagcuggaaauguacuauguggacgauaauggaauccuccauuccauccugaacauucuggaggaaaccaaugagaaccuucaggagauccucaauaacgaaaaguacggcuucaaucagaaaauugcugacuuuaacaauacacugaccgccgauaagacaaccgaggaacaaaucgaggacauucuggauucuacgcccgcgcucaugcggagaagcaucauccagacacuggcugucguggacgauguuauuaaggccgccggcaaagcuccgcagaagaucaugauggaagugacccgcacagacgggaaaaaggaggagaccaaaucccgguauguccagcuuaagaagcaaauuaccaacgauaaagugcugacaucugacgaaaagaaagagcuccugacgaaucuggaaaacaagaaaauccagcuuaagggaaagcacauuuaccucuauuucaugcagaugggcaucgauuuuuacaccgggaaaauuauggacaucaaugacgucaucaacggaaaguacgauauugaccacaucauuccucagagcaugaucaaagaugacucccuggauaacauggugcugguuagcaaggacuauaaucaaaaagugaagaaggauauuuaccccaucugcgacgagaucagaaacaauaugcucgauaaauggaagggcuauuacgcccgcaaaauuaucucugaagagaaguauaaccggcugaaaagaacaaaggagcuuaaugcugacgaaauuaacgccuucaucaaucgccagauuaacgucgugaauuacuccaacauccagaucaaacggauuuuugagaucaaguauccugaaaccaagauuaucuucagcaaagcgucuuuucccucccugcucagaaaggaguacgaaauugccaaaaugcgggaucugaaugacgcucaucacgccguugacgcuuaccugaacaucgugugugggaauauucuuacaacccuguauacggauaucuucuacauguuuaaggagaaaaaggaggaccauaagaacaucagcuucaauauggaaaaacgccucauuaacuauaucgauaagaauaaccugaaagacaagauuaaaacaucuugccucagacacgaugcccugaucaccuacaagcccgacuaugauagcggcaaguuuuacaaagagaccauuuucaagaaauccggagacaaggaaacaggccuuaucccucugcauaccaaagggccgaugagcgauacaaagaaguauggaggcuacucucagcucucccaaagcuacaucauugcggucgaguauaaacugaagaacaaaacggugaagaaacugugucgggugcccacccuuuaccugaagcaguauaaaaaugaccucaacacaaucgccaagauuaugaucgaugacgagaaggcuaccgauauuaaaguucugagaaagaucuaccucaaucagaaaauccgcuauaacgggugcuacuaucugauuuacacauccaaggaaaaacagaauaaguacaagauggccuaucaaaacuaccuugacaaugacuaucugaucuaccucaacaaaugucugaagaaaauugaugagcuggacgauggagaacuuaccucucaggaguucaucgucaauaaggacggcgauaaauuucugauugacaagaaccacaaucucgaaaucuucaagagcauuaaagagcaguauaacaagacgaucuacgauuauaccccuuacaucgugcaaucccgggagaugaaagaagaggacuuuaauaaccugucucucaagaaacagauugauacacugcuuaauaugaucaagauucugagcagauccaacgaacaggcuaaguucgagaccgccuuuuucgaaaacuuuacaaaaguguuccugaagaccaugacaaucaccaaugagaaagucuacauugugaacgagucucccagcgggcucuuuaagggcaaagaggagcugaucuga

SEQ ID NO: 4178 - RNA, 4047 nt, Artificial Sequence
  Cas9 variant
augaagaaauucgaggacuacuaucugggccucgaucuggggaccagcuccaucggaugggccgugacaaacgaaaaguacgacauucuuagauuuaauaaaaaguucauguggggcacgcaccuguuugauauggggaacaccgcuucugagcggcgcaucuucagaacaagccggcgcagacucaaacggaagaagaaucgcauugaacugcuucagacccuguuuuccgccgagaugucuaaaaaggacuucggauuuuuccaaagacucaaagaaagccaguauuuuaucgaggauaagacauucaaaaacaagaauacccuguuuauggacgagaacuacacagaucaggacuaucauauggaauaccccaccauuuaucaucugcggaaggcgcucaucgauaaugaggaauccgcuuucgagauccgcaaacuguaccuugccauuucucacauccugagccacagaggccauuuucucuucgagggggaacuguccgacaaccuugauuucgacgauauuuuuaaugaguucgucaaguaccugaacgaagaacucaauaucgacuuuaaaauuaagagcgacguuucucugcaggccaucaaagaaauucugacggauaagaugcucaaccggaccaaaaagaaggagaaacuguccgagcuucuggaagaggaaaagaauaaaaucuaucaagagaucuggaagcuccuggugggaaacgaagcuaaaaugagcacaauuuucgacgauaaggaguacgaggaagccaagaucgcuuuuucuaaaggcaauuaugacgagaaggaagaggaauacgaguccauucuuggcgagaaaauccuguucgugcagaaggccaaagcgauuuaugauuggaugcuccugcagaacauccugaaggaagacaaguaccucagcuauucuaaagucaagcuguacaacgagcacaaaaaggaucuuaaaauccugaaggacgugcucaagaaucuggauaaaaagauuuacaaagaaaucuuuuccgagaacgggcuuuaugaggaauaccugcgcauugagaagaaaaagaucggaagcaaagaagagaagaccaaggacauucucuauaauagacugaaaaagaucuucgaaaaccgggauaauauggccaucgaggacauucugaacaaaaucgagcucgacuccuuucugccuaagcagaaaauuaaggauaauggcguuaucccgcgccaagugcaccagaaggaacuugagauuauccugaaaaacgcugaaaaguacuucaaauggcucauugagaaggacgaaacagggcugucugucagcgagaaaaucaugaagaucuuuaaguucaaaauucccuauuacgugggaccucuuaauuccaagagccccuuugccuggaucgagagaaaagaauauggcaagauucuuccuuggaacuucgagaauaugguugauaugucuaaaaccgcugaaaaguucaucaagcggaugacgaacaaaugcacauaccuccccgagaaggacgugauuccuaaaaauucccugcuguacaccaaguauaugguccucaacgaacugaauaaccuuaaaaucagaggggagaagaucaaaguggagcugaagcagaagauuuacacagaacucuuucagaaaaacaagaaaaucggaaugaagacccugauugaguuccugaaaagccaaaauaucguggucaccaagguugaaauuacaggcaucgauggcacguuuaacaccucucuugggagcuauaucgacaugaagaaaauuuucggagaggagaagaucgugaaagauuccuacaagaaaaugauugaagacaucauucucuggaucacacuguauggcgaggaaaagaagcugaucaaaucuaagauugaggaaaaauacccggagaaggugacccccgaggaaaugaaacucauccugaaacuuaaguaucgcgauuggagccggcuguccaaagaguuucucacagaaauugagaccauggacgaagagacgggggagcugaucagcauuaucgaaaugcuguggagaaagaaugagaacauuauggaacuucucucuuacaaauacgauuucuccaaucgcaucaaggaguauaacggaaucaaugaaaaagagaagaacauuacauacgaggaccuggucaaggaucugcagaucagcccuucugugaaaaagaugauuuggcgggcccucguuaucgugaaagaaauuaagaaagucaccaauaagucccccaaaaagguguuuaucgagauggcgagagacacccagacagaaaagaaacgcaccgagaagcggaaagacaagcugcuugagcuguauaaaaacaucaagaaugaugacagcauuaaggaacucgagaaaaaccugaaggauaaaacaaaugacgaucugaaguccaaaaagcuguaccucuauuaccugcaacugggcagauguauguauucuggggaaguuauccgccucgaggaccugaugaacgauaaucuuuacgacauugaucauaucuacccucagagcaagauuaaagacgauuccuucgacaacacggugcuggucaagaaacagaucaacgccgauaagaccaaugaauaucccaucgacaaaucuauucagaacaagugcaaggcuuuuuggacaagccucaaagagcggggacugauguccaauaccaaguacgagagacugacacgcaccgaaggcuucagcgacgaugagcuugccggcuuuaucucucggcaaauuguggaaacgagacaggcuaccaaaguccuggccgaccuccugaaggugaucuucggguccgauacacggauuguuuaugugaaagccggacucaccagcgacuuucgccagaaguucggcaucuacaaauucagagagcugaacgauuaucaccaugcucacgacggguaccuuaauauugucacaggaaacaucuauaauacccuguuuacggauaacccguacaauuucaucaaggaccggaagaaagauaacagaacauacaaucucaacaagguguuugaacgcgagaaugacguuuggaacccugaugugaugcugucuaaaauugagcgguauaucuacaagauuagaccccuguucacccgcgcguccuaugaacagaaaggcggguuuagcgaccaaaauaucucuagcgagaaggacaaacuuagaccucugaaguccagcggcguccucucuaacauuaaguacggaggcuaugauaaaaucaagaacuccuacuucuuuaucguggaauauacagagaaaaagaagcgggugcgcagcauugaaacccugcccaucuacauuaaaaaguccaucucuaccaaagaggaccucgagaaguacuguaaagaggagcugaaacuucaggaacccaagguucuggucagcaagcucaauuauaagucccugauuuacucuaacgggcacgaguauuacaucaauagcaaaacagccgauuccaucacgauucagaacggaauccagauuauccugaccaaggagaauuaugaaacauacagaaaaauuuauaagaaccuugaguaccugaaacucaucuacaaggacgaaaagauucgggaggaaaagauccuggagaagaucccuaaaauucucaagaauaacaaaaaugaucgcgaccugucugaggaugaaaucagcgagaaguucuggaaacuuuauaaggaaauuuuugagaagaucaaaauuggcaucuucuccaaguuuaaaagcacccugccgaucuacauugaagacugcaagaagcugaaagauuucacaacccucaacaauuaugcuaagucuagauucauccaagagauucugaaaugucuuaacucccagcagggggaguuugacacgaaguacacacauaauuauagcaaaaaguacaacaccaagcugucuaaauccaagauccucgaaaaugauuucuauauuaucaaccagagccccaccggacuguuugagaaaaagguguuccucgacaaauga

SEQ ID NO: 4179 - RNA, 4047 nt, Artificial Sequence
  Cas9 variant
augggcgaggacgggaagccccugagagugaaaggaaagaccgccaucggcgcuagacucuuccaggaagggaacccugccgcggaucgcagaauguuucggacaacgcgcagacggcugaaucgcagaaaauggcggcuuaagcugcucgacgagauuuucgauccguacaucacccccgucgacagcacauuuuucgcucgccugaaacaauccaaccuuucuccuaaggauagcagaaaggaauuuaaaggauccaugcuguuccccgaccucaccgauaagcaguaucaccuggacuacccuacaauuuaucaucugcggcacgcccucaugacccaggauaaacaguuugacauccgcaugguuuaccuggccauucaucacaucgugaaguauagaggcaauuuccuuaacucuacacccguggauagcuuuaaggcuuccaaagucaauuucgacgaucaauuuaagaaacugaacgagcucuacaccgccaucaauccugaagagucuuuccagauuaaccuggcuaauagcgagaagaucgggcagcaguuucuugacccguccauucggaaauucgacaagaaaaagcaaauccccaaaauugugccuguuacgauggaugacaaggccguggauaagcugaacggaaaaaucgcgagcgaaauuaucaaugccauccucggcuauaagucuaaacuggacgucgcugugcagugcgaucccgaggacuccaacccuugggccguuaaguucgaugacgaagauauugacgcuaaacugcagaagauccuccccgagauggaugagaaucagcaaagcauuaucggcauuauccaggaccuguacucucaggugacccuuaaccaaaucgucccgaaugggaugucccugagcgaaucuaugauuaagaaauacaacgaccaucacgaucaccucaagcuguauaaaaagcugaucggacagauuuccgacagcaaaaagaagacagcccuuaaaaaggcguacgaucaguaugugggcaacgacgggaaagugaucgagcaggaugacuuuuacuccucugucaagaaaaaucucgaugacagcgaacuguccaagcaaauuauggaucugaucgacgccgauaaguucaugccuaaacagcgcaccagccagaacggaguuaucccccaucagcuccaccaaagagagcuggacgaaauuaucgagcaucagucuaaguauuacccuuggcuugcugaguccaaucccaacaaacacgaucugcaccucgccaaguauaaaauugaagaacugguggcuuuucggauccccuacuacgugggcccuaugauuacaccggaagaccagaagaaaagcggggccgccgucuucucuuggaugaagagaaaggagcccggacagaucaccccuuggaauuuugacgaaaaaguggaucgcauggagagcgcuaacaaguucauuaaacggaugacgacaaaggacaccuaucuuaucggcgaggauguucugcccgacgaaucccuccuguacgagaaauuuaaggugcugaaugaacucaacauggucagagugaauggcgauucucugaagguugcggacaaacaagccaucuaucaggaucuuuucgagaacuacaagcauauuagcgugaaaaagcugcagaauuauaucaaagggaagacaggacucccuaacaaucccgaaauuuccggccugagcgacccggaucaguuuaacaauucucuggggaccuacaacgacuucaagaaacuuuuuggagauaaggucgacgauccugaccuccaaaacgacuucgagaaaaucguggagugguccaccgucuuugaagauaagaaaauucugcgcgcuaagcugaaugagaucacauggcucacggacaagcagaaagaugaccuggaaagcucucgguaucagggcugggggagacuuuccaagaaacugcucaccggaaucgugaacgaucaaggcgagcgcauuaucgacgagcuguggaauacaaacaagaauuucaugcagauucagagcgaugacgauuucgccaaacggauccacgaagccaacgcugaccagaugaaguccaccaauauggaggauguucuggccgacgcguacacaucuccccaaaacaaaaaggcuauuagacagguggucaaggugguugacgauauccagaaagccaugggcgggguggccccuaaguuuaucagcauugaguucacccgcuccgaggaccggaaucccagacgcacgaucucucggcagagacaacuugaaaacacacucaaagauaccgcuaagagccuggucaaauccaugaauccuaacauucugagcgagcucgacaaugccucucgguccaagaagggacugaccgaucgccuuuaccuguauuuuacacagcucggcaaagacauguacaccggggagcccaucaacauugaugaaaucagcaauuaugacaucgaucauauucugccgcaggcuuucaucaaggacgauucucuguccaacagagugcuugugagcaaagccguuaacaauggaaagucugcgaacgucccucucaaacuguuuggcgccaagauggggcacuucuggaagcagcuggcugaggccggccucauuaauaaacauaagcugaaaaaccuucaaacaaaucccgacacgaucagcaaguuugcuaugcacggauucauucggagacagcugguggaaaccucccaggugaucaaacucgucgccaacauucugggcgauaaguaccgcaaugacgacacaaagaucaucgagauuaccgcgcggaugaaccaccaaaugagagaugaauuuggguucaucaaaaaucgcgagauuaacgacuaucaucacgccuuugaugcuuaccugacagccuuccuuggaagauaucucuaccaucgguacaucaagcugcgccccuauuuuguguacggcgacuucaaaaaguucagagaggauaaaguuaccaugcggaauuuuaacuuccugcacgaccucacggaugacacccaggcucgcauugccgauacagaaaccggggaggugaucugggacagagaaacaagcaucaagcagcugcgggaugucuaucacuacaaguuuaugcuuauuucucaggagguguauacccugcgcggagccauguucaaucaaacgaucuacccugcuucccaggcgggccggaaaaagcucauuccgaugaaagccgacaagcccguugauguguaugggggcuacagcggauccacagacgcuuacauggccaucguccggauucaugacaaaaagggcgauaaauauaaggugguuggggugccuaugcgcgcccugaacagacugaauaccgcuaagaacgucucugacgccaaauacgaucaggaacuuaaggaggugcugacaccccaguuuaccaaaagcaagaaaaaccggaagaccggagagaucacacaaacgguggaagacuucgaggucguucucggcaaggugauguauagacagcuggugaucgauggggacaaaaaguuuaugcucggauccucuaccuaccaguauaaugcgaaacagcugguccuuagcgaugaauccauuaagacacuggcuucugagggcaaacucaacgaggcccaagaaagcgccgcuuacgacaagguguaugaugagauccuggacaagguuaauaaauacuucgcccuguacgauaccaacaaguuucgccagaaacuuucccuggggaaggacaaauucgugggccucccuaaucacaacgucuuugacggaagcaagaagauuucuuccggcaaacgggaaauccugaaugagauucucaacgggcugcaugcgaaugcuacacuuggaacccugagcgauaucggcuucucuacgcccuucgggaagaugcagcagccuagaggaauuggccucuccagcaacacaucuaucgaauaugaguccuuuaccgggcuguucaaacgcaccaucuuucugaaggaccuuuga

SEQ ID NO: 4180 - RNA, 4047 nt, Artificial Sequence
  Cas9 variant
augaagaaacccuacaccaucgcccuggacauuggcacaaacagcguggggugggucguugugacggaugacuauagagugccuaccaagaaaaugaagguccucggaaauacagagcggaaaaccaucaagaagaaccugauuggcgcccuucuguucgauuccggggacacagcugaaggaacccgccucaaaagaacagcgcggccgcgcuacaccagacggaagaaucgccugagauuucuuaaagagaucuucacggaagagauggcuaagguggaugacggcuuuuuccagcggcuggaagauucuuuuuauguucucgaggacaaagaggggaacaagcaccccauuuucgccaaucuggccgaugaaguggcuuaccauaagaaauauccuaccaucuaccaucugcgcaaggagcucgucgacaacccccaaaaagccgaucugagacuuaucuaucuggcuguggcccacauuaucaaguuucggggacacuuccucauugaaggcacacugagcuccaaaaauaacaaucuucagaagucuuuugaccaucugguugauaccuacaaccuccuguucgaggagcagcgccugcucacagaaggcaucaaugcgaaagagcugcuuagcgccgcucuguccaagucuaagagacucgaaaaccugauuagccuuaucccugggcagaaaaagaccggaauuuuuggcaauaucaucgcccugucccucgggcugacgcccaacuucaaagcuaauuuuggacugagcaaggacgugaaacuccaacuggccaaggacacauacgcggaugaccuugauucucugcucgcccagauuggcgaccaguaugcugaucuguuccuugccgcuaagaaccuguccgacgccauccuccugagcgauauucugaccgagucugacgaaaucacacgggccccucucuccgcuagcauggucaaacgcuacagagagcaccacaaggaucuggugacccuuaaaacccugauuaaggaccagcucccggagaaauaucaagaaaucuuccuggauaagacaaagaacggguacgcgggauauaucgagggccaggugucucaggaagaguuuuacaaauaucugaagcccauucuugcccggcucgacggcuccgaaccucugcugcucaaaaucgacagagaggauuuccugcgcaagcagcggacguuugacaaugggagcauuccccaucaaauccaccuugaggaacugcaugcuauucucagacgccaggaggucuucuacccuuuucugaaagauaaccggaagaagaucgaaucccugcuuaccuucagaauccccuacuauguuggaccgcucgcccgcggccacucucgguuugccugggugaaaagaaaguucgacggggcuauucgcccuuggaauuuugaggaaaucguggaugaggaggccagcgcgcagauuuucaucgaaaagaugacaaagaacgaccuguaccugcccaaugagaaaguccucccuaagcacucccugcuuuaugaaaccuuuacaguguacaacgagcugaccaaaguuaaguaugcuacggagggaaugacacggccccaauuccucagcgccgaucagaagcaggccauuguggaccugcuguuuaaaaccaauagaaaggucaccgugaaacagcuuaaggaaaacuacuucaaaaagaucgagugcugggauucuguugaaauuacaggcguggaggacuccuucaaugcuagccucgggaccuaucaugaucugcugaagaucauccaagacaaagauuuucucgacaaccccgacaaucagaagauuaucgaagauauuauccugacacuuacgcuguucgaggacaaaaagaugauuucuaaacgccucgaucaguacgcccaccuguuugacaaggucgugcugaacaaacuugagcggcaucacuacaccggauggggcagacucagcggcaaacugaucaaugggauccgggauaagcaguccggaaaaacaauucuggacuuccucaaggcugauggcuuugccaaccgcaauuucaugcaacugauccaugacucugaacuuagcuuuauugaugagaucgcgaaagcccaggucauugggaagaccgaauauuccaaggaccuggugggaaaccucgcuggcagcccugccaucaaaaaggggaucucucagacaauuaaaaucguugaugagcuggugaagauuaugggcuaccugccgcagcaaaucgucauugaaauggcuagagagaaccagaccacggcccagggaaucaaaaaugcgcggcagagaaugcgcaaacuugaggaaaccgccaagaagcugggcuccaacauccucaaggagcaccccguggacaauagccaacugcagaacgauaaacgguaucucuacuaucugcagaaugggaaggacauguacacaggagacgaucuugacauugauuaucugucuuccuacgacaucgaucacauuaucccucagagcuucauuaaaaacaauuccaucgacaacaagguucucaccucucaaggcgcuaauagagggaaacuggauaacgugcccagcgaagccauuguccgcaagaugaagggauacuggcagucccugcuuagagcuggcgccaucucuaaacagaaguuugacaaucugacaaaagccgagcgcgggggccucacccaaguggauaaggcuggauucauccagcugcagcucguggaaacgcggcagauuacaaaacauguugcgcaaauccuggacagcagauuuaacaccgaguucgaugaccacaauaagcggauucgcaagguccauaucauuacacuuaaauccaagcuggugagcgacuuuagaaaagaguucggccucuauaagauccgggauaucaaccacuaccaccaugcccacgacgcuuaucugaaugccguggucgccaaagcuauucuggggaaguacccucagcuugcccccgaguucguguauggagauuacccgaaguauaacucuuuuaaagaacgccagaaggcgacccagaaaacccuguucuacuccaacauccucaaguuuuucaaagaccaagaaagccugcauguuaauucugauggcgaggagauuuggaacgcuaauaagcaccucccuaucauuaagaacgugcuguccaucccccaggucaauaucgugaaaaagacagaaguucagaccgggggauuuuacaaagagagcauucuuucuaagggcaacagcgacaaacugaucccuagaaagaauaacugggauacgcggaaauaugggggcuucgacucccccacaguggccuacagcguccuggugauugccaagauggaaaagggaaaagcuaagguucucaaaccugugaaggagauggucggcaucaccauuauggaacgcaucgccuuugaggagaaucccgugguguuccuggaagcgaaaggguauagagagauucaagaacaucuuaucaucaagcugccgaaguacucucucuuugagcuggaaaacggacggagacgccuccuggcuuccgccagcgagcuucagaaaggcaaugagcuguuccugccugucgauuauaugacauuucucuaccuggccgcucacuaucacgaacuuaccggguccucugaggacguucugcggaagaaauacuucguggaaagacaucuccacuacuucgaugacauuauccagaugauuaacgauuuugccgagcgccauauccuggcuagcuccaaucucgaaaagauuaaccacacguaucauaauaacucugaccugcccgugaacgagcgggccgagaauaucaucaacgucuucacauuuguggcgcuuggagcccccgcugccuucaaauuuuucgacgcuaccauugauagaaagcgcuacaccagcacaaaggaaguucugaaugccacccugauccaccaguccgugacaggccucuaugagacgcggauugaccugucucaacuuggggaaaacuga

SEQ ID NO: 4181 - RNA, 4050 nt, Artificial Sequence
  Cas9 variant
augaagcagaaauucuacgugggccuggacauggggaccgccagcgucggaugggcuguuacagaugacaaguauaacaucauuaaaagacacggcaaggcccucuggggagugcggcuguuuaaaacggcgaauaccgcugaggaacgcagaaucuuccgggccgcccgcagacggacacaacgcagaaagcagcggauggagcuucugcaggaaauuuuuggagaugagaucuccaagaccgacauuggcuucuaccagcgcaugaaagaaucuaaguauugguuugaggauaaaagagacaucaacgggaagcaacccgagcucccuuacgcucuguucguggaugacggauuuacagauaaagacuaucaugaacaguucccgaccaucuuucaccuucggaauguccuggugaacgaguggacacagaaguacgauauucgccucguuuaucuggccauccaucacauuaucaagcauagaggccacuuccuguuugaaggcaaaaagaugagcgaggugaccgacuucggguccgcuuuugaggccuucugcaaagucgcgucugauaaugacauugaaaucacgguggacgaggaaaagcucaaagauauugaggaccugcuuaagagccggcagaaauccaagaccgccaagaaacaagaacugggaaagaucaucgcuggcgccgauaaacagaagaaagcucucgccgcgcugguuacaggguguauggugaaacuuucugagauuuucgccgacaagagccuggaugacggagagcgcaacaaaaucuccuuugcugauagcaauuacgacgaauacauugccaacgucgaggaaacccucgcugagagauuccugcugaucgccgccggcaaggcucucuaugauugggcggugcugucugacauucuugaaggguccacauacaucagcgaggccaaagugaagaucuauaaaaagcacggagaugaccugcggaagcucaaaggccugcuuaagaccagacccgacgaguacaaacugauuuuuggccucccugaaaagcaggcuaauuauucugccuacaucgggauggucaaaaagaacggaaagaaaguucccauugauaagaaaugcacgaaggccgacuucuauuccuuucugaaaaagacacugaauaaaaucaacuucgaggaugaaaaggagcgcgaaauugcugagagcaucaucaaugagauugaaaacgagaccuuucucccuaaacaggugaucucugacaauggcgugauucccuaccaacugcaugaagccgagcuugaucggauccugaagaacgcggcucucuacuauccuuuccuguccgagaaggacgaugaaggguacacaaacauggacaaaauuaaggccaucuuuaaauuccgcauuccguauuacgucggaccccuuaauaccuaucacagcgauaagggcgggaacuccugggccgugagaaagcaggacggaaaaaucuacccuuggaauuuugagucuaagaucgaugcuggcgaaagcgcccggaaauucauuggcagaaugaccaacaaguguacauaucugaucgggaaagacguucuccccaaggagucccugcuguacagcaaguuuauggugcucaaugaacugaacaaucuucgcauugauggagagaaagucucuguggagaucaagcaggcuguuuacgaaaacguguucaaaaaguaucaacgggucacgggcaaaaaggugaaggacuuccugauuagauccgggaucaucggacgcgagcaggaacucagcggcuuugaccagaauuucaaaucuagccugaaggccuaccaugauauuaaacagaucgcgggggacauuaaccugucccaaaaucagaaggaggauaucauuaaagaaaucaccgucuuugccgacucucagaagaugcuuaaaaagcggcucaagaucaaauauccugagcugagcgauaaacaggugacaaagcuggcugccaagaaauacaccggcuggggaagacucucccgcgaguuccuggaagagguugaaagcgugaacaaggagacaggcgaaguccuuaauauuaucucugcucugugggagaccaacgagaaucucaugcaacugcuguccaacaaguaugacuaccuuagcgaaauuaaacggcucaacgaugaggccgaagacaagucugaggugguuacguaugaugacgugcagaaacuguacgucucccccgcggugaagagaccgguguggcagacacugaaaaucguugaggaaauuagcaagaucaugggguccaagccugagcggaucuuugucgaaauggcccgcgagcccggacagaaaggcgaugugaaggugucuagaaaaagccggcuccuggaaaaguacaaauauugcaagaaggaggcuccugagauuuacgaaaaucuugucaaagaggacgauaacaagcugagauccgacaaacucuuccuguauuacacccaaauggggcgcuguauguauucuaaugaagugaucgacauugaggaucuguuuaccaaccgguacgacaucgaucacauuuauccccagagcaagguuauggacgauucccuugacaauagagugcucgucaaacgcgaacugaacagcaauaagacagauguguuccccguuccuaaggaguacauggacaaagccaagacccugugggauaugcucaaaaagaaagaccugaucucuaaggagaaauaccacagacuuacacggcgcgauggauuuuccgaaaacgagcugagcggcuucauugcuagacagcucguggaaacgcggcagucuaccaaggccgucacacaacugcugaccaaggccuauccggaguccgaaaucguguacgcuaaagcgaaugccguuagcgaguuucgccauaaguucggguuuacaaaagugagaucuaucaacgacuaucaccaugcuaaggacgccuaccuuaauauugucgugggcaacaccuauuacgugaaauucacgaaggaugccgcuugguucauccggaauaaccccggacgcaccuauaaucucaagaaaauguuugagcagggcacagucagcagagggggagaaaccgccuggguuuccggcgaggacgggacaauuuucaccgugaagcgggugauggggaaaaacaacauccuguuuacgcgcaaggcguacgaagucagaggcgggcuguucgaucagcaaauuaugaaaaagggcaagggacagaucccugugaaaaauaacagcgaggacgaucggcucugcgcuacagagaaguacggcgccuauaauaaagccucuggggcuuacuuuaugcugguugaauccgaggacaagaaaggaaacaagaucagaacccuugaguucgugcccgucuaucuggccaaggagcucgaaaagagcgaggaugcggcuauucgcuacuguguggagaagcuggaacugaaaaauccugacguucgggugagaaagaucaaaauggauucccuuuuuaacgucgacggcuuccgcaugcaccugucugggcggacaggaaagcagcucauuuuuaaaugcgccgagcagcuggugcucgaugaagagagccaaaagauccugaagaaaaccgccaagguuuucgcugacuauaaagaaaauaagaacauuaaaaucuccgauaagaucgagcuuaccgacgagaugcugauuaagcucuacgaacuguuuuauaaaaagcugaaagacacaguguacaauaucagacuuucuacgcaggucaagacccuggagagcggcaaagaaaaguucgagaagcucucccugcucgauaaaugucuggugauugaagagauccuucaucuguuccagugccagucuguggccgcuaaccucagcuccauugggggcgccgcgacagccggaauccugguccugaauaacgagauuagccgcuguggcaagguugaaaucaucaaucaaucuauuaccggguuuuacgaacaggugaucgaccuuaaaaacauuuga

SEQ ID NO: 4182 - RNA, 4050 nt, Artificial Sequence
  Cas9 variant
augcagaaguacuaucugggccucgacaucgggaccaacagcgugggaugggccgucacagaugagaauuacaaccugugcaaauucggcgggaagagaauguggggcauucggcuuuuugacggagcucaaacggccgaagaacgcagaaugaaucgguccaaccgcagacggcugucucgccagaaacagagaaucgaucuccugcaggaacuuuucgcgaaggagauugcuaaaguugaccccaccuuuuucauccggcugaaugaaagccgccucuauauggaggauaaguccacagggaccaaguuuccucuguucgccgacccgggauacacagauaaagaguauuacaaggaauaucccaccauuuaccaccugagacaagagcucaucaaaaacccugaaucucaugacauccggcugguguaccuugccugucaccauauucugaagaaucgcggccacuuucucaucaacggcagcuucuccgaucugaaaaaucuuucuuuugugugcagagagaugcuggacgcuuucaacgagcucagcaaguaucagcugaugauuuccgauaucgacgcccuggaaaagauucucagcgaucggaaacagcagaagucugcuaaagucaaggagcuggugcaaaucuuugaauguguuccccgcgaggacaaauccgacgccaagauuugcaaagaaauccuuagcaaucuguguaaguuccucgugggggcgaagggaaacaucacaagacuguuugauaccgacuucgaugagauggagacgucuuccuucagcuuuggcgacucuaaauacgaagauucccuucugccuagccucgaggaaaauuaucccgacuacgccaacgucauucagaagaucaaagcuauguaugauugguccgugcugguugagauuauggccggggaaaauuaccugucuuucgcuaaggugaacgccuauaaaaagcauaaggagaaccucagcauccugaaaucccuuaugaagaaauacugcaccccugacgucuaccagcgguuuuucuaugagacagaugaaaagagcucuuacggaaauuauauuggcgcgauccacaacaaugggcacucccauaccaugaaaaagugugacgaggaaacauuuuacaagagccugucuaaaauccucgauaagcugguggugcagaaaaccgaccaagacacgcuugagauucugaagaaagaagccaagaaccagacacuccugccgcuggcuagaaccaaggccaauggagucauccccaaccagauucacauccaagagcuccgcgcuauucuggauaaugccaaaacauaucuuagcuuccugaacgaggccgacgaauacggcaccaucgcugagaagaucauucggaucgcgaaauuuaagauuccuuauuacgccggcccccucuccaccagacauaaagaacagggggcuaauacauggaucguucgcaagcaggagggacggauuuacccuuggaacuucgaggaaaugguggaucuggagagaucuaauaacgaauuuauccgccggaugacgaauaaaugcaccuaucugauuggcgaggacgugcuucccaagaacagccuccuguacuccaaguucaugguccugaaugaacucaacaaccugaaaaucagagggcacaagaucagcguggagcuuaaacaggagcuguauaaggaacucuuuuguaaaaaggccaagguuacaggaaaagcccugcugguguaccuuaagaaaaaggaugcugagcucacccuggaagacauuucuggcuucgaugccgacuuuaaauccagccugucuaucuauauugauuucaagaaucacauccuccgcgagcaaauugacgaugggaaguaccaguccaucgucgaaaacaucauuaaauggaagacaaucuucgacguggauagcaaaaugauugagaagcugaucgcgcgggaguauccgaauauguuuuccucugaacagauuaaaaagaucugcagacuuaagugucgcggauggggcaacuucagcucccgguuucugaauggcauccagggggagaacaccgaaacgaaagagugcuucacaauuaucgaagcucucuggaagaccaauuacaaccugaugcaacugcuuucuaaacaguuuaccuucaaggacgccauugacugcaucaaugccgauaaaguuggaaagauugacaaagugacauacgagaacaccgucaaggaucucguggucagcccugcuaauaagagagccaucuggcagacagugcagaucacggaggaaauuaaaaagguuaugaaaugugagcccgaaaagaucuuuguggagauggcucggggcggggagaaagaaaagaagcgcaccauuuccagaaaagagcggcugcugaagcucuauauggacuacaaagaugaaaacagagacuggaucaaggagauugaaagccgcgaugagcaagacuucacaaaucggaaacuguaucuuuacuauacccagaucggaagaugcauguacucuggcgaggaaauuucccuggaggaacucaugcagaagaacagcaagugggauaaagaccauaucuauccucagucuaagaucaaagaugacucccuggauaaucugguccuugcccgcaaggacauuaacaacaauaaaagcaacaagcuccugcccacagggauccaagacaagaugaaaaaguacuggaaaaugcugcucaaguacggcuuuauuucuaaaaagaaguaugauagacugaugcggaccgaggacuucagcgaugaggagcuuuccggauuuaucgcgcgccagauuguggagacgagacagagcucuaaagccguugcugaacugcucgagcaccugaaugaacauaccgagaucguguacgucaaggccgaacugguguccgacuuccggcacgauaacaauaugcuuaaaagccgcagaaucaacgacuaucaucacgcuaaggaugccuuucugaauauugugguuggcaacgucuacaaugcgaaauucacagccaacccccggaauuggaucaagaaaaaccgcaauaccaacuauuccauuagacggguguucgacuacacagugaagcgcgggucuaccaucgucuggcaaggagugaaggauggcgggcacagcauugacggaaucaaaaagacgauggcuagaaaugauauccucuauacagagcggaccuacugugagcagggcgaacuguuuaacgccacacucauuaaaaaggggaacccuaaugcuaucggccugaaaaagggacuugacccgaugaaguacggcggguauuccucucccaaaaccagcgccuucgccuuuauugaguucgacggaaagaaaggcagacagaaccaucugguugaaaucccuguguacauugcuaauaucgcggcccgccagcccgaguauauuaagaaccaccucgaggagaaaaagggguaccaaaaugucaucgugaagaaauauccuauccagaagaacgcucugauuaaacuggauggauaccccgcccggcuuagaggcgccaaugaaaaguccaucacccugaaaaacgcuguucagcucgugcugaagccggaauaucaugagacaauucgcaaugucgaaaaguaccucgaguacaucgacaaagaugagucugugagcaaggccgcgcgguuuucccacacggaacuggacaaacuuuaugaugagcugugcuucaaggcugaaaacagcauuuacaaaaagagaccugccaaucagucugccacccucaaaaacgggcaaaagacauuucuggcuaucaccaaucugaaggagaaagcccagguuaucaacaauauuaucacaauguuccgcugugacgcgaccacgacaaccaaccuuaagaccauuggcggauccgcuaaugccggcgggaugcaagugaacaaaaacacacugaccagccagaaggucgugcucgugcaccagucuaucacaggacuguuuggcacggaagaggagcuccuguga

SEQ ID NO: 4183 - RNA, 4053 nt, Artificial Sequence
  Cas9 variant
augaagaaacccuacagcaucggccuggacauugggaccaacuccgugggaugggccgucguuacagaugacuauaaggugccugcuaaaaagaugacggugcucggcaauaccgauaaaucucacaucaagaagaaccugcuuggggcccuucucuucgacagcggaaauacagcggcugauagacggcugaaacgcaccgccagacggcgcuacacaagacggcgcaaccggauucuuuaucugcaggagaucuuugccgaagagauguccaaggucgacgauucuuucuuucauagacucgaagacagcuuccuggugaccgaggauaaacgcggcgaaagacacccgauuuuugggaaucuggaggaggaaguuaaguaccaugagaacuuccccacaaucuaucaccuccggcaauaccuggcugacaauccugaaaaaguggaucuucgccuggucuaucucgcccuggcucauaucauuaaguuuagaggacacuuccuuaucgagggcaaguuugacacccggaacaaugaugugcagcgccuguuccaggaguuucucgccguuuacgacaacacguucgaaaauuccucucugcaggagcaaaacgugcaggucgaagagauucugaccgacaaaaucagcaaguccgcgaaaaaggauagagugcucaaacuguuucccaaugaaaagagcaacggccgguucgccgaguuccuuaaacugauuguggggaaucaggcugacuuuaagaagcacuucgagcucgaagagaaaacaccucugcaguuuucuaaggauaccuacgaagaggaacuugagguccugcucgcccaaaucggagacaacuaugcugagcuguuccuguccgccaaaaagcucuacgauagcauucugcuuucuggcauccugacaguuaccgacguguccacgaaagcgccccucagcgccucuaugauccagagauauaacgaacaucagauggaucuggcucagcuuaagcaauuuauucgccagaagcuguccgacaaauacaaugagguguucagcgaugucuccaaggacggguaugccggauacaucgauggcaaaacaaaccaggaggcuuuuuauaaguaccucaaagggcugcugaauaagauugaaggaucuggcuacuuccucgacaagaucgaacgggaggacuuucugagaaaacaacgcaccuucgauaacggcagcauuccucaccagauccaucuucaggagaugcgggccaucauuagacgccaggccgaauuuuauccguuccuggcugacaaucaagaucggaucgagaagauucucacauuuagaauccccuacuauguggggccucuggcgcgcggaaaauccgacuucgccuggcugagccggaagucugcugauaaaauuacccccuggaacuucgacgaaaucguugauaaggaguccagcgccgaggccuuuaucaauagaaugaccaacuacgaccuuuaucucccuaaucagaaggugcugcccaaacacucucugcucuacgaaaaguucacagucuauaacgagcugacgaaagugaaguacaaaaccgaacagggcaagacagccuuuuucgaugcuaauaugaaacaggagauuuuugacgggguuuucaagguguaccgcaaggucaccaaagauaagcugauggacuuucuggaaaaagaguucgaugaguuucggaucguggaccucacaggacuggacaaggaaaacaaagcguucaaugcuagcuauggcaccuaccacgaucugagaaagauucuugacaaggauuuucucgacaacuccaaaaaugagaagauccuggaagauauuguccugacgcucacacuguucgaggaccgggaaaugauccgcaaaagacuugagaacuauucugaucugcucaccaaggagcaagugaaaaagcuggaacggagacauuacaccggguggggacgccugagcgccgagcuuauucacggcauccggaacaaggaauccagaaaaacaauccucgacuaucugauugaugacggcaauagcaaccgcaauuuuaugcagcugaucaacgaugacgcccucucuuucaaggaggaaauugcuaaagcccagguuaucggggagaccgauaaucugaaccagguggucuccgacauugcuggaagcccggccaucaagaaaggcauccuucaaucucugaagauuguggacgagcucguuaagaucauggggcaucagccugaaaauauuguggucgagauggcgagagaaaaccaguucacaaaucagggacggcgcaacucccaacagagacugaaaggccugacggauagcaucaaggaguuugggucccagauucuuaaagagcaccccguggaaaauucucaacuccagaacgaccggcuguuccuguacuaucuccagaauggccgcgauauguacaccggagaggaacuggacaucgauuaccuuagccaguaugacaucgaucauauuaucccucaagccuuuauuaaggacaacuccaucgauaauagagugcugacaucuagcaaagagaaccggggcaaguccgacgauguucccagcgaagacgucgugaaccgcaugagacccuucuggaauaaacuccugucuuccgggcugauuagccagcggaaguacaacaaucuuaccaagaaagagcugacaccugacgauaaggcuggauuuaucaaacgccagcucguggagaccagacagaucacgaagcacgucgcccggaugcuggacgaaagauucaacaaagaguuugaugacaauaacaagcgcauucggagagugaagaucguuacccucaaaucuaaucugguguccagcuuccgcaaggaauuugagcuuuauaaaguccgggaaauuaacgauuaccaccaugcucacgacgccuaucugaaugcggugguugugaaggcccuccuggucaaauacccgaagcuggagcccgaguucguguauggcgaauacccuaaguacaacucuuauagagagcgcaaaacagcuacccaaaagauguuuuucuacagcaauaucaugaacauguucaaauccaagguuaaacuugccgaugaccagauuguggaacggcccaugaucgaggucaaugaugaaacaggggagauugcuugggacaagaccaagcauaucacgacagugaaaaaggugcugagcuauccucaggucaacaucguuaaaaagguggaggaacagaccauuggacaaaauggcgggcucuuugaugacaaccccaaaucuccgcuggaggugaucccuuccaagcucgucccccugaagaaagcccuuaacccugaaaaguacggcggauaucagaaacccacaaccgccuacccuauucugcucaucguggauaccaagcagcugauucccaucagcguuauggacaaaaagagauucgagcaaaauccggugaaauuucugaaggacaagggcuaucagcagaucgagaaaaacaauuucgucaaacuuccuaaauacacacugguggauauugggaacggaaucaagcgccucugggcuuccucuaaagaaguucacaagggcaaucagcugguggucagcaagaaaucccaagaccuccuguaccacgcgcaucaccuugauaacgacuauucuaaugaguacgugaagaaccauuaucagcaguuugauauucuguucaaugaaaucacgagcuuuuccaaaaagugcaaacuggggaaggagcacauucagaagaucgaagaggccuacucuaaagagcgggacagcgcuuccaucgaggaacucgccgauggauucauuaagcugcuuggcuuuacccaacugggggccacaagccccuucucuuuucucggcaucaaacugaaccagaagcaguauaccggaaagaaggacuaccuccugcccuguauggaagcuacacuuauucaucaguccaucaccggccuguaugagacgagaauugaucugagcaagcucgggggagacuga

SEQ ID NO: 4184 - RNA, 4053 nt, Artificial Sequence
  Cas9 variant
augggcaagaacuacuaucuggggcucgacaugggaaccagcuccgugggcugggccgucacagaugagaaauacagaauccugcgggcuaaggggaaagaccuuuggggaguucgccuguucucugaagccaagacggcggcugagagacggacccaccgcacaagcagacggcgccucgauagagaaaaagcccggauugccugccugaaggagauguuugcugaagagaucaauaagauugaccccggcuucuaucagcgccuuaacgauuccaaauacuuucuggaggacaagaaagaacaucaaccuuaugccaucuucgcugauaccggguacacagacaaggaguauuacgaugaauacccgaccauuuuucaccucagaaaagcccugcugaauaucgagaacgacaagaagaaauaugaugugcggcucguguaccuggcgauccuuaauauguucaagcaucgcggacacuuucugaacgccaaucucgacgauaaaucuggcggcaaccugaaggaguauauugaaaugcuucaucagagcauggucaauauccugaacauuaaucucaaaaacguggagaucgaaaagauugagaaaauccugaaguccacacaguacucuaauagcgaaagacuggagaaccuccuggagcuuuaugaacuguccaagaauaaaaacaagauugagaccgaaaucuucaaauuuaucugugggcucaagggaacgauuagcaaaaucuacguugaggacaaguucgaagacgaguuugcuaagaugacccugucuuuccgggauuccaacuuugacgagaaaauuaucgaaauugaggauaaucuugacgaugacaaguaugauauguuccugcucaucaaacagauccacgacuggagcgugcuggccaacauuaugaauggcgaagaguaccugucugucgcucgcgugaagcucuacgauaaacacaagaaggaccuggaaguucuuaaaaaguauuacaaacaaaacuccauggaggaguauaauaagauguucagacagaugaacgaugggaauuacagcgccuaugugggaucugucaucuacaaagacaacuccgugcggagaggcugcaagagcaagaaagaagacuuuuauaagaauauucugaacacaaucaaauccugggaggauugugaagcgaaggaguacauuaccucugagaucgacaaagggaauuuccuccccaagcagaucacagccagcaacggagugauuccuaaucagguccauaaaaaggaacugaagaaaauccuuaagaacgcuuccgaguaccugaauuuucucaacgaaaaagaugagagcggcuauaccauuucugaaaagaucguuaaacuguucgaguuucaaauucccuacuaugugggcccuaucgccuacaacauugggaaugacgaguccaagcaccgccauaacauguggagcgugcggaaggaaaaaggacccaucuauccuuggaauuucgagcagaagaucgauauuaaaaagucuagcgaaaaauuuaucagaaaccugauuaaucacugcacguaccucaacgacgaggaaguccugccgaaaaauucccuucuguaugagaaguucauggugcucaacgagcugaauaaacugaagaucaacggcgaaaagauuucuguugagcuuaagcagaauaucuuuaacgaucucuucaaaaaggggaagaaagugacaaagaaaggacugaucaaguaccugaaagaacagggcgagauugacaauugugaagaggucgagaucagcgggauugauggagacuuuaccaacaagcucuccaauuacaaaaaguucgcugauaucuuuggcgugcaaagccugacauaugaacagaccgacauugccgagaacaucauccgcuacucuaccauuuauggcgauucccggaaguuccuugaagagagaauccgcgaggaauacagcaacguucuggacgagaaacagauuaagcggauccucgggaugaaauucaaggacuggggaagacugucuaaagaacugcuugagcucuccggcguggauaaggaaacaggggagauugccagcgucaucucccgcauguggaaugacaacuauaaucugauggagcugaucgcuacggaacgguuuucuuacgcguaugagauugaacaaagaagcaagaaacucgagaagaccaucuccacaauugaauacgaggaucuggacgagcuuuacaugucuacccccgugaaacgcauggucuggcagacaauccuggugcucaaggaacuggaggaaguucugggaugcccucccaaacggauuuucguggagauggccagagaugucaacgcuccuaaggaccggaaggauagccgcaaaaagaaacuucucgaacuguauaagaauuguaaaaaggaggagggcgacugguccaaggaacugaacgccagagaggaaagcgaguuuaaaucuaagaaacucuaccuguauuacaugcagaaggggcggugcauguauuccggcaaacccaucgaucuuaagaaucugcucaacgacaaucuguacgauauugaccacaucuauccgagacauuucgugaaggaugacagcaucgagaacaaucugguucuuguggaaaagaacuuuaaugcccacaagucugacaacuacccuauugagaaugaaauccgccagaaaaugcauuccauguggaagaugcuccgggauggaaacuucauuaccgaggaaaaauacagcagacugauccgcaaggaggaguuuacggacgaugaaaaagcuaaguucauuucuagacaaaucgucgagacacggcagggcaccaaggugaucaccgaccuguuugaacagacauuccccgagagcgauauuguguauguuaaagccgggaacgucuccgaauuucgccacaaguucaaacucaucaaguguagaaaugugaacgacuuucaucacgcgaaugaugcuuaccugaacauuguggucggaaauguguauuacaccaaauucacaaagagcgcccuuaacuucaucaaggacuauaaaaagaauccugagaaaaacaaguaccacauggaucauauguuucaguaucccguuucucggggcgggguggacgccuggauuacgaaaggagcugaguccaucagcaugguccgcaagaugauggccaagaauacccccauggugacaagaaugaacuacgaaaaacacuccggccaaaaagggggcaucucugaucagaauauuugcagcgcuaaaaucgccaagaaaaacguuuaccugccuauuaagaugggagacgagaagcucaaaaauguggaaaaguauggcggguacggaucccugaccgcgaaauauuucuuucuggucgagcauacaaucaagaaaaagcggauucgcaccaucgaagccuacccgauguaucuugacgcucugaacaaagagaauaagcuccugaacuacugugugcagguucucgaguaugaugaacccaagauuaucauggagaaaaucaaggugaaaucucuguucaagauuaauggcuacuacuauuaccuuaacgccaaaagcgucaacagaaucauuugggggaaugcuacgcagcuguuucucgaaaacgacaucaaugaguaugugcggaagauuuccaagaacaucgagugcaucgauauuaauucugaaaacaauaucaaaguguacgacauuuucaucgagaaguauagcaacaaacuguuuuccaaucgccugggaaaccuuaaggaagccauuauccaaaauagaaacaaauucaucgagcugaagauuaaugaacagaucaacgucauucucgagcugguucgguacagccaggauggcguguauucuaucaaucucucccagcuggggcuuagcucuaccuacgcgauuaacagaacauccaaggagaucagcaaaaugaaggaaugcaaacugauuaaccaaucugugaccggccucuacgagaaugaaaucgaccugcugacagucuga

SEQ ID NO: 4185 - RNA, 4053 nt, Artificial Sequence
  Cas9 variant
augcagcaauacuaucugggcguggacauggggagcgccuccgucggaugggcuguuaccgaugagaaguaccagcucgugcggaaaaagggcaaagaccuguggggagugagaacauucgauaucgcccagacggcggaaguccgcagagugucucggaccaaccgcagacggcagaaucgcagaaagcaacggauucagauccuucaggagcugcucggggaagagguucugaaaauugacgcuggcuuuuuccaccgcaugaaggaaagcagauauguggccgaggauaagcggacacuugacgggaaacaggucgagcugcccuacgcccucuuuguggaucaaggauucaccgacaaggauuuuuauaaacaguucccuacaaucaaccaucugauuguuuaccugaugaccacauccgacaccccggauauccgccucguguaucuggcccuucacuacuacaugaagaauagaggcaacuuucugcauucuggcgacaucaaugaugucaaagacauucagagcauccucgaacagcuggagaacgugcuuaaggaauauguggacgauugggagcugucccucaaggacaaagucgaugcuauuaaggagaucuacaauaaagaccuggggcggggagaacgcaagaaggcuuucauuaacacgcugggcguuaagaccaaaucugccaaggcguuuugcagccucaucuccgggggaagcacaaaucuggccgagcuuuucgaugacucuggccugaaggaauccgaguaugcuaaaauugaauuugccaacgcuaauuucgaggauagcguggaggggauccaagcccuccuggaagacagauuugcggugaucgaggccgcuaagcggcuuuacgauuggaaaauucugaccgacauccucggagauaacgccucucuggcugaagccagagucaaguccuaugagacacaccaugaacagcugguggagcucaagagcuucauuaagaaguaccuggaccgcaaaaucuaucaggacauuuucaucaaucccaacaucgccaauaacuacccugcuuacguuggccacaccaagauuaacggcaaaaagcaagagcuugaagugaaacgggcgaagagaaaugauuuuuaugccuacaucaagaaacaggucauugaccccaucaagaaaaaggugucugauaaagcuguucuggcccgccucgccgagauugaaucccugaucgaggugaacaaguaucuuccucugcaggucaauagcgacaacggggugauccccuaccagauuaagcucaaugaacugcggagaaucuucaacaaucuggagaaccgccucccuguccugaaagagaaucgggauaagauuaucaaaacguuuuccuaucgcauuccguacuaugugggaccccuuaacggcguuaauagaaacgggaagucuacaaauuggauggugcggaaagaaggagaggaaggcaagaucuacccuuggaacuucgaggagaaagucgaccuggaagcuagcgccgagaaguuuauuagacgcaugaccaauaaguguacauaccucgugaacgaagauguucugcccaaauauucccugcuuuacagcaaguaucucgugcugucugagcugaacaaucuccggcuggacgggagaccucuugaagucuccgugaaacaagagaucuacgagaacguguucaagcggaaucgcaaaguuacccugaagaagaucaaaaacuaucuccugaaggaaggagucauuagcgagaaagaugaacugucuggccuugcggacgaugugaaaagcucccucaccgcuuaccacgacuuuaaagagaagcugggccaucugacacucacggaagaucagauggagaagaucauucugaaugugacccuuuucggggacgacaaaaagcugcucaaaaagagacuggccgcccuguaucccaacaucgaugagaaaucucuuagccggauggcuacauuuaauuacagagacuggggacgccucuccaagaaguuccugagcgaaauuaccucugucgaucaggagacaggcgaacugcggaccaucauccagugcauguacgagacgcaaaacaaucucaugcagcugcuuuccgaaccguaucacuuuguggaggccauugagaaagaaaacccuaagguugaccuggagagcaucucuuacagaauugugaaugaucucuaugucucccccgcugugaaacgccagaucuggcagacacugcugguuauuaaggacaucaaacaagugaugaagcaugauccuaaaagaaucuucauugaaauggcccgggagaagcaggagagcaagaccaccaaaucccgcaagcagguccuuucugaaguguacaaaaacgcggagaaguauaaaaaucucuuugaaaagcugaacagccugacagaggaacagcucagauccaagaaaguuuaccuguauuucacccaacuugggaaguguauguacacaaaugacgccaucgauuucgagaaccuggugucugcuaacagcaauuacgacauugaucacaucuauccccaguccaaaacgauugacgauagcuuuaacaaucucguccuggugaagaaaggaaucaacaaugacaagucugaccgguaccccaucgauaagaacauucgcgacgaugagaaagugaagacccuguggaauacacuucuguccaaaggccucaucaccaaggaaaaauucgagagacugauucggagcacaccuuuuucugacgaggaacucgccggguucaucgcucgccagcuggucgaaaccagacaauccacgaaggccguugcggagauucuuagcaacugguuuccggagucugaaaucguguauagcaaggccaaacacauuaccaauuuccggcaggauuuugagauccugaaggugcgcgaacucaacgacugccaucacgcucaugaugccuaccugaauaucgucgugggcaacgcuuaucacacaaaauucaccaauucccccuacagauuuauucagaacaaggccaaucaggaguauaaccugcggaaacuucugcaaaaggccaagaaaaucgaaagcaacggaguuauugcuuggaucggccagucugagaauaacccugggacaauugcgaccgugaagaaagucaucuccagaaauacggugcucaucagccgcaugguuaaggagguggacggacagcuguucgaucagcaacucaugaaaaagggcaaagggcagguccccauuaaguccucugacgaucggcugaucgacauuagcaaguacggaggcuacaacaaagccaagggggcuuauuuuguguucaucaaauccguuagacgcggcaagacaauuaaaucuuuugaauacaucccugugcaucuugccaagaaguucgacuguaaucuggagcuccugaaagaauaucuggagagcgagaaggaucuuaacaaugucgaaauccugaugcccaaagugaugauuaacucccucuucaauuacaacggaucucugauccggauuccgggcagauaugacaagaaaagccuccugaucaauguggaugucccucuucugcuggagucccagcacauuaagcagcucaagguuaucgaaaaauacauguauaagaaacgcgugagcaagaacucuaauauucugcuuaccaaauuugccuccgaccaacugaaggaucucgacgcucuguucgaugugcucagcuacaagcugaacgagaauaucuacaacgucaucaaugacaaauaugauaaacuugugauuugccgggacaaauuuaucucucuggauacagaaguuaagugugagaugauuuucgagcugcuccaccuguuucagugcaacucccagcuugccaacaucaccaaaauuggggcgaccagcaaguucggaucuaucuccaugagcaaaaaucugaaggaaaacgacaagauguccaucauucaucaaagccccucuggcaucuuugagcacgaaauugagcucacagcucuguga

SEQ ID NO: 4186 - RNA, 4053 nt, Artificial Sequence
  Cas9 variant
augaagagaauccugggccucgaccuggggaccgccagcauuggaugggcucuugugaacgaguccgaaaaugagaaagaaaagucugagaucauuaaacugggcguccggguuaacccccucacaacggaugaacagaccgacuucgagaaggggcgcccucugagcgugaaugccgauagaacacuuaaacggggagcgcgcagaaaccugcaacgguuuaagcagcgcagaaagaaucucaucgagauucugaucaaaaagggcuucaucaccaacauuucccugcucacagaaaucgggucuaauaccacauaccagacccuggagcuucgggcuaaaagcgugaaggaaaagauugagaaggaggaauuugcccgcguccugcucacgaucaacaagaaaagaggauauaaguccucucggaaagccaagaaugacgaggaaggcagccugauugauggcauguccguggcuaaagagcuuuacgacaacaaucugaccguugggcaguauguguaccaacuccuggaaaagggaggcaaauauaucccggauuucuaccgcagcgaccugcagaacgaguuugaugucauuuggaauuuccagaaggaguuuuaucccaacauccucacaggggaacuguacaagaaacuucagggacaaggccagcaaaauucuagaaagcuguuccucgccauccaccagauuuacaccgcugagaacaaagggaagcgggacacagugaaaaagcagcauuauaaguggcgcaacgaugccaucaauacccagcugcuuauugaagagguugcguacgugcuggucgaaaucaacaauaaccucaauaaauccagcggauaucugggcgccauuucugacagauccaaggagcuguacuuuaacaaagagacggugggcgaaaaucucuauaagcagauccaagagaacccucagacaagccugaaaaaucagguguucuaccggcaggauuaucuugacgaauuugagcaaaucugggaaacccaggcuaaguucuacucugagcugacaaaggagcucaaagaagaggucagagacguugugaucuuuuaccagcgcaagcugaaaucccagaagcaccuuauuagcgaaugcgaguucgagaaacaucacaaggccauucccaaguccucuccucuguuccaagaauuuaaaaucuggcagauucucaacaauaucgaguucaagcauaaaaagaccaaagaacugaagauccugagcgaggaacucaaagagacccuguuugaggaacuuaacauucgggggaauuucacauccgaugcugugcugaaguuugucaagcucgacaaaaaggagugggaacugaacuauaaaaagggaaucgagggcaauagaacgaacgaagugcuguacaacguuuaucagaaaauugccgaguacgagggguauggauucgauuggagcaagaagucugcgguggaaaucaaagaggaacuuaauaccaucuuuuccgagauuggcauuaacagcaagauccucgacuucaaucccgaaaucucugggaacgauuuugacaaacaggagagcuaccaacuguggcaucugcucuauuccgccgaggaagauggauuccugaagcagaaacuucaggacaaguacggcuuuaagucugaguacgcuaauaugcuggccaacgucagcuuccaguccgauuauggcagccucucugcucgcgccauuaaaaagauccugccuaaucugauugccgggcacgaauuuuccgaggcuuguagccuuucuggauacaaccacuccaauagccucacaaaagaggaacuggcgaaccggccgcugaagggcaaacucgagcugcuuaagaaaaauucccugagaaaccccgugguugaaaagauccucaaucaaauggugaaccuggucaaucaggugauugagucuuauggggaaaucgacgagguccgcaucgagcuggcccgggaacuuaagaaaagcgcucaggagagagcccucaugaccacaaacauuaacgccuccaagaccaaauacgaaucuuuccgcaagcugcugcaaaaagauuucggaaucaagaauccuacgcggaacgacauuaucaaguauagacucuacgaggaacugaaagcuaauaaguaucacacaauuuacaccaacaaauacaucccccgcgacaaacuuuuuagcaaagagaucgauauugagcauaucauuccuaaggccaagcuguucgacgauuccuuuagcaauaaaacccucgcguuccggaagcccaaccaggacaaaggcaauaugacagcuaucgauuauauucugucuuaccaguccaaggacaucgauaacuauaaaagcagaaucgaaaaucuguuuaagaacgggaagggcgacauuucuaaagccaagcggaauaaacuucucauggaggaaaaggauaucccggacggauucauugaucgcgaccugagaaacucccaguacaucgccaaaaaggcuaagcaacugcucgaggaagugauucggaccguuaauacaacgaccggcagcgugacaaacaaacugagagaugacugggggcuuaucaaugucaugcaggagcugaacaugccuaaguuuaaagccauugacgagucucucaucgaacagaucgagaagaaagauggaaccuucaagacacgcauuaaggacuggagcaaacggaacgaucacagacaccaugcuauggacgcccugaccguggcguuuacgcgcuauaaucacauccaguaccugaacaaucuuaacgccaaguccgauaaaaagggcgcuauuuaugggauccaagaacuggagaccuacguuaauagcaaaggaaagagaaaauucauuaagcccaugcauaacuuucgggaggaagccaagaaacacaucgaggacauccucauuucuuucaaggcuaaaaauaagguggucacaaagaacaucaauaagauuaaguccaaagauggcuuuaucaagaaagugcagcugaccccucgcgggcagcuccauaaggaaacaguguacggcaaaauuaacgagguugucgugaaggaagagaagaucaaugccaaauucgaccuggagaagaucaacaaagugaccaagcccauuuauagaaaugcgcuucugaaacggcuccaggaguucaacggagaacccaagaaggccuuuacgggcaaaaauagccuguccaagaacccuaucuaccuggaugucgcucaaacaaaaacccuuccggaaucugugaagguucaguucuuugaggaaaauuauacaauucgcaaagagaucagccccgaccugaagauugauaaaaucauugacaaggggauccagagaauccuccugaagcggcucgaugaguucaacggaaaaccuaaggaagccuuuuccaaccuggagaaaaaucccauuuggcuuaacaaggaaaaaggcaucgcuauuaagcgcgugaagaucaaaggggucaagaauguggagucucugcacaacaaaagagaccaccucggaaaugaaauucugcaaaagggcaaaagcgccccuaacgacuacguuuccaccgggaauaaccaucacguggccaucuaucaggauaagaauggcaagcugcaggagaaagucgugucuuucuacgaggcuguugcgcgggugaacaauaaacuucccaucauugaccaggauuuuaacaaagaccugggauggaaguuccucuuuaccaugaaacaaaaugaaauguucgucuuuccgagcgaggauuucaagccucuggaaacagaccucauggauaagaaaaacaauuccaagaucagcaaaaaccuguuccgcgugcagaaacuuggcaacaaggacuauacguuuagacaucaccuggagaccaagauugaggauaucaaaaagcugcgggacuucacauacauuagaaagcgcaaucccgaaucuaucaaaaacaucauuaaggugcggaucaaucaccucgggaacauuguccauguuggagaguacuga

SEQ ID NO: 4187 - RNA, 4056 nt, Artificial Sequence
  Cas9 variant
augagcaagaaauacuaucugggccucgacaucgggaccaacuccgugggaugggccgucacagaugagaauuacaaccugugcaaguaugcuggcaaaagaaugugggggauucggcuuuucgaaggaggcgagacggccgaacagcgcagaaucucucggagcaaucgcagacggcugucccgcaagaaacaaagaauugaccuccugcaggagcuuuuugcggaagagaucgcuaagauggaucccaccuucuuuauucggcugaacgagucucgccuccaccuggaagacaagagcacaggggagaaauucccucuguuuagagauaaggacuacaccgauauccaguauuacaaagaauauccgacaauguaccaucuccggaaggagcugaucgaaaauuccaaaguucacgacauucgccuuguguaccuggccugucaucacauccucaagaacagaggacauuuccugauuaauggcucuuuuagcgaugugaagaaacuuuccagcgucugcgaaucuaugcugaacuccuucaauggcaucagcaaguaucagauugagaucaacgacauugaacggcucgaggaaauccugucugaucgcaaaaagcaaaaauccgugaaggccaaagagcugauccagauuuuugagugugggcccugcgaagacaagaccgaugagaagacauguaaagcuaucguuagcaaucucugcaaguggcugaccggacuuaaaggcaacauuaauucuaucuucgacaugcaguuugaagagauugacacguccagcuucuccuuuaccgaaccuaaguacgaggauacaaucucugccgcucuggaggaaaaauaucccgacuacgccgaugugauccagaagauuaaggcggucuaugacuggagcgugcucguugagaucauggccggggaagauuaccuguccuucgcuaaagugaacgccuauaauaagcacaaagagaaccuuuguauucugaaggaagucaucagaaaauacugcgacagcgagauuuaccacaaguucuuuaacggauucgaugagaagaauggcuaugggaacuacaucggaucuaucuauaaaaauggccauuccuacgcuaugaagaaauguagcaccgaagacuuuuauaagacacucggcaaaauucuggauaagauccaaccugagaaggaagacgagaacgugcuggaggaacucaaaguggaggucaagaaucagacccugcuuccccuggcccggacgacagcgaacgggaccauuccuaaucagguucacauccaggaacucagagccauucuggauaacgcuaaaaaguaccuuccguuccugaaugaggaagacgaguauggaacaguggccgagaaaaucauuucuaucgcuaaguuucgcauccccuacuacgugggcccucucagcacccggcauaaagaacaaggggccaacuccuggauugucagaaagcaggagggacgcaucuaucccuggaauuucgaagagaugguggaccuggaacagucuaacaaggaguuuauucaacggaugaccaauaaaugcacauaccugaucggcgaggauguucucccuaagaacagccugcuuuauuccagauacauggugcugaaugaacucaacaaccugcgcauucgggggaauaaaaucagcgucaagcugaaacaggagcuuuauaaggaacucuucuguacgaaggccaaagugaccggaaagggccuguuuaacuaccugaaaaaggaggacgaggagcucgcucuggaggauaucucuggcuucgacauugauuuuaaauccagccuuacaucuuaucuggacuucaagaagcagauccucggggaagagauugaaaaagauaaguacaaaggaaucguugagaauauuaucaaguggaaaaccaucuacgacgaugacuccaagaugaugaagaaaaugauugagagagaauaucccaacguguuuagcaaggauaaaaucaagaaaauuugccgcuucaaguacuccggcugggggaauuucucucugagcuuucugaacggaauccggggcgcggacagagagacaggggaauccuucaccauuaucgaggcccuuuggaaaacgaauuauaaccucaugcagcugcugucuaagcaauuuacauuccgcgaagagaucgaucucauuaaugcugagaaggucggcaaaaucaacaaggugagcuacgacaauaccgucaaagaccugauuguguccccggccaacaagcgggccaucuggcagaccguucagauuacagaagagaucaaaaaggugaugaagugcgaaccugagagaauuuuuaucgaaauggcucggggaggcgagaaagagaagaaacgcaccgucagcagaaaggcccggcuucuggaacucuaugcggcuuguaaagaugacgugagagauuggacaaaggagaucgaagaccgcgaggaacgggaguucaauucuaagaaacuguaccuguauuacacgcagauggggagaugcauguacuccggagaggaaauuaacaucgaugagcuuaugcaaaagaauagcaaaugggacauugaucacaucuauccccagucuaagauuaaagacgauucccucgacaacaugguucuggccaagaaggugaucaacaauagcaaacagaacaagcugcucucuagcgauauccgcauuaaaaugaagaaauacuggaaugcccuguauaagggcaacuuuaucuccaagaaaaaguacgacagacuuacccggacagaagauuucaccaaugaggagcugagcggguuuauugaacgccagaucgucgagacaagacaaucuuccaaagcuguggccgaacuccugaaccggcuguaugagcacagcgaaauuguguacguuaaggcuggacuugucuccgacuuccgccaugacaauaaacuccugaagucuagacggaucaacgauuaucaccaugccaaagacgcguuucugaauaucguggugggcaacgucuacaaugccaaguucaccagcaacccucgcaaguggauuaaagagaauagagggacgaacuacuccauccggcgcguguuugauuauaauguuaagagaggcaacaccguggucuggcagggaguggaggacggcgggcacucuauugaugaaauccggaaaacaauggcuagaaacgacauucucuacaccgaguauacauacugugauaagggagaacuguucaaugccacccuuaucaaaaagggcaacgacaaggcuauuaaucugaaaaaggcccucgauagcguuaaauaugggggauacaacucccccaagacgucugcguucgccuuuaucgaguucgacggcaaaaagaaggaacgcaaaaaucauaucguggagauucccgucuauaucgugaacauugcuaagcggcagccugauacaaucaaagaguaccuggaacagaagaaaggguacaagaauguuguggucaagaaauauccgauuaagaaaaacgcccugaucaagaucgacggcuaccuugcuagacugcgcggagccaaugagaccgacauucuccugaaaaacgccgugcaacucauccugaaugauaaguauuacgaaauuauccggagaguggagaaauaucuugaauacaacguccgcuaugaggcugagagcauguuugaaggcuucgaccacgcggaucucaauucccuguacgacgagcugacaagcaagcuggaaaccucuauuuacaagaaacggcccgccaaccagcuuaaugcucuggagaaggggaaagagaaguuuaaaaacauccagacccucagagaaaaggcccaaaucauuaaggagaugcugaucauguaucgcugcgaugccgcuacaguugccaaucucaaagcgauuggaggcuccgcuaacgccgggagcaugaagaucaaaaagaacacgcugaccucucggucccuugugcuggugaaucagagcauuacaggacucuucgaaaccgaggaggaacuggucuga

SEQ ID NO: 4188 - RNA, 4056 nt, Artificial Sequence
  Cas9 variant
auguacaagaaauauggcaucgggcuggacauuggaaccagcuccaucggcuggucuguggucgaugaguacgggcacauuaucagaguuaagggacagacaggccucggggugcggcuguuccgcgaaggacaacccgccgcugacagacggacguuucgcaccacaagacggcgccuuggcagacggcgcuggagacugcggcuccugcgcgagauuuucgauccuuauaucgccgcgcaggacccgaacuuuuucgcuagacagaaagccagcgccaucgcucccggcgauucccgguuuaaggccguguaccgccuuuucaaugaccagaccgauagacaauuuuaugacaaauacccuacagucuaucaucugcggcagaagcucaugaccgaaaagagacaguucgauauucgcgagaucuaccuggcugugcaccauauuguuaaauaccgggggcacuuucugacaggaggcgccgcgaagaacuucaaacccgggaagcucgaccugaauaccuauuuugccacgaucaacgcucagcuugccgcuauuuucauggauucucaaguggaacugccucagcucgacugggaugccgucgugagccugcuuaccaaugaccaggagucccccucugacagacagaaagcgcugacaaagaugcucguugcccaaggagaugcuacccagaagcgcuuuuacacagaguucagcaaagcccugcugggccucaaggcuaaacuguaugugcuuaccggguucgaaggagacaagacggaucagaaagcccugacacucucccuggagacccuugacgaucaucaagacgaugucacacagcugcucggcgacgaacagcggcagcugguggagcugcucgccagagugcaaagcgcuauccagcuggcgauuaucaucccuaacggcaagaccuuuucugggcagaugguccagcaauaccagacccacuaugaucagcuucgccugcucaaagacuaccgggagcagcugacagaucaaaagcacagacgcgcccuuaagcaggcuuaugccgacuaccuggccaaugaccaggaucaggacgcucucguuaaagccguggaaaaggugcugaaacaaaaccagccgcuguccacggucggagugcggcuccagaccgcgauugaugcuggcgacuuccugcccaagcaaagaacaaaagccaauagcguuaucccucaucagauucaccagcaggagcuugaucgcaucauugaagcccaaucuguguacuaucccuggcuggcugaggaaaacccugucgccgcucaucgguccuacgcccccuauaagcucgacgagcugguggauuuuagaguuccguacuauguggggccucugguccagccccaggcggacaaggccgcuaaagagaccaaguucgccuggaugacacggaaagaagcucagagcaccacgccuaucacacccuggaauuuugagcaagaaguggaucgcaacgccucugcgaaugccuucauccagagaaugaagaccaccgacacauaccuucucggagaggauguccugcccaaaaacucccugcucuaucagcgguuugaagugcugaaugagcuuaacaacguuagaguggacggcaagcugcucaccauugcugagaagcagcgccuguuccaagaucuguuugucgaccggagccaggccuccgugacaaucgcucagcuucaagccaaucucauugcccacggggcugcgaaagacagaguugaaaucaagggacuggccgauccuaaacgcuuccugucuagccucacgaccuaccacgacuacgcucagauuaucccggaggcccuggaacagcccgauaagagagccgacaucgagaaaauuaucaacugguccacaauuuuugaagauaccagcaucuucaaggagaagcugcaggagauugcuuggcugacaccugaccaacggcgccagcucucucagaaaagauaucggggcuggggccagcuguccgauaagcugcuuacccaacuccgcgacgccacggggcagagcgugauggaucugcuguggaccgaacccaauaacuuuaugcagaucauuagacggacagaguuccagcaagcgaucgcucgcgucaaucagaccgaccucaaacagcaggaucuggccacaaccaucaacgaccuuuacacgucuccucaaaauaagaaagccauuagacaggugcugcucgugguugcugauauccagacagccaugcaugaagucgcgcccagcuggcuguucauugaggcugcccggggaccggagcaaaacccuaagcgcaaacuggccagacagcagcagcuucucgaggcuuauaagaccuccgccaaggagaucgugaaugaagcugugaaagagaagcugcugucugccauugacgaccaccaaaaauuugaagaucaggucgugcucuacuuccagcagaacggccuggacauguauacagggaagccccuugauuuugagcggcugagcaaauaccauaucgaccacaucauuccucaauccguugugaaggaugacagccucgauaauagaguccugaccacccccgaggaaaacgagcgcaagggagcgcgggugccuggcccccuguaugccucucagcaggggagauggcgccuucugcagcgggcuggccucaucucccaaagaaaacuggaccaucuccugcuucgcccggaagaacuggaucagcaggccacaggauucguugcucggcaacucguggaaacgagacaggucauuaagcugaucaccaauauucugagccagcaguacgacccugagcaaacaaaacuugugucuguuaaggccggccugucccaccaguuucgcacccggcucaaccugcccaaacucagagagcugaaugauuaccaccaugcccacgacgcuuaucuugcggcccggaucgggacauaccugcuccagcgcuaucccaaccuggaaagauucuuuguguacggacaguaucaaaagacccgguucgaccugaagcgccauuuuaacuucaucggcgagaugcuuaaagggaagccugaagaugcugucauugugaaagccccgcacagcgagacggugaucugggacaagcaggaugaagucaaacagcugaagaagauuauggaguacagacaccuccugguuacacaugagguguaugacaaucacggagcccucuuuaaccagaccauccaucccgcuaaaaauccuaagaaccggaaacugauucccagaaagaccacacaauccaccgaacuuuacggcggguacucuggcgagacaacgggauaucuggccaucgcgcgcaccgugacaaagaauaagaucagcuaccagguccugcgggugccuaccagacucguuggccgccugcagcgguccucugaaagcgcucagagacaaauucuuacagauugguucgcccccuccuuugugagccgcgggaaacagcagccuuucgagaucguccugcggcacguguucaagaaccaaaccguuauugacgauauccaugagcagucucacagauuuggacuccgcuccgacacguauuacugcaaucagcagcaacuggugcucagccuggaacagcagagaaugauuaucgaucagaaacuuaacaauaccaacaaacugauggucguguaugaggccguuugugaccaaguggcuaaguacuucccccuguaucggaugaaucacuuuaaagaaucucuccuggaggccggcccgaaacuugcggaacugccuauuaacacaguccaguccaagaaugggaagcucaagcugggacagcgcagcgugcuccugcagaccaugcaaggccuucaugcuaaccccgagacaaaagaucugucuaucaucgggugcccuaaguacuucggcaaacuucaggugagcuccggaauuaagcucaccgagaaugccguccugauccacgaaagccccacaggccuuuuucagagacggguucgccugucugaccucuga

SEQ ID NO: 4189 - RNA, 4056 nt, Artificial Sequence
  Cas9 variant
augaagauccugggccucgaccuggggaccaacagcauuggaugggccguggucaaugaggcugaaaacgagagagaauccucuagcaucauucggcuuggcguucgcgugaauccccugacaguggaugagcagaacaauuucgaaaaagggaagccuaucacgaccaacgccgacagaacacucaaacgguccaugcgcagaaaucugcaacgguacaaacuucgcagagcgaaccuggucucucuccugaagacccagggauggauuacagaugagacccugcucagcgagcagggcaauaacuccacauuugaaaccuaucggcugcgcgcugaggccgccacgaaggaaaucacccuugagcaguucgcuagagugcugcucaugcugaauaagaaacggggguacaagucuagccgcaaaaugaagcacgacgaggauggauccuuuguuaacaaucuugacaucgccagagaacuguaugauagcggccucacaccgggccaauacgcuuauaaccugcugaaagacgggaagaaguacauucccgauuucuaucggucugaccuccaggaggaacuggauaaaaucugggccuaccaguacgaguaucaugaaaauauucuuacccacucccugcgcagcgcgaucauugaccagucuaagacaggaaccacgaaaaucuuucucaagacacauggcauuuucaccgccgauaucaaagggaacagaaacgagcggaauaagcaacuguuugagcuuagaugcggagcucuggaacgcgcccucacagcugaggaacuggccaccgugaucgcggaggucaacggccagauuaauuccagcucuggguaccugggagccaucuccgaccggagcaaagcucucuucauuaaccaccagaccgugggccaguaucugaugcaacagcuugacagagauccuaauaagucccugaagaaccagcccuuuuaccgccaagacuaucucgaugaguucgaacagcugugggagacacaggcccauuaccacccugaacuuacggcugcccugaaacacgagauccgggacauuaucaucuuuuaucagagacgccucaagucucaaaaauggcugguugccaauugucccuucgaacaucggaaggugugcccuaaaagcuccccgcuguuucagcacuucagaauuuggcagguccucaacaaugugaccgugacagucgauaacaagaccuacguucugaaugaggaacaaaagagcauccuuucuaaagagcugcucuacaaggagaaaauuuccaagcgcgacgcucugaaaaugcuguucgugaaggcgaagggcguggauaugaacuuugccagccuugaaggggaccggacaaugucuaaucuccugaaagcugcccaggagaucgucagcauuuccggacauggcgauuaugacuucgggaagaugcccgccgaugacauccacaacaucauuagaucuguguuuggaggccugggguucgcuaccgacuggcucaaucuggauacggacgccgaugaccuugaacaggagagccagaugcgccuguggcaccucaucuacuccuuugagggagauaacagcacaaccggcgacaccaaacugguugaacggcugaugucucuucucaaccugccucaggaguaugcgagacuguucgcuaaugugcaucucgaagaugacuacuguggcauuuccagcaaggcccugaaacggauccuucccuuuaugaaggccgggcacauuuauucugaggcuugcgcccuggcuggauacaagcauuccgaacaaagccucacacgcgaggagaacaaaaauagaccucugaaggaucaccuggaacagcuucccaaaaacucccuccggaauccggucguggagaagauccugaaccagaugguuaauguggucaacucuauuaucgacaccuauggcagaccugaugaaauccgcauugagcuggcccgggaacucaaaaauaacgcgcuggggagacaggccaucuucgaggcuauuaaucgcaacacaaaggagagcgaaagaauccaacagauucuuaaaaaggaguuuggacugacgcaugugucccggaaugacaucauccgcuacagacucuaccaggaacugucuggcaacggguauaagacccuguacagcaauauuuauaucccccaagagaaacuuuucuccaaggaaauugauaucgagcacauuaucccucaggcccggcucuuugacgacagcuucucuaacaaaacacuggaguaccgcgaugucaacaucaagaaauccaauaccacagcuauugacuuugugagaaacgaauauggcgagaaugaaguugagcaguacaagaagcgggugaacgaucugcucaaaagcggagccaucucucaggcgaaggccaaaaagcugaaaaugaccgaggcugaaauucccaaugacuucaucgagcgcgaucuuagaaacacgcaauauauuucccggaaggcccaggaaaugcugcgcgacgucgcuagagugguuaccgccacaaccggcagcgugacagaucggcucagacaggacuggcagcuggucgaugugaugcaagagcugaauugggacaaguacgaacgccaggggcuuaccacggugaucaacggacgggauggccagcagaucagacgcauuacagacuggaccaaacggaaugaucacagacaucacgccauggacgcucugacaaucgcguucaccaagcccgccuacauuucuuaucucaaccaucugaaugcucgcagcgaggacgauauccgguccauugagagacgcuuucucgaacgggacgccaacgggcaccugagauucaucagcccuauugcccacaauuuucggucugaggcuaaacgccaucuugaaaugauccugguuuccaucaaggccaaaaacaaggucgugaccagaaauaacaacacaacgaagaccaaaggaggccggcgcaaucggauucaacucacaccgagagggcagcugcacgaugcgaccguguacggcagcauccugcuuccccauacaaagaccauugcugucgacggaaaaaugacggccgagaucauuggccaggugcaaaacccuguuuucagacaggcccugucccagcgccucgaggcuugugggaaugaucccaagaaagccuuuacaggaaagaacucucuggaaaaagcgccuguguggaucgaccaggcucacaccgagcauguccccgccgaagugaccauccaacggcucgagccgcagcacacaauuagacgcgccguuaauaaggaucugaacaucaauaaggugcuugacaaaggcauucagcacauccugcaggcucggcucgaugccuaugggggagacgcugccaaggcguucgccaaccuggauaauaacccuauuuggcugaaucaagaaaaaggcaucgcuaucaagagagucaccacagccgagaacauuagcggggaaccccuucaucacaaacaugacaaggagggccgcccuauccuggacacgaauggaaagcccaugccuuccgauuuugugcggcucaugaacaaucaccauguugcuauuuuccaggacgccgauggcaaccugcaggagcacaucgugucuuuuuacgaagccgucgcuagagugaccgagcucgggcugcccgugauugacaaagaauauaauaaggauaaaggauggcaguuccuuuuuacacugaagcaaaacgaguacuucgucuuuccgaacccugcgcagggcuucaaucccgacgagaucgaucugaccgacgaacgcaacuauagcagaauuucccccaaucucuaccggguucagaaaaugucuagcaaguacuauguguuccgccaccaucuggagacaaccguggaagauaagaaagagcuucaggggaucacguggaagagaauccaaucccugaacaaucucaaaggaauugucaaggugcggaucgaccacauuggccgcaucguucagauuggggaauacuga

SEQ ID NO: 4190 - RNA, 4056 nt, Artificial Sequence
  Cas9 variant
auguucagccagcaaaacaaucuguacugcgagucccucucuaagcuguauuacaacaucaccaaaaauuuucuuagcaagaacgaaguguguagaauuuaugagaucuucuuuugcuccauucugacauacuuccucaaaaaguauaaucacgacaucuuuaaaaagucuagcacgaugaagaccauucugggccuugaucugggggucacauccaucggaugggccguuaucgugaccgacgaugacaacacacccauuaaaauccucggcauggggucucggauuaucccucugagcaccgcugauaaggaagaguuccagaaaggacaggccauuuccaagaaucagagccgcacaaucgcgagaacccaacggaaaggcuacaaccgcaagcagcugagaaaggaagaacucaaaaagauucugggggagcuuggaaucacgccgucuaaagaacugcucaaucugcccuccaucgagcuuuggaagcugcgggcugacgccgccagcggcaacgcuccucucucugccgaacagcugggccgcaucuuuuauaugcugaaucagaaaagaggguacaaguccgcucggagcgaggccaaccaagauaaaaaggacaccgauuacguggcggccgucaagggacgccaucagcagcucaaagagaagggccagacaauugggcaacacuucuauaccgaaaugcugacacuugaggaaaauucuggacauuuucaggugaaaaacaauguuuaccccagagaggcuuaucuggaagaguucaacgccauuaucgcugcccagaagccucaacacgcguuucucaccgacgauguggucgaccggcugcgcgaugaggugauuuucuaccagagaaaacuuaagucccagaagggccugguuagcaucugugaauuugagggguucgaacggacguucuuugacaacgugaaacagaaggacaaaacaaucuucaccggacccaaggucgccccuaaauccucuccgcucuuucaacugugcaagauuugggagacagugaauaacaucaaucugaaggugaaaaacaccgauggcagcaagaauaaaugggcugacuauguccccacccucgaacagaagcaggagauuaucgagcaucuguucaaaaacgccggcauuucccuugaugcucugcgcaagauccucggguuuaauaaggacgaaaucuucguuaacaaacagauugagaagggacugcaaggcaauacaacguacgccgaaauccacaaaauucuuggggauagcaagccugagcugcucggauuuaacaucaauauugaacccucuaaacacuccgcccugcugguggacaagagaaccggcgagauccucgcugagaaagaagggcaacaggugagcgcggagauugaaaaggagaacuucuaucagcuguggcauacaaucuacucuaucaaggaucuugacgagugugccgcugcccugauuaaacgguuuaauaucgauccuaacgucgccgcucagcucgccaagauugacuucagcaaaggagcguuuggcaauaaguccaacaaagcuaugagaaagauccugcccuaccugaugcagggcuauaacuacgccgaugccugcucucuugcuggguauaaucacagcgacucccagaccaagaaagaaaaggaggaaaacgugguugacgauaaacucaagcugcuggagaaaaauagccuccgccagccgguggucgaaaagauuaucaaccaaaugauccaugugguuaaugccauuaucgacaaguacggaaaaccugaugagauucggguggagcuggcuagagaccuuaagaaaucuaaggaugaacgcaacgaggccgaacugcagaaugcguccaacaaaaagcucaaugaggaagucgccaaccggcugaaggagcugggccuucccgugacaaaaagauucguccagaaguauaaauuuaucuucccugugcgcgaccggaagauuaaagaggcucaacucguuaaucaguguaucuacugcggggaaaccuucaacgugacggaggcccugagcggagauaauuuugacgucgaucacaucauucccaagucuaugcuguucgacgauucccagacaaacaaagugcucguucacagaaaguguaaugcuaaggacaaaagcaacaagaccgccuaugauuuuaucgcggccaaaggcgaaaacgagcuggcuauuuaccuugaccgcguggacgauugguucaagagagggguccuguccuacggcaaaaugcagagacucaaggugucuuaugaacaauacgccgagcgcaagcagcugaaaaaggagaccgaagcugacaucaaacugugggagaauuuuauugaacgggaucuuagacagacacaguauaucgccaagaaaagcaaggaccuccugaagaaaaucugcaacaaugugaccguuacagagggaaagauuacggcccaacugcggaaccucuggggcugggaugacguccugaugaaucuucagcugcccaaauacaaggcucucgggcagaccgagaucaaagaauggacauccgagcauggacgcagacugcacaagaaggaagagauuaccaacuggacaaaacgggaugaccauagacaccaugcgaucgaugcccuggugguggcuuguaccaagcagggcuucauucaacgcaucaauacgcuuaacucuagcgacaccaaagaugccauggaccgggaaauuaaggccgcuaaagagaaguauaaugagcucuacgauaagaaacugcugacagaaaccaacgagcaggucaagaaucacacagaaagauuuaacaaacucgagaccuaucugaagucccagcaaccuccgcuuuucacgacacgcuacguggaacaggaggccgacaaaaucuuuguuagcuucaaggcggggaaaaaggcugccaccuacggaaucagaaagauuaaaaaggacggcaaaaagguggucgugcaggagaaaaucguugugccccgcggggcccugcacgaacagucugucuauggcaagauuaagacacaagagaaagauaagccucucaaauaccuguuugaaaaucccgagaccaucguggacaaccggauuaagauccugguuaaagaaagacuugauaaguucgagggagacgugaagaaagcucugaccucccucaagaaagagccucuguuuaucgauaaugaaaagaacacacuccuggagaaagccgcgugcuauacggacgcuaccguccuuaaguacaagcugcaggcccucaaagccaaccaggugaaugauauuguggacgaaggcgucaagcggaucguuaaagcucgccuggcccagcauaagaacgagaaagaggcuuucaaggauacagugugguucaaucaagaaaaacggauucccaucgugagcguccggguguuugcccgcccggacgcgucuaagcuggccauuaucaagaccgaugagaacaauaaaccuaucggguucgcucuuacaggaaacaaucaccauauugccaucuauaaggacaacaccggcaaacugguucagcacauuugcacguuuugguccgcuguggaaagaaagaaauucgggguccccacagugguuaagaauaccggaacccucuggagcgagcugcuccacaaggaccugccuggcacauuucuugauaaacugccccaggacgggcucgaacuggaguacucucugcagcaaaacgagauguucgugcuuggccugccuaaggagagcuuugaggaugccaucaaaaauaacgaccucccccugcucuccaagcaucuguaucuugucuggagcauuucugauaaugacuacugguuccggcaccaucuggaaaccaaaaacuccgagcucaagagcacaacgggagccaaggaauccaaacgcuacuauagauuucagucugugggcaccuucacaaaggagaauccgaucaaaguucagcugaaccaccugggggagauuaccaagaucggagaaccuuga

SEQ ID NO: 4191 - RNA, 4059 nt, Artificial Sequence
  Cas9 variant
augaagaaaagaaaccgggaggaauacuaugugggccuggacaucgggaccagcuccgucggaugggccguugcuacacccgauuaccgcauuccuaaguucagaggccacaaaaugugggggucucggcucuuugccgagggaaagcgcgcggcugaaagacggcaguuccgcacgaauagacggcgccuggccagacggcgcgacagacuucaaauccuggaggaacucuuugccgaggagauggcuaaaguggauaacaccuucuuuaugcggcugaaggaaagcaaguucuuucuugaggacaaaacagugaaggaaaaacauauucuguucuccaccgauaaguuugacgccgaucgcuucuauaaagacaauccgacaaucuaccacgucagaaagcggcucauggaggaggaaccccaggauauuagagagcuguuucuggcugugcaucacauccucaaguaucgcggccauuuccuguuugccgggucucuugaacagaacggagcgagcaucgaggaacugguucggacccuccugggcaaacagggccuugccauucuggacgauacaaucgacuccaaugagauggugaacauucucaagaauaccggggagacgaaaucugauagaaagaaagacguccaagaacuguggaacccucugaaggacaaagugaagaaggcucaggccgcugagauggccggacucguucugggccuuaaaagcgauaucuccaagcuguucgcgaauagcgacuacaaagaucucgacucuuccauuaagaacaucaauuucagcucuggggauuaugaagagaaacgcgacgauuacgccaacuccauuggagacgauaucgugcugcuugacaccaugaaggcucuguacgauacacucauccugagccagauucugcagggcaagcggucuaucuccgccgcuaaagucgaagacuauaauacccacaaggagcaacucagagcccugaaagccauucuuaagccccacaaacgccuguacaacgagauguuucgggaaaauaacaagaaggaccucagcaacuauguggcuuacaucuccucuuauagcgaggggaaaagagugaaucgcgaaggauucuacaaguauguccaggcgguucugaaacagguggaugacuccgauagcaagcaggccauucuugaggcuauccggcuggaaacauuucucccucugcugagagugaaagacaacgccgucaucccccaucaaauucaccaggccgagcucgaggcuauccuggaaaccgcccgcaagaaguacaauuuccuuaacgaugugucugacggcguuuccgugaaagauaagauuauccagcuguuuacguuccggauuccuuacuaugucggcccgcucaauccccauagcggggagacaguggcggacagaaaacaaggaaccggcuggguugugcggaagcagcgcgggaaagucuacccuuggaacuuugcugauaugguggacgucaaggccucugccgaggcuuucaucacaaaucugaccaacaaaugcaccuaucugaucggagaagaugugcuucccaagagaagccuccuguacuccgaguuuaugcugcucaaugaacugaacaugauuaaguaugacggccacgagcuuccuguugccaucaaacagcuguacauugaacagguguucaagcaagagcacaaaaagcagacaaaagggcggguccucgauuuucugaagagaaauggacugaucacgggcucugcuaccgccgugauuacaggcauggacgacgcgaucaagggggaucuucagagcuaucgcgacaugguucggauuuucggagccggcuuugaucauuccauggcugaaagaaucauccgcugggugacccucuucggggaggccaaagacauucuggagaacaagaucagagaagucuacggaaauagcauuucugauucccagaugcgggcuaucaaaaagcugaaauacgccgacuggggccgccucagccaagcguuccugauugccgugaaggggugugauaagucuggcguggagagaaacaucaucacaugccuucgggcuuccagccagaaucugauggaaauucucuccgaccagggaaccuauaucaaacagauuaaggccuggaaccaccaacauacgacaaacaugauggauacccuggacuaccagcugguugaugaccuuuaugucgcucccucugugaaacgcagcaucuggcagucccucuguauuguggaggaacuggucaagaucaugggccaggccccgaaaaagaucuuuguggagguuaccagaacaaagcaagccgagaaaaccaagaaagauucucggaagaaacgccugguggaacucuacacagcuauugggaaggagggagcggccuggaaaaaggaaaucgaggcucaccaggccggcgacuucagacggaagaaacuguaucuuuacuauacgcagauggggcgcugcauguacagcaaugaaccuauugccauggacgcucuguuuaccuccgccuacgauaucgaccauauuuauccccaaagccucacaaaggauggaucuugggacaaccugguccuggugaaaucccagcuuaauaaggagaaaagcgaucaguacccucucagacccgcgauccgggagaagaacaaggcucacuggcaguaucuguguagagccggcuucaucucugaaaagaaguacgagcgccugaugcggaccacagaacucaccgccgaggagcuguccggguuuauugcuagacaacuuguugaaacgagccaggccaccaaagcggugacaggccugcucgagcgcaucuauaccaauacagaaauuugcuucgucaaggcugagaccgugucucaguuucggcaccagcauaacuucaucaaaauuagagaacugaauaacuaccaccaugccaaggacgccuaucugaauaucguugugggaaacgucuaccacgagaaguuuacgaaaaaucccugggaguucauugcucgcagcacagaacggagaccuuacaaccuuaaucgcauguaugauuuugaccugcucaagcaaggccgggugaucuggcaagugccgaaaucccuggagaccguccaggccaugaugaaaagcaacgauguuagaaucaccaaaaagcuccuggugcagaagggggaacuuuacgacgcuacaauuaccaaagcccacaaggcgaaagagggaacauauuucccccugaagggcgccgaugcucggcuccgcgacgugcauagauacgggggauaugagaaaaucaagauugccuacuauucugucuuuuccugucgggaaaaggcuagcaauacgauccacacccugauuaucccuauccccguguacaaagccggccugcuucagacagaggccgaccugaccgcuuacgcguggcagacaaagcagaaaaccaagccuauuaaagauaucuauuccgccauuacgcccaucuacaagaaacucugcauuaacacaguugugaagaucgacggguucaaguauuuccugggcggaaaaaccggcgauuacauguggcucgacccggcuaucccugucgugcuggaugaacaagccgccgcuuaucuuaaggccauuucuaaaguugggcgcgcggacgauguggagaacaccgcucaggccaucgaccugauuacagccgaagcuaaugaggccuuuuacgauguccuccugaagaaaauggaagcgaagaucuucgcuaaggccuaucagaccauuguggagaaacuggccagcgagacagcuagagaacgguuuagagagcuuuccaucggagcccaguguucuugccugcucgaaauucugaaccuccuggcuaauaacaagacgaccuucacauuuuucaaagacaagaugggcguuaccaugagccgccggaaacaacccauggaucuuacaaagcuggaggaguguaucguguacgaaaccuccaucacggggcuguacgagaaggccgucucucuccuguga

SEQ ID NO: 4192 - RNA, 4059 nt, Artificial Sequence
  Cas9 variant
augggcaagagauaccacaucgggcuggacauuggaaccagcuccaucggcugggccgugauggaugacgauuucaaaauuaugcgggucaaggggaaaaagggaaucggcguucgccucuuugaggaagggaaaacagcugccgagagacggggacaucgcacgaccagacggcgcuauucuagacggaaguggcgccugaaccuucuggaagagauuuucgaccccgaaaucgcgaagguggauccuacauuuuucgcuagacucaaagagagcaaucuguccccgaaggacgaucggaaacaguacucuggcaaccuuaucuuucccgagaaggccaaagaagagauucgcgaauggaccgagaaguauccuacaaucuaccaccugagaaaugcccucaugaccgagaaccggcaauucgacauucgcgaaguguuucuggcucugcaucacaucgucaaguauagaggcaauuuccucuuuaacgggaauuuccagacaggagaggugaaccugagcgaucgguuugacgauauuaauuccgccuucaucucugcuugcggcgaagaggaagcgccccagauuccuagcgagcuuuacaacgacauccaggagcugcucuuugauaaaaauaccagaaagcuggacaaccaaaaacagcuugccacgaagcugucccaggacaaugauaaagacuggagcacccaguucucuaaggcccucuucggguauaaaacaaaguuuaagguugugcugcaauccaacgaagaucuggacgauuuccagcucgacagcgaugacgcugaugacaaaaucgccucuauuuccgagcagaucgaugacgaccgcggaagcauucuggauaauaucaagauucuuuacucucggaucacccugaacgaaaucguccccgacggcaaaacacucucccagagcaugauugagaaguacaaccugcauagagaucaccuuaaagaaaucaaggaccaacugaagcacaccgauaauugggugaaauuugacgaucucuauucccaguacguuaacgggaagcuggagucugaccgccauaaaaagcugagcuccgaugacuucuauaaaaaggugcucacgcuguuugauggagagcuuaagacacgggucaaagaauggcaggagaagggcgaguuccugccuaaacaaagaaccggcagcaauggggugauuccgcaccagcuccaucagaacgaacuggaccagaucauugaaaaucaaucuaaguacuaucccuggcuugcuacacugaacccuaaugagaaacgccagcggguggccaaguacaagcucuccgagcuggucgcguuuagaauccccuauuacguuggaccuauggugaccaaagaucagagcgacuucgccuggauggugcgcaagucugacgaaaaagagaucacccccuggaacuuugaucaggucguggaccgggauaagagcgcugaagaguucauuaauagaaugacaacgaaagacaccuaccugaucggcgaggauguucucccggccaagucccugcuuuaugaaaaauuuacagugcugaacgagcucaauaacauucgcaucaaugggaagccucugaccacagacgaaaagcaccaagucuaccgggaucuguuccagaacgcuaaaucuauuagcaccaagaaauuucacaauuaucuuguguguaagcucaacaaacccaaccaucugaauaucacgggauucuccgaccugacaaaguucaacagcucucucgauuccuacauugaccugaagaaaaucuuugccgaucagaucgacgaucagagccuucaagacgacuucgagaagaugauuagauggucuaccguuuuugaagauaaacagaucuucgagcggaagcuguccgagauuaauuggcucaccgaccaggaacgcagcgagguggccaaacugagauaucggggcugggggagacuguccaagcgccuucucgcuggaauccacgaugaaaacggccagcggauuaucgacgcgcuguggaacucuccuaagaauuuuaugcaaauccaggccgaggucgcuuucaauaaacagauuaacgaucugaauacaaaggaacucagcgacaacaauguggaggauguccuggccgacgccuacaccucuccccaaaacaaaaaggcuaucagacaggugcuucugguuguggaggauauucagaaagccaugcauggcgacgcgcccacauccaucagccucgaauuugcucgcgaggaacaggaguccagcagaacgcggucucgcagagccgcccuguccgcuaccuaucggcaaauuagcgaugaaaucgucucugccacagugaagggggagcugggaaaggcuaccuccaucagcgaccgccuuuaccucuacuucacacagggcgggagagacauguauaccggagagccuauuaauaucgaugaaauuucucggggcuacgagaucgaccacauucugccgcagagcuuuaucaaagaugacucccuggauaaccgcguucucgugaagggggccaucaauaacggcaaaagcgcgaacuaugucauggaccagucuugggcccccgauagacuggcuugguggaagaaacuucuggacaaucggcucauuucccgcaagaaauaccaaagccugacgcugaccccuggaaagaucaacaaguauucccagaauggcuucauuaacagacagcuuguggaaacaagacaggugaucaaacucguugccaauauucugaacgaucaauacucuaaugacgauaccaagaucauugucgugaaagcugcccugaacagccagcuccggggguuucuggagcuuuucaagaaucgcaacaucaaugacuaucaucacggaauggaugcguaccuguccacauuuaucggcaacuaccucuauaaaaaguaccccaagcugcggucuuauuucguguacggggaguucaaaaaguuuagcggaaaacagaaucugaaguccuucaacuuucuucacgaccuggaagacgauucuauuaauaucauuagcaacgacgauggcgagaucgucgggaaccaucacgaaaugauugaggaacucgagaaagccuaucaauacaaguauaugcugguguccagagagguuuucgaaaagaccggcgaccucuuuaaugugacggucuacagccgcaaagcuaagaaaacacugaucccuaucaagcaggauaaacccauuaacaucuacggaggcuauucugggaauaacgacgccuacauggcuauugugaaacuuccgggaaagaagggcaagccugauaccuauaaaaucguugggauuccccugcgguucgccggagagcucgaaagagccaagcagcugggcgaguccgcuuaccgcgaaaaacugagcgcggugaucacaccucaguuuaccaaggagaagaaagaccggaagaccggggagaucacaaaagucguggaugacuucgaaguugugcuugauagaguccccuaucgccaacuguuuaaggacucugauaaaugguucaugcucggcuccgccgcuuaccaguauaaugccaagcagcuggugcucaacaaugacgacgugaaacugcuuaacgagcagggacggaagaagcuggaacucccuaaugagaaacugagcucugcccugaacgaugucuuugaccauauuauccaaauuaugaacuccaaguucggccuuuacgauaaaaauggguucagaacgaagcugaccgaagcugccagcaucuuuuacgaccucccccugcgggcggaguauaauggaaacaaaaagguuacagauggcaagcucgaggugcuggacaauauucuuaucgggcugcacgcugauccguccuucggaaaccugaaacagcucaauaugagcaccccuuuuggccagaugcagacaaaagggggcgugguccugaacggaaacucuacccuuauuuaccaaagccccacgggccuguucgaacgcagagugaagcucaaggaccuguccaaauga

SEQ ID NO: 4193 - RNA, 4059 nt, Artificial Sequence
  Cas9 variant
augaagaaaauccugggccucgaccuggggaccacaagcauuggaugggccuucaucaacgagggcgaaaaugauaacgagacguccucuauuaucaaugcuggggugagaauugucccccuuaccacagacgaagaggccgauuuuaagaaaggaaacaccaucagcaucaaugcggaccggacacugaagcgcggcgcuagacgggggcuccagcgcuucaaacaaagacgggaugcccugcuucaguccuuucgcggaauuaacuucaucucuagcaauuacguuuaugccgaaaccggcaagcagacaaccuuuuccucuuacaagcugagagcuaaaagcgccacggagcucgugaccaaggaggaacuggugcagguccugcucaugcugaacaaaaagcggggcuauaaauccagccgcaaggcuaagacagccgaggaaggggacgcgauugauggaaugaaaaucgccaaggagauuuucgagaauaaccuuaccccuggccaauggguguacaauucucuguccaucgggggaaaauuuauuccggacuucuauagaagcgaucuccagaaggaaguugagaaaaucgugcgguuucagaaccaguuccaccccgaacaaaugaaugagaagcugcuugaaaacauccagggcaaagcucgcacagucaccucucaguacuuuucccggauucugaauaucccucucgccgagaacaaggggacgagagaggaaacaaagcugcagcauuauaaauggcgcaacgaggcucugaccgaggaacucgaccugaaggugcuugccuucauuaucacagaaauuaauaaccaaaucaaucagagcaacggauaccugggcgcgaucucugauagauccaaagagcucuacuuuaaucaggagaccguuggccaauuccaguauaaccagcugaaggaaaaugcccacaccaaacuuaagaaccagguguucuaccggcaagacuaucuggaugaguuugaaaagauuugggagacacagagcaaauucuaccccgaacucaaugacgagcugaaguccgaggucagagacaucacgaucuuuuaucagcgcaaacugaagucucagaaacaucucgugagcuucugcgaauuugagaaggggcacaaggcuauuccuaaauccagcccccuguuccaagaauuucggauuuggcagaacaucaauaacaucguggucaagaaugagaccacaaaagagccuuuccuucugggagaagaucucaagaaaguuauugcccaggagcugucuuuuaaggaauccaugaccgacagccagcuucugacauucugugaucucaagaaaggcacccauacggugaacuuuaagaaaaucgaggggaauagaacaaacaccucucuguucaaggcuuuugaaaagauucuggugcucgagggauacgacgagcuggaucuuagcaagcuggacgccuccgauaucaaaucuauuaucaagagcgccuucuccgaccucgaaauuagcaccgcuauccuggauuucgacccgacaauccaaggcaacgauuaugacaagcagucuuacuaccagcuguggcaccuucucuauuccagcgaggaagacgauuuucugaaaaagucucugauggacaaauucggguuuaaggagucccaccuccccuuccugcuuaauauuaaccugcaggcggauuacggaagccucuccgccaaagcuaucaagaagguccugccucaucugauggacggccacauuuaugauaaagccugcacccuugugggcuacaaucauucuagcucccucacaacggaccaaaacaaugaacgcguucugaaggauacccuggagcuccugaaaaagaacucucuucggaaucccguggucgagaaaauccugaaccagaugauuaaugugaucaacgccaucauuaaggacccugcuauggggaagcccgaugaaaucagaguugagcucgcccgcgaacugaaaaauaacaaugagcagcggagcgaaaugacaaaggcgauuaacaaauccaccacagagcacgagcaaaucagaaagcugcuucacaccgaauuugggauucaucgcgugacgcggaaugacaucaucagauauaaacucuggaaggagugugauggcauuagccuguacaccgggaagccgaucgaaccuucuaaacuguucacaaaggacuaugauauugagcacaucauucccaaaucccgccucuuugacgacagcuucucuaacaagaccaucugcgagcggcagcugaacaucgauaaauccaauaagacagcuuacagcuuuuuccaggaaaaacuuucugccgaggaauuugaccaguucgagaagagagucaagagccuguuuggaaaaauuucccggaccaagcaaaacaaacuccugauggccaauaacgaaaucccugagggcuucauugaucgccagcugagagagacgcaguacaucgcuaagaaagccaaggaaauucuucucgaggugagccggaaugucacagcuaccaucgggucugugacagacaagcugagagaugacugggaacugguugaugugaugaaagagcucaacugggaaaaguaugacaaacugggccuuaccuacauugaggagggaaagaauggcgaacgccuguauaaaaucaaggauuggaccaagcggaacgaccauagacaccaugccauggaugcgaucacagucgccuucacgaaacccgcuuacauucaguaucucaauaaccugaaugcccgcaccaacacagacaagaaaggaaauuccaucauuggaaucgagaacaaguaccugaaaagagauaagaauaacaaacuucgguuuauugaacccaucccuaacuuccgcgagguggcuaaaaagcaacuggaaagcauccucauuuccuauaaagccaagaauaaaguugugaccaagaacaagaaugucaccaaaaagucuaacggcacaaaucagaaaauccagcugacgccgagagggcagcuccacaaggagacaguguacggaaaacugcaacaguacgugaccaaggaggagaaaauuaacgcgaauuuuacccccgaauauguuacaaaggucgccaagaaagaauaccgggaggcccuucugaagcgccucaucgagaacgaaaaugacccuaaaaaggcuuucaccggcaaaaacgcucugagcaagaaucccauuuauaucucccuggagaacaauauccuugugccugaaaaggugaaaauugucuggcugaagucugacuacacaaucagaaaagauauuacgcccgaccucaagaucgauaaagugauugacaucgggcugaagaccauucuccagaaccggcugaaugaguuuaacggcgauacaaagaaagccuucguuaaucuugacgaaaacccgaucuggcaaaacaaggagaaaggaaucgccauuaagcgcgugaccaucagcggcgucuccaaugcucaggcgcugcacaccaaaaaggaucaucucgggaacgagauucuggacgaaaauggacagccucugcccguggauuuuguuucuacaggcaacaaucaccauguggccaucuauagagacgagaaggggaaccuucaggaagaggucgugagcuucuuugaagcuguuacgcggaauaaccugggacucuccauuaucaauaaaaaccacgagaagggcugggaguuccuguuuagcaugaaacaaaaugaguucuucaucuuuccuaccgauggguucaacccccacgaaauugaccuccugaauacagaaaacuaccaucuuaucucucgcaauauguuuagagugcagaagauugccaccaaaaacuauauguucaaccaccaucuggagacaaaguccgucgacggcgaaaugcugaaaaccaagaagcagcucagcaaaaucucuuaccacuuuauucagacaccuuccuaccugaauuauaucaucaagauucggaucaaccaucuuggacaaauugugcagcugggcgaguacuga

SEQ ID NO: 4194 - RNA, 4059 nt, Artificial Sequence
  Cas9 variant
augaagcaggacuacuauaucggccuggauauggggaccgagagcgugggaugggccgucacagacguugauuacaaccucauuaaaaagagaggccaagacuauuggggaguguaccuguucgaugaagcucagacggcccaggggcggcgcgcguuuagaaccaaucggcgcagacuugcucgggugcgccacagacugaaccuccugcaggagcuuuucgacuccgaaaucucugccaaagauuuuggcuucuuuuaucggcuggagaauagcaaguacuucgacgaagauaaacccgagauugcccgcgggaaguuucuccuguucaacgacaaggauuuuggagacaaagaguauuacaagaauuacccuacaaucuuccaucugagaaacgcucuccggacccaagaaauuaaagauguccgccugcuuuaucuggccgugcaccauauccucaagaauagaggccacuuucuguucggcgagcaggacuuuaacguuaaugacgcuuccgaugugucuggggaauuugagaaaaucaaccgguuccuuagcgagaaugacggagccggcuucgaucgcgaaaagauuccggagaucuucgaaacacugugcaacgagaaucucgcgaagagagaacggaaagagaagauucuggagcuggccgggaacuccaaaaauaagcuccugggagaagcugucaacgccgugguuggccuuaacuuuucucugagcaaaauguucggggaggacagagauuuucagggagaaaauaagauguccuucaccgacagcucuuuugaggaaaaacucgcuaaggcccgcauggcgcuggaugacgaugaggccgacuuccuugagacacugaagaaagugcaguccgucgcuagccuccauaacauccugcacggcaaggaauuuauuucugaggccaaaaccgaggcuuacgaaacgcaccggagagaucuguccgaacucaagaaauaugugcgcgagaauugucccgagaaguacgcccugguguuccggagacaagucaagaaaggcaagaaaaacaccagcggggccgacgaaaaugagaaggacgauaaaaagguuaacaauuaugcugcguacaucggaauggacaagggcaaaggguuugaaaagugcaaaaaggaggauuucuaugccuuucuuaaaaaggagauuggaaucaacgacgaaucucugcucgcuaagaucgaugagggcauuuuccugccuaaacagaucuccgccgaaaauugugacauucccuaccaggugcaucuugccgagcugaaggcuauccucgccaacgcggaaaauuacuucccuuuucugaaacagaaggaugagaacugcgagaugacagugagcgagaaaauuaucucccugaugaaguuccgcguccccuauuacguggggccuuuuaccgacaaagaaacacgguucucuuggaugaucaagaaggaaggacucagcacccagaaaauuacgccguggaauuuugaugacguuguggauagagacgcuuccgagaagaaauucaucgaacgcaugacaaacuuuuguaccuaucugacaggcgagaagguccuucccgccagcucuuuccuguacuccgaguaugccuuucucaaugaacugaacaaccugaaagugaauggcaccaaggaucuucggguuaagaacauucucuucgacuuugcuaaaaccaauaagaaacugacacugaagaaaugcugugagcagcucgugaagaacgggcugcuuccugaaggaagcaaggccagagacgucuucucuggcacggauggggacuuuaaaaauagccuguccucuuacaucgauuucaagcgcauuaucggagacaaagcugaucucuaucgggacaugugcgagaagaucauucuguggaucaccgugauuagcgauaaagaaagacuggucaagaucauuaaggacaaauacggcacagugcuuuccgaugaggagaucaaggggcucaaagcccugaacuacaccaaguggggccggcugagcgaaaaacuccuggacggaauuuucgagacagauucugaaggcgagguugggaauguguccaucaucgagaagaugcgcaccgacacggaaaacuuuauggagcuucugagcaauaaacacaacuauaagagagcgauugaacucgccaauucugaguccaucgucgaugaacgggugacauacagagcuguugaggagcuguauuguagccccgccgugaagcgcuccauuuggucugcucugaaaaucguccgggaaauugugaaggugcagggacauagcccuaaaaagaucuucguugagaccaccagagaaaaacccgacgucacacgcaagggccaaagaaccgugucccggaagcagcagcuucucgacaaauaccgcgagaaccugagaaaugaaacagagcugaucaagaaaauugaggaaacggaggauucuaaguuuaacagcgacaaacucuucuuuuauuucacccagauggggaaggaugccuacacaggagaaaagaucgaguuugacgauguguucaaaaccgaaaaguaugacauugaucacaucuacccgcgguccaaaauuaaggacgauagccuggacaaucgcguccuugugagacggaaaaucaaccaaucuguuaagaaggauuccuacccucugagcgcggagauccgcaacagaauggagggccucuggcggcagcugcgcgacaaaaagcugauuucugacgaaaaauuuuauagacuuacacgguccacgccccucaccgagaaggaaugcggggauuucaucaaugcccagcugauugcuaccagccagucugccaaagcugccauccaacugcucaagagaaugcugccugagagcgagauuguguacuccaaggccggcaacgucaaugaauuuaaaaagcgccuugaguucgugaaaauccgggaacugaacgaccuccaccaugcuaaggaugcguauuucaauaucguugugggaaacgucuuuaauacaaaauucaaccacaaucccgccguguuucagagaagcaacggcaccgggaauuacgacuucgagcgccuguaugauuuugacauuacaaacgcuuggaagaaaggagaugaaaaucggaucagaucuguugccgagaagaacaccugucgcgugguccgguucuccaagacggagaaaggccaguuuuacgacgccacaauuuaucccgcugggaagaaugauaaacuggccccugugaagggaaaagcgccgcuuaacgacaccagcaaguacggcggguacgauaaggaaacaaccgcuuauuucaugcuggugaaauccagagacaagaaaaagaaagauaagacccuccugucucucgagugcgucacaguucuggccgacaagaacuuucgcacggccgaagacaaacuuaaguacugcgagaaagaacugggccucaaggagcccgagauccugauugagaaaaucaagcugaauacccuuuucaagauuaacggaagcuaugcuuggauccggggcagaacaaaugaucggcuggugcucuguaacgccaaucagcuguggcucgacaacggguccgcgaaagaacugaagaaaaucucuaaucauuuucgcgaugugaagaaauacaacaauaaggaccuuccugucagagaagaggaguucagcaaagaacaaaaccuggcucucuaugaucuguuuaccgagaagcugggaggcaagauuuacgccgggcuucccgugcagggacagaucaaaaaucuggaaaagggccgggacaaauucgaggcccucgaacugaaggaucaacucuucguucugauggagauucuuaaauuuaugcaaugcaacuccaugacaucuaauaucaagcugauugggggcgcugagaacgccggaaagaaucgcaucagcaaacugauccaggacuccgaugugaagaugauuuucuguagcccuaccggcuauuuuugcaaagucguggacuucaagagauuucucuga

SEQ ID NO: 4195 - RNA, 4059 nt, Artificial Sequence
  Cas9 variant
augaagaaaauccugggccucgaccuggggaccacaagcauuggaugggccuucaucaaggagcccgaaaaagauguggucggcuccgagauuguugacaugggggugagaaucgugccucuuucuagcgaugaagagaacgacuuugcuaagggaaauacgauuuccaucaacgccgaucggacccugaaacgcggcgcgagacggaaucuccagcgcuucaagcaaagacggaacgcucugcuugaaaucuuuaaggagaaaaagcugauuucuacaaauuucaaauacgccgaggacgggccgagcuccaccuuuucuacacucaaccugcgcgccaaggcugccaaagaaaagaucgagcugcaggaucucgucaaggugcugcuucagauuaauaaaaagagaggauauaaaagcucccggaaggcuaaaagcgaagaggacgauggcucugccaucgacuccaugggcauugcgaaggagcuguacgaaaacgaucucacccccgggcaguggguuuaugaggcccugcaaaaaggacgcaagaaugugccugacuucuacagaagcgaucuucaggaagaguuuaagaaaaucgucaacuaucagucugaguucuuucccgacauuuucaaugcuuccuuuguggaagacuggaugggcaaggccagcacaccuaccaaacaguacuucaacaagaaagggguucaacuggcugagaauaagggaaagcgggaggaacgcagacuccaggaauauaaauggcgggccgaggcggugaacuuuaagaucgaucugucugaaaucgcccugauucucucccagaucaauagccagauuuccaacucuagcggcuaccugggggcuaucuccgaccgcagcaaagagcuuuacuucaagaaccugacggucggacaauaucucuaccagcagauuaaaaagaauccccacaccagacugaagggccaaguguucuaucggcaggauuaccuugacgaguuugaaagaaucuggucugugcaguccagcuucuauccucagcugaacgaugcccucaaacgcgagguccgggacaucacaauuuucuuccaaagacgccugaagucucagaaacaucugaucagcaauugcgaauuugaggaucaccauaagguugugccgaaaucccaccccguguuccaggaauuucggauuuggcagaaccucaauaaccugcuucugaucaagaaggacaaucucaacgagaaauucgaucuggagcuugaaucuaagauugcucuggccaaugagcucgccuuuaaaagagaacugaacgucaaggacgcucugaaaauccucggccugaagccuaaugagugggaguucaacuuuaccaaaaucgaagggaaucgcacaaaccaagcguucuuugaugccuucgcuaagauuaucgagcuugaagacggagagcccauugaccugggcgaucucaaggccgacgauauccuggaccaguucagcgaagccuuucugcggauugggaucgauaccgagcuucuccagguuaauuccgacauugagggagcugaauacgagaaacagagcuauauccaauucuggcaucugcuguacucuuccgaagaugaccagaagcucaaacugaaccuuaucagaaaguuuggcuucaaaccugagcacgccaagauucuggcgagcaucucucuccaggaugaccacgcuucccugagcucccgcgccauuaagaaaauccugccccaucuucagucugggcucauuuacgauaaggccuguacguaugcuggauacaaccacagcuccucuuuuacaaaagacgaaaaugagaagcgggagcugagagccgaacuggagcuccugaaaaagaacagccuucgcaauccggugguggaaaagauccugaaccaaaugaucaaugucgugaacgcuauucucaaagauccugagcugggccggcccgacgaaaucagaguugagauggcccgggagcugaaggcgaaugccgaacagcgcaaaaacaugaccuccaauauugcuagcgccacaagagaccaugauaaguaucgggagauccuuaaaucugaauuuggccucaagagagugaccaagaacgaccugcugcgcuacaaacucuggcuggagaccgaugggauuucccuuuauacaggaaagccuaucgaggcuagcaaacuguuuucuaaggaauacgacaucgagcacauuauccccaaagccagacucuucgaugacuccuuuagcaauaagacgauuugcgaaagacagcugaacaucgauaaagcgaaugucaccgccuucucuuuucugcaaaacaaacuuagcgcugacgaguucgaacaguaucagucccgcgucaagagccucuacggcaaacugucuaaggccaaaauucagaagcugcucauggcuaaugauaaaauccccgaggacuuuaucgccagacaacugcaggagacacgguacauuuccaagaaggccaaagaaauccuuuucgagauuagccgcagaguguccgugaccacagggaccaucacggauaagcugcgggaagacuggggacucguugagauuaugaaagaacugaacugggagaaguaugauaaacugggccuuacauacaccaucgaggggaagcacggcgaacgccugaacaagauuaaagacuggucuaagagaaaugaccaucggcaccaugcuauggaugcgcucaccguggcccugacaaaaccugcuuauauccaguaccucaacaaucugaacgccaagggacuuaauaacaaaaagggcaccgaggucuucgccaucgaacagaaguaucugaaacgcgagaaugggaagcucuguuuuauuccgcccaucgaaaacauuagaagcgaggcuaaaaagcaccugucccggauccuggugucuuacaaagccaagaauaagguugugacaauuaacaaaaauaagacgaaaagcaaggcgggacuuaacgagcaaaucgcucugaccccucgcggccagcuccauaaagaaacagucuaugggaaguccuuccacuacucuaccaaauuugagaagaucggagccagcuucaaugugcagaagauuaacacaguggccaaaaaggaagagagagaggcucugcucaaacggcuggccgaaaauggcaacgaccccaagaaagcguuuaccgggaagaacacgcuuaauaagaugccuaucuaccuggaucucggcaaaaacauuaagcuguccgagaaaguuaagaccgucgugcuggaacagaauuauacaaucagaaagaacauugaccccgaucuuaagguggacaaggucaucgaugugggaaucaaacgcauucuggagagccggcucgaagaguucggcgggaaugcuaagcuggccuuuucuaaccucgaggaaaauccgaucuggcugaacaaagagaagggaauuuccaucaaaagaguuaagauuagcggcgugucuaaugucgaaucccuucacgugaagaaagaccauuucggggagccuauccuggaucaagaaggaaacgagauucccguugacuuugugagcaccggcaauaaccaccaugucgccaucuacgaggaugaaaaugggaaccugcaggaggaagugguuucuuucuuugaggcugugguccgccagaaucaaggccucccuaucauuaagaaaaaccacacacugggauggaaguuccuuuucacccugaaacagaaugaauauuuuguguuccccuccgacgacuuugugccugccgaugucgaccucauggaugagcagaacuaccaccugaucagccccaaccucuuccggguucagaagauugcucggaaaaauuauguguuuaacaaucaucuggagacgaaggccguggacaacgaucuucugaaguccaaaaaggaacugagcaaaaucacauaccacuucuaucaaaccccggagcaucuccgcggcauuaucaagauccggauuaaucaccuggggaaaaucauucagaucggagaauacuga

SEQ ID NO: 4196 - RNA, 4059 nt, Artificial Sequence
  Cas9 variant
augaacaagaaauacuaucugggccucgacaucgggaccaauagcgugggaugggccgucacagaugagaacuacaaucuguauaaguacgcuggcaaaagaaugugggggauucggcuuuucgaagccgcggacacggcugccgagcgcagaaugaagcgguccaaccgcagacggcugucucgcaaaaagcagagaaucgaucuccugcaagaacuuuuuagcgaggaaauuguuaagaaagaccugaccuucuuuauccggcucaaugagucccgccugcacuucgaggauaagucuacaggagaaaaauauccccuguuuguggacaaggaguacaccgauauugacuaucauaaacaguacccuacaauguaccaccucagaaaggaacugaucgagaacccggagccccaugauauccggcuuguguaucuggccugccaccauauucucaagaaucgcggccacuuccugaucaacgggagcauuuccgacgucaaaaaucuuucuuuuguguguggagaaaugaucaaggaguucaacagcguuuccgaauacgagauuagccugaccgauaucagagaacucgagcggauucugucugacaaaaagacagcuaaauccgugaaggccaaacaggucgcucagcuguuugagugcaccccugccgaagauaaggagcaacagaagugugcgaaagccaucaucacgaaucucagcaagcugauugugggccuuaaaggcaacaucucuaagauguuccaccagccccuggaagagauuuccaccaagagcuuuaaguucacagaagcuaaguaugaggacgagaucaugccugccauugaagagaauuaccccgacuaugcuucuguuaucgaucgcaucaaagggguguacgacugguccguccucguggaaauucuggauggagaggacuaucuuagcuuugccaaggugaaagcguacgaaaagcauggcaaaaaccugcacauccucaagaaugucaugaagaaauacugcaaggaugagguuuaucaggccuucuucaacgggauuaacgagaaaaauggauacggcaacuauaucggggcuauuagaaagaauggacauaccuacaaaauggaccgguguaaguccgaagaggauuuuuauaagggccugcagaaaauccugucuacaaucgugccugaccaggaagaugaggagcuccuggaaaaacuuaaagccgagguggaaaaccagacccugcucccgcuggcuagaagcaaggagaauggcacgauucccaaccagguccaccuucaagaacugaugaaaauccucgacaaugccaaggaguaccuggauuuccugaaaaaggaggacgaauaugggacaauugccgagaagaucauuuccaucgcuaaauuucgcauuccuuacuacgugggaccccucagccggagacacaaggaagagggcucuaacuccuggaugauccgcaaagaagaggggcggaucuauccuuggaauuucggagacaagguugauguggagcagagcaacaaagaauuuauugagagaaugaccaauaagugcacauaccugaucggcgaagacguccuucccaagaacucucugcucuauagcaaauacauggugcugaaugagcugaacaaucuuaagauucgcgggaacaaaaucuccguugaacucaagcagcggauuuauaaagaucuguucuguaccauggcgaaggugaccggaaagagaauccuggaguaccucaaaauggaggacccggaaaucguccaagaggauauuucuggcuuugacaucgauuucaagagcgcccuggcuuccuaucuugacuuuaaaaagcaaguggucggcaacgaaauugagaaagaucauuacaaggagaucauugaagagaucaucaaguggaaaacaauuuacgacgaugacagcaagaugaugcgccggaugaucgaaagagaguauccugaaguguucgauaaagagcagauuaagaaaaucugccagcugaaguacucuggguggggaaauuuuuccgaccgcuuccucaacggcguuagaggggccgacaaagagacggaagagagcuauaccauuaucgaagcccuguggaagacaaauuacaaccugaugcaacuucucucuaagcaguuuuccuucaaagaggaaaucgaucagauuaaugcugagaaggccggagacgugggcaaaaucaacuaugagaauaccgucaaggaucugauugugagccccuccaacaaacgggcgaucuggcagacaauucaaaucgcugaagagauuaagaagguuaugaaaugugaaccugagcggaucuucaucgaaauggcccgcgggggcgagaaggagaaaaagagaaccgugucucggaaaacgagacugcaggaacucuacgccggaugcaaggacgauacacgcaauuggaugaaggagauuggcgaccgggaagagagagaguuuaacagccgcaaacuguaucuuuacuacacccagauggggaaguguauguauaccggagaugaaaucgacgucgaugcucugaugaaaggcaauuccaacugggacauugaucacaucuacccccagucuagaauuaaggacgauagccucgacaauauggugcuggugcggaaagacguuaacaauaagaagcgcaacaaaauccugucccccaagaucagagaggauaugaaaggguauuggacaaugcuuugccaaaagggacucauuagcaaacggaaguacgaccgccugaccagaacaacggauuucaccgacgaggaacugucuggcuuuaucgaacggcagcucgucgagacacgccaguccagcaaggccguggcugagcugcuuaacagacuguauaaagauucugaaguggucuacgugaaggccgggcucguuuccgacuuccggcaugauaaugaccugcugaaaagccgcagagugaacgauuaucaccaugcgaaggacgccuuucuuaauauugucgugggcaacguuuaccacgugcgguucaccucuaauccuagaaaauggaucaaggauaaccgcgacagcaauuacuccauucggagagucuuuaacuaugacgugaaacagggagauaagaucguuuggcacggcagcgagaaugggggacauucuaucgaccaaauuaagaaaaucaugucccgcaacgauauucucuacacagaauauaccuacugcgagaagggccagcuguucaaugaaacgcuggcuaaaaaggggaacgagaaagccaucgcucucaagaagaaucuggacccggugaaauauggaggcuacaccacacccaagaccagcgccuuugcguucgucgaguuugaugggaaaaagaaagaacggaagaaccacauuguggagaucccuguguaugucguuaauauugccaagagagaacccgacgcugugaaaaaguaccuugaggaacgcaaaggcuacuccaacguggucaucaagaaauauccuaucaagaagaacucucugauuaaaauggauggauaccucgcccggcugagaggcgcuaaugagaaggacaucauucugaaaaacgccgugcagcuuauccugaauaaggaucucuaugagauuguucgcaaaaucgaaaaguaccuggaguauaaccuccaauaccaggccgacgcuaaauucgaaggguuuacaaugaaggaucugaauaugaucuaugaggagcuuuaccugaagcucaaagaaagcauuuuccagaagcggcccgcgcagcaaaugaaaacccuggagaagggaaaagaagccuucaucuccauugagaaccugggcgaaaaggcuaaggugaucaaugagauuaucgccauguuuagaugugacgccacgacagucgcuaaccuuaaagugaucaaugggucucagaacgccggaagcaugaagguuaauaaaaacacccugacauccaagucucucaaacuggugcaucagagcauuaccggccucuucgagaccgaagaggaacuggucuga

SEQ ID NO: 4197 - RNA, 4062 nt, Artificial Sequence
  Cas9 variant
augaagaaaaaguacuaucugggccucgacaucgggaccaacagcgugggaugggccgucacagaugagaauuacaaccugugcaaauucaauggcaagaaaaugugggggauuagacuuuuugaagacgcuaagacggccgcggagcggcgcaccaagagauccaaccggcgcagaaucgcucggacaaaacagcgcauugaucugcuccaagaacugugugagaagucuaucuucgaaaaagaccccaccuuuuucauuagacuuaaugagagcucccugcaccucgaggauaagucuacaggagaaaaauauccucuguuuguugacaaggaguacaccgauaucgacuaucaucgggaauacccgacaguguaucaucugcgcaaggagcucaucgagaaccccgaaccucacgaucccagacugguguaccuugccugcugucacauuaucaaaagccggggccauuuccuggucaauggguccauuucugacgccaaggaucucagcuuuaucugcgagaacaugauuaauuccuucaacgcugccagcgacuacaaaaucaauauucaggauaugaccgcucuggaaacgauccuuaccgaccgcaagauggccaaaucugugaaggcgaaacagaucguucagcuguuuaaguguauuccuugcgaggacaaggaacaacagaaauguugcaaggccaucauuacaaaccucuccaaacugaucgugggacugaagggcgauauuagcaaaaucuucaaugagucuuuugaggaaaucaaguccuucaaguuugcugagaccaaauaugaagacgagauucuccccacaauggaagagaucuacccugaucacgccgagauuaucgaaaagauuaaaagcaucuaugacuggucuauccuggaugagauucuugacggcgaagaguaccuguccuucgcuaaggucaaagccuaugaaaagcacaagaaaaaccuccaugaucugaagauccuuauuaaaaaguacugugacgaugagaccuaucagagcuucuuuaaugggaugaacgagaaaaacaaguacuccaauuacaucggaucuauuagaaagaacggccacacguauaaaguggaaaagugcaaaagcuccgaggacuucuacaaggaacugcucaaacugcugagcucuguuaauccggggcaggaggaugagucccuccuggaacaaaucaaguuugagacagaaaaccagacccuucugccccuccugcggacaaaagagaauggaaccauuccuaaccaggugcauaugcaggaacuuaucaagauccuggacaaugcgagcaaguaucucgacuuccugaacgagaaagaugaguacggcaccacagccgacaagauuaucucuauugcuaaauuuaagauccccuauuacgucgggccucugagcgaucgccacaaagaaaauggauccaacucuuggauggugagaaaggagaauggccggauuuaucccuggaacuucgacgauaagguggacgccgaaaagagcaauaaggaguuuauccaaagaaugacgaacaaauguaccuaccucaucggcgaagauguccugccgaaaaauucccuucuguacagccgcuauaugguucucaacgagcugaacaaucugaaaauucgggggaacaagaucucuguggagcuuaagcagcagauuuacaaugaccucuucugcacaaaagcuagagugaccggaaagaacauccugaauuaucugaaaaaggaagauccugagcucgccgccgaagaccuguccggcuuugaugucgacuucaaaagcgcucuuacaucuuaccuggauuuuaagaagcaagugguugggaacgagauugaaaaagacuauuacaaggagaucaucgaggaaauuaucaaauggaagaccauuuauaaugaggacuccaaaaugaugaagcgcaugaucggacgggaauaccccgagacgcucaaccaggaucagauuaaaaagaucugccaccugaaguacaauggcugggggaacuucagcgagacauuucugaauggaaucaaaggcgcgaacaaggaaaccggcgaguguuauaccauuaucgaagcccuuuggaaaacaaauuacaaccucaugcagcugcuguccaagcaauucucuuucaaagaggaaauugaccagaucaaugcugagaagaccggggccauuggaaagaucacauaugagaaccucgugaaagaucuggucgugagcccugccaacaagagagcuauuuggcagacgauccagaucaccgaagagauuaaaaagguuaugaaaugcgaacccgagcgcaucuuuauugaaauggcccggggcggggagaaggagaagaaaagaacagugucccgcaagacccggcuucaagaacuguacacaggauguaaagacgauaccagagacuggaugaaggagaucggcgaucgcgaagaacgggaguucucuagcagaaaacucuaucuguacuauacgcagauggggaagugcauguacaccggcgaggagauugacgucgaucugcuuaugacagcuaauuccaagugggacaucgaucauaucuacccccagagccggauuaaagacgauucuuuugacaacauggugcucguccgcaaggacaucaauaacaaugugaaaggaaacaauauuguuccuuccagcauccagaaggaaaugaccucuuauuggaaaaugcugcugcaaaaggagcucauuuccaagaaaaaguacgaaagacugacacggagcaccgauuucacggacgaggagcuuucuggcuuuaucgaaagacagcugguggagacacgccagagcuccaaagcggucgccgcccuccugaaccggcuguauaagaauagcgaaaucguguacguuaaagcugggcuugugucugauuucagacacgacaacaagcuccugaaaucccgcagaauuaaugauuaucaucacgccaaggacgcuuuucugaacaucgucgugggaaauuguuaccggaccaaguucacagccaacccgcgccaguggauuaaaaagaauagagauaccaacuauagcauccggcgcguguuugacuucgauauuaaacaaggcgacaagaucguuugguacgggaacaaaaaugagaacggaaagcauaccauugaucagaucaagaaagcgauguccagaaaugacauccucuacacagaauauacguacugcgagaagggcaaacuguuugacgagacccuuacaaagaaagggaacaagaaggccauuccccugaaaaagaaucucgauccucugaaauauggcggauacaccucugucaagacaagcgcuuucgccuuuaucgaguucgacgauaaaaagaaggaacggaaaaaccacauuguggaaauccccauuuauguggcuaauaucgccaagcgcgagccugaagcggucaucaaauaccuggaggagcagaagggcuaugugaacauuguugugaaaaaguaccccaucaaaaagaacucccuucugaagauugacggguaccucgccagacugcggggaggcgauucuagcaucauuacccucaaaaaugcuguccaacuggugcuugacaagaaauccuaugaaaucauccgcaagguugagaaauaccuggaucacaauucuaaguaugaagccaacagcaagcucgagaaauucaaugaaaacgaccugaauauuaucuacaacgagcugugucuuaagcugagaaauuccauuuaucagaaacggccggugcaucagcucgagacgcuggaacaggggaucgauaacuuuagaagccucgagucucugaaggacaaagcuaagauuaucaacgaacuucuggccauguuccgcugcgaugccaagacaggaauggaccuccggcugauuggcggggcuuccaauagcggcagaaugcgcaucucuaaaucccggcugaccagcaagucucuuaaacugaucaaccaauccgucaccggacucuuugagacagaggaggaacugguguga

SEQ ID NO: 4198 - RNA, 4062 nt, Artificial Sequence
  Cas9 variant
auggagaagaacuacuaucugggccucgacauggggaccagcuccgugggaugggccgucacagaugaaaauuacaaccugaugagaaagaagggcaaagaccuuuggggaguucggcuguucaaggaggcuaaaacgucugccgaacgcagagugaagcggaccagccgcagacggcuccagcgcgagaaggcgagaaucggguaucugaaagaacuuuuugcugaugagauuaauaagguggacgccggcuucuaccaacggauggaggauuccaaauuuaucucugacgauaagacaguccaccagaaauucacccuguuuagcgacacaaacuauaccgaugaagacuacuauaaugauuaccccacaauuuuccaucuccgcaagaagcugaucgaguccgacgaugaauacgacgugagaaugguuuuucuggcccuccugaacauguauaaacaccgggggcauuuccuuaaugcuaaccugucugacaauggaaugggcgauauuaacgagcaguacgaccgccucaaggagcugugcagcgaauaucuuaauguggagugggaaaacaaaccugauaaguuugaggaaauccugaaagaguguaauugcuccaacagccucagaaaugagcggcugcuggaaaccuucaaccucaagaaaacggacaaggagaagugugaaaugcugaaacuuaucugcggccugucugggacccucuccaagauuuuuaaagaucuggacgaugacagcgagacaaagaaaaugaccaucucuuuccgcuccagcaacuacgaugaagaggccauuaaugucgaggaaaucauuggaucugagaacuuugaaaucauugcugugcuuaaggagauccacgacugguccaugcuggccaauaucaugagaggcaagaaauaucucagcguugcgcggguggaagaguacgagaagcauaaagaugaccugaagauucugaaaaaggucaucaaggaauauuccauugaggaauacaacaauuucuucagagugauggccgacaacaauuacucugcuuaugugaacagcgucaauuccaacaaagagagcacacgcagaggggccaagugugauaaugacaccuuuuucaaagagaucaagaaaauuguuaacaagugcuacgauucugaagagaaggaauauauccucaaagagaucgaaaagggaacguuucugccgaaacagauuaucuccagcaauggcgugauucccaaccaagugcacaagaucgagaugaaaaagauucuucagaaugcugagaaauaccugccuuuccucacagaaaaggacgauucugggcugagcgucuccgagagaauccuucagauguuuucuuuccagauccccuauuacauuggaccuaucagcggcaagauuggcuccgacgagaaaagcaagaacucuugguccgugcgcaaagagaaggggcggaucuaucccuggaacuuuaaagauaagauugacgaaaaggagagcgccgagaaauucaucgaaagaaugguuaaucacuguaccuaccugaacaaugagauggugcucccuaagaacucucugcuguacgaaaaauuuaugguccucaaugagcugaacaaucuuaagauuaacaaugaaaacaucuccguggagcugaaacaaagccucuauaauaaccuguucaagacaggaaagaaaguuaccgcgaagggcaucaaauccuaccuggagcgcaaugggcuuugcgaaccgaacgaggauauuaaucucaccggaaucgacggcgauuuuacaaaccggcugucuaacuaugccaaguucaaagggauuuuuaauacggacgaacugaccuacgagcaguggaacauggcugagaagaucauuaaguggagcacaaucuauggagauuccaaaaaguuccucgaagagaaaaucagaaaugaauacucugagaagcuggacagccagcagauuaaacgcauccuuggcauuaaguuccgggacuggggcagacuguccgaagaacuccugaacauggagggggccgaugugaauaccggagaaaucaaaagcgucauuggccgcaugugggacgagaacuauaaucugauggaacuuaucgcuacagauaacuuuaccuacaagcaagugaucaaggagaaacagaaugggcucgacaagucucuguccgaaauugauuacgacgaucuggacgagcucuaugucagcgcccccgugaaacggaugaucuggcagacgcugcuuauuaucaaggagcugguuucugugauuggauacgaaccuacaagagucuucguggagauggccaaagauguuaacaccgaaaagaagcggaccgacucccgcaaaaagaaauuucucgaucuguauaagcaaugugagaaagacgaaagagauuucuggaucaaggagaucgacgacaagagcgaggcugaauuucggaaaaagaaacuguaccuuuauuacacacagaagggcagaugcauguauaccggggagcagauuaauccccucgaucugacaaacgacaaucuguacgauaucgaccauauuuacccucgccacuucgugaaagaugacucuaucgaaaacaaucucguccuggugaagaaggagaaaaacgcgcauaagagcgauacguuucccauugaggacgauauccggaaaaaccaguaugccuucuggaagaugcuuuacgagaaaaauuuuauuaccaaggugaaguaucaaagacugacacgcaaagagccguucuccgacgaagagaaggcuaacuuuaucaugagacagaucguugaaacccggcagggcacaaaagucauuaccgauauccucgaaaagagcuucgacaaaacgcagauuguguacgugaaggccggaaaugucucucuguuucgccaaaaauaugaguguaucaagugcagagaaauuaacgacuuccaccacgccaaugaugcuuaccugaacaucgugguuggcaauguguaugacaccaaguucacauccgauccucggaacuuuaucaaagaguaccgcaagaauccccagaaaaacgaauaccauauguauaaacuuuucgacuacaauguccagagaggggaucggguggccuggaccgcgagcaacggagaguccaugaaaguugugaagggcacacucaagaaaaauaccccucuggucacguuuaugucuuaugaggaacacgggggacuguacgaccagaacauuaucagcgcuaaggauauugagaaagugaagggcaaaggguaucuccccaucaaguccucugacagccgccugaauaacacagaaaaguacggcggauaugccaaaguuuccggcgccuacuucuuuguggucgagcauaccgugaagaaugugcggauucggacaaucgaacccaugccuugcuaccuuaccaaaguccugaccacaaaggagaaaaucgaagauuauuguugcaacauucucaaguacgacucuccgguugugaaguaugagaaaaucaagauguacagccugauuaaagugaacggguaucccauguaccugacgggacgcaccggcaaucaacuuaucgucuccaacgggauucagcuggugcucagcuaugaugaggcuaaguacaucaaagaccugcucaagauuaaucaggaagaguucgaucagaacagacuggaaaaucuuggaaucaacaaauuucggaaugagaagcuguacgacacacucaacaagaaauauaccaaugagaucuacaagaaaagaccuaacucuaugggcaauaagaugauugaauggaaaaacacauuccaaaaucuguccaucaaggaccagaccgagguucugcuucagcugauucaacucgggcagaagcagaacagcggcgugaaucuggaaaaacucggagccucuaagaaaacgggcgucucccuggugagcaagaaaaucacagauaaggagucuuuugaacuuauuaacaaguccaucaccgggcuguaugagaacaaaguugaccuccugcgcguguga

SEQ ID NO: 4199 - RNA, 4062 nt, Artificial Sequence
  Cas9 variant
auggccgcuuucaaguacuaucugggccucgacauggggaccaacagcgugggaugggccgucacagaucccaauuacaaccugcuuaaagcgaagggcaaagaccugugggggaucagagaguuuaaugaagcuagcacggccguugagcggcgcacccacagaauuucucggcgcagacggcagcgcgaacaagugagaaucggacuccugaaggauuauuuccaugacgccauuggcgagguggauccugacuuuuuccagcggcuugcuaacagcaaauaccaccuggaagauaaggacacagagguccgcuauaagaauaacguguuuaaugaugacgauuacaccgacaaagauuauuucgaccaguacccgacaaucuaccaucucagaaaggagcugauugaauccaccgacaaacacgauguucggcugguguuucucgcccugcuuaacauguucaagcaucgcgggcacuuucucaauucuggacugggcgagaacagcggcgaaaauaacaucaauaacgcuuaucuggagcuuacaaaucugcucuccgaguucacccaguacaaccugaacgaaacgaucgacgggaaaaagauugaggauauccugucuagacgggacaugagccgcaccagaaaggccgaaggacucgcggagauucugggcgucgauuauaaaaauaagcccuacaaagaacuuauccgggggcugugcggacucaaguuuaacgccugugcuauuuucccugagauccaauccgacgaggugcccaaacuggauauuugccuuagcgaagccucuuuugacgagaaguccgaugaaaucgcuaauauccugggcgaggacuauuucgaaauuaucauggccaugaaagauauuuacgacaucgggagccucgcgggaauuaugaagggccacaacuaucugucucaggccagaguuacauccuacgagaagcauaaagaggaccugcgccuccugaagaaugugauccggaaauacuguagcaaggaagauuaugacaacuucuuuaauucugaggcugauggcuccuacgccagcuaugucggguccuacaacucuaaaaccaagcagagacgcgugggaaauaagcggagcuccgaggaacuuuauaaagcuaucaagaaaauucugaagaacgugccugccgaagacgccgauguccagagaauccucaugagcauugagaaugagacauuccugcccaaacaacuuaccgcuucuaacggcguuaucccuaaucaggugcacgcgaaggaaauuaagaaaauccuguccaacgccgagcgcuaccucccguuucugcgggaaaaggacgagacggggcugagcgugucugagaaaaucaugaaacucuucagcuuucagauucccuauuacgucggaccuacaaccgaaaaauccucuaaggauggcgggaauggaugggugguuagaaaggaggaaggccaggugcugcccuggaacaucgacgagaaaauugauaugaaggcuacaagcgaagccuucaucucccgcaugguccggagaugcaccuacauuagcggcgagccugugcuucccaaaucuucccuggaguaucaauccuuuuguguucucaacgaaaucaauaacauuaagaucgacggggagcgcaucucuguggaacugaaacaggauauuuacaaggaggucuuccagaaaggaaagcgggugaccaagaaacaacugugcaaguaucuucauacaagaggcaucauugaagccgaggagcaggucacggggaucgacgugaccauuaauaacgcucucacaaccuacggaaaauuuaaggccauccugggcgaugacaucuccaaagacagcguucagaagaugguggaaaauauugucuucugguguacaguguauggggauuccaagaaauuucugaaggaccggaucgaggaaaaauacggcgagaagcucaccaaagaacagauuaagcgcaucguuggauucaaguuuaaagauuggggcaaccugucuaagaauuuccuugagcugagcggggcggacguguccacgggagagucugucagcauuaucagagcucucuggaacaauaaccugaaucugauggaacuuaucaacucccggcucuauaauuacaaagagagacuggccgaauaccaaaacacaaugaugaagacccugagcgauauugaggccgaggaccucgaugaauauuacuucucugcuccggugaaacgcaugaucuggcagaccauucugaucauuaaggagcuugugaagguucugggcugcgaaccugaccggaucuuugucgagaugacaagacgccccgaugaaagaaaaaugcggaccgagucccgcagaaagaaauucgaggaacucuauaagaaagugaaggacgaggauguggacuggaugaaagucaucgcccacgcugaugaaacagggagcauucggucuaagaagauguaccuguaucugacgcagaaaggacgcuguauguacaccggcaagcacaucgagcuuuccgaccucuuuaauaacaaccuguaugacauugaucauguguacccuagacacuucguuaaagacgauaauaucgacaacaaucuggugcucgucugcaaggaaaagaacgcccauaagagcgauauuuacccccuggaggacgagauccuugcgucucagaagaauauguggagcgaacugcggcgcuccggguuuauuacagaggaaaaauauaacagacucaucggccggaauagcuucaccgaugagcaaaaggccggauuuaucgcucgccagcugguggaaacaucucagggcaccaaagggguugccaacauucugcagcaacuucuccccgaguccaagaucguguacgcuaaagccagcaaugucuccgaguucagaaacacgcgggacauuccuaagucuagacugaucaaugaauuucaccaugcgcacgaugccuaucugaacauugugguuggaaauguguacuaugucaaguucacccagaacccgcucaauuuuaucaaaaacgacuacgaucgcgacaagaccaaaaacaauuauaaccugagcaagauguucgacugggauguggagcggaauggcgaaguggcuuggaucgcccagaaaaaggacggggaggcuggaaccauugccacagucaagaaaguucuuggcagaaacacaccccugaugacgcgcuacuccuuugaggggaagggcggacucacaaaugaaacccuguacucugccaaaaaggcuaaagaggaaggcuauaucccuuucaagagcuccgaugagaagaugaaagacgugacaaaguacgggggauucaccucugugaccggcgcguacuuuuuccuggucgaacacacagagaaaaagaaacggagcagaaugauugaguccgugccccuuuaucuggcccagaagaucgaacaaaacccucaugagcucgaaaaauauugugagcagguucuggggcucauugauuuugacauccgcgugcggaagaucaagauuggaagccugaucaaaagaaagggcuacuucuuuuauauuacggggaaaaccggccaccgccuuauccugcggaaugcugucaacaugugccucaagaaagaaugggugaaguacauuucuaagcuggagaaagccguugauaagaauaacguggagggaaucauuacaaaagaaaagaaugagcugcuuuacuccgaacugaucgagaaauucaagaacagcaucuuuucuaauagacccaacccggucggcgacaagcucgaugaagccaaagagaaguucauuaaucuggacaucgagaaacagugcauugugcucugucaaauccugcagcuuuccagcguucuggggucugaaugcgauaugacccuccugggagaguccgcucauuguggcaagauucugaucagcaaaaagaucggggacgaagauauuuaucuuaucaaccaguccgugacaggacuguacgagaagaaaauuaaucuccggaccgucuga

SEQ ID NO: 4200 - RNA, 4065 nt, Artificial Sequence
  Cas9 variant
augaagaaaauccugggccucgaccuggggaccaacagcauuggaugggccuucaucaaugaggcugaaaacgagauugaaguguccucuaucgucaauacaggcguuagaauugugccccuuacgaccgaugaggaaagcgacuuuaagaaagggaacacaaucuccaucaaugccgaucggacccugaagcgcggagcgagacggggccuccagcgcuucaaacaaagacgggaggcucugcuugagacauuuaaccgcauuaaguucaucgccaccgacuuuguguacgccgaaacaggggcugccaccacguucucuagcuaucagcugagagcuaaguccgccgucgaggcggugaccaaagaagaacucguuaaggugcugcugaugcucaauaaaaagcggggauacaaaucuagccgcaaggccaagacagcugaggaaggcgaugccauugacggcaugaaaaucgcuaaggagauuuuugaaaacaaucugaccccugggcagugggucuauaacucccuuagcaaaggaggcaaguucaucccggauuuuuaccacucugaccugcagaaagagcucgaaaagauugugagauuccaaaaucaguuucauuccgagcagaucaacgauaaacugcuugccgacauccaggggaaaagccggacacaaaccucucagcacuucuccaagacgcugaauauuccccucgcggagaacaaaggaacacgcgaagagaccaagcugcagcauuaucaguggagaaaugaagcccuggcuaacgagcucgauaugaaaauccuggccuuuauuaucacagaaauuaacaaucaaaucaaccagagcucuggcuaccuuggggcuaucuccgaccggagcaaggagcuguauuucaaucaggagaccguuggacaauaccaguacaaacagcuccaggaaaacgugcacgccaagcugaagaaucaagucuucuaucgccaggauuaccuugacgaguuugagaaaauuugggagacccaggccaaguuccauuccgaacugaacgagaaacucaaggcugagaucagagacauuacaaucuuuuaucagcggaaacugaagucucaaaagcaccuggugagcuucugcgaauuugagaaaggccacaaggcgauuccuaaauccagcccccucuuccaggaauuuagaaucuggcagaaucugaacaauguggucguuaagaacgagacgaccaaagagguguucgaacuuucugaggaacugaagcagcucaucgccgaggaacugcaauuuaaggaguccaugacagaugugcagaugcuuaccuucugugagcugaaaaagggcacacauaccgucaauuuuaaaaagauugaagggaaccgcacgaauacaagcaucuacaaggcuuucgagaagauucucgaaguggagggauaugaaaucgacuuuucuaaaaugaagccucuggagauuaaggagaccguugcccccaucuucgaaacccugaacauuaauacagugauccucgauuucgacccuaccauccagggcaacgauuuugacaaacagccguacuaucaacuguggcaccuucuguacagcgccgaggaugacgauaagcucaaagaaacacugaagacgaaauucggguuuaaggagaaccaucugcccuucauucuuaauaucaaccuccaggcugacuacggaucccugucugccaaggcgauuaaaaagauccugccucaccucauggauggccacauuuaugacaaggcuugccugauggucggguacaaucauagcuccagccuuaccacagcccagaacaaugaccgggugcugaaggauacccucgaacugcugaaaaagaacucucuuagaaaucccguuguggagaagauccucaaccaaaugaucaaugucauuaacgccaucaugaaagacccugcuaugggaaagcccgaugagauucgcguggaacuggcccgggagcugaaagcuaauaacgaacagagaaagaaagccacauccgacaucaauaccgcgacgaccgagcacgagcgcauucggaagcuccugcauagcgaauuuaacaucccgagagucacacgcaaugauaucauucgguauaaacuuuggcuggagaccggcggcaucucucucuacacagggaacccuauuaaagccuccgaccuguucagcaagaacuaugauaucgaacacauuauccccaaauccagacuguuugacgauucuuucagcaauaagacccuuugugagcgccagcucaacaucgacaaauccaauaagacggcuuacucuuuucugcaggaaaaacugagcgagaacgauuucgccgcuuaugagaaucgggugaaggaccucuuuaagacaggaaaaauuaaguccuacaccaaauacaagaaacugcuuauggccgauaacgaaaucccugagggcuucauugacagacaacugcgggaaacacaguauaucgcgaagaaggccaaagagauucuccuggaaguuagccgcaaugugaccgcuaccaucgggucugucacagacaagcugagacaggauugggagcuuguggacguuaugaaagagcucaacugggaaaaguacgauaaacugggacugacgcauauugaggaaggcaagaauggggagcggcucuccaagaucaaagacuggaccaagagaaacgaucaccgccaccaugccauggacgcuaucacaguggccuuuaccaaacccgccuauauucaguaccugaauaaccuuaaugcuaagacacaaggcgaaaacaaagcgaauagcaucauuggaaucgagaacaagcaccuguaucgggauaagaacaauaaacucagauucauuucucccaugaagaacuuccgcgaggaagccaaaaagcagcuggaguccauccugaucagcuacaaagcuaagaauaaggucgugaccaaaaacaagaauacgaccaaaaagucuggcgggacaaaccagaaaauucagcuuaccccuagaggacggcugcauaaggaaacaguguauggcaaacuccaacaguacgccaccaaggaggagaagguuaaugccagcuuuacagaagacuacauccagaaagucgcuaagaaagaguaucgcgaagcccugcucaagagacuggaggaaaacgauaaugacccgaaaaaggcguucacggggaagaacgcucuuaauaaaacccccauuuacaucucccugaaggauaacauuaucgugccugagaaagugaagacagucuggcucgagaccgacuauacaauccggaaagauauuacccccgaccugaagaucgacaaggugauugauguuggaaucaaacgcauucugcaaaauagacuuaacgaauuuaauggcgacccuaagaaagccuucgugaaccugggggagagccccaucuggcucaauaaggaaaaaggcauugccaucaagcgggucacgaucucuggaguguccaacgcucaggcccugcacaccaagaaagaucaccucggcaacgagauucuggacaagaaugggaacccgaucccuguugauuuuauuagcacaggaaauaaccaucacguggcgaucuaccgcgacgaaaaaggcaaucuucaggaggaggucguguccuucuaugaugcuguuauuagacggaaccuggggcucucugugaucaauaagaaccaugaaaaaggaugggaguuucuguucagcaugaagcagaaugaauuuuucaucuuucccuccgacggcuucaacccucacgagauugaucugcuuaaucccaacaauuaccaucugaucucuccuaacauuuuccgcguccagaaaaucagcaccaagaauuauauguuuaaccaccaccucgaaacaaaggccguggacggggagaugcugaaauccaagaaagagcucucuaagaccagcuaccauuucauucaaacacccaccaaccugaauggcaucaucaaagugagaauuaaccaccuuggaaagaucguccaucugggcgaauacuga

SEQ ID NO: 4201 - RNA, 4065 nt, Artificial Sequence
  Cas9 variant
augaagaaaauccugggccucgaccuggggaccaacagcauuggaugggccuucaucaaugaggcugaaaacgagauugaaguguccucuaucgucaauacaggcguuagaauugugccccuuacgaccgaugaggaaagcgacuuuaagaaagggaacacaaucuccaucaaugccgaucggacccugaagcgcggagcgagacggggccuccagcgcuucaaacaaagacgggaggcucugcuugagacauuuaaccgcauuaaguucaucgccaccgacuuuguguacgccgaaacaggggcugccaccacguucucuagcuaucagcugagagcuaaguccgccgucgaggcggugaccaaagaagaacucguuaaggugcugcugaugcucaauaaaaagcggggauacaaaucuagccgcaaggccaagacagcugaggaaggcgaugccauugacggcaugaaaaucgcuaaggagauuuuugaaaacaaucugaccccugggcagugggucuauaacucccuuagcaaaggaggcaaguucaucccggauuuuuaccacucugaccugcagaaagagcucgaaaagauugugagauuccaaaaucaguuucauuccgagcagaucaacgauaaacugcuugccgacauccaggggaaaagccggacacaaaccucucagcacuucuccaagacgcugaauauuccccucgcggagaacaaaggaacacgcgaagagaccaagcugcagcauuaucaguggagaaaugaagcccuggcuaacgagcucgauaugaaaauccuggccuuuauuaucacagaaauuaacaaucaaaucaaccagagcucuggcuaccuuggggcuaucuccgaccggagcaaggagcuguauuucaaucaggagaccguuggacaauaccaguacaaacagcuccaggaaaacgugcacgccaagcugaagaaucaagucuucuaucgccaggauuaccuugacgaguuugagaaaauuugggagacccaggccaaguuccauuccgaacugaacgagaaacucaaggcugagaucagagacauuacaaucuuuuaucagcggaaacugaagucucaaaagcaccuggugagcuucugcgaauuugagaaaggccacaaggcgauuccuaaauccagcccccucuuccaggaauuuagaaucuggcagaaucugaacaauguggucguuaagaacgagacgaccaaagagguguucgaacuuucugaggaacugaagcagcucaucgccgaggaacugcaauuuaaggaguccaugacagaugugcagaugcuuaccuucugugagcugaaaaagggcacacauaccgucaauuuuaaaaagauugaagggaaccgcacgaauacaugcaucuacaaggcuuucgagaagauucucgaaguggagggauaugaaauggacuuuagcaaaaugaagccucuggagaucaaggagaccguugcccccauuuucgaaacccugaacaucaauacagugauucucgauuucgacccuucuauccagggcaacgauuuugacaaacagccguacuaucaacuguggcaccuucuguacagcgccgaggaugacgauaagcucaaagaaacccugaagacaaaauucggguuuaaggagaaccaucugcccuuccuucucaauaucaaccugcaggcugacuacggaucccugucugccaaggcgauuaaaaagauccucccucaccugauggauggccacauuuaugacaaggcuugucuuauggucggguacaaucauagcuccagccugacgaccgcccagaacaaugaccgggugcucaaggauacacuggaacugcuuaaaaagaacucucucagaaaucccguuguggagaagauccugaaccaaaugauuaaugucaucaacgccaucaugaaagacccugcuaugggaaagcccgaugagauucgcguggaacuggcccgggagcucaaagcuaauaacgaacagagaaagaaagccaccuccgacaucaauacagcgaccacggagcacgagcgcauucggaagcugcuucauagcgaauuuaacaucccgagagucacccgcaaugauauuauccgguauaagcuguggcucgagacaggcggcaucucucuguacaccgggaacccuauuaaaggauccgaccuguucagcaaggauuaugacaucgaacacauuauccccaaauccagacuuuuugaugacucuuucagcaacaagacacucugcgagcgccagcugaauauugauaaauccaacaagaccgccuacucuuuucugcaggaaaaacucagcgagaaugacuucgcugccuaugagaaccgggugaaggaucuguuuaagacgggcaaaaucaaguccuacacaaaauacaagaaacuucugauggcugacaaugaaaucccugagggguucauugacagacaacuccgggaaacccaguauaucgccaagaaggcgaaagagauucugcuggaaguuagccgcaacgugacagccaccaucggaucugucaccgauaaacuuagagaggacugggagcucguggauguuaugaaagaacugaauugggagaaguacgacaaacugggccucacacauauugaagaggggaagaacggcgaacggcuguccaagaucaaagauuggacgaagagaaaugaccaccgccaccaugcuauggaugccauuaccguggcuuuuacaaaacccgccuauauccaguaccuuaacaaucugaacgccaagacccagggagagaauaaagcuaacagcaucauuggcaucgagaauaagcaccucuaucgggacaagaacaacaaacugagauucauuucucccaugaagaauuuccgcgaagaggcgaaaaagcaacuggaauccauccuuauuagcuacaaagccaagaacaaggucgugaccaaaaauaagaacacaacgaaaaagucugggggaacaaaucagaaaauccagcugaccccuagaggccggcuccauaaggagaccguguaugggaaacugcagcaauacgcuacaaaggaggaaaagguuaacgccagcuuuaccgaggauuacauccagaaagucgccaagaaagaauaucgcgaggcucuccugaagagacuugaagagaaugacaacgauccgaaaaaggccuucacaggaaagaaugcgcugaacaaaacgcccauuuacaucucccucaaggacaauauuaucgugccugagaaagugaagaccgucuggcuggaaacagauuauaccauucggaaagacaucacacccgaccugaagaucgauaaggugauugacguuggcaucaaacgcauucuucagaacagacugaaugaguuuaacggggauccuaagaaggcuuucgugaaucucggcgaaagccccaucuggcugaacaaagagaaaggaauugccaucaagcgggucaccauuucuggcguguccaaugcccaagcucuccacacgaagaaagaccaccuggggaacgaaauccuugauaagaacggaaauccgaucccuguugacuuuauuagcaccggcaacaaucaucacguggccaucuaccgcgaugagaaagggaaccugcaggaggaagucguguccuucuaugacgcgguuauuagacggaaucucgagcugucugugaucaacaagaaucaugaaaaaggaugggaguuucuguucagcaugaagcagaacgaauuuuucauuuuucccuccgauggcuucaauccucacgagaucgaccuucugaaccccaauaacuaccaucucaucucuccuaauauuuuccgcguccagaaaaucagcacaaagaacuauauguuuaaucaccaccuggagaccaaggcuguggauggggaaaugcucaaauccaagaaagagcugucuaagacaagcuaccauuucauucaaacccccacaaaccuuaacggcaucauuaaagugagaaucaaucaccugggaaagaucguccaucugggcgaauacuga

SEQ ID NO: 4202 - RNA, 4065 nt, Artificial Sequence
  Cas9 variant
auggccgacuucgcuaaguaccaacccggcaugguggccgaugggagaaaaaucccucuggacuggacccucuauuaccugcggaagaaagcgcuuacacaagcuauucgcaaggaggaacuggccuggauccuccugaacuuuaaucagaaaagaggauauuaccagcuucggggcgaggaagaggaagagaacagcacgaagcacgaggaauauuacgagcugaaggucguuuccguggaagccgcugaggaggggaaaggaggcaauaccugguauaacgugacacucgaaaauggguggauuuaccgcagacagucuaagaucgagcugaacgauugggucggaaaagugcggccguucauuguuaccacagaauacgagaucgacggcgugaccaucaagaaagauaagaauggcgaagucaagcgcagcuuuagagcccccuccgagaacgacugggggcugcggaaaaagcgcacagagucucuccuggaagagagcggaaaaaccgugggcgcuuucauuuauaaucauauccuuuccgaaccugccgauaagauuagagggaacuuuauccggacgauugagcgcaaauucuacaagaaagaacuggaggcgauccucagagagcaaucuaagcaccagaaggaacugaaagacauugauacccuuaucgccugcaucaaggagcuguaucccaauaacaaaccucaucaggacagccucauuaagaaagauaugacauaccugcugaucaccgaccucaucuuuuaucagcggccccugaaguccaagaaaagccuuauugcugauuguccuuacgaauauuacgaguacguuauuaaggaaacaggagagaauaaacgccaaucuaucaagugcaucgccaaauccaacccguauuaccaggaguucagacuguggcaguuuauuaucaaucuccggcuguucgacagaaacaacgacaaggaagugaccagcgaguaucuuucuuccauggaagauuacacgcgccuguuuacauaucucaaugaccggaaggauauuaaccaggagacccugcugaaagacuucuuuaagcaaaagaaggucaaaagaggcauggagaaggaguuccccauccgcuggaauuacauugaggauaaggaaaagaaguauccuuguaacgagacacggcacgaacuccugaccgcucuugggaaagugggaaucgaccauagcuggcuggaugacaaggaacucuucuacagacuguggcaccuucuguacucuguggaguccaaagaagaggccgaaggcgcgcuccgcaagcuggucgauaaugacgauuuuguuaacgccuuccugaaaaucaagcccuuuaagaaagaguauggcgcuuacagcgaaaaggccauuaaaaagcuccuggcugugaugcggauggggaaucuuuggaacgagguggacaucugcgagcagaccagagaccgcauucagaauaucauuaaaggagauaucgacgaaaagauuaaggaucggaugggcagaacauucucccaacugucugacuuucaggggcucccugaguggcuggccuguuaugucguguacggacagcacagcgaagccacggauauccagcgcuggaccaaacccgagaaccugauggcuuauaucaauggcuucaagcaacauucccuucggaacccgauuguugaacagugcauccucgagacacugagaaccgugcacgacauuuggaaagaggcggggcauaucgaugaaauucacaucgagcugggacggggcaugaaaagcacagccgaccagcgcgcuagaaugucuaaauccaucaugcagaaugaaaacaccaaucuccggauuaagagccugcuuauggagcugaagaacgccaaagaguuugaaaacgucagaccuuacucucccaugcaacaggagauccuccgcauuuaugaagagggcgcccugcaggaacugacgaaggaggaugcucaguacaaugagaucagcaaaauuucccaaauggcccagccuucugcgaacgaacuucucaaguaccggcuguggcuggagcagaaauauuguagccccuacacagggaagcccaucucccucagcaagcuguucaccucugcuuaucagaucgaacacauuaucccucaauccagauacuuugacgauagcuucaccaauaaagugauuugcgaggccgaaguuaaccagcuuaagucuaauaugcugggauaugaguuuaucaaaaagcauggcggggagauugugcgcuguacaaugaucggagacgucaaacuccuggaugccaaggaauacuauaacuucgugaccgagcacuacacaaauaacagacggaaaaaggaaaagcugcuuauggaggacaucccgcaggaauuucucaaucgccaaaugaacgacuccagauacauuagcaaaaaggucauggcuauccuguccaauauugugcgggaggaggaugaacaggaggccaaaucuaaguucguuaucgcuugcagcggcgggauuacggaccgccugaaacaggauuggggccucaacgacguguggaacuccaucgucuaucccagauucgaacggcugaauaaacuuaccaauacagagaacuuuggacgcugggagaacaagaaaggcaaacagguguuccaaaccucuguuccucuggaacuccagaaagauuuuagcaagaaaagaauugaccaucggcaccaugccauggaugcgcuggugaucgccugugcuuccaauaacaucauuaauuaccugaacaaugagagcgccaagucucaggaaaagcgcgaggaccuuagaaagaagcucugcgauaaaaaccggaucauuagaaagcccugggaaacauucacccaggacgcucacacggcccuggagaaugucgugguguccuuuaaaaacuauauccgcguuauuaauaaggcgaccaacuacuaugagaaguacgauaaaaaugggaagaaagaaaucgccgagcaaaagggacaggacaugugggcuauccggaaaccuaugcacaaggaaacagucuucggccaggugaaccugagacgcaagauuaccaucaaacucaaggaugcccuggagaaaauucccgcuaucugcgacaaggaacuucgggacuauauuaauauccugguggccaaacaguuuaacaagaaacaaauccucgcccauuucaagagcauuaauuacagacugaacaugaagucugucgauaaaguggacguuuggcaguuuuccaacgagaaggagccgaugguggcuacacgcaaaagcgucgauaccucuuucgacacgaagcggaucgcgacaauuaccgauacagggauccagaaaauucugcuuaauuaccugaaggccaagaacaaugacccuaacaucgcuuuuacccccgaaggaauugccgagaugaauaaacacaucaccgaauauaacaauggcaagcaacaucagccuauccucaaagugagaguuagcgagcccaagggggccaaauaccaggugggcgaaacaggaaacaagcgcuccaaguucgucgaggcucagaaaggcacgaaucuguauuuugccauuuacgaggauaaggaagggaaccggagcuauaauaccaucccucucaacgaggugauugaaagacugaaacaaggacuuucucccguuccggacgcgaaugagaaguccaucccucugaaauuccaccucagccccaacgaucugguguacguccccaagacagacgaggaaaaugagauuaagaugggccagaucuauaaauucguggauuccucugggaccacagcuaacuuugugccucaccgggucagcaaucugaucuacaacguugacaagaaaauugccgaaaacuucuguaaucaugagaucauucagaacgaauacggaaucggcuccccgcagucuaagaaucagaaaagcauuaccggggagaugaucaaggccgugugcuggaaacuugagguggaccgccugggcaacauccacaagauuaucaaguga

SEQ ID NO: 4203 - RNA, 4065 nt, Artificial Sequence
  Cas9 variant
augaagaaaauccugggccucgaccuggggaccacaagcauuggaugggccuucaucaaggagcccgaaaaagauguggucggcuccgagauuguugacaugggggugagaaucgugccucuuucuagcgaugaagagaacgacuuugcuaagggaaauacgauuuccaucaacgccgaucggacccugaaacgcggcgcgagacggaaucuccagcgcuucaagcaaagacggaacgcucugcuugaaacauuuaaggagaaaaaucugaucccgucuaacuuccaguacgccgaggacgggcccagcuccaccuuuucuacacucaagcugcgcgauaaagccgcuaaggagaaaauugaacuggacgauuucgucaaggugcuccugcagaucaauaagaaaagaggauauaagagcucccggaaagccaugagcgaagaggacgagggcaccgcuauugauucuaugggcaucgccaaggaacuuuacgagaacgaccugacaccugggcaguggguuuaugaagcgcucaaaaauggacgcaagaacgugcccgauuuuuacagauccgaccugcaagaggaguucaaaaagauugucaauuaucagagcgaauuuuacccugacauccuuaacaccucuuucguggaggauuggaugggcaaggccuccacgcccaccaaacaguauuuuaauaagcgcgggguucagcuggcugaaaacaaaggaaagcgggaggaaagacggcuccaagaguacaaauggcgcgccgaagcugugaauuucaagauugaccugagcgagaucgcccugauccucucucagauuaacucccagaucagcaacuccucuggcuaccugggggcgauuagcgauagauccaaggagcuuuauuuuaaaaaucugacagucggacaguaccucuaucaacaggugaagaaaaacccucacacccggcugaagggccagguguucuacagacaagacuaucuugaugaauuugagaaaaucuggagcguccagucuuccuucuacccgcagcugaaugacgaacucaagcaggagguucgcgaugugacaauuuucuuucaacggagacucaagagccagaaacaucugaucucuaacugcgaauuugaggagcaccauaaggugguccccaaaagccacccuaucuuccaggaguuccgcauuuggcagaaucugaacaaucugacccuuaucaagaaagacaaccugaaugaaaagugugaacucgcccuggaggauaagacggcucuugccaacgagcuggcuuuuaaaaaggaacucuccgugaaagacgcccugaagguucugggccucaaacccucugauugggaguucaauuuuacaaagauugaagggaaccggaccaaucaugccuucuuugaggcuuucgcgaaaaucauugaacuggaggacggagagccuaucgaccuuggcaaccugaaggccgaugacauccucgaucaauuuagcgaggcuuuccugagaauugggaucgacacagaacugcuucaggucaauuccgauauugaaggagccgaguaugaaaagcagagcuacauccaguucuggcaccuccuguacucuuccgaggacgaucaaaaacugaagcagaaccucauucgcaaauuuggcuucaagcccgagcacgccaaaauccuggcuagcauuucucuucaggacgaucaugccucccugagcucccgggcgaucaagaagauccucccgcaucugcagucugggcugauuuaugacaaggcuugcaccuacgccggauauaaccacagcuccucuuuuaccaaagaugaaaaugagaaaagagaacuucgcgccgagcucgaacugcugaagaaaaacagccuccggaauccugugguggagaagauccugaaccaaaugauuaauguugugaacgcuauccuuaaggaccccaaucugggcagaccugaugagauucgcgucgaaauggcccgggagcucaaagcuaacgccgaacagagaaagaauaugacauccaacaucgcgagcgccacgcgggaccacgagaaauaccgcgagauccugaagaaagaguucggccugaagagagugaccaagaaugaccuucuccgguauaaacuguggcuggaaacagaugggauuucucucuacaccggaaagcccaucgaggcuuccaaacuguuuagcaaggaauaugacauugaacacaucauucccaaagccagacuuuucgaugacucuuuuuccaacaagacaaucugugagcgccagcugaauaucgauaaagcuaacgucaccgccuucagcuuucuccaaaauaagcugucugcggacgaguucgaacaguaccagagccgggugaagucccuguacggcaaacuuagcaaggccaaaauucagaagcuccugauggcuaacgauaaaaucccugaggacuuuauugccagacaacugcaggaaacgcgcuauaucucuaagaaggcuaaagagauucucuucgaaaucacaaugagaguuuccgugaccaccgggacaaucaccgauaagcugcgggaggacuggggacuugucgagauuaugaaagaacugaacugggagaaguacgauaaacucggccugacauauacgaucgaagggaagcauggcgagcgccugaauaagauuaaagacuggaacaagagaaaugaucaccggcaucacgccauggacgcccuuaccguggcucugacaaaaccggcguacauccaguaucucaacaaucugaacgccaaggcuauuggaaauaaaaagggcaccgaaaucuuugccauugagcagaaguaccucaaacgcgagaacgggaagcugugcuucauucccccuaucgaaaauaucagagccgaggcuaaaaagcaucuuagcaaaauccugguuuccuauaaggccaagaacaaaguggucacaauuaauaagaacaaaaccaagaaaaaggcgggauucaaugaacaaacggcucucacaccccggggccagcugcacaaagagaccguguacgggaagucuuuucacuacagcaccaaguucgagaaaaucggagccuccuuugacgcccagaagauuaacacaguggcuaaaaaggaggaacgcgaagcccugcuuaaaagacuggcggagaauggcaacgauccuaagaaggcuuucaccgggaaaaacucucucaauaagaugcccaucuaucuggaccucggcaaaaacaucaagcugagcgaaaaaguuaagacggucgugcuugagcagaauuacacaauucggaagaacaucgauccggaccugaaaguggauaaggucauugacgugggaaucaaacgcauucucgaguccagacuggaagaguuuggcgggaaugccaagcuggccuucucuaaccuugaagagaauccuaucuggcugaacaaagaaaagggaauccccauuaagcggguuaaaaucagcggcguguccaaugucgagagccuccaugugaagaaagaucacuuuggggagaagauucuggacgaagagggaaacgaaaucccuguugauuucgugucuaccggcaauaaccaucacgucgcuauuuaugaggacgaagaugggaaucuccaagacgaggugguuaacuuuuacgaggccgugaucagacgcaaucagggcgaauccauuaucaaauaucggcacgaggaaggauggaacuuccuguacagcaucaagcagaaugaguuuuucgucuuccccucucaagacuuuaacccuaacgauuucgaccuucuggaucccaaaaauuaugaccugauuuccccgaaccucuacagagcucagaaguuuagcaaggugauguacggcaauucugccgugcgcgauuaugucuuccggcaucaccuggagacaguucuuaacgacgugaaagaacugaaggauguggcguacaaacagcucaagucccugcaguaucucaaugggaucaaaaaggucagacugaaccaucuuggacaaauuauccaggugggcgaguacuga

SEQ ID NO: 4204 - RNA, 4065 nt, Artificial Sequence
  Cas9 variant
augacccugcacuacaacgugggccucgacaucgggacaaauagcgucggauauacgauuguugaugacaacggcaagauccuucaggugaaagggaagaauggauacggcgugagagucuucaaagagggggccaccgcugccgaacggcgcauuuuuagaacaacccaucggcgccuuaagagacggaaauggcgccugagacuccugcaagauuucuuugagcccuauauccuuccucaggacgauggauucuuuauucggcgcaaggaauccaaccuggugcucaaugacagagaugaggacacagcgucucuguucaacgaucggagcgaccgcgauuuuuaccaggcuuauccgaccaucuaccaccugagacaggcccucaugacagaaaagcggcaauucgacguucgcgagaucuaucuggccaugcaucacauuaucaaauacagaggccauuuucuucugaauggcaccgugaacaauuucacgaacaauaagauugaucuccacuccgacuuugaggaacugaacgcccuucugcucaaugucauccccgagcugaaauuccagauugaccuggaucacucuaccauguuucagacaacccuccugaacacaaccaucagccgguccgggagacagcgcgaccuugugaagucuuucuacaauggaagcgaugacaaacaacuggcuaagcagcagaaguccguugcuacggaacuccugaaagccauucuuggccugaaggcgaaauuccauaagcucuuuaaccuggaucugcucgagacaaccgagugggaguucagcuuugacgccgaggauaucgacgauaaacuggcuaagcuggaaccucugaugacagagaaccagcaacaggugauggacauccuccagcggauuuucgccgcuaucacccugaaugggauuguccccgaaggaaaaacccuuucugccuccaagguggauagcuaucaaaagcacaaacaggaccugaagcuccugaaagcgaucgcccagcauucugacaagaaaacagcuacggugcugcagaccgccuacaacgaguauauuaauggcaucgcuuccaagccucucaagcaagaggauuuuuacaaaagacugacaaacgccgucaagaaaagcucugacccccagguugccgauaugcuugcucugaucgaccaggaaaaguuccucccuaaacagcgcaccaaggagaauggggcgauuccgcaccaacugcaccagcuggaacuugagcggaucauugauaaccagaaggacuauuaccccuggcucgccgaacugaauccuaaccaggcuagacaaaaaguggccaaguauaaacuguccgagcucguggccuuucgcguccccuacuacgugggaccucugaucgagcccgaaguucagcaggcuacaagcaaugcccauuucgcguggauggcucggaaggaggccggcccgauuaccccuuggaacuuugaucagaaaguggacagaaaugucuccgccgaacgcuucaucaagcggaugacgacaaaggauaccuaucuucuggcugaggacgugcucccccugcacucucugcuuuaccaaagauuuaucguucucaacgaacugaauaacgugcgcgucaauggccagaaacugaccaagaaacagaagcaagccguguaucaggaucucuucaaacggcagccucaugucacaaagaaacaguuuaagagcuaccuggugcaaaccggggaguucgcugaguccagcaagauugaaggacuugccaacgagacaucuuucaacuccggccugacgaccgaaaaugagcucagaaaaaucuuuggggcgcagcuggacgaggcccgguaucagguugauuucgaacagauuaucgagugggcuacacuguuugaagacgccaagauucuucgcaccaaacucgcugagaucacauggcugaccacggaacaaauugagaagcuggccggaaucagauaccggggcugggggagauucagccgcaaacuccuggcgggacuucgggaccagaacggccagcagaucauugaucugcucugggacacccccaauaacuuuauggugaucgucucucaagccgcuuucagcgaggccauuacaaaggaaaaugagaagcugaucgauagacgcggcgcucaggacgugauuaccgaucuguauacaucuccccagaacaaaaaggcccuuagacaaguucucgccaucguggcugacguccagaaagcgaugggaggggugccuccgcagcggaucuuuauugaguucgcccgcgaagaugaaaagaaucccagacgguccguggagcgcagcagacagcuggagaaacuguaccaaaccaucuccaacgaauuucucauuaauagcgagguucggcaggaacugaaggaggcugucgaccagaaggugaacuucaaagaucgccuuuuucuguacuuccuccagggcgggguggaccuguauucuggaaagagaaucaauauugaucaacugucccacuacgacaucgaucauauccuuccucagagcuuuauuaaagacgacucucuggauaaccggguccucgugucccagaagcugaaucgcagcaaauccgacucuguuccccucagcgaguucgccaacuauaaguucggcccugccaugcaggcuaaguggcugcaacuuaaagaagccgggcugcucuccaagagaaaauacgauaaucugacgcuggaccccacaaaacuuucuaaguuugcgccgcugggcuucgugaaccggcagcucgucgagaccagacaggugaucaagcuggcugccaaccuccuggccagcgaagagacaaaaguugugaccauuaaggcuaauaugacccaccagguccgcaaggaacuugauuuuccuaaaaaccggaaugugaacaauuaucaccaugccuucgacgcguaccugacagcuuuuguuggaaucuuccucuccaagagauaucccaaacugaagccuuacuuuacguacggcgauuuccaaaaagggaacaagcugcccgaccuuaagaauuuuaacuuccuguaugagcucaaaaauaaggaucgcagcauugacucuaacaccggagagaucaucugggauaaacagcgggaccuggccuacaugaauaagauuuauaacuuuaaaaaggugacagucgugcacgaagugcucaccaaguccggcgcccuguacaaucagacacuuuauaaagcuagcgaggacaaggccucugggagaggaaccaaacaacugauccgcaagaaagauaacaugccuacggaacuguacggcggguauacaggcuccaccagcgcuuucaugucuauuguccggcucuggaagaaggacaaacccuacuacaagguugugggaaucccgaccagaauggccgcgaaacuggccaaucaggcucagcuucuggauuaucucacaaagaaauucaccacacgcaagcuggugaagaaaacgggcgacuacaagaccacagucgagcgguuugaacucgugguuccuaaagugggguucaaccagcuggucauugauggaggccaacccuuuaugcuugggagcgccaccuaucaguacaacgcuagagagcuguucaucuccaaggaggccgugaaagcccugaauaagcagcucagcacacauguugaccuggugcaggucuuugaugaaauucuugugcaaguuaaccggugguucccccuguaugacaccaauggauuucgcgagaaacucucucacggcagagaucgguucaugaagcugaacgacuccuuugaagaaaagagcgauacgcagaucgacgugcucaaucgcauccugauuggguuccacgcuaacgcggccagaaccaaucuuaaaauccugggccugggaacagaucucggcuuuaugacccagcaggcugggauucggcugacagaaaaggccauccuuguccaucaauccccuucuggacuguucgagagaaaaguggcccuccgcgaccugaagggccuccgguga

SEQ ID NO: 4205 - RNA, 4068 nt, Artificial Sequence
  Cas9 variant
augaccuacagcaucggccuggacauugggacaggauccgugggcugggccgucaucggggaugacuauagacucaagcgggcuaaaggaaagaaccugauuggcguucgccuuuucgauucugccacgaccgcggcugagagacggggguaccgcacaaccagacggcgccugagcagacggcacuggcgccucagacugcuuaaugacaucuuugccuccgaucuggccgaacaggacgagaacuuccucccccggcugaaauauucuugggugaauccugaugacgaacaaaacccgcagcugaauagcgauguggcuaacggagcccucuuuggcuccucugagacagacaaggcuuuccauaaaaauuaccccaccauuuaucaccuucgccaugaacuuaugacagauaccgccaagcacgaccugagagaggucuaccucgcgauccaucacaucgugaaguaucggggcaacuuucugaauacggccgauaaaauuaacgcugagaauagcuucaacguugaccuuuuuaucgccgcucuggacgaauacaaugaguuccucgaaaccccuauuacauccaucaaggaugcccagcuguuuagcgacaaacugaccgauauuaacgcgcgcaauaagucugugagagucgagaacgccauguccgagacauacgacgauaaaagcaagaucuucaaggcuauucucaccgcccugguggggaacacggcuaauuuucagacaaucuucgaccuuucugaucuggaaaaagacgaggccaagaacuuuaaauucaagcucgaucuggaagacguugagaccaaacuugaugugguccgggccaagcuguccgacgaacaaaaugcuuuccucgaggcggugcugaucgccuaugacggaauuacacugaaaaugauccucggcgauuacaagagcauuucucaguccaugaucgagagcuauaagucccaccagagagacuggaaauacauuaagaacaaugugcgccugaacgaacagaaaaucgagcccgauaaaaauucugucaaauuuuucaagcuggacccuaagaaacugaucuaucccagcaaccucgcuuaccugcaaguuauuuccagcaaugaagaugagcaucggaaggggcuugacuauuuuaaaaccgccauccaggaugccgacauucugcagagaaucgaaaacgauaccuuccucccucgccagcggacaaagagaaauggagugcugccguaccaacugcaccucgcugagcuggagcagauuaucaaaaagcagucuaaguacuaucccuuucuugccaacaucuacacgcaagacaauaaaaccgaaaacaagcugauuggccuccugaaauuccgcgugccuuauuacgucgggccccugguggaggcggaaaagguuacaggagauggcaaaaaucauuggcuuaucaagaaggagcuccaggaaaacaccccuauuacacccuuuaacuucgacgauguggucgacaaagacaaguccggcgagcaguuuaucaaacggauuaccgggacggauagcuaucugaucggagagccgacacugccugaaaauucucuccuguaccagaaguauaacgugcuucaagagcugaauaacguuagaaaugaacgccaccagcggcuccccauuaaagugaagcaggacaucuucgagcacgucuuuaaaaucgauaagaacgugaaugcuaagaaagucauggccuaccugaagcugaacggcuacggggacuuccagauugccggacuuagcgauaccagaaccggcaaauuuaauuccaaccucucuagcuauaauuacuucguggaccugcuggggcgcgagaagacagaaaagauccgggaggauagacucgaagagauuaucgaaauucaaaccguuuucgaggacaagauccugguggcuaagcggcuuuccaaccuggauuuucucacaccucaggagaaaagcaagcugucugccaaacauuauacgggauggggccgccugucccagaaacuucucaccacacaguucaucaagaccgcucugagcgaagccggcgacauuaucccccaaucucacuccauuaucgaucugcucuacuauacagacaagaaucugauggagauucuuaacgauaagaccuuuaaugucagaaacuggcugacggaacagaacaaagggaccgagagcggaaauucccucuacgaccagaucgacgcgcuggccggccccaaggauaucaaacgggggauuacacagguguucucuaucauugacgauaucaagaaagcuaugggaagcaacccugaaaccguuuaucuggaguuugccagagagacacaaaccucccgccuuacaaauucucggcucaacagagugcaggaaauuuacaauagcccggagcugaagacggaguucgcuuaccuggccaagaaacucgaagcggaaaccaaggaguccauccaugacgaucgccuguaucuuuacuaucugcaggagggcagagacauguacacagggaaagaaauccccuuugaucaaauuagcucuaacuaugacaucgaucacauuaucccucaggccuucaccaaggacgauucccucgacaaucggguccuggugaaccgcgcuaccaaugccagaaaaagcaacucucccacauuuacgaaugacauuaucgauaaccggaaguccugguggcagagccuggugaaacgcggccuuaugucuaaggagaaguucgaaagacugaccgacaaacggaagacauuuagcgagaaucagaccaaccauuucauugcucgccaacucguugagacaagacagaucaucaaaaaugucgccgaucugauuaagaacaacuacgacggaacccaggccguggcuauccgggcgucccucacgggcgaaaugcgcagauaucuggauuggccuaaaaaucgggacaugaacgauuaccaccacgcccaugacgcucuuaugauggccacaguggggaaguacgucgauagacgcggauuuuucgacaauggcagcgugucugauggggccggaaacgcuuauaaucuguacaccaaggacuggcucguugccgcgcgggugggcaccagaaacgauucccagcgcgucaaucccuauggguucauugugggcagcaugaacuccaaagcuguucggcaacaggugaauaaggagacaggagaaaucgucuggggcaacgagaaucuggacuaccugagacacgugcuuucuuauaaaaagauucugguuacccgccggcucagcggguccucuggaagacuguacgccgaaacacucuuuagcccgaacccuaaagccaagcugaucgcucagaaggccaaucgcuccguggcgcuuuauggcggguucacgaaagcugagucugccuacaccgcccuggucgaguuuaacaagaaaggagaccggagcuacaagcucaucaaagugcccauggcuauugccaauagagugaacgauaagcagaucacagucaccgcuuauauugccucccugaaucugcgggacuucagccgcguugugcuugaacaucugccucucggcacacugaucagagagucugauggguccgaauuuuacgcggccagcucugaguauaagcacaacgcuaaagaacucugggcccccaaggagauucugcgguccagcaaaaagcuggacaaagcuaccgccgauaaccugaucgacaucuucgauuuucugacgaaugacaagaccauuucuaacuucaaguuuuacgagaaagaucuccugcaccuuaagaaugugcgcgacaaauucgucgaagccuccgaugagaucaagauuaaagugcugagcgacguuaucuaugaacuccauaacgaugcuggcuggagagacccuuuuaagcacauucaagagaaacccgcguggacaaugcuucaggugaagggaggcaucaagcucuccgaaaaagccgcuauugucuaccagagcccgaccgggcuguucgagacaaucaccaucgugggagaguga

SEQ ID NO: 4206 - RNA, 4071 nt, Artificial Sequence
  Cas9 variant
augaagaaauucgaggaauacuauaucggccuggacauggggaccggaagcgugggcugggccgucacagauuccgcuuacaacauuaucaagagacacgggaaagcccucuggggaauuagacuguuugagucugcgaagacggcugaggagcgcagaaucuuccggaccagccgcagacggacagaacgcagaaagaaucggcuucaucugcuccaggagauuuuugccgaggaaaucuccaagaaggacaugggcuucuaucaacgcaugaaagagucuaaguacuggcacgaagauaaaaaggacaucaacgggaauaugcccgagcugccuuaugcccuuuuugcugaugacggauucaccgauaaagacuacuauaagaaguacccgacaauuuuucaucugagauacgcccucgcuaccaacacaaccgauaaacccgacauccggcugcuguaucucgcccugcaccauauuaucaagcaccgcggccacuuccuuuuugagggcaaaaagcugagcgaaguuaaagaguucuccacggcgauugaagcccucgugcagcaggcugaggaacaggagaucgaucugaagucucuuacccaagaggaagugcugacacagcucgagcauauuaugagcgacgcccagugcaccaaauccgauaagaagacacaggucagcaaacugaucguggggaccgacaagcaaaaacagaagcaggaaaaagcuaucgccgcgcugauuacgggauguacaguuaagcucucugacaucuuugccgauccugagcuggacaaggaagagauuuccaaaaucugcuucagcgauaauggcuacgaggaaaaggagguggaaauugagucuguccuugcugacagauuucugcucaucgccgcugccaaagggguguaugauuggaccguucugcacgacauccuuggagaugcccgguuccuguccgaagcuaaggugaaaacauacgagaagcaucgcgacgaucucagaaaggucaaacagcugcugcggauggacaaggagguguaugaagcgguguucggcgucagcgagaaaaacgaagccaauuacucugcuuauauugggauggccaagaaaaacggaaagaagcaacccaucgagaaaaaguguucccaggaggauuuuuacaaauuccucaagaaacagcuggacagacuuagcguugacgaaaugggccaagagauuaucgaugaacugaaggccgagauggaccucggcacccuguuuccuaaacagaugauucgcgauaauggggugauccccuaccagcuucacgaaaacgagcugaaugcuauccucgacaacgcccagaaguucuauccuuuucugcuggagaaggaucaagacggauacaccccgguggagaaaauucagaagaucuuccgguuucggauucccuauuacgucggcccucucaauacagcgcaccaggauaaagggggacauuccuggucugugcgcaagaaagaaggcaagaucuaucccuggaacuucagcgaaaugauugacgaggaagaguccgcuacgaaguuuaucgagcggaugaccaauaaaugcacauaccugauuggggaagauguucuuccuaaggagagccugcucuaugccaaauucaacgugcugaacgaacugaauaaccuuagaaucgacggagagcucaucgcccccgaacugaagcaggauauuuacaauaacgucuuuaaaaaguaccaacgcgugaccggcaagaaaguuaaggacuaucugcggaucaauggcgugauuucuaaagagcaggagcucuccggguucgaucagaacuuuaagagcucucugaaggcuuaccacgacuucaagcagaucgucggaacaggcgugcuuagcgaauccgagcaagaagacauugucagagauaucacccuguucgccgacucucagaagaugcucaaacagcgcauccaucggaaguauccgaugcugagcgauaaacagauugcucaacuggccaauaagaaauacgcgggguggggaagacuuucccgcacguuucucgagaacaucgagagcgugaauaaggaaacaggcgagguuaugaacauuaucaccgcccugugggaaaccaaugagaaccugaugaaacuccugucugggaaguaugacuacacaaagcagauugaacaguggaaugcucggcaaaugaaaaagggcgagaucgaguaucaggauaucgaggaacuuuacguguccccugccgucaaaagacccauuuggcagaccaucaagauugugcgggaaaucacaaacauuaugggaggcgcuccuaaacgcaucuucguugagguggccagagaacccggggagaagggaguccggaaggugagcagacgcaaucagcugcucgaccuguacaaagcguguaagaaagaggcccccgaacuguaugaucggcuugcuaacaaggagucugacaacgcccucagauccgauaaacuguuucuguacuauagccaaaugggccgcugcauguacuccggggacgcuaucgaucucgacgaacuguucacgaauagauaugauauugaccacaucuacccucagucuaaggugauggacgauagcauugacaaccggguucuugucaagcgcgaucucaauuccaaaaagaccgacacauuuccggugucugaggaauauagaaaagccggaaaggcccuguggagcacccugcugaaaaagggccuuaucuccaaggagaaauacaagcggcucacacgcaccgagcccuucggggaagaugagcuggcuggcuuuauugcgagacagcugguggaaacgcggcagagcaccaaagccgucgcucaucuccuggaggaggccuacccugacgccgaaaucguguaugcuaaggcccgcgcgguuucugaguucagacacaaauuugauaugauuaaggugcgggaagucaacgacuuccaccaugcuaaggaugccuaccuuaauaucgugguuggaaacacauauuacgugaaauuuaccaaggacgccgcuugguucguccgcaauaaccccggcagaacauauaaucugaaaaagauguuugagaacgaaaccgugaaacgggggaaugagacggccuggaucccuggagauaacggcacaauuuguaccguuaagaaauggaugagaaagaauaacguccucuucacacgccgggcguacgaggugaaagggggacuguucgaccaaaauauccugaaaaagggcaaagggcagauucccaucaagggcggagcugacgaaagacuucgcucccgggauaaauauggcgccuacaacaaggccagcggggcuuacuuuaugcugguggagucugacggaaagaaaggcgaaagaaagcgcaccauugaguucgugccggucuaucucgccaaaucccuggaagagagcguugagcuccggagacgcuacugcgaagaggaacuggggcuugugaacccugaugugcggcugucuaagauccggaaaaaugcucucaucgacgucgauggauuuaagaugcaccuggugggcagaaccgagaaccgccugcuucugauuggggccacacagcucguucugagcgaagacgaucagcaacucaucaagaaaauuggcaaguauugucuggaccauagagagaauaaagaugcggugcuuuccgagaaguacgaacugacgauggaccucuucgagaaacuguaugauaucuuugucuucaagcuggaacagaccguguacgccguuaaacuuagcaaacaggcuaaggaccugaaagaggugaaggaggaauuucucgcccuggaugacgagcaaaaaugccuccugcuuauggaaauucugcaccuguuccaguguucuccccagcucgcuaaccugacaaauaucggaggcgggaaguccgccggaagccuuaaaauccuguccgacauuaccaagcagcaaucuguccuccugaucaaccagagcauuacaggcuuuuaugaacaggugaucgaucucaagaccauuuga

SEQ ID NO: 4207 - RNA, 4071 nt, Artificial Sequence
  Cas9 variant
auggaggugggcaacuacuaucuggggaucgacgccggaaccgauagcgucggcugggcuguuacagacaaucaguacaacgugauuagaaagaaagggaagucccucuggggaauccggcuguucgauggcgccaauacggcgcaagaacgcagaaccuuucgggcccuucgcagacggaacgagcgcaaaaagcagagaauuaaucugcuccaggaacuguucugcaaagagaucuguaaacuugaccccaacuuuuucauucggcugcgcgauucuagccucugguccgaagacaaggaggagaaacagaucuauucucuguuuaaugauaagaacuucaaugacagaaacuaccacaauaacuauaaaacaaucuaccaucugcgggcugaucucauuaagaauaaagaaaagcacgacgcccgccugguguaucuugcuauccaucacauuaugaagaacagagggcauuuucuguucaauggaaacaucgagagcgucaccuccuuugaaaacacauucaaugaguuuaaaaacugccuccuggaugagcuugaaauuaaucuggaguguccuucuaucagcgaguucgagaacauucucaaggaccggaccuuuaaaggcacacaaaagugcaaaaagcugaaagaacuguguuccaucccgagcucugauaagaagcucgacaauaucuucaaacugauuuccggccuuaaggccgaccugagcaucauuuucgaggaugagucuuuuaaagaaaacgagcacaauaagaucuccuucgcugacagcaacuacgaagagacccgcgaagugcucaauucugagauucaggagaaaacgcugaucaucgauauuuuuaacuccaucuacaauuggguuauucuuagcgacauccuguccgggggagaauauaacggcgggcucuaccugucuauugccaaggugaauaccuauaacaagcacagcaaagaucugaagauccucaaauccgucaucaagaaauacuucccccagaaguauacagacauuuuugcgagcaauaaggagaacaacuacugcucuuauaucggaauguacaaauccggcgggaagaaauacagcgugaagaaauguucugauaagccugaagaguucuauaagaccauuaaaaauaucauuaacaagaauacagccgaagagaucagcaacgacaaagauguucaguacauucuguccgagaucgaaaauaacucuuuucuuccccugcaaaucaauaagaacaauggagugauuccuuaucaggcuaacaaaaucgagcucgaaagcauucugaagaaugccgagaacuaccuucccuuccugaaagagaucgacaccgaaugcaauaagacgacauccgagaagauuaucgaucucuuugaguucagaaucccuuauuacgucggcccgcugaacaccagcaaaggcgaaaaugcuuggaugauucggaaggaagacgggacaaucagacccuggaacuuugagcagaaaguggacauugauaagaccgccgcggaguucaucacccgcaugacaaaccaguguacguaucugaauaacgaaaccgugcucccuaaauacucucugcuuuacuccgaguauacaguccugaaugaaauuaacaauauccggaucaacggagagaagauuagcguugaacucaagcaagacaucuuuaauauucuguucaaaaacaauaaacaggugaccugcaagaagcugcuuucucaucucaacuccaauggcuacaaccugaaaaaggaugaccugagcggguucgauggaaauuuuaaguccucucucagcuccuauaucgaccugaaaaacuacauuuucggcgauaauaucgacaagccccagaucuauaaccuugccgagaaaauuauccuguggauuacacucuacggggaugacucuaagcugcugaaaagagugcuucaaaagaacuguagcgagcagcucaauccugaacagaucaagaaaauuaccaagcugaaauuuaagggauggggccgccuguccaaggcuuuccucagcgagcugcggggcgccgauagagaaacgggggagacaaugaccaucauuaagggacuucgcaacacccagaauaaccugaugcaacuccugucucagaauuauacauuuaccgaagagugcgagaaaaucaacuccggcuacuucaucaaucccaacgaaauuagcuacgacucuaucgucaagaauauuguggcuuccccgagcaucaagcggucuguuuggcagacaauucagaucguggaggaaauccaaaaagucauggggagcaagccuagaaaaauuuuuguggagauggcccgcggagaggaagagaagguucggacgaccuccagaaaacagaagcugcuugaucucuauaagaacaucagcgacgaaugcgccaaaggcauguacgacgagauuuauucuaaggaugaauccgacuucaaaaauauccgccuguaccuguauuacacacagaugggguguugcauguauagcggcaagcacauugaucucucccagcugucuaacaccaauaucugggaccgggaucauaucuacccccaaagcaaaacaaaggacgauucccuugacaaccuggugcucgucuacaagucuauuaauagcgagaaauccgaugacaucauuucuccuaccauccagaacaauaugagaacguuuuggaagcugcuguucgaucggaaauuuauuagcgagaagaaauaucaccgccuuaccagaacaacaccccucaccgacgaagaacuggcuggauucaucaaccggcagcugguggaaaccagacaguccacgaaggucauggcgagcauuuuuaagcgcaucuaccccaacacagagaucauuuaugugaaagccaagaauguuucugauuuccggcacagaaaagacugugaaaacggcgugaagguccgcgagcucaaugacuaccaucacgcuaaagaugccuaucugaacaucgugguugggaauguguacuccagcaaguucaccaacaauccucuuauguggcugaagaacaauagaaacgucaaauauucucucaaucggauguacgacuuuaaccugacagugaauaacgagaauauuugggugguuggaaacgaaggcacccaaaagaccgucaacaaauaccuggggaagaaugauauccuuuauacacgcuacgccaugacgaacaaaggagagcuguucgaccagaauccgcucaaggcuaccggcgauaaauccaagcagacaacccuggugccccucaagaaagggaaggaaguguggaaauauggcggauacaacagcauuacaccuucuuauuuuaugcuggucgaguccaaggacaaaaagggcaauuacaucagaaccaucgaaacgaugccccuuuaucgggagaaggaguucagcaaaaacgaagaguuucugcucaauuacugcaaggaagugcauaaacugaaggagccuaaaauuauccugaaguguauuaagaaaaacgcccuucugaucguugauggguuccccaugcaccucaagggauccacaggccugcaacucaaacugcagggggcggugcagcuuauucuggagagcgacauggucaucuaccucaagaaacugaugaaguuugugaaugaaaacaauaucaacaagaauaaacuggagguuaccccguauauggaacuuucugcuaaggagaacauuaaacuguacgauaucuucauucagaagcucaccacaggaaucuauagcaaacgcccugccaaucccguggaaaagcugauuaacgccagagacaucuuuauugagcucaccgucaaagagcaaugcaucgugcuguccgaaauccuucaucuguuccaguguaagccucugacaucugcuaaccucguuagcauuaaucugaagaaaacggugggcaucauucagaucgccaagaacauuaccgcuaaaaaugucaaacuugugcaccagucccccacagggaucuacgaguauaccguggaucugaacaagaucuga

SEQ ID NO: 4208 - RNA, 4071 nt, Artificial Sequence
  Cas9 variant
augaccaagaaagagcagcccuacaacaucggccuggacauugggacaagcuccgugggaugggccgucacgaaugauaacuaugaccuccugaauaucaagaaaaagaaccuuuggggcguuagacuguucgaagaggcucaaaccgccaaagaaacacggcucaaucgcucuaccagacggcgcuacagacggcgcaagaacagaauuaauuggcugaacgagaucuuuagcgaggaacuugcgaagacagauccuuccuuccugauucggcuccaaaauucuugggugagcaaaaaggacccggaucgcaaaagagacaaguauaaccuguuuaucgaugggcccuacaccgacaaagaguauuaccgggaguucccuacaaucuuucaucugcgcaaggaacucauucugaauaaggauaaagcugacaucagacuuauuuaucuggcccuccacaacauccugaaguaccggggaaauuucaccuacgaacaccagaaauuuaacauuuccaaucuuaacaacaaucugucuaaggagcucaucgagcugaaccagcagcugauuaaauaugauaucagcuuccccgacgauugcgacuggaaucauaucuccgacauucucaucggccgcgggaacgccacgcaaaagagcucuaauauucugaaagauuuuacccuugacaaggaaacaaagaaacugcucaaggaggugaucaaccugauucuuggaaaugucgcucaccugaacaccaucuucaaaacaucccucaccaaggaugaagagaaacugaauuuuagcggcaaggacaucgaaucuaagcuggaugaccucgauuccauucuggacgaugaccaguucacggugcuugaugccgcuaacagaaucuacagcacaauuacccugaaugagauccucaacggcgagucuuauuuuuccauggccaaaguuaaucaguacgaaaaccaugcgauugaccuguguaaacuucgggacauguggcacacaaccaaaaaugaggaagccguggagcagagcagacaggcuuaugaugacuacaucaacaagccuaaauaugggaccaaggaacuguacacaucccucaagaaauuccugaaggucgcccugcccacgaaccucgcuaaagaggccgaggaaaagaucucuaaaggaaccuaccuggugaagccucgcaauagcgagaacggcguugugccguaucagcuuaauaagauugaaauggagaaaaucauugauaaccagucccaauacuaucccuuccugaaggaaaauaaagagaagcuccugagcauccugucuuuucggauuccuuacuaugucgggccccuucaguccgcggagaaaaacccuuucgccuggauggaaagaaagagcaauggacacgcucgccccuggaacuuugacgagaucguggaucgggaaaaaucuagcaauaaguucauuagacgcaugacagugaccgacuccuaccucgucggcgagccgguucugccuaagaacucucugaucuaucagcgguacgaggugcucaaugaacugaacaauaucagaauuacagagaaccuuaaaaccaaucccaucgggagccgccugacgguggaaacaaagcaacggauuuacaacgagcucuuuaaaaaguauaaaaaggucaccgugaagaaacugaccaaguggcugaucgcccagggauacuauaaaaacccuauucuuaucggccucucccagaaggaugaguucaauagcacacugaccacauaccuggacaugaaaaagaucuuugggucuuccuucauggaagauaacaagaauuaugaccagauugaggaacucaucgaguggcugacgauuuuugaagauaaacaaauccuuaacgagaagcugcauagcucuaaauacuccuauacccccgaccagauuaagaaaaucagcaauaugagauacaagggcuggggacgccucuccaagaaaauccugauggauauuacaaccgaaacaaacacgccccagcugcuucagcucucuaauuacagcauccuggaccugaugugggcuaccaacaauaacuucauuuccaucaugucuaaugacaaguaugauuuuaaaaacuacauugagaaucacaaccucaauaagaacgaggaccaaaacaucagcgaucugguuaaugacauccauguguccccugcccuuaaacggggcauuacccagagcaucaagauuguccaggaaaucgugaaauucauggggcacgccccgaagcacauuuuuaucgagguuacaagagaaaccaagaaaucugagauuacaaccucccgggaaaagcgcaucaaaagacugcagagcaagcuccugaacaaagcuaaugauuucaagccccaacugcgggaguaucuugugccuaacaagaaaauccaggaggaacucaagaaacauaagaaugaccugucuuccgagagaauuaugcuguacuuccuccagaacggaaaaagccuguauucugaagagagccuuaauaucaacaagcuguccgauuaccaggucgaccacauucucccccgcacguauaucccugaugacagccuggagaauaaggcgcuggugcuugccaaagaaaaccaacggaaggcugaugaccugcuccucaauucuaacgucauugauagaaaucuggagcgcuggacauacaugcugaacaauaacaugaucggccuuaaaaaguuuaaaaaucugaccagacgggugaucacagacaaggacaagcucggguucauucaucgccagcugguucagaccucccaaauggugaaaggagucgccaacauccuggauaacauguacaagaaucagggcaccacaugcauucaggccagagcuaaccuuagcacggccuuucggaaagcgcuguccggccaggacgauaccuaucacuucaagcaucccgaacucgugaaaaaucgcaacguuaaugacuuucaccacgcucaagaugccuaccuggccucuuuccucgggacauauagacugcggcgcuuuccgaccaacgagaugcuucugaugaauggagaauacaacaaguucuauggccaggugaaggagcucuacagcaaaaagaaaaagcugccugacuccagaaagaauggguuuaucauuucuccccuggucaacggaacaacccaguaugaucggaauacgggcgagaucaucuggaacgugggguuccgcgacaagauucuuaaaaucuuuaauuaccaucaguguaacgugacaagaaagaccgaaauuaagaccggccaauucuacgaucagacaaucuauagcccuaaaaaucccaaguacaaaaagcugauugcucagaaaaaggacauggauccuaacaucuauggaggcuuuuccggggacaacaagucuagcauuaccaucguuaaaaucgacaauaacaagauuaaacccgucgccaucccgauucggcucaucaaugaucugaaggacaaaaagacacuccagaacuggcuggaggaaaaugugaagcacaaaaaguccauucaaaucaucaaaaacaaugugccuauuggacagaucauuuacagcaagaaagucggccuucugucucugaacuccgauagagagguggcuaaucgccagcaacucauccugccucccgaacauagcgcccuucugcggcuccugcagauucccgacgaggaucucgaccagauccuggcguucuaugauaagaacauccuuguugagauucugcaggaacugaucacgaagaugaaaaaguucuacccguuuuauaaaggggagagagaguuccucauugccaauaucgaaaacuuuaaucaagcuaccacaucugaaaaggugaacucccuggaggagcuuauuacccugcuccacgccaauagcacaucugcucaccugaucuucaacaacauugagaaaaaggccuuuggacgcaaaacccauggccucacgcugaauaacaccgacuucaucuaccaguccgucacagggcuuuacgaaacccggauccacauugaauga

SEQ ID NO: 4209 - RNA, 4071 nt, Artificial Sequence
  Cas9 variant
augaccaagaaagagcagcccuacaacaucggccuggacauugggacaggaagcgugggcugggccgucacgaaugauaacuaugaccuccugaauaucaagaaaaagaaccuuuggggaguuagacuguucgaaggggcucaaaccgccaaagagacacggcucaaucgcuccaccagacggcgcuacagacggcgcaagaacagaauuaauuggcugaacgaaaucuuuucugaggaacuugcgaauacagauccuagcuuccugauucggcuccagaacuccugggugucuaagaaagacccggaucgcaagagagacaaauauaaucuguuuaucgauaaccccuacaccgacaaggaguauuaccgggaguucccuacaaucuuucaucugcgcaaagaacucauuaucaauaagaacaaggcugauauuagacugguguaucuugcccugcacaauauccucaaauaccggggcaacuucaccuacgagcaccagaaguuuaacauuagcacgcuuaauuccaaccuuucuaaagaacugaucgagcucaaucagcaacugauuaaguaugacaucagcuuccccgauaacugcgacuggaaucauaucuccgauauucugaucgggcgcggaaacgccacccagaaaagcucuaauauucucaacaauuuuacacuggacaaggagaccaaaaagcugcugaaggaagucaucaaccucauucugggcaauguggcucaccuuaacacaaucuucaaaaccucccugacgaaggacgaggaaaaacucagcuuuucuggcaaggauaucgaguccaaacuggacgaucuggacagcauucucgaugacgaucaguucacaguucuggacaccgccaauagaaucuacucuacaauuacccuuaacgaaauccugaauggggaguccuauuuuagcauggcuaaggugaaccaguacgagaaccaugccauugaucucuguaagcugcgggacauguggcacaccacaaagaaugaaaaggcggucggacuuuccagacaagccuaugaugacuacaucaacaaaccuaaguauggcacgaaagagcuguacaccucucucaagaaguuccugaaaguggcucugcccacaaaucucgccaaggaagcugaggagaaaaucagcaaggggaccuaccugguuaaaccucgcaacuccgagaauggaguggucccguaucagcuuaacaagauugagauggaaaagaucauugacaaucagagccaguacuaucccuuccugaaagagaacaaggaaaaacuccugucuauccuguccuuucggauuccuuacuaugugggcccccuucaaagcucugagaagaauccuuucgccuggauggaaagaaaaagcaacgggcacgcgcgccccuggaauuuugaugagaucguggaccgggagaaguccucuaacaaauucauuagacgcaugacagucaccgauagcuaccucguuggagaaccggugcugccuaaaaauucccugaucuaucagcgguacgaggugcucaacgaacugaauaacaucagaauuacggagaaccuuaagacaaaucccaccggcagccgccugaccgucgagacaaaacagcauaucuacaacgaacucuuuaagaauuauaaaaagauuaccgugaaaaagcugacaaaguggcugaucgcccaaggcuacuauaaaaacccuauucuuaucgggcucucucagaaggacgaguucaauuccacgcugaccacauaccuggauaugaaaaagaucuuuggaagcucuuucauggaaaacaauaaaaacuauaaucagauugaggaacucaucgaguggcugaccauuuuugaggacaagcagauccuuaacgaaaagcugcacuccagcaauuacuccuauacaucugaucaaauuaaaaagaucagcaacaugcgguacaaaggcugggggagacucuccaagaaaauccugaccugcauuacgaccgagacaaauacccccaagucucugcagcuuagcaacuacuccguucucgaccugauguggacaaccaauaacaacuucaucagcauuaucucuaaugauaaguaugacuuuaaaaacuacauugaaaaucauaaccugaauaagaacgaggaucagaauaucuccaaccucgugaaugacauccacgucagccccgcucugaaacgcggaauuacgcagucuaucaagauugugcaagaaaucguuaaauucaugggccacgccccuaaguauauuuuuaucgaggugacacgggagaccaaaaaguccgaaauuacaaccagcagagggaagcggauccagcgccuucagucuaaacugcucaacaaggcuaauggauucaaaccgcagcugagaaaguaccugguccccaacgagaaaauccaagaagaacuuaagaagcauaaaaaugaucucagcuccgaacggauuaugcuguauuuccugcagaacggcaagagccucuacucugaggagucccugaauaucaacaaacuuagcgacuaucagguggaccacauucugccuagaaccuacauccccgaugacucccucgaaaauaaggcccugguccuggccaaagagaaccagcgcaaggcugaugaccuucugcucaacucuaaugugauugauaagaaccuggaacgguggacauacaugcucaauaacaauaugaugggccugaaaaaguuuaaaaaccuuacgagacgcguuaucaccgacaaggauaaacugggguucauccauagacaacucgugcagacaagccagauggucaagggaguggcgaauauucugaacuccauguauaagaaucaaggcaccacauguauccaggcccgggcuaaccugucuaccgccuuucgcaaagcccuuagcgaccaggaugacagauaccacuucaagcauccugagcugguuaaaaaucggaacauuaaugauuuucaccacgcucaggacgccuaucucgcguccuuccuggggacguaccgccucagacgguuucccacagaugagaugcugcuuaugaacggagaauauaauaaguucuacggccaagugaaagagcuguauucuaagaagaaaaagcucccggacagccgcaaaaacggguuuaucauuuccccucuggucaacggcaccacccaguacgacagaaauacaggagaaaucaucuggaacgugggcuuccgggauaagauucugaaaaucuuuaauuaccaucagugcaacgugacccgcaagacagagauuaaaacggggcaguucuaugaccaaaccaucuacagccccaagaauccuaaguauaaaaagcugauugcucagaaaaaggauauggaccccaacaucuacggaggcuuuucuggggauaauaaauccagcauuacaaucguuaagaucgacaacaauaagauuaaaccugucgccauccccauuagacugaucaacgaucucaaggacaaaaagacccugcagaauuggcucgaagagaacgugaaacacaagaagucuauucagaucaucaaaaauaacgugccgauuggacaaaucauuuauuccaagaaagucggccugcuuagccuuaauucugaucgggagaucgccaacagacagcagcugauucucccucccgaacauuccgcucugcuucgcauccugcaaauccccgacgaggauccugaccagauucucgccuucuacgacaagaacauccugguggaaauucuccaggagcugaucacaaaaaugaagaaguucuauccguuuuacaaaaaugaacaggaguuccuugcuagcaacauugagaauuuuaaccaagccaccacguccgaaaagaucaauagccuggaggaacugauuacccuccugcacgcgaacucuacaagcgcccaccuuaucuucaauaacaucgagaaaaaggcuuuugggcggaaaacccauggccugacacucaaugauaccgacuucauuuaccaguccguuacaggacuguaugaaaccagaauccacauugaguga

SEQ ID NO: 4210 - RNA, 4071 nt, Artificial Sequence
  Cas9 variant
augagcaagaaagacuccgaguacuauaucggccuggauauugggaccaacucugugggaugggccgucacaaauggcaaguacgaccuccugaacaucaaaaagaaaaaucuuuggggaguuagacuguucgaagcugccgagagcgcggcugggcggcgcauuaacagauccacgcggcgcagauaucggcgcagacggaaucgcaucaacuggcucaaugaaauuuuugccgaugagcugucuaagguggaccccagcuuccuuaccagacugaacuccucuuggaucagcaagaaagauuccagccggacacgcgacaaguacaaucucuuuauggaugccgacuauaccgauaaaaacuaccaccauaaguauccuacaaucuaccaccugagacgggaccugauguucgaugacaaacaguuugauauucgccucguguaccuggcccuucauaauaucauuaaguauagaggcaacuucaccuacgaccaccggaaguuuaaugucucugaaauguccagcaaccugacaaaagcccucgagaauuucaaccaagagcugauggaauuugaggacgcuuucccggauaacaccgacuauucugccaucuccgaagugcuucucaagagcaauaacguuucuacgaaaauugaugagaucauuuccaaucuggagcuggacaaggauaccaaaaaguaccugaaagaagugcucaagcugauccuugggaacagcgcgaaucugaacacaaucuuucauaccucccucgacaaggaugacgagaaacugucucuuagcgccaaggauauugaacugaaacucaauaaccuggacucccugcucagcgaugagcagauccacuucauuucuuccgcuaaugaacuguauagcucuaucacacuuaacgacauucuggacggaaagaccuaccucagccuggccaaaaucaagcaguaugauacgcacugcuccgaccuucaggagcugaaggagaugugguacaaaacaaccaaucccgaucucaucaagaaaucuagaaaggcuuacaaagaauauguccauggcagcuacaacacagaggacuuuuauaaggccauuuccccuuuccugaagaucgcgauucccgaagaucuggccaaagacgcucucaagaaaaucgaugccaauaccuaccugccuaagcaacgcaccagcaacaauggcgugauucccuuccagcuuaaccugaucgagcucgagaaaaucauugacaaccagucuaaguauuacccuuuucugaaggaaaaucgggagaaaaucauuuccauccugagcuuccgcauuccguauuacguugggcccauccaggcuccuacagauaagaacuuuucuuggauggugaaaaagauucaagccaaagccagacccuggaauuucgacgaagucaucgaucgggagaaguccagcaacaauuuuaucaaaagaaugacgaccacagacaccuaccuugugggagaaccugugcuccccaagaacucccugauuuaucagaaguucgagguccugaaugaacucaacaauauccgcauuucuaaaaaccugagccaggauccgcuuggcuccaagcugucuguugaggugaaacagcaaaucuuugaggaacucuucaagcgguacaaaacagucaagagcgaccagcugaagaaauggcugauuagaaauuccuauuuuaccgacccuacgaucaucgggcuuagcaagcccucugaguucaacuccagccucucuacauuuauugauaugaaagcuaucuucggaauggacuuugugaauaacccucgcaauuccagccagcuggaggaacuggcggaguggcucaccguguucgaagauaagcaaauucugucugagaaaauccggcacagcaacuaccccuauuccgaccagcagauuagaaagaucagcaacaugcgcuaccggggcugggggagaaucucuaagaaacuucugugugauauuaagguugaauccaccaucuauaaaagccaucagcuccaccccuacuccauucuggaccugauguggucuacaaauaacaauuucuacagcauccuucacaaggauaaauauaacuuugaguccauucucgaagacuacaaucugggaaccgaugacaagacagauaucaacgagcugguggacaauauccauacgucuccugcccucaagcggggcauuauccaaagcauuaacaucgucaaagagcuggugaaguucaugggccacgcuccgcagcauauuuuucuugaguucacccgcgaagauaaaacauccacccugucugaaagcagaaagaaacggcucaagaaacuguauaauaaccuguccgaggacacaaagaaguuuaaacuugaccucagagauuaccugguucccgacaagagcauccagaaagaacuggagucucacgauaaggaccucuccaaagagcgccugaugcuuuauuuccugcagaauggaaagagccucuacucugaugaagcccuggacauuaaccggcuguccgaguaucaaguggaucauauccuuccuagaaccuacaucaaggacgauagccuggaaaauaaagcccucguccuggcuaaggagaaccagcgcaaagccgacgaucuccugcuucagcccucuauuaucaauaagaacauggaaagauggauuuacaugaaagaccacgggaugaucuccccuaagaaguuuaaaaaccugacgcggaccacaauuaccgaggacgauaaggugcacuucaucaaucgccagcucguccaaacaagccagaucauuaaaaacguggcgaauauccuggacaacauguauaaggagcagggcaccacgugcguugaaacaaaagcuaaucuguccagcgccuuuagaaccgccuucucugagcaggaugacaaguaccauuuuaagcaccccgaguucauuaaaaaccgggaugugaaugacuuucaucacgcucaagaugccuaucuugcuugucugcucgggcuguaccgcauccagagauucccgagcgacgaaaugcuccugauuaagaaagaguaucggaaguucuuugcccaggcgcaaaacuccgucaaaaaucacggaaagaucccugauucucagaagaacggcuucauccuugcuccccuggugaauggggaaacacucauuaacaauaaaaccauggagaccaucuggaacauggacuacaagcgcaaaguuauuaagaucuuuaauuauaaacaguacaacauuacaaagagaacggaaaucaaaaccggagaguucuacaagcagacacuguauagcccucaugaugaaaaugugaagaaccccauuccucagaaaaagaaccuggaccccaaaaucuacggcggcuauuccgggguccaaucuagcuaccuugcuaucauuaagguggaucagaaaaagccgaccaugguguccguuccuauccgguuuucuaagaugauugacgacggaaaacugagccuccaguccuggcuggagaauaacaucaagcacaaaaagacaauugagguccucaaaaccaagauccccaucggccaacugacguauaaucccaagaacggguaccuuagcgugcagucugaaaaagagauugccaaugcucagcagcuguuccugccuuuugaacauguggcccuccugacacuucugcacgcgccgaccuccgaguaugaucaaauccucagcuucuacgacaccgauauucugcucgaaaucuuugacgagauuacaaacaagaucaaaaccuucuuucccuucuacaucgaugagcaggaauaucuggucucuauucgcgagaauuuccaguccgccacagugaucgaaaagguuaacgugcuucaacagcugcugauuaugcuccaugcuaauagcuccagaaucucuauuaaacugggagaggucagcaagaaggaccuuggccggaaaaagaaaagaaucccucuggaaaacacggaucucguguaccaguccguuaccgggcuguaucagacaaaguuucacauugacuga

SEQ ID NO: 4211 - RNA, 4074 nt, Artificial Sequence
  Cas9 variant
augaacgacagaaauaagaaauacaacaucggccuggauauugggaccggaagcgugggcugggccgucacagacaauaacuauaaucuccugcacgcuaagaaaaagaaccuuugggggauccggcuguucgauggagccgagacggcggcuucccgcagaaccuuucggucuacacgcagacgguaccgcagacggcgcaauagaauuaacuggcucaaugaaaucuucgccgacgagcuggccaaaaaggaucagagcuuucuuguucggaugaacuccucuugggugagcaagaaagacaagauucgccaaagagaucaguauaaucuguucauggacuccgauuacaccgacguggaauaucaucgggaguuucccacaaucuuccaccuccgcaaaagacugaucgaagauaagucucaggcugacauucggcuggucuaccucgcccugcauaacaucauuaaauauagaggcaauuuuaccuacgagcaccagaacuucgaugugagccauauggacuccgggcuugcucugcuccugaaucaacuuaaccagcagcugcaggccuuugagguugcguucccugacgaaacaaacuuugagagcaugucuaccauccuccuggaaaagaagacgccgacccagaaaauugaugagaucguggaccaaauucagcccgagaaggaucugcuccagaucaccaaaaauaucaugaagaugcugcuuggaaacaaagccgaccuggucaagauuuucucccucgauagcgacgauaaaaucacaguggaauuuucuuccaauagcauugagcaagaccugucuaaccuugaagagacacuguccgaugaacaguucaauaucauuacccucgcuaacagcaucuacuccucuaucguucugaaugacauucugagcggcgagacguaucucuccuucgccaaggcucgccaguacagcgaucacaagaaagaccuggccaaacuuaaaacaauguggcgggagucuccugacagaaaggcggugggcaaagccaagaaggcuuaugaugacuaccugcacuccgggaaauauggaaucgaagauuuuuacaaggacaugagcaaauuccucgagaccgccacacccgucgaacuggcuaaggaggccaacgagaaaauucuuaauaagucuuaucugcucaagcaacgcaacaaugaaaacggcgugaucccuuuucagcugaauaaaaacgagaugauugaaaucaucaauaaccaggccaaguacuaccccuuccuggcugagaacaaagauaagcuccugagcauucuuuccuuucggaucccuuauuacguggggccgcugcagucuaaaaaggacaaucccuucgcguggauggaaaagaaaagccaaggaaagauuagaccuuggaacuuugaugagaucgucgaccgcgaagccuccagcaauaacuucauucggagaaugaccucuaccgauacauaucucaucggcgagcccguucugccucugaaaucccccauuuaccagaaguaugaggugcuuaaugaacucagcaacgugcgcaucaaugcugacgaggucgauaacccgcugggggacaaacugucuguggaucucaagcaggccaucuacaaugaacuguuucuuaaacaucgguccguuagcaaggcccugcucacgaaguggcugauuaaccaguccuauuuccaaaauccucagaucucuggacuggcugacagcaaaaaguuuaacuccggccuuaccacauaccacgacuucaaaaagauuuuuggcgaggauuucgugaaugaccccaccaaccagucucagcucgagcaacuggccgaauggcugacaaucuucgaggauaaaaagauucucaagaucaaacuggacgauagccaguuuaauugcaccccugaacagaucaagaaaauugcggggaugagauaccagggauggggccgccuuuccaagaaacugcucugugacaucaagacgacaaccgucaccagcaagaaccaucaacaggcuucuuauuccauucuggaucugauguggaacacaaaucggaacuucaucagcgugcuuaaaaaugacaccuacaaguuugaggauaaaauucagacauucaaccucgacaagaaugaagccgccacgccccaagcuaugaucgaugagcugcagaccucucccgcccugaaaagagggauccggcaguccguuacaauuauccaggagcucgugaaguuuaugggacacgcuccugaacacauuuuccuggaguuuacccgcgaagacgaugucagcucucuuacaaagagcagagacucccggcugaacaaacucuaugccagaaucgcgaagaauaccaaaaagacggacgaugagcugaaaaagagccugcuuccgucuuccgacauuaaagccacccucaaggcuaacaagaauaaccugagcaaugaucgccugaugcucuacuaucugcaaaugggcaaaucccuuuacucuaaccagccccuggacaucaaucggcucagcgaauaucagaucgaucauauucugccucaguccuacaucaaggacaacucucuggagaauagagcccuugugcuggcuagcgagaaccaacacaaauccucugaucuccugcucaagcccgaaauuaucaaccagaauauugcccgcuggagauacaugaaagacgcggggcugaugggaccuaagaaguucaaaaaccuuacacggauccagauuaccgauagcgaccagaauaacuuuaucaaucgccaacugguccagacaucccagaucauuaagcaugugagcaacauccucgauucuauguauggcgaccaaggcacccagugcguugagacgagagcccaccuguccacagaguuccggaaggcuuuuagcaaugaagacgauaacuaccauuuccagcaccccgaauuugugaagaaucgcaacauuaaugacuaucaccaugcccaggaugcuuaccuggccugucuucuggggcucuaucaaaugaaaaaguacccgaccgacaacaugauccugcucaagaaagaguauaagagauucuucucuaauaccaaaaagauuuacgauaaaaagcaccauuuuccugacuacgucaagaacggauggaucaucggcuccauguucaauggggagaaauauguggaugaagagacaggacagauuaucugggaccagcagaccaaggauaugguuagcugcauuuuucaauacaaacaguauaacgugacaaagcggacggaagccgcuaauggcgaguucuacaaccagaccgucuauaaaaaggaccccaacgagaagcgcaaacugaucucucuuaagcaggggcuggauacaaaacucuacggcggauauuccggcgacaauccugcguacauugugcuggugaagaucgaugacaaaaagaacaaacugguuaagaugcccaucagacuugccgaacaagucgacaauaagaccauugaucugcagacauggcucgaggaaaacgugccucacaaaaaggggauccaggugcugaaaaccaagauuccccucggacaggucaucuacagcaaaaagaauggcuaucuggcucuuaaguccgacacggagauugugaacgcccaacagcugguucugccguacggguauguggcccuccugacacuucugcagaaaaugccugaaaauaaguacgaugagguccucgcuuguuaugacgauggaauccuggacaacauuuuuguggccaucaucgauaaaaugaagcacuucuaccccuauuacagcggcgagcucaaaacccugucugacaauauugauaacuuuaaggaaagccccgacguuaauaagaucaaaacccuucaacagcugcugcuccugcuucaugcguccucuacaaccgcuagcauugaguucaacaaugugaagaaaaacucccuggggcggaagccuaauucuaucaacauucagaacacagaucuccugagcuuuuccgccacgggccucuacgaaucucgcauccacaucgacuga

SEQ ID NO: 4212 - RNA, 4074 nt, Artificial Sequence
  Cas9 variant
auggccgcuaagaacuacaauaucggccuggacauugggaccagcuccaucggaugggccauuguggaugacaacuaucagcucaugcacgcgaaaggcaaguacggguauggaacaagaaucuacucugagggccaaacggcugccgaucggcgcggguucagaaccacacggcgcagacugaaucggcgcaaauggagacuucggcugcuccaggacuuuuucgaacccuauauucugccucaggaugaggccuuuuucauccgccagaagcaaagcaaccuugucccgcaggacaccaaaaagcaguaccccgaauccguucuguuugaugacacaucugauaaggacuucuauaccgaguacccuacaaucuaccaucucagacaggcucugaugaccgaaaaucggcaauuugauauucgcgagguguaucuggccauccaccauauugugaaauacagaggacacuuccucaacaaugcucccgucaagacguuuaaaagcggcaaccuggaccuugccaucaaguucaaugagcugaacgaagaguuuaaauccguguauccugaucucgaacugcaguucaaucuugaccagauugacgagaucaagaagauucugcucgauucuaccaaaagccgguuugaccgccagggcgaggcgguuaagcugaucuacacaguguccgaagucaaaaccaucgagaagcugcaaaacaaaauugugaagcaguuccucagcgggauccugggacuuaauacaagauucgauguucugaccaacacggaaucugacgauuccauguggaaauuuagccucgacucugaguccagcgaugacgcccuggaugaaauuaucgcucagcuugacgaucccgccauucauguggucgagcuggugaaugagauccacucuuccaucacacucgcuggcauugugccugaagggcaaggacugagcgaguccauggucgaaaaguaugaggcccacaaggcgcaucugcagcuccugaaagccguugaaaaacuuguggacaagaaggcugccgacaaacuggagguggcuuacgaucaguauaucaacggcaaggacucuaagcaguucauuaaagaggauuuuuacaaggccguccaaagcgaaaucaaagggguggccggagacgagguugcugaaauuaaccagcucaucgagcuggaucaguucaugccgaagcagcggaccaaagaaaauggcgcgaucccccaccaacuucaucagcacgagcuggacgugauuaucgagaaccaguccaaguacuaugauuggcucggcgaaaaggucgggaaugaguacaaacuggacaagcuggugagcuuuagaguuccuuauuacgugggaccccucgucgauacagccucuaaagaaaagaaagacgagacccgcuucgcuuggauggugcggaagaacccugaguccaccgaagccauuacacccuggaauuuugaggauaucgucgacaagaacgccagcgcugaaaauuucauuaaaagaaugacgaccaaggauaaauaucugcuuaacgaggacgugcugccgaagugcucucuccugacacaggacuuugaaguuuacaaugagcugaacaauauccgcgugaacggcgagaaauucaccgccgaacaaaagcagcuuauucacgaugagcucuuuacaaaacaugcgagcgucuccaucaagcagcugaaggacuuccuggugucugaacucauguauguucgggauaaucugaaaguggaggggcuugcugacgaaaagaaacugaugagcucccucagcacccaguuugauuaccaaaagaucauuccugaccagaucaacgaugucaaauacagagaggacauugagcagaucauugaauggucuacgaucuucgaggaugccgccaucuucaagacaaagcugaaagaaauugacuggcugaccgaugagcaacgcaauaaacuugcuaacaagcgguauagaggauggggcucccucagcaagcgccugcuggccugucucguggacgaaaacgggcagcggaucauugauauccugagagacucuuccgacaauuuuaugaugauugugaaccgccccgaguucaaacaggcuaucuuugaugagaaugccaaccuuaccgaaacaaauagcaagaaggacauguucgagaugaucgauaacuuuuacaccuccccucagaauaaaaaggcgauucggcaaguucugcucgucgugcaggacauccagaacgccaugggaggcguggcuccccagaaaauuuucaucgaauuugccagagaggaugaggucaauggccggcgcacaaacucuagauauagccaaauucgggaaauguacuccaaggugacggacgauguuaucaauaaaaccgugagaggggagcuggaagcuaacaagggaucucugaauaaggagaaacuuuuccucuauuuucugcagggcgggaucgaccuguacagcggaaagacaauuaacaucgauaauauuuccagcuaugacgucgaucacgugcucccccagucuuucaucaaagacgacuccauuaacaacaagguucuggugaaugccaaaggcaaccgcgucaagaaugauaacgugccuauggaacuuuuuggggcgaaaauguacccgaccuggaagcggaugguugacacaggcaucaugagcaaggccaaauucaagaaucugacccucaaccccgauaauguggacaaauuuaaggcugagggauucauuaacagacagcuggucgagacgcgccaaaucaucaaacugguggcccagauucuuaaugauaagcucggcgacgauaccaagaucgugucugucaaagcuaaccugacacaugacaugagaguuuucuuugauuucccuaagaaucggaacgugaauaacuaccaccaugccuuugacgccuaucuguccgcuuucguggggaccuaccucuauaaacgcuaccccaagcugcagccuuauuuugucuacggagaguucaaaaagauggauaaacuuaagaauaugaccagcuuugacuuccugagagaucucaagcacacagacaaagugguugacaaggauacgggcgagauuaucgcggacaaacuggccgugauuacaaacaugaacaagaucuaugauuuuaagaaaguccuggugacccacgaaguucaugaaaauucuggggcuauguacgaccaaacacuuuaccccgccaagcuggauaaaagccucggacggaagggcgccaaacagcugaucccgaagaaggacgauaugccuaccgcucucuaugggggcuacaccggauccaaagacgccuucaugagcauugugcgccugaagaaaaaggaugaagucuauuacaaagugaucggcauucccguuagaaucgcggacucugugcagcacgggaaggaggucgauguggaggcucuuacacaguuuauugaaacgaaauucaccaaggagaaccugaauaagaaaacaggagaaaucacccggaagguggagugguucgaacucguccugccuaaaguucuguuuggccaagccguguucgacgggggacagcccuuuaugcuuggcuccagcacauauccucauaaccugcgcgagcucgugcugaccaaggauuccgucaaaaagaucgccgggaaggagucuaauaaaagcuaccucgacgcuuaugacgaaauuauggaggccaugaacaaguacuucccccuguacgauacgaauaaauuuagagaaaaggugaucgagggccgguccaaauucauugaccuuccggauaaggacgaguaugaaaacaauaagcugguucaggugggaaaaucuacaaucauugaucgcauguuuaucggccuccacgcgaacgcugccagaaccgaccugaagaauauugggaucaccacaccuuucggauuuaugcagcaagccagcggcaucaaacugaccaaggauacagucgugcuuuuccaguccucuacggggcuguuugagcggaaaguugcucucaaggaccuguga

SEQ ID NO: 4213 - RNA, 4077 nt, Artificial Sequence
  Cas9 variant
augaaggagcccuacggcguggggcuggacaucggaaccaacagcgucggcuggacaguuguggaugccuccgggcacgugagaaaaauuaagggacagacgggcaucggggucagacucuucaaagaaggagcugccgcggcugaccgcagaggcuuucggaccacacgcagacggcugaagcgcgugaaauggagacuucggcugcuccgcgaguucuuugaucaaccuauuucuaagguugacaucaauuucuuugccagacggaaguauagcgauguguccccgcgcgaccccaacuacaauggccuggaaaagacccuuuucaacgauagaucugaccaggauuuuuaucaugacuacccuacaauuuaucaucugcgggaggcccucaugacccagcaccgcaaguucgaugucagagaaaucuaccuggcuauccaccauauugugaaauaucgggggaauuuucugagaaacgacgccgcuacagccuaccgcagcggaacccucgaucugcagcaacacuucgagacgcuuaaucaccuguuuucccaggcggaccucgagcugaaccuuaaucugaccacagacguugcccuccuggauucuaucaagcagacccuggugcggacagacauuagcagauccgaucgccagaaacucaucaugccccugcuugcuguccugaccggcgccacgacagcugaaaagaagcggcaaaaagccguggugaccgaguucgcgaaggcccucgucgggaacaaaacaaagauugacguucugacccuuaccgauaucgacgcuacagaagccaaagauugggcuuuuagccuggaggagaaucaggacaagcucccuggaauugaagauagauucucugaggugggccagcagaucaucgacgaagugauucgccuguacgccuccgucaaccuggcccaacucauccccgaggggaaacgguucagccagucuaugguggaaaaguauaagagacauggagaggaucugaaacuucugaaggcuuacauucgcucccagagcgacgcgaaacggggcagagccauccgcgcuacguaugaccaauacauugauggcguuaagucuaaacaggugacccaggaggccuuucagaaggcccucgggaaguucgucgacgcugauguggaccuuaauuccugggccgcgcaaaucaaacaggcuaucgauagcgaacaguuuaugccuaaacugcggacaaaacagaacggagccauuccguaucaaguucagcagaaugagcuggaccagaucauuuccaaccaaaaggaauacuaucccuggcucggcgaggaaaacccugugaucaaaagacgggggaaguuccccuacaagcuggaugagcuguuuggauuccgcgucccuuacuaugugggcccccucauuaccaaagagaugcaggccgcuacagccaaugcuggguuugccuggauggucagaaaggcggacggaccgaucaccccuuggaacuucgaugacaaaguggaucggguugccucugcuacggccuuuauccagagaaugcagacaaccgacaccuaccugauuggcgaagaggugcuucccgcucgcagccugaucuaucaacgguucaugguccucaaugaacugaacaauauuagaguggaugacggccagcugacaccucgccagaagcaaagacuuuacaaccagguuuuuaaaaagcacaagcgggugaccgccaaaaauauccaggacaaccucgucgcggcccgcgaguuccccacagcucccagaauuacggggcuggccgauccuaagguguuuaauuccagccugucuaccuaucaugaccucaaacaggugcugccggaagcuauguccgauguucggaagcaagccgacaucgagaaaauuauccuuuggagcacaaucuucgaggauucuaccauuuucaagcagaaacugacagaaaucagcuggcucaccgccgcucagcugaagcagcugggacaacuucgcuacagaggcugggggcagcuccugcggaagcugcucacgggacugaaagacgauaacaaucgcuccauuauggacggccuuugggagaccaacgcgaauuuuaugcagcugagaucucagcccgccaucgaaaaccaaauuaagagcgcuaaucaggccaaccucacaaccgccgaucugcaggacacaaucaacgagcuguauaccuccccucaaaauaaaaaggcuauccgggaggucaugguggugcuugccgauauuaaagacgcgaugcacgggcagacgcccaacuggaucuucgucgaagcugcccgcggcggaggcguggccgggagacggacacagagcagaucuaagcagauuguugcugccuaccaaggaaccgcgcaggcuaucgugcgcgaucagguccagcgggagcucaaggagaaaauuaagaauaaagccaacuuuaauacaagacuggugcuguacuuccuccaaaacggccgcgaccuguauaccggggacgccaucaauaucgaucggcuuuccgaauacgacauugaucacauccugccucagagccucguuaaggacgauucucuggacaacagagugcugaccaaugcucgcauuaaccgggagaaaaaugauacauuugccuccgaaaaguucggaaagaaaaugggcgcuaaguggaaagagaugcauagaauggggcuuaugacgaagcgcaaacucgaccaucugcugaugcggcccgaugaaaucagcaaguaugccaccggcuuuauuaacagacagcucgucgagacacgccaggugaucaagcugguugaggaacuuaucaaugcggaauacccguccaccgccauugugucugucaaagcuaaccugacacaccaauuccggcagaccuuugacuucccuaagaucagagaggugaaugauuaucaccaugccuuugacgcugcccucacggccuucauuggaacauaccugcugaaacgguaucccaaacuugagcgcuuuuucguguacggcaaauucgcuaagcagccugucaaccugaccagauuuaacguuauccggaaacucgcgaagaccgacacacccauuaccgauaucgacacaggggaagugcugugggauaagcucacggacauuaaauacuucgagacccuguaugauuacaagagacuucuggugacacgcgaagucagcgagaauuauggagccauguuugaccagacccuccugaaggcuuccgauaacggcaagcggcugauccggaaaaagcaaucuuucgacacagccaucuacgggggauauaccggcaagacgcuugccuacauggcuauugugaaaguuagcaccaagaaagaugugcaguaucaggucguggggguuccuacaaccauggugacacaaaucgaacagcuggagcagcagggcaugaccaauaagcaagccgucacaaaagugauugagccccucaucgcggcuaacaauaagaagaugcugaccuacgaaguucuccugccgaaagugcgcuuugagcaggucgugcgggacagaauuaagggacagacgcaccgcuucgcccuuggcacagauaccuacuaucacaacauccaggaacuguaccucccucugacccugcaacgggccuuucuugggaaacagaaugaguccgaggugcagcugaaccagaaucuccugacagucuucgacgcuacccucgcccaaguuaacagauauuuuccccuguacgaaaugaauaaguucaaaaagauccuuaacagcgcgcgcgaucagauugagcugcuggaagcuaagaaucaguuugugaaaaacaagcucgugcugggaaaacaaggcauccuuacgaauauguucauugggcugcaugccaacgccucuuauggagaccucaagguccugggcgugaaaaucgacuucgggaagcuccagguucccggcggaauuaagcugacaggcgaugcugagaucaucuaccaguccccuaccgggcuuuuugaaagaaaaauugcccugaaggaccuguga

SEQ ID NO: 4214 - RNA, 4077 nt, Artificial Sequence
  Cas9 variant
augaacgagcccuacggcguggggcuggacaucggaaccaauagcgucggcuggacaguuguggauaugaacgggagagugcggaaggucaaaggaaagacggcccucggcgcucgccuguucaaagaaggggccaccgcggaggacagacggggauuucgcacaaccagacggcgccuuaagagagugaaauggcggcugcgccuccugagagaguucuuugaucagccuauuuccaagaucgacccgaauuucuuugcucggcgcaaguauucugauauuagccccagagacccuaacuacaauggccuugccaaaacacuguucaacgaucggaccgaccaagaauuuuaucacgauuaccccacaaucuaucaucuccgcgacaagcugaugaccuccgauagaaaauucgacauucgggaaaucuaccuggccauccaccauauuguuaaguauagaggcaauuuucuccgcacggggccugcuucucaguacggaagcgccucccugcaccuugcuaccucuuuccagaaacugaacgaucucuuugcccagagcgaggagucccugaauuucaagcuggugacagacgaagcgcaacuucagcagauccagcaaauucucguccggaccgaccugagcagaucugagcagcagcgccagaucuggccccugauggugguucucaugggcgccacagcugccgaaaagaaacggcaaaaggauuuugcuaaagagcuggccaacgcgcuuguggggcugaaggccaaacucaaugucgugacccugacgaacguggacacaaccgucguuaaggauuggacauucacccuugaggaaucccaggacaaacugccugagauugaggaacagcucagcgaagugggacaacagaucauggaugaggugauucagcuguacgcuucugucaaucuggcccagcucaucccggcuggcaagagauucucccaacauaugguggagaaguauaaccaccacgaaaagaaucuggagcuucugaaggccuacauccauagccagucugacuccaaacgcgggcgggaaauuagagccaccuaugaucgcuacaucgacggaguuaagagcaaacccgugacacaggagauguuuuauaaggaucucaugaaguacgucgaagcugacgcgacguccaaccaccuggccgcugagauuaaagaugagaucgacucugaacaguucaugccuaaacuucggaccaaacaaaacggcagcauucccuaucaggugcagcaguacgagcuggaccaaaucaucucccaucagaagaaauacuauccuuggcucggcgaagagaaucccguugccgaaagacgcgggaaguuuccguacaagcuggaugagcuggugggauuccgggucccuuauuacgugggcccccucauuacaaaagaggaccagcaggccaccagcggggcuggauuugccuggauggucagaaaggcggauggcccuaucacacccuggaacuucgaccaaaaaguggaucggauugcuucugccaccgccuuuauccagcgcaugcagacgacagacaccuaucugauuggggaagauguucuucccgcuagaucccugaucuaccaacgguucauggugcucaaugagcugaacaauaugagagucgaagaccagaagcuggccccucgccagaaacagcggcuuuauaaccaaguguuuaagcagcaccagcacguuagcgugaagaauauccagcaaaaccucauggaugcuggagaguacagagagaccccgaaaauuacaggccuggccgaccccaagggcuucaauucuagccuguccaccuaccaugauuuuaaaaagauccucccugaagcgauugccgacgagcacaaacgcgcugauaucgaaaagauuauccuguggucuacaacguucgaggacagcgccauuuuuaaacagaaacuugaagaggucgcuuggcugaccgacgcccagagaaagcagcucuccgggcugcgguaucgcggauggggccaacugagccauaaacuucucacagcguucaaggaugacaacgggagaucugugauggauggacugugggagaccuccgacaauuucaugcagcugcggaaacagcccgccaucgaaacacaaaucaaggaggcuaaccaggccaaucucaccgaugcugacauucaggauacgaucaacgaacuguacaccagcccucagaauaaaaaggccauucgcgaggugaugcuuguucuggacgauaucaagaacgccaugcacggccaaacacccucuuggauuuuuaucgaagcugcgagagggggcggagucgccggccggcgcacccaguccagaagcaaacagaucguggaggcuuauaaguccacagccaaagagauugugucugaaaagguccagcaugagcucaacgaaaagaucaaggccaaggcugacuucaauacccggcuggugcuguacuuucuucaaaacgggcgcgaucucuauacgaaugaggccauuaacaucgacagacugagcgaauacgauauugaccacauccugccgcagucccucguuaaagacgauucucuggacaaucgggugcuuacaagcgcgagaaucaaccgcgagaagaaugauaccuucgcuuccgagaaauuuggacggaagaugggcgcccaguggagagaacugcaccgcaacgggcucaugacacagcggaaacugaagcaucugcuuaugagaccugacgagauuagcaagcacgccaccgauuucaucaaucgccaacucgucgaaaccagacaggugauuaaacugguugaggagcugaucucuuccgaauaucccagcgcuucuauuguggccgucaaggcgaaccucacacaucaguuucggcagacguucaauuuuccuaaacugcgcgaggugaacgacuaccaccacgcuuucgaugccucccuuaccgccuuuaucggaauguaccugcucaagcaauaucccaaacuggaacgguucuuuguuuacggcaaguucgcuaaacagccuaucaaucugacaagauucaacgugauucggaaacuugccgucgcugaggaacccaucgccaauauugagaccggggagauccugugggacaagacagcggauauuaagugcuuugaaaagcucuauaacuacaaacgccugcucgugacccaugaggugagagaaaacuauggcgccauguucgaccagacgaucuuuaaggcuacagauagccggaaacgccugauucaaaagaagaaaggauucgccaccgagaccuacggcggguauacaggaagaacccuugcuuaccuggccaucgucaagguugugacaaauaaagacacgcaguaccagguggucggcaucccgaccacaauggugacccagauucaacagcucgaagccucugggcugacaagcaagcaggcuguuaccaaagcgaucggagccaugauuaacgagaauaacaagaagcugcaguccuaugaggugcuucugccuaaaguccgguuugaacaagugguuagagacgaggugaagggccacauccaucgcuucgcucucgggacggauaccuacuaucacaauauucaggaacuguaccucccccugacaauccagcgggccuuucuuggcaaaagaaacgacaccgaugcccagacagagcaaaaucugcucaccgucuucgaaacaacccuggcucaggugaaccgcuauuuuccccuguacgagaugaauaaguucaaacagauccuuaacagcgcccaagagaaguuugcggcucugccuacgaagaauaaaacaguuaagaacaaacucgugaccggaaaggacggcguccugaauaaccucuucauugggcugcaugccaaugccucucuuggagaucugaaaauccugggcaugaagaccggguucggaaagcuccaggugccgggcgggcugaaacuuacagaccaggcugaaauuaucuaucagucccccaccggccuguuugagcggaagguggcccucaaagaucuguga

SEQ ID NO: 4215 - RNA, 4077 nt, Artificial Sequence
  Cas9 variant
augaacgagcccuacggcguggggcuggacaucggaaccaauagcgucggcuggacaguuguggauaugaacgggagagugcggaaggucaaaggaaagacggcccucggcgcucgccuguucaaagaaggggccaccgcggaggacagacggggauuucgcacaaccagacggcgccuuaagagagugaaauggcggcugcgccuccugagagaguucuuugaucagccuauuuccaagaucgacccgaauuucuuugcucggcgcaaguauucugauauuagccccagagacccuaacuacaauggccuugccaaaacacuguucaacgaucggaccgaccaagaauuuuaucacgauuaccccacaaucuaucaucuccgcgacaagcugaugaccuccgauagaaaauucgacauucgggaaaucuaccuggccauccaccauauuguuaaguauagaggcaauuuucuccgcacggggccugcuucucaguacggaagcgccucccugcaccuugcuaccucuuuccagaaacugaacgaucucuuugcccagagcgaggagucccugaauuucaagcuggugacagacgaagcgcaacuucagcagauccagcaaauucucguccggaccgaccugagcagaucugagcagcagcgccagaucuggccccugauggugguucucaugggcgccacagcugccgaaaagaaacggcaaaaggauuuugcuaaagagcuggccaacgcgcuuguggggcugaaggccaaacucaaugucgugacccugacgaacguggacacaaccgucguuaaggauuggacauucacccuugaggaaucccaggacaaacugccugagauugaggaacagcucagcgaagugggacaacagaucauggaugaggugauucagcuguacgcuucugucaaucuggcccagcucaucccggcuggcaagagauucucccaacauaugguggagaaguauaaccaccacgaaaagaaucuggagcuucugaaggccuacauccauagccagucugacuccaaacgcgggcgggaaauuagagccaccuaugaucgcuacaucgacggaguuaagagcaaacccgugacacaggagauguuuuauaaggaucucaugaaguacgucgaagcugacgcgacguccaaccaccuggccgcugagauuaaagaugagaucgacucugaacaguucaugccuaaacuucggaccaaacaaaacggcagcauucccuaucaggugcagcaguacgagcuggaccaaaucaucucccaucagaagaaauacuauccuuggcucggcgaagagaaucccguugccgaaagacgcgggaaguuuccguacaagcuggaugagcuggugggauuccgggucccuuauuacgugggcccccucauuacaaaagaggaccagcaggccaccagcggggcuggauuugccuggauggucagaaaggcggauggcccuaucacacccuggaacuucgaccaaaaaguggaucggauugcuucugccaccgccuuuauccagcgcaugcagacgacagacaccuaucugauuggggaagauguucuucccgcuagaucccugaucuaccaacgguucauggugcucaaugagcugaacaauaugagagucgaagaccagaagcuggccccucgccagaaacagcggcuuuauaaccaaguguuuaagcagcaccagcacguuagcgugaagaauauccagcaaaaccucauggaugcuggagaguacagagagaccccgaaaauuacaggccuggccgaccccaagggcuucaauucuagccuguccaccuaccaugauuuuaaaaagauccucccugaagcgauugccgacgagcacaaacgcgcugauaucgaaaagauuauccuguggucuacaacguucgaggacagcgccauuuuuaaacagaaacuugaagaggucgcuuggcugaccgacgcccagagaaagcagcucuccgggcugcgguaucgcggauggggccaacugagccauaaacuucucacagcguucaaggaugacaacgggagaucugugauggauggacugugggagaccuccgacaauuucaugcagcugcggaaacagcccgccaucgaaacacaaaucaaggaggcuaaccaggccaaucucaccgaugcugacauucaggauacgaucaacgaacuguacaccagcccucagaauaaaaaggccauucgcgaggugaugcuuguucuggacgauaucaagaacgccaugcacggccaaacacccucuuggauuuuuaucgaagcugcgagagggggcggagucgccggccggcgcacccaguccagaagcaaacagaucguggaggcuuauaaguccacagccaaagagauugugucugaaaagguccagcaugagcucaacgaaaagaucaaggccaaggcugacuucaauacccggcuggugcuguacuuucuucaaaacgggcgcgaucucuauacgaaugaggccauuaacaucgacagacugagcgaauacgauauugaccacauccugccgcagucccucguuaaagacgauucucuggacaaucgggugcuuacaagcgcgagaaucaaccgcgagaagaaugauaccuucgcuuccgagaaauuuggacggaagaugggcgcccaguggagagaacugcaccgcaacgggcucaugacacagcggaaacugaagcaucugcuuaugagaccugacgagauuagcaagcacgccaccgauuucaucaaucgccaacucgucgaaaccagacaggugauuaaacugguugaggagcugaucucuuccgaauaucccagcgcuucuauuguggccgucaaggcgaaccucacacaucaguuucggcagacguucaauuuuccuaaacugcgcgaggugaacgacuaccaccacgcuuucgaugccucccuuaccgccuuuaucggaauguaccugcucaagcaauaucccaaacuggaacgguucuuuguuuacggcaaguucgcuaaacagccuaucaaucugacaagauucaacgugauucggaaacuugccgucgcugaggaacccaucgccaauauugagaccggggagauccugugggacaagacagcggauauuaagugcuuugaaaagcucuauaacuacaaacgccugcucgugacccaugaggugagagaaaacuauggcgccauguucgaccagacgaucuuuaaggcuacagauagccggaaacgccugauucaaaagaagaaaggauucgccaccgagaccuacggcggguauacaggaagaacccuugcuuaccuggccaucgucaagguugugacaaauaaagacacgcaguaccagguggucggcaucccgaccacaauggugacccagauucaacagcucgaagccucugggcugacaagcaagcaggcuguuaccaaagcgaucggagccaugauuaacgagaauaacaagaagcugcaguccuaugaggugcuucugccuaaaguccgguuugaacaagugguuagagacgaggugaagggccacauccaucgcuucgcucucgggacggauaccuacuaucacaauauucaggaacuguaccucccccugacaauccagcgggccuuucuuggcaaaagaaacgacaccgaugcccagacagagcaaaaucugcucaccgucuucgaaacaacccuggcucaggugaaccgcuauuuuccccuguacgagaugaauaaguucaaacagauccuuaacagcgcccaagagaaguuugcggcucugccuacgaagaauaaaacaguuaagaacaaacucgugaccggaaaggacggcguccugaauaaccucuucauugggcugcaugccaaugccucucuuggagaucugaaaauccugggcaugaagauuggguucggaaagcuccaggugccgggcgggcugaaacuuaccgaccaggcugaaaucauuuaucagucccccacaggccuguuugagcggaagguggcccucaaagaucuguga

SEQ ID NO: 4216 - RNA, 4077 nt, Artificial Sequence
  Cas9 variant
augaaggagcccuacggcguggggcuggacaucggaaccaacagcgucggcuggacaguuguggaugccuccgggcacgugagaaaaauuaagggacagacgggcaucgggguccgccucuucaaagaaggagcugccgcggcugaccggagaggcuuucggaccacacgcagacggcugaagcgcgugaaauggagacuucggcugcuccgcgaguucuuugaucaaccuauuucuaagguugacaucaauuucuuugccagacggaaguauagcgauauuuccccgcgcgaccccaacuacaauggccuggaaaagacccuuuucaacgauagaucugaccaggauuuuuaucaugacuacccuacaaucuaucaucugcgggaggcccucaugacccagcaccgcaaguucgaugugagagaaaucuaccuggcuauucaccauaucgucaaauaucgggggaauuuucugagaaacgacgccgcuacagccuaccgcagcggaacccucgaucugcagcaacacuucgagacgcuuaaucaccuguuuucccaggcggaccucgagcugaaccuuaaucugaccacagacguggcccuccuggauucuauuaagcagacccugguucggacagacaucagcagauccgaucgccagaaacucauuaugccccugcuugcugugcugaccggcgccacgacagcugaaaagaagcggcaaaaagccgucgugaccgaguucgcgaaggcccucguggggaacaaaacaaagaucgacguccugacccuuaccgauauugacgcuacagaagccaaagauugggcuuuuagccuggaggagaaucaggacaagcucccuggaaucgaagauagauucucugagguuggccagcagaucauugacgaagugauccgccuguacgccuccgugaaccuggcccaacucauucccgaggggaaacgguucagccagucuauggucgaaaaguauaagagacauggagaggaucugaaacuucugaaggcuuacauccgcucccagagcgacgcgaaacggggcagagccauucgcgcuacguaugaccaauacaucgauggcgugaagucuaaacagguuacccaggaggccuuucagaaggcccucgggaaguucguggacgcugaugucgaccuuaauuccugggccgcgcaaaucaaacaggcuauugauagcgaacaguuuaugccuaaacugcggacaaaacagaacggagccaucccguaucaagugcagcagaaugagcuggaccagauuaucaacaaccaaaaggaauacuaucccuggcucggcgaggaaaauccuguuauuaaaagacgggggaaguuccccuacaagcuggaugagcuggugggauuucgcgucccuuacuaugugggcccccucaucaccaaagagaugcaggccgcuacagccaacgcuggguucgccuggauggucagaaaggcggacggaccgaucaccccuuggaauuuugaugacaaaguggaucggguugccuccgcuacggccuucauucagagaaugcagacaaccgacaccuaccugaucggcgaagaggugcuucccgcucgcucucugauuuaucaacgguuuaugguccucaacgaacugaauaacaucagaguggaugacggccagcugacaccucgccagaagcaaagacuuuacaaucagguuuucaaaaagcacaagcgggugaccgccaaaaacauucaggacaaucucgucgcggccggggaguuucccacagcuccccgcaucacgggacuggccgauccuaagguguucaacagcucccugagcaccuaucaugaccucaaacaggugcugccggaagcuaugucugauguuagaaagcaagccgacauugagaaaaucauccuuugguccacaauuuuugaggauagcaccaucuucaagcagaaacugacagaaauuucuuggcucaccgccgcucagcugaagcagcugggccaacuucgguaccgcggguggggacagcucagcagaaagcugcugacgggccucaaagacgauaauaaccgguccaucauggacgggcugugggagaccaaugcgaacuucaugcagcuucgcucucagcccgccauugaaaaucaaaucaagagcgcuaaccaggccaaccugacaaccgccgaucuccaggacacaaucaaugagcuguauaccuccccucaaaacaaaaaggcuauuagagaggucaugguggugcuggccgauaucaaagacgcgaugcacggccagacgcccaauuggauuuuugucgaagcugcccggggaggcgggguggccggacgcagaacacagagccggucuaagcagaucguugcugccuaccaaggcaccgcucaggugauugucuccgaucaggugcagagagagcuuaaggagaaaaucaagaacaaagcgaauuucaacacacgccucguucuguacuuucugcaaaaugggcgggaccucuauaccggagacgccaucaacauugauagacugagcgaguacgacaucgaucacauucuuccucagucucuggugaaggacgauucccucgacaaucgcguccugaccaacgcccggaucaauagagagaaaaacgauacauucgcuagcgaaaaguuuggcaagaaaaugggggccaaguggaaagagaugcaucgcaugggccugaugacgaagcggaaacuugaccaccuccugaugagacccgaugaaauuuccaaguaugcuaccggauucaucaaucgccagcugguggagacacggcagguuaucaagcucguggaggaacugauuaacgccgaauacccgucuaccgcgaucgucagcgugaaagccaaucuuacacaucaauuuagacagaccuucgacuuuccuaagauucgggaggugaacgauuaucaccaugcuuucgacgccgcucugacggccuuuaucggcacauaccuccugaaacgcuaucccaagcuggagagauucuuugucuacgggaaauucgccaagcagccuguuaaccuuacccgguucaaugugauucgcaaacuggcuaagaccgacacacccaucaccgauauugacacaggagaagugcucugggauaagcugacggacaucaaauacuuugagacccucuaugauuacaagagacugcuugucacacgggaaguguccgagaacuauggcgcgauguucgaccagacccugcucaaagccucugauaaugggaagagacugauccgcaaaaagcagagcuuugacacagcuauuuacggaggcuauaccgggaagacgcuggccuacauggccaucguuaaaguguccaccaagaaagauguccaauaucaggugguuggcgugccuacaaccauggucacacaaauugaacagcuugagcagcagggaaugaccaacaagcaagcugugacaaaaguuaucgagccccugauugccgcgaauaacaagaagaugcucaccuacgaagugcugcucccgaaaguccgguucgaacagguggugagagaccgcaucaagggccagacgcaccgguuugcucuggggacagauaccuacuaucacaauauccaggaacuuuaccugccucucacccugcaaagagccuuccugggaaaacagaacgagagcgagguccagcuuaaucagaaccugcucacaguuuuugacgccacccuggcucaagugaaucgcuauuucccccucuacgaaaugaacaaguuuaaaaagauucuuaauucugcccgggaucagaucgagcugcuggaagcgaagaaccaguucgugaaaaauaagcugguccucggcaaacaagggauucugacgaacauguuuaucggacuucaugcuaacgccuccuucggcgaccucaagagccugggggugaaaacaucuuucggccagcugcagguucccggaggcauuaagcucaccggggacgccgagaucaucuaucaguccccuacaggacuguuugaaagaaagauugcucuuaaagaucuguga

SEQ ID NO: 4217 - RNA, 4077 nt, Artificial Sequence
  Cas9 variant
augaagcagggcaaaagaggguacuaucugggacucgacaucggcaccgauagcauuggguacgccgugacagacgagcaauaucaucugcuucgguuccauggaaacgaugcuuggggcucccacgucuuugacucugccagccugugcgaugaacgcagaggguuccgguccgcgcgcagacggcucgaccgcagacagcagcggguuaagcugcuucaggagaucuuugcuaaagaaauugccaauaucgauccccgcuucuuuauuagacugucugagagcuaccgguggcgcgacgauacggacgauagauauaucuacuucaacgaagaggaguauaccgacauccaauacaugcgggauuacccuacaauucaucaccucaucugugaacugauggagaaugaagaggagcaugacauucgccugguguaucucgccugcgcuuggcugguggcccacagaggacacuuucuuucccagcugucugucgacaacaucgauagccucauugacaucgaauccguguaccagaaguuccugcacuuuuucauugauaauggcugugagaacccguggauccaggacgcugaacuuguuggcgggauccugaaagagcacauuggagugaccgaaaagcauaaucggcucggcgagaucaugcuggggaacagaaagcccagcaaagauguccgcgacacauuucuguauucugaguacugcauuauccggcuccuggccggaggcaccuguaaacuuagagaucuguaugggaaagaagaguacgaagacuucggauccgugagccucgagauggaugacgauaagcuggcggaaauuaugaucaauaucggcgaggacuaugagcuuauugccguucugcgcucucuccacgacugguccgugcuggcugauauccuggacggccaaaacgggcucacaaauauuagcaccgccaaagucgcuaucuacgaacagcacaagaaggaucuggccacgcuuaaauacuuuauucggaaguauugcccugagaaauacaacgcgaucuucaaggacgccagagaagauaauuauguggcuuacucuuaucauuacaacaauaaacuggacggacagaucaagaaaaaggccgauaccgagacauucuccaaguuucucauuaaaaucauucacagcaucaagcccgacaaagaagaugagauuaucuaucaggacauggauaaccgccugggccuucggcaauuccugccuaagcagagaaacaccgacaaucgcgugauuccccaucagcucuacgaguacgaacugaaaaagauccuggagaacgcugccaaguaucucuccuuucugaaucaaaaagaagaugggaucucuaacacagagaagauuaucagcauuuucaaauuuaagaucccuuacuaugucggaccgcuuaauaaacacuccgaguucgccuggauugacagaaagagcggcaagauccugcccuggaacuacgaaaauaugaucgacgaugacgcuucugaggaagcguuuauuaaaaagaugaccaaccaguguacguaucucccuggggaguccguucugcccaaagauagccugugcuaccagaaguucauggugcuuaaugaaaucaacaauauuaaaguggacggacggaagaucucugucggcgccaagcagggcauuuauagcgaucucuuucugaaauacaagaaagugaagcgcucccaaaucgaggaguaccugaucucuaacgggcagcucgaaaagaaucggagagagacacugagcggaauugacauccagauuaaguccagccuuucuucccauaucgcuuuccggcgccugcucgaacagaaaauucugaacgaggccgauguugaaagaaucaucgagcgggccagcuaugcugaggacaagggcagaguggccaaguggcugcgcgcgaaauacccucaccuuaccgaagcugauauuaaguauaucuguaaagucaagauuaaagacuuugggcggcucucuagaacauuccugaccggaaucgagggcgccugcaaggaaaccggggagguggccacaauuaucuccaugaugugggaaagcaaugauaaccugauggagcuccuguccgagcgcuacacguuugcugacaccauucuugaguucaagucugauuauuacacagaaagaaaacaaacccugagcgaacggcucgacgagauguauguuuccaacgccgugcgcagacccaucuaccggacacuggacaucgucaaggaucuggagaaggcuuucggcaagccggagaaaauuuuuaucgaaaugacccgcggagccaugccugaacuuaagggcaagagaacgaaaucucggcagcagcagcuccuggaguacuaugacaaguguaaagaagaggaugugcgcgaccugaagcaacagcucgaggcgcugggggaauacgucgauaauaaacuucagagcgacagacuguuccucuauuuuaugcaguucggaaagugcgccuacuccggcaugcccauuagccuggagcggcugauggcugggucuaaggaauaugauaucgaccacauuuacccucaagccuaugugaaagaugacuccaucaucaacaauaagguucuugugcucagcgucgcuaacggagagaaaaaggauguguaccccauuaaaucugaaauccgcaauaagaugcagaaaacaugguccuuuuggcaucacguuggcaccauuagcgacgagaaguacaagagacugauccggucuacccccuucacagaggacgaaaaauauggguuuauuaacagacagcugaccgagacaagccaauccacgaagguggucgccgaacuccugaaagagcgcuacccugaagcggagaucguguauagcaaggccggccuuaucucugauuuccggcaugaguuugaccuguacaaauccagaagcuauaaugaucuccaccacgcuguggacgccuaccugaacauuguugucggaaauguguaucauaugcgcuucucccggcagugguuuaacgucaauucuagcuacuccaucaagaccaagacacuguucacccacacagugaacugcaauggcaaagaaguguggaacaaggauaugcuuccggggguucugaaaaccgcuaagaaaaauacggcccauuuuaccaagcacgccacauucaagaccggaggccucuucgaccagaaccccgugaaaaaggcuccugggcugacaccccucaaagcgggacugccuaccgagaaguacggcggguauaacaaagccggcgucauguuuuucauucccgugagauacaagucuggaaagaaaacgguucuuauggugcugagcgucgaacuccuguauggcaaucgcuuucuggaggaugagaucuucgcuaaggaauacgccaaagaccggcuucagagaaugauugggaaguccguggaugagaucgacuuuccgauuggaaugcgcccuuggaaaguuaacacaauccugucucucgauggcuuccggaucuguauuaccgggaaugccagcggaggcaagugccugaucgcucaacccauuaugcaguuuuccagcgacgaauauuggaaguacuaucucaaaaagguggagaaauucgucgaaaaggugaaaaacaauucuuccuacguguacgaugucgacuaugacgccguucagcaugaggauaaccugaaacuuuacgaccuguaucucgauaaacugcagaauagcaucuacagaaagcggauuaacgcgccuauccaaacacugaucgaggggcgcgaaaaguuuauugacuguucugugaucgagcagugccaggugcuucugaauauucaccaggucuucggcagaaugaccuccggaugugaucucacccugaucggcgggaaaacacggagcgcuucuacggugaacuuuuccagcauuauccucaauuggaagaaaaacuauaccgacguucgcaucauugaucaauccgccagcggacugugggaaguggucucugagaauauccuugaauaccuguga

SEQ ID NO: 4218 - RNA, 4077 nt, Artificial Sequence
  Cas9 variant
augggcaagauguacuaucuggggcucgacaucggaaccaacagcgugggcuacgccgucacagaucccuccuaucaccuucuuaaauucaagggggagccuauguggggagcucauguuuuugccgcgggcaaucagucugcugaaagacggagcuuccgcacguccagacggcgccuggacagacggcaacagcgcgugaaacucgugcaggagauuuuugccccggucaucucucccauugauccuagauucuuuauccggcugcacgaaagcgcccuuuggcgcgacgauguggcugagaccgacaagcauauuuucuuuaacgaucccacauacaccgacaaagaauauuacuccgauuauccuacaauccaccaucugaucguugaccucauggagucuagcgagaagcacgaucccagacugguguaccuggccgucgcuuggcucguggcccaccgggggcauuuccugaaugaaguugacaaggauaacauuggagacgugcuuuccuuugacgcguucuacccugaguuucuggccuuccucagcgauaauggcgucucuccgugggugugcgaauccaaagcucugcaggccacccuucugagccgcaacucugugaaugacaaguauaaagcucucaagucccugaucuuuggcagccaaaaacccgaggauaacuucgacgccaauauuucugaggaugggcugauccagcuccuggcgggaaagaaggucaaaguuaacaagcuguucccucaggaauccaaugacgccagcuuuacacugaacgauaaagaggacgcuauugaagagauccucggcacccugacgcccgaugaaugugaguggauugcccacaucagacggcuuuucgacugggcuaucaugaagcaugcccugaaagaugggcgcaccauuuccgagucuaaggugaaacucuacgaacagcaccaccaugaccugacacaacugaaguauuuugugaagaccuaccucgccaaagaguaugacgauaucuucagaaaugucgacagcgaaacaaccaagaacuacguggcuuauuccuaccacguuaaagaggugaagggaacgcugccuaaaaauaaggcgacacaggaagaguuuugcaaguacguccuuggcaaagugaagaacauugaguguagcgaagccgauaaaguugacuucgaugagaugauccagcggcugaccgacaacucuuuuaugcccaaacagguguccggggaaaauagagucauuccguaucaacucuacuauuacgagcugaagacaauccuuaacaaggcugccagcuaucugccuuuccucacccagugcggaaaggaugccaucucuaaucaggacaaacugcugagcauuaugaccuuucgcauccccuacuucgugggcccucuccggaaggauaacuccgaacaugcuuggcuggagagaaaagccggcaagauuuaucccuggaauuuuaacgacaaagucgaucuugacaagucugaggaagcguucauccgccggaugacaaauacguguaccuacuaccccggggaggaugugcugccucucgacagccugauuuaugaaaaguuuaugauccugaacgagaucaauaacauuagaaucgacggauacccgauuuccguugaugugaaacaacaggucuucggccuuuucgagaagaaacgccgggugacaguuaaggacauccagaaucuccugcugagccucggggcucuggauaaacacggaaaacuuaccggcauugacacaaccauccauucuaacuauaauacguaccaccacuuuaagucccugauggaaagaggggugcucacacgcgaugacgucgagcggauuguggaaagaaugaccuauagcgaugacaccaagcgcgugcggcuguggcugaacaauaacuacggaacacuuaccgccgaugacguuaagcauaucucuagacuccggaaacacgauuucggccgccuguccaagauguuucugacaggccucaaagggguccauaaggagacgggagaaagagccagcauccuggacuucauguggaacaccaaugauaaccuuaugcagcugcucuccgagugcuauacauuuucugacgagauuaccaaacugcaagaggcuuacuacgccaaggcucagcugagccuuaaugacuuccucgauuccauguauaucucuaacgccgugaagcggcccauuuacagaacacuggcgguggucaaugacauccgcaaagccuguggcaccgcuccuaagcggauuuuuaucgagauggccagagauggggaaagcaaaaagaaacgcuccgugacgagacgggagcagaucaagaaccuguaucgcagcauuagaaaggacuuccagcaagaaguugauuuucucgagaaaauccuggagaauaagucugacggacagcuucaguccgaugcucuguaccucuauuucgcccagcugggccgggacauguacaccggggaucccauuaaacuggaacacaucaaggaccagagcuuuuauaacauugaucacaucuacccucaaucuauggugaaagacgacucccuugauaauaagguccucgugcagagcgagaucaacggcgaaaagucuagccgcuacccccuggacgcggccauuagaaauaaaaugaagccgcugugggaugcuuauuacaaccauggacucaucucccugaaaaaguaucagcggcuuacacgcagcaccccuuucacagacgaugagaaaugggacuuuauuaauagacaacugguugaaacccggcagucuacgaaggcccucgcuauccugcugaaacgcaaguuccccgauacagagauuguguacuccaaggccggccuuagcuccgacuucagacacgaguuugggcuggucaaaucucggaacaucaaugaucuccaucacgccaaggacgcuuuccuggcgaucgugaccggaaacguuuaucaugaaagauuuaaccgccggugguucauggugaaucagccuuacagcgucaaaacaaagacccucuuuacccacuccauuaaaaacggcaauuucguggccuggaacggggaggaagaucugggaagaaucgugaagaugcuuaagcaaaauaaaaacacaauucacuuuacgcgcuucucuuuugaccggaaggagggccuguucgauauccagccccucaaagcuagcaccgggcuggucccuagaaaggccggccuggacguugugaaauauggaggcuacgacaaguccacagccgcuuacuaucuucuggugcgcuuuacccucgaggauaagaaaacacagcauaagcugaugaugauucccgucgaagggcucuacaaagcccggaucgaccacgauaaggaguuccugaccgacuaugcgcagacgacaauuucugaaauccuucaaaaagauaagcagaaggugaucaauauuauguucccgaugggaaccagacauaucaaacugaacagcaugauuuccaucgacggcuuuuaccucagcauugggggaaagucuuccaaaggcaagagcguucugugccacgcuauggugccucugaucgucccccauaaaaucgaguguuauauuaaggccauggaaucuuucgcccgcaaguuuaaagagaauaacaaacuucggaucguggagaaguucgauaagauuaccguugaagacaaucugaaccucuacgagcuguuucuccagaaacugcagcacaaucccuauaacaaguucuuuuccacacaauucgaugugcuuaccaaugggagaagcacauuuacgaaacugucuccugaagaacagguccagacccugcucaacauccuguccauuuucaagacaugccggagcuccggcugugaccuuaagagcaucaacggaucugcucaggccgcgcgcaucaugauuagcgcugaucugaccggccucuccaaaaaguacucugacaucagacugguggaacaaagcgccuccgggcucuuuguuucuaaaagccagaaucugcuugaguaccuguga

SEQ ID NO: 4219 - RNA, 4083 nt, Artificial Sequence
  Cas9 variant
augaccaagcugggcaaacccuacgggaucggaguggacauuggcagcaacuccaucggguucgccgcugucgaugaaaauucucaccucauuagacugaagggaaaaacaguuaucggcgcccggcuuuuugaagaggggaaggcggcugccgaccgcagagccagccggacgacccgcagacggcugucccgcaacagauggcggcucucuuuccugcgcgauuucuucgaaagccauauuacaccuaccgacccgaacuuuuucaugagacagaaauauuccgagaucucucccaaggauaaggcucgguacaaauaugaaaagcgccuuuuuaaugacagaacagaugccgaguucuaccaacaguauccuaccauguaccaucugcggacacgccuccugaccgaccccagcaaagcugaugugagagagaucuauuuugccauucaccacauccugaagucccggggacauuuccucacgagcggcuacgcgaaagacuuuaauaccaacaagguggcccugaaugaaauuuucccugcccuucaggaugcuuacgcucaggucuaucccgaccuggauaucacauuugacgagaacaaggugaaugaauuuaaaaccguucuccuggacgagaaggccacaccuucugauacccaaagagcgcuugugaaccugcuccuggccgaggacggcgauaaagacauucugaagcagcagaaacagguccucacggaguucgcuaaggccgugguugggcugaaaacaaaacuuaauguggcucugggaaccgaggucgauuccagcgaagccacagccuggaacuuuucucucggccaacuggacgauaagugggcugggaucgaguccgcgaugaccgacgaaggaaccgagauucuugaucagauccgcgaccuguaccgggccagacuccugaauggcaucgugccggcugggaaaacacugagccaggccaagguggaugacuaugagcagcaccacgaagaccucgagcuguucaaagauuaccuuaagcaacuggaagacgauggaauggccaaagcuauucgccagcucuaugaccgguacaucgauggcgacgaugccaagcccuuugucagagaggacuucguuaaggcgcugacgaaagaagugaccgcucauccuaacgccaagucucccgagcuucuggagcgccucgugcagccugauuuuaugcugaaacaacggaauaaggccaacggcgcuauucccguccagaugcagcagagagaacuggaccaaaucauuaaaaaccaguccguguauuacgauuggcucgccgcuccgaauccuguugagaagcaccgccagagcaugcccuaccaguucgacgaacugcuuaacuuucggaucccuuauuacguggggccccuggucacagccaaggagcaaaaagcggcccagggaggcguguucgcuuggaugguuagaaaggaucccgacgggaauaucaccccuuauaacuuugacgaaaaaguggaucgcgaggccuccgcuaauacauucauucagcggaugaagaccacggacacauaccucaucggagaggauguccugccgaaacagucucugcuuuaucaaagcuacgaagugcucaacgagcugaauaacgucagagugaaugacaacaagcuguccuuugaucagaagcagcagguucucggcgaacuguucgagcggcauaauaccgugaccauuaaacaauuugucgacaaccuucuggcccacggggauuaugaccgcauccccgaggugagaggacucgcggaugaaaagcgguuccugagcucucuguccacauacaaucagcuuaaaggcauucuccacgaggccaucgacgauagcgacaagcagaccgauaucgaaaagauuaucgcuuggucuacaauuuucgaggacaaggccaucuuuaaaacgaagcugaacgaaauuagcuggcugaaugcuggcaugaucaacucccucgccaacauuagauaccgcggguggggacaauucucucauaagcugcuuaaugagcugacccucagcacaggccggaccguuuuugaggaacugcugaucuccagccacaaccuuaugcagauccucacagacgaggugcugaaacagaagauugccgaacugaaugcucaugagcucaaagcgucugggaucuaugccgcuauugaugacgccuacaccuccccuagcaacaagaaagcccugagacagguccuuucugugaucgaugacauuacgaaugcugccggacaagcgcccaacuggcuguauaucgaaaccgcugauggcgacggggugccuggcaagcgcacaaauuccagacagcggaagauccaggagauuuacguuaacgccgcccaggagcucaucaccggaagcguccgcggcgaacuggaggauaaaauugcuuccagagccgacuucacagaucggcuggugcuuuauuuuaugcaagggggacgcgacaucuacaccggcgaaccccucaauauugauaaccugucuagcuaugacaucgaccacauccugccgcagucccucauuaaggauaauucucuggacaacagagugcuuguccauccucuggugaaucgggagaaagauacgaucuucgcgagcacacgcuuugcuaagcagaugaacgggauguggagacaguggcacgccgccggacucauuuccagccggaaacugcgcaaucugcaaaugagacccgacgaaaucgauaaguacgcuucuggcuucguugcccggcagcuuguggagaccagacagauuaucaagcugacagagcaaaucgucgcugaccaguacccugaugccaaaauuaucgcggugaaggccgggcucuccagccagcugcgcaaagaacucgacuuucccaagaaccgggagguuaaccacuaucaucacgcuuucgaugccuuucuggcugccagaauuggcaccuaccuucugaaacgcuauccuaaucucgaacccuucuuuaccuacggaaaguucaagaaaacagaggugaagaaacugaagucuuucaacuuuauccgggacaugacgcaugccaaagauaagauugucgcuaaagagaccggcgaaaucgugugggacaaugcguccgauauuaacgagcuggacagaaucuauaauuucaagcgcaugcuuaucacacacgaaguucgguuugagaccgccagccuguucaagcagacacucuacgcugccaaaaacucuaagaauagagggggaagccgccaacugauuccgaaaaagaaaggcuaucucguggacaucuacgggggauacacccaggaaacgggcuccuaucugagcgucgugcggcuuacaaagaaggccauguacgcuguggucaaaguuucuaccagagaugccgcgaagcuggcuguggccaaauccauuagcgagcagaaggagaacgaaacccucaaaaagaucauugacgggaagcuguccaaaacaucuaagaaaggcaagaccacacaccagcuguuugagaucgugcuuccucgggucggacagaaaacgcuguucaagaauagcaaguauaaccaauuucucguuaauuccgauaccuacaugcauaacuaucaggaacuguggaugccccgcgaguaccagagaauguggaaagacauccuccugucuaaucacggcgaugcccaacuugaagggcagcuggaccagauuuucaaguuuaucgugagccaggugaacuccuauuucaaucuguacgauauuaaccaauuucggaaaaagaucgcugacgccacagauaaauucgcgaagcuccccacccaugacacagauaacgcucgcggaaagauugccaccaucggccagcugcuuaucgggcugcaggccaaugcuaugagaucugaccuccggaaccuggauauuaaaacgccuuucggacuccugcaaaucggcaccgggauuacacuugaccuggacaccagcaucauuuaccaguccccgacaggccuguuugagagagaggucccccucaccgaucuguga

SEQ ID NO: 4220 - RNA, 4083 nt, Artificial Sequence
  Cas9 variant
augaccaagcugaaccagcccuacggcaucgggcucgacauuggaagcuccucuaucggcuucgccguggucgaugcuaauagccaucugcuuagacugaaaggggagacagccauuggagcgcggcucuuucgcgaaggcgaguccgcugccgggagacgggccucucgcacgaccagacggcgccugagccacaacagauggcggcuucgcuuccugcaagacuuuuucgauccucacaucuccucuauugacccggacuuuuuccucagacagaaguauagcgaaaucucccccaaagauaaggagcgguuuaaauacgaaaagcgccuguucaaugauagaacagacgcucaguuuuauaagcaguacccuaccauguaucaucugcggcuccaccugaugaacgaugccagcaaagcugacccccgcgagaucuucuuugccauucaucacauccuuaagucuagaggacacuuccugacaccuggcgaugcgaaaaauuuuaacaccgacgauguugaccucaagcauauuuuccccgcccugacagaggcuuacgcccaggcuuauccugaccuuacccuguccuucgaaccgagcaaagccgagaaguuuaagucuauccuccuggaugaagacgcgacguccaaugauacccaaaaagcccuggugaagcuccugcuuagcgacgauggcgacaaagaggugcugaagcagcagaaaaagguccucacagaguucgcuaaagccguggcugggcugaagguuaaguuuaacguggcccuuggaauugaagucaccgaugccgacguggagaaauggcacuucggcauggcucaacuggaagauaaguggucugacaucgagcccucccucacagaucaggggauggaaauuuuugagcagauccaggaccuguaccgggcgagacugcucaauggaaucguuccugccggcaaaacccugagccaagcuaagguggacgauuacgaccagcauugcaaagaucuuaagcuguucaaggaguaucucaaacagcugaacgaccacgaucuugccaagcgcauucggcugcucuacgacagauauaucgauggggacgaugccaaacccuuucugcgcgacgauuucgucaaggcucugaaaaaggaagugacggcccacccuacagagcucgcggaaucccugcuugagcggauggaacaagacaauuuuaugcugaagcagagaaccaaagcuaacggaucuauucccgugcagaugcagcaacgcgagcucgauaagaucauugccaaucaggccgaguacuauagcuggcuggcugccgaaaacccggucaaagagcaucgggacuccaagccuuaccagcuggacgaacuucucaauuucagaauccccuauuacguuggcccuaugaucacaaagaagcagcaagagaaaagcggccagaacguguuugcuuggauggugcgcaaagaucccucugggaacauuacccccuacaauuucgacgaaaaggucgaucgggaggccuccgcgaacgccuuuauccagagaaugaaaaccacagacacguaucugauuggagaggaugugcugccuaagcagagccuccuguaccaaaaauaugaaguucuuaaugagcugaacaaugugcgcgucaacggcgaaucucucagcaccgaccagaagaaacggcugaucagagagcuguucgagcggcacuccucugugacacuuaagcaguucguugaaaaucucguggcucauggggaugucgccaagcgcccggacgugagaggacuggcugaugagaaacgguuucugagcucccucagcaccuaccaccagcugagaggcauucuucaugacgccaucgaugaccgcgggaagcaaucugauaucgaaaacauuaucacaugguccaccgucuucgaggacgcgagcauuuuuaaaucuaagcugggagaaaucuccuggcucgacagcaaaacgcggacaacccuguccaauauuagauaucgcggcuggggccaguucucuagaaagcugcuugaugggcucaagcugggaaacggccacaccaucauucaggagcugaugcucagcucccggaaucugaugcaaauccuuacagacgagacccugaaaaaggaaauggccacacucaaccaggagcgccugaaacccgauucuaucaaugaagcuauugacgccgcuuacacgagcccuuccaacaagaaagccaucagacaggugcugaagguuguggaugacauuaagcacgccgcuaaugaucaggcgcccagcuggcuuuauaucgagaccgccgacgggggaggccauccugggaaacggacacucucucgccaaaagcagauucaggcuaucuacgaaaacaccgccaaagagcugaucgauuccgccgucagaggcgagcugaaggacaaaauugcugauaagacaaacuuuagcgaccggcucgugcuguacuucaugcagggaggccacgacaucuauaccgggacggcccuuaauauugaucaacugucuuccuacgacaucgaucauauucucccccagagccugaucaaggacgauucucuggacaaccgcguucuugugcacgcgaaaaucaauagagaaaagaacgcugaguuugccagcacccuguucgccgcuaaaauggccuccacauggcaccgguggcgcgaugcgggacucauuagcggcagaaagcugaaaaaucuccugaugcggccggacgaagucgauaaguaugcuaaaggguuuguggccagacagcuuguggagacccgccagaucauuaagcugacagaacaaaucguugccgcucaguacccugacaccaagauuaucgccgucaaagcuggacucucucaucagcugcggcaagagcuggauuuccccaagaacagagacgugaaucacuaucaucacgccuuugaugcguuccuugccgcucgcaucggcacguaccugcucaaacgguauccuaaccuggcccccuuuuucacauacggggaguucaccaagacaaaucucaaaaagcugcaguccuuuaacuucauuggcgcucuuacccauaccgacggaaagaucacaagcaaagacacgggcgaagugcugugggauaaucagagagacauugaggaacucgaucagaucuacaacuuuaagcgcaugcugauuacccacgaggucuauuucgagacagccgggcuguuuaaacaaaccguguacgccgcuaaggacuccaaagaacggggaggcucuagacagcuuaucccuaagaagaaaggguauagcacaggaauuuacggcggguauacccaggagacgggcuccuacaaugcgcugguucgccucacaaaggccggaaaaguggucuaucggguguucaagaucucuacccagaacgcugccgaaaucgccgcugccagaagccuguccgcggaggaaggcaaugagcggcucugucaaauucuggagcagucucuucugaaaaccaacaaggauaagaaaaacacaguugaccuguuugauguggucaucccccgccucgggaaggaagcucuguuccacaauagcaaauacggacuuuuucuggugaacuccgacaccuacuaucauaauuaccaggagcucuggcugagcagagaaaaccagaagauucucaaaaagcuguucucuacaaaguaugaucaauccgagauggaccgggaugcccuucaccuguuugaaacgaucgccaaacagguugagcaguucuucaagcuguacgacauuaaucaguuucgcaccaaaaucagcucugcuuucgaugccuuugagaagcucccgguggaaggcgaggaagggaaagucgagacacugaagcaacuucugaucggacuccaugcgaacccugugagauccgaccugaaaaaucucggcauuaagacccccuucggguuucugcaggcuggcaagggaauccaccuugacgaugacacagaaauuauccagcaaagccccgccggccuguucaaacggagagugcgccuggccgaucucuga

SEQ ID NO: 4221 - RNA, 4086 nt, Artificial Sequence
  Cas9 variant
augaccaagcugggcaaacccuacgggaucggaguggacauuggcagcaacuccaucggguucgccgcugucgaugaaaauucucaccucauuagacugaagggaaaaacaguuaucggcgcccggcuuuuugaagaggggaaggcggcugccgaccgcagagccagccggacgacccgcagacggcugucccgcaacagauggcggcucucuuuccugcgcgauuucuucgaaagccauauuacaccuaccggaccgaacuuuuucaugagacagaaauauuccgagaucucucccaaggacaaggcucgguacaaauaugaaaagcgccuuuuuaaugauagaacagacgccgaguucuaccaacaguauccuaccauguaccaucugcggaaucgccuccugacagaucccagcaaagcugacgugagagagaucuauuuugccauucaccacauccugaagucccggggccauuuccucaccagcggcuacgcgaaagauuuuaacacgaauaagguggcccugaacgaaauuuucccugcccuucaggacgcuuacgcucaggucuaucccgaucuggacaucaccuuugaugagaauaaggugaacgaauuuaaaacaguucuccugaaugagaaggccaccccuucugacacacaaagagcgcuugugaaccugcuccuggccgaggacggggauaaagacauucugaagcagcagaaacagguccucaccgaguucgcuaaggccgugguuggacugaaaacgaagcugaauguggcucugggcacagaggucgauuccagcgaagccaccguguggaacuuuucucucgggcaacuggacgauaagugggccggaaucgaguccgcuaugacagacgaaggcaccgagauucuugaucagauccgcgaccuguaccgggcgagacuccugaaugggaucgugccggccggaaaaacccugagccaggcuaaggucgaugacuaugcccagcaccacgaggaucucgaacuguucaaagacuaccuuaagcaacuggaggacgauggcacagccaaagcuauucgccagcucuaugaccgguacaucgauggcgacgaugccaagcccuuuguuagagaagacuucgugaaggcgcugacgaaagaggugaccgcucauccuaacgccaagucucccgaacuucuggagcgccucgcccagccugauuuuaugcugaaacaacggaacaaggcuaauggggccauucccguccagaugcagcagagagagcuggaccaaaucauuaaaaaccaguccguguauuacgauuggcucgcugccccgaauccuguugaaaagcaccgcaagagcaugcccuaccagcuggacgagcuucugaacuuccggaucccuuauuacgugggaccccucgucacagcgaaagaacagaaggccgcucaaggcgggguguuugccuggaugguuagaaaagaucccgacggaaauaucaccccuuauaacuucgaugagaagguggaccgcgaggcuuccgccaauacauuuauucagcggaugaaaaccacggacacauaccugaucggcgaggauguccugccgaagcagucucuucucuaucagagauacgaggugcugaacgaacugaauaacguccgggugaauaacgagaagcucagcauugaacaaaaacagcagguuauccgcgagcuguucgagagacauaauuccgugaccauuaagcaguuugcggaaaaccuucgggcccacggggacuaugcucacauccccgagaucagaggacuggccgaugaaaaacgcuuccucagcucucuguccaccuaccggcaacuuaagagccuucucccugacgcuauugaugaccccgccaaacaggccgauaucgagaauauuaucgcuuggucuacagucuuugaagacgcggccauuuucaagaccaaacugaaggagaucaacuggcuggauagccagacaauuacgaagcucuccaacaucagauaccgcggcuggggccaauucucucauaaauuucugaaugggcuuacccugggaaacggccacacaaucauucaggaacucuuccugagcaauaacaaucugaugcagauccuuaccgacgaaacacuccagaagaaaaugaccgagcugaacgcugauaagcugaaagccgccaauauuaacgacgcuaucgaugacgccuauacguccccuagcaauaagaaggcgcucagacaagugcugcggguuauugaagacaucaaacgcgcugccgaugggcaggaccccucuuggcuuuacguggagaccgccgauggaggcgggacaccgggcaagagaacccgggcucgccagcaucagcugcaagaaaucuaugccaacgcggcucacgagcucauugacuccgccgucagaggagagcuggaagauaaaaucgccgacaaggcugauuuuaaugaccggcuggugcuuuacuucaugcagggcgggcgcgauauuuauacaggaaccccucucaacaucgaccagcugagcucuuacgauauugaccauauccugccccagucccucaucaaagacaauagccuggauaacagagugcuuguucacgccauuaucaaucgggagaagaacgcuacguuugccuccacaauuuaugcgcaaaagaugaacgccaccuggcgccaguggcacgaagcuggccugaucucugggagaaaacuccggaaucugcagaugagaccugaccaaauugauaaguacgccagcggauucgucgcucgccagcugguggagacacggcagaucaucaaacuuaccgaacagauuguggccgcccaauaccccgagaccaagaucauugcugucaaagcgggccugucccaucagcucagagaggaacuggaguuuccuaagaaccgcgacgugaaucacuaucaucacgccuucgaugcuuuucucgccgcccggaucgggacauaccugcuuaagagauuccccaaccugcaggccuuuuucacguauggcaaauuuaagaaagcugacguuaagaaacuccgcggauucaauuucauucgggauaucacccacgcggaagacaagauuguggucaaagauacaggcgaggugaucugggacaagaagagagauguugacgagcuggaucgcaucuacaacuuuaaacggaugcugauuacccaugaagugcacuucgagaaggcugaccuuuuuaaacagacagucuauggggccaaggacucuaaagaagccggaggcaagaagcaacugaucagcaaaaagaaaggguacccgguggauauuuauggaggcuacacccaggagacgggguccuaccucagcguugugagacugacaaagaaagcuauguaugccgucgugaaggugucuacccgggacgcggcuaagcucgccgucgccaaauccaucagcgaacagaaggagaaugagacccugaacgauauuaucgacgaaaaacuuucuaagaucuccaaaaauggcaagauuacacaugagcuguucgaaguugugcucccucgcgugggacagaagacccuguuuaaaaacagcaaguacaaucuguuccuugucaacucugauacauauaugcacaauuaccaagagcuguggaugcccagagaauaucagaaaauguggaaggacaucagccucuccaaauacggcgaugcucagacggaggaccagcuggaucaaauuuuuggguucaucgugagccagguuaacucuuauuuuaaucucuacgacauuaaccaguuccggaagaagcugaacgaugccgcugacaaauuugccacccuucccaugcgcgauacagacgacaugcaaggaaagaucgcgaccaucggccagcugcugauugggcuccaggccaaugcugccagauccgaucugcggaaccuugacaucaaaacaccucugggacuccugcagauuccgaauggcaucagccucgauuccgacaccucuguggucuaccaaagccccacggggcugcuugagagagaagugcaucuguccgaucuguga

SEQ ID NO: 4222 - RNA, 4086 nt, Artificial Sequence
  Cas9 variant
augaagaaacccuacagcaucggccuggacauugggaccaacuccgugggauggucugucguuacagaugacuauaaggugccugccaaaaagaugaaagugcugggcaauacggauaaggaguacaucaagaaaaaccugauuggggcccuucuguucgacagcggagaaaccgcugaggcgacaagaaugaagcggaccgcucgcagacgguauacacgcagacggaaucgcauccucuaccugcaggauauuuucuccccggaacuuaaccaagucgacgagucuuuccugcacagacucgaugacagcuuucugguggccgaagauaaacggggcgagcgccauguuaucuucgggaauaucgccgacgaggugaaguaucacaaagaauuucccaccauuuaccaucugagaaagcaccucgcugauuccucugagaaggccgaccugcggcuugucuaucuggcucucgcccauaucauuaaauaccgcggacacuuccugaucgaugaaccuauugacaucagaaacaugaauagccagaaccuuuuuaaggaguuccugcucgcguuugacggcauucagguggauugcuaccuggccuccaaacacacagacaucagcggcaucauuaccgcuaagaucucuaaaucccggaagguugaggccgugcuggaacaguuccccgaucaaaagaagaauagcuuuuucgggaacauggucucucucguguuuggacugaugccuaauuucaaguccaacuucgagcuugacgaagaugcuaaacugcaguuuagccgcgacucuuaugaugaggaccucgaaaaucugcuuggcauuaucggggaugaguacgccgacguguucgucgcggccaagaaaguuuaugauuccauucugcucagcggaauccugacgaccaacaaucauuccacaaaggcuccccugucugccagcaugaucgacagauacgacgagcacaacuccgauaaaaagcuccugcgggacuuuauuagaaccaacaucggcaaggaaguguucaaagagguguuuuaugauacaagcaagaauggguacgcuggauauauugacggcaaaaccaaccaggaagauuucuacaaguaccuuaaaaaucugcuccagaaggucgacggcggggauuauuuuaucgagaagauugaacgcgaggacuuccugcggaaacaaagaacguuugauaacggaucuaucccucaucaggugcaccuugacgagaugaaggccauccugcgccggcagggcgaauuuuacccguuucucaaagagaaugccgaaaagauucagcaaauccugacauucaaaauucccuauuacguugggccucuggcuagaggaaacucccgcuuugcgugggccagcuauaauucuaacgagaagaugacccccuggaauuucgauaacgugaucgacaagacaagcuccgcucaggccuucauugaacggaugaccaauaacgaucucuaccugccugaccagaaaguccuucccaagcacucucugcucuaucaaaaauuugccguguacaaugagcugaccaagaucaaauacguuacagagacgggcgaagcuagacuguucgacguguuucuuaagaaagagauuuucgaugggcucuuuaagaaggaacgcaaagucaccaagaaaaagauccugaacuuccuggacaaaaauuuugaugaguuccggaucacagacauucagggacucgauaacgagaccggcaacuuuaaugccagcuauggcacauaccaugaccugcuuaagaucauuggggauaaggaguucauggacuccagcgauaacguggacguccuggaagauaucgugcucucucugacccuguuugaagacagagagaugauuaaacagcgccuucucaaguaugaagauaucuucuccaaaaagguuaucgcgaaucugacgcggagacacuacacaggauggggccggcugagcgcuaaacucauuaacgggaucaaggacaagcauucucgcaaaaccauucuggacuaucuuaucgaugacggacacuccaauagaaacuuuaugcagcugauuaaugaugacaaccucagcuucaaggaugagaucgccaauucccaagugaucggcgacggggaugaccugcaucaggucgugcaggagcuggccggcucuccggcuauuaaaaagggaauccuucagagccucaaaauuguugaugaacuggugaaggucaugggcuacaacccugagcaaaucgugguggaaauggcccgggagaaucagaccacagcuagagggcgcaacaauucccagcagcggcugggaucucucaccaaggccauucaagacuucggcagcgauauccugaaaagauaucccguugaaaacaaucagcuucagaacgaccagcuguaccucuacuaucugcaaaacgggaaggacauguacacaggagauacgcuggacauccacaaucuuucccaguaugauauugaccacaucauuccucagagcuuuaucaaagauaacucucucgacaaucgcguccugaccaacuccaagagcaauagaggcaaaucugauaacgugcccuccaaugagguggucaagcggaugaaaggguucuggcugaagcaacucgacgcgaagcugauuagccagcgcaaauuugauaaccuuacaaaggccgagagaggcggacugucugcugaagacaaagccggcuucaucaagcggcagcucguggagacccgccagauuacaaaacauguugcuagaauccuggaugaacgguuuaaucgcgacuucgauaagaacgacaagagaauccggaaugugaaaauugucacccuuaagagcaaccugguguccaauuuucgcaaagaguucggguuuuacaagguuagagaaaucaacaauuuccaccaugcccacgacgcguaucugaacgccguggucgcuaaagcccuccugauucgguaccccaagcucgagccugaguuuguguauggagaauacccgaaguacaacagcuauagagagcgcaaaucugcuacggaaaagauguucuucuacuccaauaucaugaacauguuuaaaaccacaauuaagcuggccgauggccggguuguggagaaacccgucaucgaggccaaugaagagaccggggaaaucgcuugggacaagacaaagcacuucgcgaacgugaaaaaggugcuuagcuauccucaagucuccauuguuaaaaagguggaggaacagaccggaggcuuuucuaaagagagcauccugcccaaagggggcuccgauaagcucauugccagaaaaacgaagaauaacuaccugucuacacagaaauauggaggcuucgacagcccuaccguggcuuacuccaucauguuugucgccgauauugagaaggggaaaucuaagcgccugaaaacagugaaggaaaugaucggaaucaccauuauggagcggagcagauucgaauccaauagcguuaccuuucuugaggaaaagggcuaucgcaacauccgggagaauacaauuaucaaauuccccaaguacucucuguuugagcucgaaaacgggagacgccggcugcucgccuccgcuauugagcugcagaaaggaaaugaaauguuccuuccgcaacaguuugugaaccugcucuaccaugcccagcacgcgaauaaggaggacagcgucaucuaucuggaaaaacauagacacgagcugucugagcuuuuccaucacauuaucggcguguccgaaaagacgauccugaagccuaaaguugagaugacccucaacgaggcuuuugaaaagcacuucgaguucgaugaagugagcgagcuggcccagucuuuuauuucccuccugaaauucacagccuuuggggcucccggcggauucaaguuucuugacgccgauaucaaacaaagcaaucugcgguaccagaccgucacagaagugcuguccagcacccucauucaucagucuguuacgggccuguaugagacacgcaucgaccuuagcaagcucgggggagaauga

SEQ ID NO: 4223 - RNA, 4086 nt, Artificial Sequence
  Cas9 variant
augggcaacuacuaucuggggcucgacaucggaaccaauagcgugggcugggccgucacagaugagaacuacaauauugaaagauucaagaaaaagaacaugugggggauccggcuguuugacgaggcuaaaacggccgaaucccgccggauucacagacaggcgcgcagaaugcggcaacgcaagauccagagacuuaaucugcucauggagcuguucgauguugaaauuucuaaaguggacgagagcuuuuucauccggaagaaggaguccgaucuucauuaugaagacaaaucucaggauagccgcuacgcucuguuuaacgacaaggaguucaaugauaaagacuaucacaacaaguaccccaccaucuuucaucucauuauggaucugaucgaaaaugacgagaaaaaggauauuagacugcucuaucuggccugccacuaccuuaucaagaaccggggacauuucauuuuugagggccagaaauucgacgucaauuccucucugaacaauaacaucaauaagcucaaaagccaccuggaccaauuuuacaacauuugucuugauuucgacaacgauaagcugaucgaaauccucgugaaucagaaccugaauauuuccgagaaaagcaagaaaaucaaggaacugcuccgcaagacaaaccuggagguggggauugccaaucuuaucgcuggaggcucuauuaaacuguccaacauguuugacgaugacgaacucaagaaucuggauuauaacagccuuucuuucaaaaauuccaacuucgacgagggcagagagcuguuugaagagguucucgaagaucgguucgagcugguggaaauccugaaggacauccacgaugccagcguccucgagaccaugcugucuuccgcuagcauuuccccugacgggggaaaauacaucucuagcuccaugauuaauagcuauaacaagcauaagcgcgaccuuaaacugcucaagaaaaucauuaagaaauacaagaagucugaguaugauaauaucuuuagagacgaaaacaucaaaaauaacuaccuguccuauacacggaccggcauuaacaagaauaaaaaggugcaggccgaggauaacacagacagcgauggguucuacaaauacaucguuaagauucuuaaggacaucaaagaaaaugauucugacgaggauauuaaguauauccugagcgaaauugacaaaaagaacuuugugccgaaacagagaaccaaggaaaauuccgucauccccuaccaacuccgcgagaucgaacugcggaaaauuaucgauaaccagucuaaguaucacaaguuccugaaugagguggacgaaaaaggaauuagcgugaaggagaaaaucauuucccuccugacguuuagaaucccuuacuauaucggcccccuuaacccuagcuacaaugaggaaaagaacuucaccacaucuugggucaaacgccuggcgaaggggaagguuacccccuggaauuuugaggauaugguggacauugacgccucccgggaggcuuucaucgagaacaaacucaauaagugcagcuuucugcuggaugaaacagugcuuccuaaagacucucuccuguaucaggaguacaugguccugaacgagcucaauaaccugaagauuaacggacaguccaucaauaccgaucuuaaaaagagcauuuacgaagaacuguucaagaaauauaagaaagugacgagaaagcgccucaucuccuacaucaaagaaaaggagaacaugucuggcgacauuguuaucacaggcauugauggggacuuuaagcaaggacugaaaagcuauaucgccuucaaggauauuaucggcgaaaagaucgacgaugacauuuaccggaaggagguggagaaaaucauuagagauaucucccuguauggggacgauaagucuuucauucagaaaaagaucaagaaugaaaacaaacuugaccucagcgacgaucagauuuccaagaucgcuaaacugaaguuuaaagacuggggacgcuucagcaagaagcugcucgucggcaucaaagccucugauaagaauaccggggagauugacaacaucauuggauuuaugcggaauuacaacuauaauaucaugcaacugauggcgaacguguucacauuuaaagaugaaauugagaaacuuaauuccaaauacuacaccgacgaaaagaucaacaucgauuaucuggacgaucucuaccugagcucuccggccaagagaaugcuguggcaguccuuccagauuguugacgagaucaaaaauauuaagaacagcgaucccaaaaagaucuuuauugagauggcucgcucuaaagaagacaagccuacccggaagaugagcagaaaaucccggcuugagaagcucuauacagacagcaaaaagcaguucaucaaacuguuuggccccgaugaauacgacaagcugaauaacgagaucaagaacaaaucugaguccgauuuccgcugggacaaucucuaucuguacuauacgcaauuuggcagauguauguacagccuugauccuauugaccuggaggagcucuccaacaagaaucuguacgaucaggaccauaucuaucccaaaucuaagauuuacgaugacagcaucgaaaaccgggugcuggucaaaaagcagcuuaaucucgauaaauccaacgaguauccgauuccugacagagugcugaauaaggauaagaacaaacugcucgccuucuggaagaugcugaaugaaaaagagcuuaucggggacaagaaauacgcucgccugauucggaagucucccuuuaccgacgaggaacucggagauuucaucgccagacagcuggucgagacacgccaagccaccaaggaaacagcuaacaugcugaaaagacuuugcccugacagcaagaucguguauguuaaagcgaagaauguguccgauuuccggcgcaaauuugacauucugaaguguagaucuaucaacgaucuccaccacgcccaugacgcuuaccugaauauugucgugggcaacguuuucgauaccaaguuuacgagcaauccccucaacuucaucaaaaauaacuccaagaaccggagcuauaaucuggagaaaauuuacgacuacgaugugauccgcaacgaaaagaucgccuggcuugccgagagaaaagaggaaaaucaggacgggucuauugcuacaguccugaagaaccucuccaagaaugauauccgggugacccgcagaaccuauauuaaaugcgaggaccuguuugaugaaaacaucgugcggaagggaaauggcaaauuccccauuaaggagaacaauaacaaaagcgacacaaauaaguacgggggcuauucuggaaucaaaaacgccuacuuuguucugcuugaagacgagaagcacaaucgcauccuggaggcgauuccuuccuucaucuauaagaaagaaaagaacggcgagaaagggagcgucauuaauuaccuccagaacauccugggaauuaagucugcuaaaauccucagagauaagauuaagaucggcucccugcuuaaaaucgacaaguuuccguauaaccuggccgggaaaagcggaaauggcauucucaucuccgggggcgugcagcugauucuggauaagaacaccagcaaauacaucaagaagauugaaaauuacaaauauaaacuugacgagaacaaggauuaccaaaucaauaucuucgacaagcugucuaaagaggaaaacauuaagcucuuugaucuguucguggacaaguucgagaauagcaucuauaaaaaccgggucaauauuaagcucaaagaaaucaagcuggccagacccaaauuugagcaucuuuccauugaggaacagaucaagacacugacgcagaugcugauccucuucggacgcgagaacaaugcugugaaccuggaauacauuggccuuccuaaaaauaccgggaagacaaagaucaacaaaaagauuaauaacaaagauaucaagauuaucaaccagucuauuaccggacuguaugagacagaagaggaccucgccaauaucuga

SEQ ID NO: 4224 - RNA, 4086 nt, Artificial Sequence
  Cas9 variant
augaccaagcugaaccagcccuacggcaucgggcucgacauuggaagcaauuccaucggcuucgccguggucgaugcuaacucucaccuucuuagacugaaaggggagacagccauuggagcgcggcucuuucgcgaaggccaaagcgcugccgagagacgggaaucccgcacgaccagacggcgccugucuagaacacgguggcgccuuagcuuccugagagacuuuuucgccccucauaucaccaagauugauccggacuuuuuccuccggcagaaauauuccgagaucucucccaaggauaaagaccgcuuuaaguacgaaaagagacuguucaaugaucggacagacgcugaguuuuaugaggauuacccuagcauguaucaccuucgccuccaucugaugacccacacacauaaagccgaccccagagaaaucuuccuugcuauucaccacauccugaagucccgggggcauuuucucaccccuggagccgcgaaagauuucaacacggacaagguugaucuggaggacauuuuucccgcccuuaccgaggcuuacgcccagguguauccugaccuggaacucacauucgaucuggcuaaagccgacgauuucaaggcgaagcugcucgacgagcaggccaccccgagcgauacacaaaaagcucuggugaaucuucugcucucuuccgacggcgaaaaggagaucgucaaaaagagaaaacaggugcugaccgaauuugccaaggcuauuacgggccuuaaaacaaaguucaaccuggcccucgggaccgagguugaugaagccgacgcuagcaauuggcaguuuucuaugggacagcuggaugacaagugguccaacaucgagacaagcaugaccgaucaaggcaccgagauuuucgaacagauccaggagcuguaccgcgcgcggcuccugaaugggaucgugcccgccggaaugucucuuucccaggcuaaagucgccgacuacggccaacacaaggaagaccuggagcucuuuaaaacauaucugaagaaacuuaacgaucaugaacuggccaagacgauuagagggcucuacgaccgcuauaucaauggagaugacgcuaagccuuuccugcgggaggauuuugugaaagcccugaccaaggagguuacagcgcaccccaacgaagugagcgagcagcuccugaauagaaugggccaggcuaacuucaugcuuaaacaacgcaccaaggccaauggcgccauuccuguccagcugcagcagcgggaacucgaccaaaucauugcuaaccaguccaaauacuaugauuggcuggccaagcccaacccgguggagaagcacagagcuucuaaaccuuaccagcuggacgaacuucucacauuucgcauccccuauuacguggggccucugaucacccccaaggagcaggccgagagccgggaaaaugucuucgcguggaugauuagaaaagaucccuccggaaacaucacgccuuacaauuuugacgagaagguugauugcccggccagcgcuaacauguucauucaacgcaugaaaaauacagacaccuaucugaucggcgaagaugugcuccccaagcggucucugcuuuaccagaaguaugaggugcugaacgagcucaauaacgucuccauugacgggagacggcugggagccgaccagaaacagcgccugaucagagaaguguuugagcggcauagcucuguuaccaucaagcaaguggcugaaaaucuugucgcccacggcgauuucgcgaaaagaccugagauucgcgggcucgccgacgaaaagcgguuccugagcucccugucuacauaccaucagcucaaaaagauccugcacgaggcuauugaugaccccaccaaagagcaugauaucgaaaacauuaucacauggagcacgguguuugaggacgccgcuauuuucaagaccgaacuugccaagaucuccuggcuggauagcgacacaaucaaagcccucucuaauauuagauaucgcggauggggccaguuuuccagaaagcugcuggauggccuuaaacucgggaacggacacaccguuauccaggagcugaugcugagcaaucacaaccucaugcaaauucugacagacgaaacccuuaagacgaccauggcugagcugaaucaggauaaacucaaggcggacgauaucgaggacgugauuaacgacgccuacacaucuccuuccaacaagaaagcucugcggcagguccugcgcguggucgaagauaucaagcaugccgccaauggccaagaccccagcuggcuuuauaucgagaccgcugaugggccgggaacagccggcaaaagaacccagucccggcagaagcagauucaaacgguguacgcgaacgcugcccaggaacucaucgacucugccguucgcggggagcuggaagauaaaauugcugacaaggccagcuucacagauagacuggugcucuacuuuaugcagggcggacgggacaucuauaccggcgcgccucugaauauugaucagcuuucccacuacgacaucgaucauauccugccccaaucucucauuaaggacgacagccuggauaaccgcguccuggugaaugcuacaaucaacagagagaaaaauaacguuuucgccuccacccuuuuugccagcaagauggcugccaccuggcggaaauggcacgaggcugggcugauuucuggacgcaagcucagaaaucugaugcuccggccugacgaaaucgauaaauucgcccacggcuuuguggcgagacagcuggucgagacacgccagauuaucaagcugacggaacagaucgccgcugcccaauaucccaacaccaagauuaucgcugugaaagccgggcugucccaucagcuccgggaggagcuggacuucccuaagaauagagaugugaaccacuaccaucacgccuuugacgcuuuccuggcggcccgcauuggaacauaucuucugaaacgguaccccaagcucgcuccguuuuucaccuauggcgaauuugccaaaguugaugucaagaaauucagagaguucaauuuuaucggggcccugacacaugcuaagaagaacauuguggccaaagacaccggcgaaaucgugugggauaaggagcgcgacauucaggaacucgaucggaucuacaauuucaaaagaaugcugaucacgcacgaggucuacuuugagacagcggaccuuuucaagcaaaccauuuaugcugccaaagauagcaaggaacgcggaggcucuaagcagcugaucccuaaaaagcagggguaccccacccagguguauggaggcuacacacgggagaacaccgccuaucucgcuguugugaaaacagucgaaaagaaagccgacguguacagaguugugcggauugcgacgucccaagucgcugcccugaaggaggcccgcgcucagagcaccgugaaggaaagagagcugcuuaaaaaguuucugacaaccaaauucacaaagaucgggaaaaacggaaagaaggccauuacccccuuugacaucguuaucccucgggugccgcgcgagcaacucuuccacaauaaaagauauggcuuuuucauggucaacucugauacgcugaugcauaauuaccaggaacucuggaugagccgguccgaccagcagauucugagcaagcuggugaaaucugcuaagaccguggagaacgggcaggucggcagacuguucgaaaauaucguugagcagauuaacaaauacuuuccccuguaugauaucaaucaauuccgcaagaagcucgaccaguccaaagauauuuuuagcaagcugccucuugaaggaaacggcacaaccuccgggaaacgggagacaauccagaauauccugaccggagccggcacaggggcgaagaacggagaccucaaaaaucugggcauuaagacccccuucggguuucuccaggugccuucuggcaucgugcuggaugacgauacgacacuuauuuaccaaagccccaccggaaugcugaacagaaucguccgccuguccgagcucuga

SEQ ID NO: 4225 - RNA, 4086 nt, Artificial Sequence
  Cas9 variant
augaagaacgaggaaaauaucuaccugggccucgacauugggaccgauagcgugggauaugccgucacagacgauaaauacaagaucaugaaauaucacggcaacgcugccuggggguccacgauuuucgacgcgggagcucugggcgccgauagacggguuuuucgcucugccagacggcgccuugacagacggcaggagcgcauccaacugcuccaggaaauuuucgcuaaugagaucgccaagguggaugaaagauuuuucauccggcugcuugagagcgggcuguggcgcgcugacgccgaggauagauacguguuuuucaacgacaaagaauauaccgauguccaguacaugcgggacuaucccacaauucaucaccucaucugcgagcugauuuacaauccuaacaagcaugaugugcgccugguuuaccucgcgugugccuggcuggugacccacagaggacauuuucuuuccaauaucaacacagaaaauauugcugaccuggucgacauccacaacguguauaauggcuucaugcgguuuuucgaggagaacgaaauuaucugcgauuggcgcgagguuaauguggaggaacucggcagaguccuggccgcuaacaucgggauuaaugaaaaguaccggaaccuuucuaccgugcuguuugccacaagaaaaccggacaagaaagcgaaggagggauuccccuauagcgaggaugccaucgugcgccuccuggcuggcgggaccuguaaacugaaggacgucuacauuaaggaagaguaugaugaauuuggauccaucacgcucggcauggacgaugagaaaaugaccgaaauuauggccgacaucggggaugacuucgaucugaucaaggcucugcggucucuguacgacugggggauucucgccaacauccugguuaaugagaacaauagcccucuuauuucccagagcaaagugaagguguaugagcaacacagagaagaccuggccaaccucaaauaccugguccauaaguacaucccccacaaauauaaugagauuuuccgcgaaauccggggcgauaacuacguggcuuauucuuaccauuaugagcugaagaaugacgaaaagaugggcaaaaaggcggauguugagaaauuuuccaaguuccuccugaaaauccuugaggggauuagcguggacgaacaggauaaggucguguacgacaacaugaucgagagacugacacuccgccuguuucuuccuaagcagaaaaauaccgauaaccggguuauuccccaccagcuguaugaauacgagcucaagucuauccugaaaaauacaaagaacuaccugccuuuccucaaagagaaggacuccgauggaauuagcaaugaagacaagaucauuucuaucuuuaaauucaagaucccguauuuugugggcccccugaacugcaauucccaauucgccuggauucagagaaaagcugaugggaagaucuuuccuuggaacuucgaggacaaagucgauuuugacgccagcgaacaggccuucauucagcgcaugaccaaccaauguacguaccuucccgaggaauccgugcugccuaagcagucucucuauuaccagaaguuuaugguccugaaugagaucaacaauauuaaaaucgacggacggaagaucagcguggcuaugaaacaagagcuguauaacgaaauuuucgagaagaaaaagagaguucgcaaaaaggaugugaucgacuucuuugucuccaauggcuaccuugaagggggaaaggaggcccucauuagcggccuggaugaacagauccacacaaaccugucuuccuuccaugcguuucggagacuccugcagaaucacauucuuagcguggaggacguugagucuaucaucgaacgggcuagcuauuccgaugacaaacgcagagugcuucucuuccugaagaacaaauacucuuuucugaccgaugaggacauuaaguacaucugcaaaauuaagaucaaggauuucggccggcuuagcaaaaaguuucucgucgacuucgaagggacauguaaagagaccggagaaauuuccaccgugcugagacugaugugggagacaaauaacaaucucauggagcugcuuagcgauaaguauacguuugccaacggcaucaaagaaaaucgcaagaaguacuauaccgagcagcaaaagacacuggacgaucggcucgacgaaauguacaucucuaacuccgugaagagaaccauuuaucgcacacugagcguugucaaagacgugaccaaggccuucggggugcccaaaaagaucuuugucgagauggcuagaacgaauaacccggaucugaagggaaaacggacacgcaccagacagcaacaggugauugagcuuuacgccaagugcgacgaagaggauguucgggaacucaaacaucaaauggagucucugggcgaauauguggacaacaagcugcaguccgauaaacucuuccuguacuuuauccaguucggaaagagcgcuuacuccggcaaaaugauugaccuugagaagcugaugucuggaagcaaggucuaugauaucgagcacauuuacccucaggccuaugugaaagacgauuccaucaucaauaacaagguucucguguucucugaagagaauggcgcgaaacaagacauuuaccccaucaagaccgaaauucgcaaacagaugagcgggaucuggacaaccuggcaucacgucggagccauuuccgaugagaaguauaagagacugacacggagcacgccuuuuaacgaagacgagaaauacggcuucaucaaucgccagcugaccgagacaucucaguccaccaaggcuaucgcccaaauucuuaacgaaaaauaucccgagacagaaaucguguacguuaaggcugggcucgugagcgacuuuagacacgaguucggacuguguaaaugccggucuuacaaugaucugcaucacgccauugacgcguaucucaacgucguggugggcaaugucuacaacaugaaguuuaaucgcaagugguucuccguugauagcaaauauucuaucaagaccaaaacgauuuuuagccauucccugguguguaacgggaagaucaucugggacaaagaaaagaugcuucccauggugcugaagaaugccaaaaagaacaaugcucacuucaccaaauaccaguuuaugaagacaggcggauucuuugaucagaugccuugcaaaaaggccagcggccucgucccgagaaagaaagggcuggacaccgagcgguauggaggcuacaacaagucugggauuauguuccugacacccaugagauauaaaaucggaaagaaauccgauauuaucauucuuagcaucgagcugcucuacggcaagcuguuccucaaagacgaaguguuugcuaagaaguacgccgaggaacgccugcagaaaauuaucgggaagaaagccgaugagguuuccuucccuaugggcaugaagcccuggaaaaucaacaccgugcuuucucuggacggauuuaaugucugcauuacgggcaucgggggaggcgggaagugucucagcgcucagccuauuaugcagcugucccugcccuaugagcuugcgaaguaccugaaaaagaucgaaaaauucguggagaagaacaaaaauaacgccaauuauauuuacgaugaacaguaugacucuguuagcguggaugagaacaucaagcucuacgacgucuaucuggacaagcucgaaaauuccaucuacaacaaacggauuaauucuccggaggcuauccugaagaacggaagagagaaauuuugcaaacuuaaugugcuggaacaagccguuacacucauuaacauccagagcauuuucggccgcaugaccgggggcugugaucuggagaauaucggaggcaaaaagcacuccgccgcuacagugaacuuuagcucuaaugucuccaacuggaagaaauacuauaaugacgugcggguggucuaccagagcccuucugggaucugggaaagacgcucccagaacauucuggagcuucuguga

SEQ ID NO: 4226 - RNA, 4086 nt, Artificial Sequence
  Cas9 variant
augaacgagcccuacggcguggggcuggacaucggaaccaauagcgucggcuggacaguuguggauaugaacgggagagugcggaaggucaaaggaaagacggcccucggcgcucgccuguucaaagaaggggccaccgcggaggacagacggggauuucgcacaaccagacggcgccuuaagagagugaaauggcggcugcgccuccugagagaguucuuugaucagccuauuuccaagaucgacccgaauuucuuugcucggcgcaaguauucugauauuagccccagagacccuaacuacaauggccuugccaaaacacuguucaacgaucggaccgacaaggaauuuuaugaugacuacgccacaaucuaucaccuccgcgauaaacugaugaccuccaauagaaaguucgacauucgggaaaucuaccuggcuauccaucacauuguuaaauauagaggcaacuuucuccgcacggggcccgccucucaauacggaagcgcuucccugcaucuugccaccucuuuccagaagcugaaugaucucuuugcgcagagcgaggagacacugaaccuuaagcuggugaccgacgaagcccuccugcagcaaauccagcagauucugguccggacagaccucuccagaagcgagcagcaacgccagaucuggccucugauggcugugcuuaccggcgccucugcugccgaaaagaagcggcagaaaaauguuguggucgagcuguccaaggcgcucguggggcugaaagccaagaugaacguggucacgcuuacagagguugaugcugccguggugaaagacuggaccuucacaauggaagagagccaggauaagcugcccgaaauugaggaacaacucucugaggucggacagcagaucauggacgaggugauucaacuguacgcuuccguuaaucuggcccagcucaucccugccggcaagagauuuagccagcacaugguggaaaaauauaagcaucacgagaaaaaccuggaacuucugaaggcuuacauccacucucaguccgauagcaaacgcgggcgggagauuagagcgaccuaugaccgcuacaucgauggagucgacuccaagccggugacccaagaaauguucuauaaggaucucaugaaauacguugaggccgacgcuacaucuaaucaucuggccgccgagauuaaggaugaaaucgacagcgagcaguucaugcccaaacuucggacgaagcagaacggcuccauuccuuaucaggugcaacaguacgaacuggaccagaucaucagccaccagaaaaaguacuaucccuggcucggcgaggaaaacccugucgcugagagacgcgggaaguuucccuacaaacuggaugagcuggugggauuccgggucccguauuacgugggcccucucauuaccaaggaagaccaacaggccacaucuggggcgggauuugcuuggaugguuagaaaagccgauggccccaucaccccuuggaauuucgaccagaagguggaucggauugccuccgcuacagccuuuauccagcgcaugcaaaccacggacacauaucugauuggggaggauguccuucccgcuagaagccugaucuaccagcgguucauggugcucaacgaacugaauaacaugagaguugaggaccgcaaacuggcgccccagcaaaagcagcggcuuuauaaucagguguuuaagcagcaucaacacgucucugugaaaaacauccagcagaaucucauggaugccggagaguacagaaagaccccucagauuaccggccuggccgacccgaaaggcuucaacagcucccugucuacauaccacgauuuuaagaaaauccuccuggaagcuauugccgacgagcauaagcgcgcugauaucgagaaaauuauccuuuggagcaccacauucgaagacuccgccauuuuuaagcaaaagcuggaagagguggcguggcucacggacgcccagagaaaacagcugagcgggcugcgguaucgcggauggggccagcuuucucacaagcuccugaccgcuuucaaagaugacaaggggagauccaucauggauggacugugggagacaagcgacaauuuuaugcaacuccggaaacagcccgccaucgaaacccagauuaaggaggcuaaccaagccaaucugacagaugccgacauccaggauaccauuaacgaacuuuacacgucuccucagaauaagaaagcuauccgcgagguuaugcugguccucgacgauauuaagaacgcgaugcauggccagacccccuccuggaucuucguggaagccgcuagagggggcggaguggccggccggcgcacacaaagcagauccucucagaucgucgaggccuauaaagggaccgcuaaggagauugugagcgaaaaaguucagcacgagcugaaugaaaagaucaaggccaaagcggacuucaacacacggcuggugcuuuacuuucuccagaacggacgcgaucuguauaccaaugaggcuauuaacaucgacagacuguccgaauacgauauugaccauauccucccucaaucucuggucaaggacgauagccuugacaaucgggugcugacguccgccagaaucaaccgcgagaaaaaugauacauucgccagcgagaaguuuggccggaaaaugggggcucaguggagagaacuccaccgcaacggacugaugacccagcggaagcugaagcaccuucucaugagacccgacgagauuucuaaacaugccacagauuucaucaaucgccagcugguugaaacccggcaagugauuaagcuggucgaggagcucaucuccagcgaauauccggcggcuucuauuguggccguuaaagccaaccugacccaccaguuuagacagacauucaauuuuccuaaacuucgcgaggugaacgacuaccaucacgcuuucgaugccucccugacggcuuuuaucggcauguaccuccugaaacaguaucccaagcuggaacgguucuuugucuacgggaaauucgccaagcaaccuaucaaucuuaccagauuuaacauuauccggaagcuggcgguggccgagaaacccauugcuaauaucgaaacaggcgagauucucugggacaagaccgccgauaucaaauauuucgagaagcuguacaacuauaaacgccuccuggugacacacgaagucagagagaauuacggagcuauguucaagcagacccuuuuuaaggccagcuauaacaaaucuaagacgcugguuccuaaaaagaaccauauggaaacaagcguguacggcggguacuccaaucaggagaccgccuaucucgcuauugugcggauccccuucaaaagcggauuuaaguucaucgucgugggcauuccgacccgcaugguugcgaagaucaaacacuaccaaucucugggggccacacugaaccaggcuacccauaaggugauugaaccuaaauuuacaaagaucuccagaaaaacgaagcagaccgucauuagcgacuaugaggugguucuucccaagguguaccuggaucaggucgugcgggaccaaguuaaaggacagauguauagauucucccucggcucugacaaggaguaccacaaugugcaggaacuguaucucccccugagcauccagcaagccuuugucgggcauuacgaugaguccgacgaucagcgcucuaacgaccuugugaaaguguacgaugccgcucugaagcagcuccagcgguauuucccucugcaccugagcagaaauuuugaccaagucgccucccaggcgcaccagucuuucgaaggccuuaaaaacaauguucaaacaagcgauaagcagcugggaaagaaagaggugcucaacucccuguuugugggccuccaugcuaaugccacccgcagcaaccugucuguccuugggauguccaaggacuucggacggaucaaaagcaauggcauuacacugaccgaucaggccgaaaucauuuaccagucuccgacggggcuguucgagagaaagguggcucucaaagaccuguga

SEQ ID NO: 4227 - RNA, 4086 nt, Artificial Sequence
  Cas9 variant
augggcaacuacuaucuggggcucgacaucggaaccaauagcgugggcugggccgucacagaugagaacuacaauauugaaagauucaagaaaaagaacaugugggggauccggcuguuugacgaggcuaaaacggccgaaucccgccggauucaccggcaggcgcgcagaaugcggcaacgcaagauccagagacuuaaucugcucauggagcuguucgauguugaaauuucuaaaguggacgagagcuuuuucauccggaagaaggaguccgaucuucauuaugaagacaaaucucaggauagccgcuacgcucuguuuaacgacaaggaguucaaugauaaagacuaucacaacaaguaccccaccaucuuucaucucauuauggaucugaucgaaaaugacgagaaaaaggauauuagacugcucuaucuggccugccacuaccuuaucaagaaccggggacauuucauuuuugagggccagaaauucgacgucaauuccucucugaacaauaacaucaauaagcucaaaagccaccuggaccaauuuuacaacauuugucuugauuucgacaacgauaagcugaucgaaauccucgugaaucagaaccugaauauuuccgagaaaagcaagaaaaucaaggaacugcuccgcaagacaaaccuggagguggggauugccaaucuuaucgcuggaggcucuauuaaacuguccaacauguuugacgaugacgaacucaagaauuucgauuauaacagccugucuuucaaaaauuccaacuuugacgagggcagagagcuuuucgaagagguucuggaagaucgguuugagcucguggaaauccugaaggacauccacgaugccagcguccuggagaccaugcucucuuccgcuagcauuuccccugacgggggaaaauacaucucuagcuccaugauuaauagcuauaacaagcauaagcgcgaccugaaacuucugaagaaaaucauuaagaaauacaagaagucugaguaugauaauaucuucagagacgaaaacaucaaaaauaacuaccucuccuauacacggaccggcauuaacaagaauaaaaaggugcaggccaaagauaacacagacagcgauggguuuuacaaguacaucguuaagauucugaaagacaucaaggagaaugauucugacgaagauauuaaauauauccuuagcgagauugacaagaaaaacuucgugccgaagcagagaaccaaagaaaauuccgucauccccuaccaacugcgcgagaucgagcuccggaagauuaucgauaaccagucuaaguaucacaaauuucugaaugaaguggacgagaagggaauuagcgugaaagaaaagaucauugcgcugcucacguucagaaucccuuacuauaucggcccccugaacccuuccuacaaugaggagaaaaacuuuaccacaagcugggucaagcgccuugccaaggggaaaguuacccccuggaauuucgaagauaugguggacauugacgcuucucgggaggccuuuaucgaaaacaagcugaauaaaugcuccuuccuccuggaugagacagugcugccuaaggacagccuucucuaucaggaauacaugguccugaacgagcugaauaaccucaaaauuaacggacagucuaucaauaccgaucugaagaaguccauuuacgaggaacuuuuuaaaaaguauaaaaaggugacgagaaaacgccugaucagcuacaucaaggagaaggaaaacacauccggcgacauuguuaucaccggcauugauggggacuucaaacaaggacucaagucuuauaucgcuuucaaagagauuaucggcgaaaagaucgauaaugacauuuaccggaaagagguggagaagaucauuagagauaucagccuguauggggacgauaaauccuuuauucagaagaagaucaaaaacgaaaauaagcuggaccuuucugauaaccagauuagcaaaaucgccaagcucaaauucaaggacuggggacgcuuuuccaagaaacugcuggucggcaucaaggcgagcgacaaaaauacaggggagauugauaacaucauuggauucaugcggaauuacaacuauaauaucaugcaacucauggccaacguguuuaccuucaaggacgaaauugagaaacuuaauucuaaguacuacaccuaugaaaagaucaacguugauuaccuugacgaucuguaucucuccgcuccggccaaaagaaugcuguggcagagcuuucagaucguggacgagauuaagaauaucaaaaacucugcucccaagaaaauuuucaucgagauggcccgcuccaaggaagauaagccuacacggaaaaugagcagaaagucucggcuggagaaacuuuacacggacagcaagaaacaguuuauuaaacucuucggccccgaugaauaugacaagcugaacaaugagaucaagaacaaguccgagagcgauuuucgcugggacaaucuguaccucuauuacacccaauucggcagauguauguacucucuggacccuaucgaucuugaagaacuguccaacaaaaaucucuaugaccaggaucauauuuaccccaagagcaaaaucuaugacgauuccauugaaaaccggguccuggugaagaaacagcugaaucuugacaagucuaacgaguacccgaucccugauagaguccucaauaaggacaaaaacaagcugcuggccuuuuggaaaaugcucaaugaaaaggagcugauuggggauaaaaaguaugcucgccuuaucagaaagagccccuucacagacgaggaacugggagauuucauugcgagacagcucguggagacccgccaagccacaaaagaaaccgcuaacaugcugagacggcugugcccugacuccaagaucguuuacgugaaagccaagaaugucucugauuuucgcagaaaauucgacauccuuaagugucggagcauuaacgaccugcaccacgcccaugaugcuuaucucaauaucgugguuggcaacguguuugacacgaaguucacauccaauccccugaacuuuauuaaaaacaauucuaagaaccgcagcuacaaucucgagaaaaucuacgauuaugacgucauuagaaacgaaaagaucgccuggcuggcggagcggaaagaggaaaaucaggauggguccaucgcuaccgugcuuaagaaccugagcaagaaugacauucgcgugaccagacggacauacaucaaaugcgaggaucucuucgacgaaaacauuguucgcaagggaaauggcaaauuuccccugaaggagaacaauaacaaaucugauaccaauaaguaugggggcuacuccggaaucaaaaacgccuauuucguccugcuugaagacgagaagcacaauagaauuaucgaggccaucccuagcuuuauuuacaagaaagaaaagaacggcgagaaagggucugugaucaacuaucugcagaauauucucggaaucaaguccgcuaaaauucugcgggauaagaucaagauuggcagccuccugaaaaucgacaaguucccguacaaccuugccgggaaaucuggaaauggcauccugauuuccgggggcgugcagcucauccuggauaagaacacaagcaaauacauuaagaagaucgaaaauuauaaauacaagcuggacgagaacaaagacuaucaaauuaauaucuuugauaagcuguccaaagaggaaaacaucaagcuguucgaccucuucgucgauaaguuugagaauagcauuuacaaaaacagagugaauaucaagcugaaagaaauuaagcucgcucgcucuaaauucgagcaucugagcaucgaggagcagauuaagacgcuuacccagaugcugauccuguuuggacgggagaacaaugccguuaaccucgaauauaucggccugcccaaaaauacagggaagaccaagauuaacaaaaagaucaacaauaaagacauuaagaucauuaaccaguccaucacaggacuuuacgagaccgaagaggaucuggcgaauauuuga

SEQ ID NO: 4228 - RNA, 4089 nt, Artificial Sequence
  Cas9 variant
augaagaaacccuacagcaucggccuggacauugggaccaacuccgugggaugggccgucaucacagaggauuauaagguuccugcuaaaaagaugaaagugcucggcaauacgucuagagacuucauuaagaagaaccugcuuggggcccugcucuuugauagcggagaaaccgcggaggcucggcgccugaaaagaacagcccggcgcagauacacccggcgcagaaaucggcuucgcuaucugcaggaaaucuuccucgacgagaugaacaagcuggauuccggcuuuuuccacagacuggacgauucuuuucucgugccggaagagaaacgggggagccgcuaccccauuuucggaacacugcaagaggaagucaauuaucaugagaacuuuccuaccaucuaccaccuuagaaagaaacuggccgacuccaaggaaaaggcugaucuccggcugaucuaucuugcccuggcucauaugauuaaauaccgcggccacuuccucuacgaggagucuuuugacagcaauaacaauuccauccaggaaauuuucaacgaguuuacagccgaauaucauaauaccaucgagggcagcugccugucugggcagauugaacagguggaggcgauccugacggauaagauuuccaaaagcgccaagagagagcggauccucaaacuguuccccgcugaaaagucuaccggacuuuucuccgaguuccugaaacucaucguuggcaaccaagccgacuucaagaagcacuuugaucuggaagagaaaacaccucuucaguucagcaaggacaccuacgaagaggaccuggagaaucuccuggaacagauuggggaugaguuugcugaccuguuccuccuggccaaaaagcuguaugaugcgacacugcucgccggaauccugaccgcuacggacgugucuacaaaagcuccccuuuccgccagcaugauuaacagauacgaaacccaccagcaagaucuggccgcccucaagcaguuuaucaagaauaaacugccugagaaguauuccgaagucuucucugaccugagcaaagauggcuacgcuggguauauuaacggaaagacaacccaggaggcguuuuacaaauacaucaagaaccuccugaucaaguucgagggcgccguggacuuucuugagaaaauugagcgcgaagauuuccugcggaagcagagaaccuuugacaauggcuccaucccgcaucaacuccaccuucaggagaugaacgcuauucugcgccggcagggggaucauuaucccuuccuuaaagagaauagagaaaagaucgagaaaauucucacauuucgcaucccuuacuauguuggaccccuggcccggggcaacagagacuucgccuggcugacgcgcaauagcgaccaagcuauccggccuuggaacuucgaagagguggucgauaagaccucuuccgccgaagacuuuauuaauaagaugacaaacuacgaucucuaucugcccgaggagaaagugcuuccgaagcacagcauccuguacgaaaccuucgcgguguauaaugagcucacaaaagucaaguuuauugcugaagggcugagagacuaccaguuccuggauucuggacagaaaaagcagaucauuaaccuucucuuuaaagacaagcgcaagguuaccgagaaagauaucauucacuaccugcauacgguggacggcuaugaugggaucgaacugaagggaaucgacaaacaauucaaugccagccucuccacauaccacgaucugcuuaagauuaucaaagacaaggauuuuauggacgacgccgauaacgaggcuauucuggagaauaucgugcauacccucaccauuuucgaagaccaggagaugaucaagcagucucuggcccaguaugaugcuaucuuugaccggaaagucaugaaggcccugacaagacggcacuacaccggcuggggcgaacuuagcgcgaaacucauuaacgggauccgcgauaagcaaacaggaaaaaugauucuggaguaucugaaggacgauggcgaaaucaauagaaacuucaugcagcucauuaacgacgauucccugagcuuuaaggagacgauccagaaagcccaggugaucggggagaccgaaaauauuaagcaaaucguucaggagcuuccuggaucucccgcuauuaaaaagggcauccugcaguccauuaaaaucguggacgaacucgucgagaucaugggguacaacccugagagcauugugguugaaauggcccgggagaaucaguucacaaaccaaggcagacgcaauucucagcagcggcugaagaagcugaccgauuccaucaacaaacuuggaagcuccauucucgaagaacaucccguggacaauucucaacugcagaacgauagacuguuucucuauuaccugcagaauggcaaggacauguacacaggggaagcucuugagcugagcaaacucuccucuuaugacgucgaucacaucauuccccaggccuucaucaaggacgauagccuggacaaccgcgugcuggucuccuacgcgaaaaauagaggaaagagcgaugacgugccuucucuugagauuguucaaaaacggaaggccuucuggcgccagcugcucgauucccagcugaucagcgaaagaaaguuuaacaaucucaccaaagcugagcggggcgggcugacggaagacgauaaggccggauucaucaaacgccagcuuguggagaccagacaaauuacaaagcacgucgcucagauccuggacgcccgguuuaacaccgaagugacagagaaaggcaagaagaaacgcgccguuaagauuaucacccucaaaucuaaucugguguccaacuucagaaaggauuuugagcuguauaaaguccgggaaauuaacgacuaccaucacgcucaugacgcguaucuuaaugccgugguggggacggcucugcucaagaaguacccgaaacuggagcccgaauuuguuuauggcgauuacccuaaguacaacagcuaucgcgagagaaaaacagccaccgaaaaggucuacuuuuauucuaauaucaugaacuucuuuaaaacaaccgugaagcucgccgacggaagcgagaagaaacggcaccagaucgagaccaaugaagagacaggcgaaauugugugggauaagacgaaacacuucgagaucgucagaaaggugcuguccuacccccagguuaacauugugaaaaagaccgaggaacaaacagucgggcagaauggaggccuuuuugacaacaauaucgugagcaagaacaaaguuguggaugcuucuaagcugauuccuaucaaauccgggcucagccccgagaaguauggaggcuacgcccgcccgaccaucgcguauuccguccuggugauugcugacaucgaaaaagggaaggccaaaaagcugaagcggauuaaagagaugguuggcaucacaauucaggauaagaaaaaguucgaagccaauccuaucgcuuaccuugaggaguguggauucaaaaacauuaauucuaaccauaucaucaagcugcccaaguacagccucuuugaguucgacgauggccaaagacgccugcucgccuccucuauugaacugcagaaagggaaugaacuuauccugccuuaucaccugaccgcgcuccuguaccaugcucagcggauuaacaagaucagcgagcccauucacaaacaguauguggaagcccaucaaaacgaguuugaggaacuucugacgacaaucaucucccucucuaagaaauacauucagaagccuaaugucgagagccugcuccagcaggccuucgaccaaaccgaugaagacaucuaucagcuguccgagagcuuuauuucucuucugaagcugaucuccuucggagcucccggcgccuuuaaauuccucgggguggauauuagccagucuaacgugagauaccaguccgucagcucuugcuuuaaugcuacccugauccaccaauccaucacaggacuuuaugaaacccgcauugaccugagcaagcucggcgaggacuga

SEQ ID NO: 4229 - RNA, 4089 nt, Artificial Sequence
  Cas9 variant
augaacgagcccuacggcguggggcuggacaucggaaccaauagcgucggcuggacaguuguggauaugaacgggagagugcggaaggucaaaggaaagacggcccucggcgcucgccuguucaaagaaggggccaccgcggaggacagacggggauuucgcacaaccagacggcgccuuaagagagugaaauggcggcugcgccuccugagagaguucuuugaucagccuauuuccaagaucgacccgaauuucuuugcucggcgcaaguauucugauauuagccccagagacccuaacuacaauggccuugccaaaacacuguucaacgaucggaccgacaaggaauuuuaugaugacuacgccacaaucuaucaccuccgcgauaaacugaugaccuccaauagaaaguucgacauucgggaaaucuaccuggcuauccaucacauuguuaaauauagaggcaacuuucuccgcacggggcccgccucucaauacggaagcgcuucccugcaucuugccaccucuuuccagaagcugaaugaucucuuugcgcagagcgaggagacacugaaccuuaagcuggugaccgacgaagcccuccugcagcaaauccagcagauucugguccggacagaccucuccagaagcgagcagcaacgccagaucuggccucugauggcugugcuuaccggcgccucugcugccgaaaagaagcggcagaaaaauguuguggucgagcuguccaaggcgcucguggggcugaaagccaagaugaacguggucacgcuuacagagguugaugcugccguggugaaagacuggaccuucacaauggaagagagccaggauaagcugcccgaaauugaggaacaacucucugaggucggacagcagaucauggacgaggugauucaacuguacgcuuccguuaaucuggcccagcucaucccugccggcaagagauuuagccagcacaugguggaaaaauauaagcaucacgagaaaaaccuggaacuucugaagaccuacauccacucucaguccgauagcaaacgcgggcgggagauuagagcuaccuaugaccgcuacaucgauggagucgacuccaagccggugacacaagaaauguucuauaaggaucucaugaaauacguugaggcggacgccacgucuaaucaucuggcugccgagauuaaggaugaaaucgacagcgagcaguucaugcccaaacuucggaccaagcagaacggcuccauuccuuaucaggugcaacaguacgaacuggaccagaucaucagccaccagaaaaaguacuaucccuggcucggcgaggaaaacccugucgccgagagacgcgggaaguuucccuacaaacuggaugagcuggugggauuccgggucccguauuacgugggcccucucauuacaaaggaagaccaacaggcuaccucuggggccggauuugcguggaugguuagaaaagcugauggccccaucacaccuuggaauuucgaccagaagguggaucggauugccuccgccaccgcuuuuauccagcgcaugcaaacgacagacaccuaucugauuggggaggauguccuucccgccagaagccugaucuaccagcgguucauggugcucaacgaacugaauaacaugagaguugaggaccgcaaacuggcuccccagcaaaagcagcggcuuuauaaucagguguuuaagcagcaucaacacgucucugugaaaaacauccagcagaaucucauggaugccggagaguacagagaagcgccuaagauuaccggccuggccgacccgaaaggcuucaacagcucccugucuacauaccacgauuuuaagaaaauccuccccgaggcuauugccgacgaacauaagcgcgcugauaucgagaaaauuauccuguggagcaccacauucgaagacuccgccauuuuuaagcagaagcuggaggagguggcguggcugacggacgcccaaagaaaacagcucagcgggcugcgguaucgcggauggggccagcugucucacaaacuucucaucgcuuucaaagaugacaaugggagauccaucauggauggacugugggaaaccagcgacaacuuuaugcagcugcggaagcaaccugccauugagacacagaucaaagaagcuaaucaggccaaccucaccgaugccgacauucaagauacaaucaaugagcuguacaccucuccccagaacaagaaggcuauucgcgaaguuaugcuuguccuggacgauaucaaaaaugcgaugcauggccagacgccuuccuggaucuucguggaggccgcuagagggggcggaguggccggccggcgcacccagagcagauccucucaaauugucgaggccuauaaggggacagcuaaagaaaucgugagcgagaagguucagcacgaacucaacgagaaaauuaaggccaaggcggacuucaacacccggcuggugcuguacuuucuucagaauggacgcgaucucuauacaaacgaagcuaucaauauugacagacuguccgaguacgauaucgaccauauccugccccagucucucgucaaagacgauagccuggacaaccgggugcuuaccuccgccagaauuaaucgcgagaagaacgauacguucgccagcgaaaaauuuggccggaagaugggggcucaauggagagagcugcaccgcaauggacucaugacacagcggaaacugaagcaccuucuuaugagaccggacgaaaucucuaagcaugccaccgauuucauuaaccgccagcucguugagacaagacaggugaucaaacuggucgaggaacugauuuccagcgaguauccugcggcuucuaucguggccguuaaggccaaucucacccaccaauuucggcagaccuucaacuuucccaaacugcgcgaagugaaugacuaccaucacgcuuucgaugccucccuuacagcuuuuaucggcauguaccugcucaagcaguauccuaaacuggagcgguucuuugucuacgggaaguucgccaaacagcccauuaaccugacgagauuuaauaucauucggaaacuugcgguggccgaaaagccuaucgcuaacauugagaccggcgagauccugugggacaaaacagccgauauuaaguauuucgaaaaacucuacaauuauaagcgccugcucgugacccacgaggucagagaaaacuacggagcuauguucaaacaaacacuguuuaaggccagcgacaacaagucuaaaacccuuguucccaagaaaaaucauauggagacgagcguguauggcggguacuccaaccaggaaacagccuaccuggcuaucgugcggaucccguucaagagcggauuuaaauucauugucgugggcaucccuacccgcaugguugcgaagauuaagcacuaucagucucucggggccacccugaaacaagcuacacauaaggugaucgagcccaaauuuaccaagauuuccagaaaaacaaagcagacggucaucagcgauuacgaggugguucugcccaagguguaucuugaccaggucgugcgggaccagguuaaaggacaaauguacagauucucccugggcucugauaaggaauaucacaaugugcaggagcucuaccugccucucagcauccagcaggccuuugucgggcauuaugacgaauccgaugaccaacgcucuaacgaucuggugaaaguguacgacgccgcucuuaagcagcugcagcgguacuucccgcuccaccugagcagaaauuuugaucaggucgccaaccaagcgcaccaguccuucgagggccugaaaaauaacguucagaagucugacaagcaacuuggaaagaaggaagugcugaauagccucuuugugggccugcaugcuaccgccacacgcuccaaccucagcguccuggggaugucuaaagauuucggacggcuucaguccagaagcggcauuacccugacagaccaggccgagaucauuuaucagucucccaccgggcuguucgagcgcaagguggcucucaaagaucuguga

SEQ ID NO: 4230 - RNA, 4089 nt, Artificial Sequence
  Cas9 variant
augaccaagcugggcaaacccuacgggaucggaguggacauuggcagcaacuccaucggguucgccgcugucgaugaaaauucucaccucauuagacugaagggaaaaacaguuaucggcgcccggcuuuuugaagaggggaaggcggcugccaaacgcagagccggacggacgacccgcagacggcugagccgcaacagauggcggcucuccuuccugcgcgacuuuuucgaaucucauauuacaccuaccgauccgaacuuuuucaugagacagaaguauagcgagaucucccccaaggacaaagcucgguacaaguaugaaaaacgccuuuuuaaugauagaacagacgccgaguucuaccaacaguauucuaccauguaccaccuucggaaucgccucaugacagauccuagcagagcugacgugcgggagaucuauuuugccauucaucacauccugaaguccagaggccauuuccugacccccggcgaugcgaaagacuuuaacacgaaugauguggcccucgacgaaauuuucccugcucugcaggaugccuacgcucaggucuaccccgaccuugggaucaccuuugacgaggauaaggccaacgaguucaagacaauucugcucaaugagaucgcgaccagcauugacacacaacgcgcccuggugaaacuucugcucgcugaggaagaugacaaggauauccugaaacagcagaagcagguucugaccgaguucgccaaagcuguggucggacucaagacgaaacugaaccuugcccugggcacagaaguggacucuuccgaggccaccgcuuggaauuuuagccucgggcaacuggaugacaagugggcgggaaucgaaucugccaugacagaugagggcaccgagauucuugaccagauccgggaucuguauagagcucgccuccugaacgggauuguuccuaccggaaagacacugucccaggccaaaguggacgacuacacgcagcaccacgaagaucuccaacuguucaaggccuaucuuaaacagcuggaggacgauggcaccgcuaaggccauccggcagcucuacgacagauauauugauggcgacgaugcggcuccguuucugcgcgaaaauuucgucaaagcccuuacaaaggacgugaccgcccaucccaacacaaagagcccugagcugcucgaacggcuggcucaacccgauuuuaugcugaaacagagaaauaaggccaacggggcuaucccugugcagaugcagcaacgcgagcucgaccagaucauuaaaaaccaggccgucuacuaugauuggcuggcggcccccaauccgguugagaagcaccggaaaucuaugccuuaccagcuugacgaacugcucaacuucagaauccccuacuaugugggaccucuggugaccgcuaaggagcaaaaggccgcucagggcggggucuuugccuggauggugcgcaaagaucccgaaggaaauauuacgcccuacaacuucgacgagaagguugaccgggaagcguccgccaauacauuuauccagagaaugaaaaccaccgauacauaucugauuggcgaggacgugcuuccuaagcagagccuccuguaccaacgguaugagguccugaacgaacucaauaacgugcgcguuaauaacgagaaacuguccaucgaacagaagcaacaggugaucagagagcuuuucgagcggcauaauucugucaccauuaagcaauuugcugaaaaccugagagcccacggggauuacgcucacaucccggagauucgcggacucgccgacgaaaaacgguuccugagcucccugagcacauauagacagcuuaagucucuccugcccgaggccaucgaugacccugcuaaacaggcggauauugaaaauaucauugccugguccacgguguuugaggacgcugccaucuucaagaccaaacugaaggagaucagcuggcucggcucugaagccauuacaaaacugagcaacauccgcuacagaggcugggggcaauucucccggaaguuucuuaauggacugacccucggcaacgggcauacaauuauccaggagcugcugcuuucuaccaacaaucucaugcagauucugacggaugaaacccugcagaagaaaaugacagagcucaacgcugacaagcugaaaaccgccaauaucaacgaugcgaucgacaaugcuuacacaagccccuccaacaagaaagcccuucgccaaguccugagagugguugaugacauuaagcgggccgcugacggacaggauccuagcuggcucuauguggaaaccgccgacggcgggggcacgcccggaaagcgcacaagagcgcggcagcaccagcugcaagagaucuacgcuaaugccgcccaugagcugauugauaccgcuguccgcggcgaacuugaggacaaaaucucugauaaggccgacuucaacgauagacucgugcuguauuuuaugcaagggggacgggacauuuacacaggcgcuccgcugaauaucgaucagcucuccagcuaugacaucgaucacauucugccucagucucuuaucaaagacaacucccuggacaaucgcguucucgugcaugccauuaucaacagagaaaagaaugcgaccuucgccagcaccauuuacgcucagaaaaugaacgccacauggcggcaguggcacgaggcugggcugaucuccggaagaaagcugcgcaaucuucagaugcggcccgaucagaucgacaaguaugccucuggcuuugucgccagacagcugguggaaacgcgccagauuaucaaacucaccgagcagauuguggcugcgcaauacccugauacaaagaucauugccguuaaagcugggcugagccaccagcuccgggaggaacuggaguuccccaagaacagagacgucaaccauuaccaccaugccuuugaugccuuccuugcugcccgcaucggcaccuaucugcucaaacgguuuccuaaucugcaggcguucuuuacauacggaaaguucaccaaggcugacgugaaaaagcugagaggcuuuaacuucauucgcgauaucacgcacgccgaagacaaaaucguggccaaggauacaggggaggucgugugggacaaacagcgggauguugacgagcuugauagaauuuauaauuucaagcggaugcugaucacccacgaagugcgcuuugagaccgcugaccucuucaaacaaacagucuacggagccagagacuccaaggaagcgggcgggucuaagcagcugauucccaaaaagaaaggauauccgguggauaucuacggcggguauuuucgggagaacaccgcuuaccucgccguugugaaggucacgaaaaagacagaaaccauuuucaaggugguuaaaaucgccacaagccagguggcugcccugaauaaggcucgcuccagaagcaccgccgaggagcuuucuguccugacagaacuccugaaaccuaaguuuuccaaagugggcaagaacggaaagaucaccgacacgcccuucgaggugguccugccccggguuccuagagaacagcuguuuuacaaugcgaaauauggcuucuuuauggugaacagcgauaccauguuccauaauuuucaagagauuugggugucucgcuccgaccagaagauccugcagcagauucggaaagccaagaucgauuacccgaacgucgaccaagaucucgacaaucuguuccacaaccucgcugaucagauugugaaauauuucgaccuguacagcaucgccggguuuaaggaaaagaucucucagagccaaaauacauucaacgaucuugcuguugacgauaccgaccaguccgugggaaaaauuacagucaucaaugagcugcugaagggcgcccaggccaacgggaugaccggaagccucaaagugcugaagauuucuacacccuuuggcuucacccaggacaaauccgggguucuuacgaaggauagcuccaucauuuaucaaucuccuacaggccuguuugagagaagcgugcgccucaccgaccuguga

SEQ ID NO: 4231 - RNA, 4089 nt, Artificial Sequence
  Cas9 variant
augaccaagcugggcaaacccuacgggaucggaguggacauuggcagcaacuccaucggguucgccgcugucgaugaaaauucucaccucauuagacugaagggaaaaacaguuaucggcgcccggcuuuuugaagaggggaaggcggcugccaaacgcagagccggacggacgacccgcagacggcugagccgcaacagauggcggcucuccuuccugcgcgacuuuuucgaaucucauauuacaccuaccgauccgaauuucuucaugagacagaaguauagcgagaucucccccaaggacaaagcucgguacaaguaugaaaaacgccuuuuuaacgauagaacagacgccgaguucuaccaacaguauucuaccauguaccaucugcggaaucgccucaugacagauccuagcagagcugacgugcgggagaucuauuuugccauucaccacauccugaaguccagaggccauuuccugacccccggcgaugcgaaagacuuuaacacgaaugauguggcccucgacgaaauuuucccugcucugcaggaugccuacgcucaggucuaccccgaccuugggaucaccuuugacgaggauaaggaaaacgaguucaagacaauucugcucaaugagaucgccaccagcauugacacacaacgcgcgcuggugaaacuucugcucgccgaagaggaugacaaggauauccugaaacagcagaagcagguucugaccgaauuugcuaaagccguggucggacucaagacgaaacugaaccuugcucugggcacagagguggacucuuccgaagccaccgccuggaauuuuagccucgggcaacuggaugacaagugggcuggaaucgagucugcgaugacagaugagggcaccgaaauucuugaccagauccgggaucuguauagagcccgccuccugaacgggauuguuccuaccggaaagacacugucccaggcuaaaguggacgacuacacgcagcaccacgaggaucuccaacuguucaaggccuaucuuaaacagcuggaagacgauggcaccgccaaggcuauccggcagcucuacgacagauauauugauggcgacgaugccgcgccguuucugcgcgagaauuucgucaaagcucuuacaaaggacgugaccgcccaucccaacacaaagagcccugaacugcucgagcggcuggcccaacccgauuuuaugcugaaacagagaaauaaggcuaacggggccaucccugugcagaugcagcaacgcgagcucgaccagaucauuaaaaaccaggcugucuacuaugauuggcuggccgcgcccaauccgguugaaaagcaccggaaaucuaugccuuaccagcuugacgagcugcucaacuucagaauccccuacuaugugggaccucuggugaccgccaaggaacaaaaggcugcccagggcggggucuuugcuuggauggugcgcaaagaucccgagggaaauauuacgcccuacaacuucgacgaaaagguugaccgggaggccuccgcgaauacauuuauccagagaaugaaaaccaccgauacauaucugauuggcgaggacgugcuuccuaagcagagccuccuguaccaacgguaugaaguccugaacgagcucaauaacgugcgcguuaauaacgaaaaacuguccaucgagcagaagcaacaggugaucagagagcuuuucgaacggcauaauucugucaccauuaagcaauuugccgagaaccugagagcucacggggauuacgcccacaucccggaaauucgcggacucgcugacgagaaacgguuccugagcucccugagcacauauagacagcuuaagucucuccugcccgaagccaucgaugacccugccaaacaggcugauauugagaauaucauugcgugguccacgguguuugaggacgccgcuaucuucaagaccaaacugaaggaaaucagcuggcucggcucugaggccauuacaaaacugagcaacauccgcuacagaggcugggggcaauucucccggaaguuucuuaauggacugacccucggcaacgggcauacaauuauccaggaacugcugcuuucuaccaacaaucucaugcagauucugacggaugagacccugcagaagaaaaugacagaacucaacgccgacaagcugaaaaccgcuaauaucaacgaugccaucgacaaugcguacacaagccccuccaacaagaaagcccuucgccaaguccugagagugguugaugacauuaagcgggcugccgacggacaggauccuagcuggcucuauguggagaccgcugacggcgggggcacgcccggaaagcgcacaagagcccggcagcaccagcugcaagagaucuacgcgaaugcugcccaugaacugauugauaccgccguccgcggcgagcuugaagacaaaaucucugauaaggcugacuucaacgauagacucgugcuguauuuuaugcaagggggacgggacauuuacacaggcgccccgcugaauaucgaucagcucuccagcuaugacaucgaucacauucugccucagucucuuaucaaagacaacucccuggacaaucgcguucucgugcaugcuauuaucaacagagagaagaaugccaccuucgcgagcaccauuuacgcccagaaaaugaacgcuacauggcggcaguggcacgaagccgggcugaucuccggaagaaagcugcgcaaucuucagaugcggcccgaucagaucgacaaguaugcuucuggcuuugucgccagacagcugguggagacgcgccagauuaucaaacucaccgagcagauuguggccgcucaauacccugauacaaagaucauugcgguuaaagccgggcugagccaccagcuccgggaggagcuggaguuccccaagaacagagacgucaaccauuaccaccaugcuuuugaugccuuccuugccgcucgcaucggcaccuaucugcucaaacgguuuccuaaucugcaggccuucuuuacauacggaaaguucaccaaggcggacgugaaaaagcugagaggcuuuaacuucauucgcgauaucacgcacgcugaagacaaaaucguggccaaggauacaggggaggucgugugggacaaacagcgggauguugacgaacuugauagaauuuauaauuucaagcggaugcugaucacccacgaggugcgcuuugaaaccgccgaccucuucaaacaaacagucuacggagcuagagacuccaaggaggccggcgggucuaagcagcugauucccaaaaagaaaggauauccgguggauaucuacggcggguauuuucgggaaaacaccgcguaccucgcuguugugaaggucacgaaaaagacagagaccauuuucaaggugguuaaaaucgccacaagccagguggccgcucugaauaaggcccgcuccagaagcaccgcugaggaacuuucuguccugacagagcuccugaaaccuaaguuuuccaaagugggcaagaacggaaagaucaccgacacgcccuucgaagugguccugccccggguuccuagagagcagcuguuuuacaaugccaaauauggcuucuuuauggugaacagcgauaccauguuccauaauuuucaagaaauuugggugucucgcuccgaccagaagauccuucagcagauucggaaagcgaagaucgauuacccgaacgucgaccaagaucucgacaaucuguuccacaaccucgccgaucagauugugaaauauuucgaccuguacagcaucgcuggguuuaaggagaagaucucucagagccaaaauacauucaacgaucuugccguugacgauaccgaccaguccgugggaaaaauuacagucaucaaugagcugcugaagggcgcucaggccaacgggaugaccggaagccucaaagugcugaagauuucuacacccuuuggcuucacccaggacaaauccgggguucuuacgaaggauagcuccaucauuuaucaaucuccuacaggccuguuugaaagaagcgugcgccucaccgaccuguga

SEQ ID NO: 4232 - RNA, 4089 nt, Artificial Sequence
  Cas9 variant
augaccaagcugggcaaacccuacgggaucggaguggacauuggcagcaacuccaucggguucgccgcugucgaugaaaauucucaccucauuagacugaagggaaaaacaguuaucggcgcccggcuuuuugaagaggggaaggcggcugccgaccgcagagccagccggacgacccgcagacggcugucccgcaacagauggcggcucucuuuccugcgcgauuucuucgaaagccauauuacaccuaccgacccgaauuucuucaugagacagaaauauuccgagaucucucccaaggauaagagccgguacaaauaugaaaagcgccuuuuuaacgacagaacagaugcugaguucuacaaauaugagaauugcccuaccauguaccaucugcggaaccgccucaugacagaccccuccaaggccgaugugagagaaaucuauuuugcuauucaccacauccugaaaagccggggacauuuccugaccccuggcgacgccaaggauuuuaauacgaacaagguggcggucaauaaaauuuuccccgcccuccaagacgcuuacgcccagguguacccugaucuggacaucaccuuugacgagaacaagguuaaugaauuuaaaacagugcuucugaacgagaaggcuaccccgucugauacacagagagcccucgucaaucugcuucuggcgaaagagggcgaccgcgauauucucaagcagcaaaaacaggcccugaccgaauuugcuaaggccgugguugggcugaagacgaaacucaacguggcucugggaacagaggucgacuccagcgaagccaccgccuggaauuuuucucuuggccagcuggaugacaaguggacagggaucgaguccgcuaugaccgaugaaggaaccgagauucucgaccagauccgggaucuguauagagcgcgccuucugaacggcaucgugcccgccgggaaaacacucagccaagcuaagguggacgauuacgcccagcaccacgaggaccuggaacuguucaaagacuaucucaagcagcuggaggaugacggaacggccaaggcuauucggcagcuuuacgauagauauaucgacggcgaugacgccaaaccuuuuguccgcgaagauuucguuaaggcgcugaccaaagaggugacagcucaucccaacgccaagucuccugaacuccuggagcggcuugcccaacccgacuuuaugcugaaacagagaaauaaggcuaacggcgccauuccggugcagaugcaacagcgcgagcucgaucagaucauuaagaaucaguccgucuacuaugacuggcuggcugccccuaaccccguggaaaaacacagaaagagcaugccuuaccaacuggaugagcuccugaauuuccggauccccuacuauguugggccccuugugaccgcgaaagaacagaaggccgcucagggaggcgucuuugccuggauggugcgcaaagacccugaugggaacaucacaccguacaauuucgacgagaagguugaccgggaggcuuccgccaacaccuuuauucagagaaugaagacgacagauaccuaucugaucggagaggacgugcuccccaaacaaucucugcuguaccagagcuaugagguccuuaaugaacucaacaaugugcgggucaacgauaauaagcuguccuucgaccagaaacagcaagugcugggcgagcucuuugaacgccauaacaccguuacaauuaagcaguucguggauaaucugcuugcgcacggggacuacgauagaaucccugagguccggggacuggccgacgagaaaagauuucucagcucucuguccaccuauaaccagcugaagggcauucuucacgaagcuaucgaugacagcgauaaacagacagacaucgagaacauuaucgccuggucuacgauuuucgaagauaaggcuaucuucaagaccaaacucaaugagauuagcuggcugaacgccggcaugaucaauucccuggccaacauucgcuaccggggguggggacaauuuucucauaagcuccugaaugaacuuacacugagcaccggcagaacaguguucgaggagcuccugaucuccagccacaaccugaugcagauccuuaccgacgaaguucucaaacagaagauugcugagcugaaugcgcaugaacugaaagccucugggaucuacgcugccauugacgaugccuauacgucccccagcaacaagaaggcucuccgccaagugcugucugucaucgacgauauuaccaaugccgcgggacaggcuccuaacuggcuuuacaucgagacagccgacggcgauggggugcccggcaaaagaaccaauucccggcagcgcaagauccaggaaauuuaugccaacgcugcccaagagcugaucacaggaagcgugagaggcgagcucgaagacaaaauugcgucccgggcugauuuuaccgaccgccugguucuguacuucaugcaagggggaagagauaucuauacgggcaagccgcuuaauauugacaaccucucuagcuacgauaucgaccacauccugccucagucccugauuaaagacaauucucucgauaaccggguccuggugcauccccuugugaaccgcgagaaggacacaaucuuugccagcaccagauucgccaagcagaugaaugggauguggcggcaguggcacgcugccggacugauuuccagccgcaaacucagaaaccugcagaugcggccugaugaaaucgacaaguaugcuucuggcuuugucgccagacagcugguggagacacgccagauuaucaaacuuaccgaacaaaucguugcggaucaguaccccgacaccaagauuaucgccgugaaagcugggcuguccagccagcuccggaaggagcuggauuucccuaagaauagagaggucaaccacuaccaucacgccuuugacgcuuuccucgccgcccgcauuggcacauaucugcuuaaacgguaccccaaucuggaaccguuuuucacguauggaaaguuuaaaaagaccgaggugaaaaagcucaaaucuuucaacuucaucagagauaugacacaugcuaaggacaagauuguugcgaaagaaaccggcgagaucgugugggauaaugccuccgacauuaacgagcuggaucgcaucuacaauuuuaagcggaugcugaucacacacgaagucagauucgagaccgcuagccuuuuuaaacaaacgcuguaugccgccaagaacucuaaaaaucgcgggggaagccggcagcucauuccuaagaagaaaggcuaccugguggacaucuaugggggauacacacaggaaaccggcuccuaccucagcguugugagacugaccaagaaagcuauguaugccgucgugaaggugucuacacgggacgcggcuaaacuugccgucgccaaguccauuagcgagcagaaggaaaacgagacccugaaaaagaucauugaugggaaacucuccaagacaucuaaaaagggcaagacgacccaccaacuguucgagaucguucugccccgcgugggacagaaaacacuuuuuaagaauagcaaauacaaccaguuccuggucaauuccgacaccuauaugcauaacuaccaggaacucuggaugcccagagaguaucaacggauguggaaggauauccugcucucuaaccacggcgacgcucagcuggaagggcagcuugaucagauuuuuaaauucaucgugagccaaguuaauuccuacuuuaaccuguaugacauuaaucaguuccgcaagaagaucgccgaugcgacagacaaauuugcuaagcugccuacccaugauacggacaacgccagaggaaaaauugccaccaucggccagcuccugaucgggcuucaggcuaaugccaugcggucugaucugagaaaccucgacauuaagacaccguucggacugcuccaaaucggcaccgggauuacacuggaucuugacaccagcaucauuuaccagucccccacaggccuguucgagcgcgaagugccucugaccgaccucuga

SEQ ID NO: 4233 - RNA, 4089 nt, Artificial Sequence
  Cas9 variant
augaaccaggagcccuacgccaucggccuggacauugggaccagcucccucggaugggcuaaugccgauauggacggcuauaucgcgagagugaaggggcaaacaggacugggcguccggcuuuucgaagaggggcagccugcugccgaucgcagaucuuuucggacgacccgcagacggcugagccgcagacgguggcgccucagacugcuucgggaaauuuucgacgagccgaucuccucuauugaucccaacuuuuucgcccgccagaaagcuagcuccaucucuccuaaggacgauagauuugaaacaaccuaccagcuguucaaugacaaaacagaucaagaguuuuauagcaaguaccccaccaucuaucaccuccggugggcccugaugacagagcaucgcaaauucgaccugagagaaauuuaccucgcuguucaccauaucgugaaguaucggggaaacuuucugagauccggcaauccuaagagcuucaaacccucugagcuugauuuuucccagcgcuucaaggaagugaacggccuguggcaccucauuuuugacgaggucgccccucagcugccgaccgauaaucuugaggaaaucacgaaacuggugcucgacaccacacggaccagagcggaccgccagcgggagagcguuaagcugcugauggccgcuacagauaaccauaaagacuggaagcccuaccucaccgaguucacgaaggccauucuggggcuuaaaacaaagcuguaccuccugaccggaguggaugucgcuaaagccgaccaaaagacauggaccuucucucuugaagauaucgaagaccacagagcggaucuggagaccgccuuugacgaucgcucccucgagcugauugaaaaacugguggaccuccaggcugccauccagcugacagagaucaugccuagcggccaguauuucucucaauccaugauuuaccgguaugaucagcacaaggaacaucuuagauggcugaaagacuacgcugagcagcaaacggacgccaauaagcgcaaggccguucggcucgcuuaugaucacuacaucgaaggggacgcgaaaggaaagcccgagauugccgaugacuuuuauaaagagcugaacagaauccuuaagggcgauaccagcgaacuggcuaaaaagauuaaucaugagaucgcccucgaacacuucaugccuaagcagcgcacaaaagagaacggggugauccccuaccagauucaccagcaagaacuggacuccaucauugauaaucagaagaaauacuaucaguuucugggagaggacaacccggucgugucucaucacggcagccagccuuacaagaucgaugagcucguguccuuccggguccccuauuacguuggcccuaugauuaccgccgaccaacagaaaaagacagcugccgggcaguuugcguggauggugagaaaggauagcggagacaucacccccuggaauuucgaugacaaaguggaccggacggcuucugccacaaacuuuauccagcgcaugaagaccaccgauacauaucugauuggcgaagacguccuuccccugcaaucccucaccuaccagaaauucauggugcugaacgagcugaauaacaucagaauuaauggggaacuucucacacgggagcagaagcagagaacguauaacgauguuuuuaaaggacauggcaccgugaaugucaagagccugaucaagucucuggagugccacagcgaagugacaggggccauuaaaguugagggacucgcugacccuaagcgcuucaacuccgcccugaccacauaccgggauuuuaaaaagauccuuccgguggcuauugaccaaccccagagacaggccgauaucgaacgcaucauuaauuggucuaccaucuucgaggacgcggauauuuucaaagccaagcugcaagaaaucgacuggcucacggauacccagagagaccggcugagcacaaaacgcuacagaggcuggggccggcuguccgcuaagcugcuccugaacauuaaggauacccaggggcugagcaucauggaccagcucuggaauacacaacauaacuuuaugcagaucguccacgagccugacuaugccgagaaaauugaaaagaccaaugcuaaaggacugaagcagcaggauaucuucgagacgauuaacgaaauguacacaucuccccaaaauaaaaaggcccuucgccagauccuggcgguggucagagacauucagaaggcccaccauggccaggcuccuucccggaucuuuaucgaggccgcucgcggggccgaacaaaacccccagagaacccggcagcgccaaaaacagcucgccgaucuguucgcugaccaggcgaaggagauugugaaugagacaguugcccaggaacugaacgaugagaccgacaacaaagcuagauuuaccgaucggcuuaugcucuauuuccugcaaaauggacaggacauguacacaggcgaaaagcugaacaucgauaaacucagcacguaugacauugaucacauccugccgcagucucuugugaaggacgacucccuggauaauagaguccucgugagcaagguugagaaccugaaaaagaaugaccauuuugccuccgaacuguacgcccgcaaaaugcaggggaccugggagcuuuggcggucugcuggccucauuagcgccagaaagcugaaacaccuucucaugcgcccugaugagaucaacaaguaugcgacaggauucauccggagacaacugguggaaacccgccaggucauuaagcuggugacagacgugcuguccaaugaguacgauucugacaaaaccaagaucauuagcguuaaagcuggccucucccaccagcugcggauggaacuggaucuucccaaggucagagagcugaacgacuaccaucacgccuuugaugccuuccucgcugugcgcaucgggacguaucugcucaaacgguacccuaagcuggagagauuuuucguguauggacaguaccaagucgcgccccagcuugaccugcggcgcuuuaauuucauucaugaucucgugagcggcaaacaggaaaagaucguugccgaggaaacaggggagauuguguggaacagagaaaaggacgucucuuauaugaaacaccuucugucccuuaagcaucugcucgugacccacgagguuaaagaggaucacggagcucuguucaaucagaccaucuacaaggccaaaaaggacaacggcaaugucgggggcaagaugaaacuccugccuacaaagagcaaccggcccaccgaaaucuauggaggccauucuucccaagccauugcuuaccuugccaucgugcgcgugaaugggaaagagccgagcuacagaguuaugggagugccuauucggauccuggaccagcucaagcaggcuaaaaagcaaggcgaauaugccgagagacuggcgcugaagcaguuuuucacacccgauuuuacgaaagggaagggaaaaauugucucugacuucgauguggugaucccccacaucccucuucugcagccggucauugacgaaaucagcggccagucccaucgcuuugcccucgggaccaacacauacuaucggaaccugcaacagcucauucugacccuugcugaucagaagguucugaucagcaaagagacaggcguggacgaggaaaagaagcugguggaggucuacucucacauuugucagcaagugaugaaauucuuuccccucuaugauagaaauaaguuccgcgaacugcuuguugacucccggagccauuuugagcagcugccuaucgugaacagauacuccgaugccggaaaacucgaaaucgcuggcaagcgcgggauucugcagcagaucauggucggacuccacgccaaugccacccccggcgaccugaaagagcuuggggugaagacgccuuucggaaagcugcaaguucccggcgggauuaaacugaccgagaacgcuaagcucaucuaugaaucuccuacaggccuguuuaaacgggaggugaagauuaccacagaauga

SEQ ID NO: 4234 - RNA, 4089 nt, Artificial Sequence
  Cas9 variant
augaagaaaaaggccgagaaaaucuaccugggccucaacguggggaccaauagcauuggauaugcugucacagacgaacaguacagacugcuuaaguucaacggcaaugaugccuggggguccaucguuuuugacgcggcuucuagcaacgaggaucggcgcaaucacagacuggcccggcgcaaccucgacagacggcaacagcgcauuguguggcugcaggaaaucuucgccaaagagauuuccaagguggaugacagauuuuucauccggcuuucugagagcuuucgcuggagagaggauguccaggaccgguauguguucuuuaaugauaaggaguacacggacguucaauauaugaaagaauaccccaccauccaucaccugauuugcgagcucauggauaacaagacaccucaugacgugcgccuggucuaucuggcuugugccuggcucaucacccacagaggacauuuccugaauaaccuuaauguggaaaaacuggaugagauuauggacuuuuccucuguuuaccagaacuucaucaauuacuuuacagagaacggcuauaagcggccguggggagaaauugacgugagcgcucucuccgagguccugaaacagaagaccgggaucacagugaagaauaaagaacuucagaacauucugcucgagggcaagaaacccgaaaagagcggcaccgaggaguucccuuuuucucaagauuccaucauccgccugcuggccgggggacagugcaaacucaaggacguguucuguaaagaagaguaccuggaucuuggcagcgucucucuggggauggacgaagagaaguucgaugaaauuuccggaagcaucggcgaggacuaugaucuccugauugcgcuuagagggcuguacgacuggucuguucucgccaaccugcugaauggacacuccgagacgaucagcauggcuaaggugcagauguaugaacagcacggcaaagaucuccaaauucugaaguacuuugugcggaaauauguccccgacaaguacaacgagguguucagaaaagccaaggcugauaauuacguugccuauaccggccauauggacaaggacacagcgucccagaucaaaaagaaagccaaggcugaagaguuuucuaaauacgugcuuaagcugaugagcccuaucaagcccgagaaaaccgaucuccaguccuaugaagacaugugcgagcgccugaaacuuaaccgguuccugccuaaacaaaagaauacagauaacagagucauuccgcaccagcucuacgaauaugagcugauccagauucugaaaaaugccagcguguaccuccccuuucugaacgacaccaauaacgggaucucugaagcugauaagguucuuuccguguuccgcuauaagauuccuuacuacgucggaccccugaaugaggagagcucuuuugccuggaucagccggaaacagggcaagaucacgccuuggaacuucaaagaaaugguggacgaggaugccuccgaaaaugcuuuuauuagacgcaugacaaacaaguguaccuaucuccccacagaggacguccugccgaaagauucucugugcuaccaaaaguucauggugcuuaaugaaaucaacaaccuccagauugacgggcugaaaaucccuguuaaggcgaagcagggaauuuaucaugagcuguuugagaaaaauaagaaagugaagcggaaagauaucgaagaguaccucauuagaaacaauuaucuggacaaggauagcaccgaacuuaucuccggcaucgacgagcagauucacagcgggcugucuuccuacugugccuucuuuaaccuccugaauaagaaaauccugagcgaagacgaugucgagcgcauuaucgagcgggcuucuuaugccgaagacaaguccagagugauuaaauggcuucgcaaggaguaccccggacucagcgaagaugacauccgguacaucgccagaauuaaaauccgggauuucggccgccuguccaagaccuuccugacaggccucaaggggugcgacguuucuaaaggauuugauggccaagacguggagaugauuagcauccugcagacgaugugggaaaccaacgauaaucuuauggagauucuguccgacaaguauacauuccucgaggcucuggaagccuuuacccaggaguacuauacagggaaaaagaaaucucugaaggaaagacuugaugagaugcgggucagcaacuccgugagacgcccuguguaccggacccucgcgguugucaaggacaucgagaaggcuuucggaaagcccaauaaaaucuuuguggaaaugacgagaggcgggcaggccgaucaaaagggcaaacgcauuaagagcagaaaacagcagauccuggaccuguaugacaaguguaaggaugacgugcacgaucucauguggcagcuggagucucuuggagaauacgccgacucccggcugcaaagcgaucgccucuaucuguacuucaugcaguuuggcaaaugcgcuuacucuggggcccauauuggauucgagcagcugauggcuggcuccgucgaauaugacaucgaucacauuuacccccaaagcuaugugaaggacgauucucuuaacaauaaaguucucgugcugagcgaccugaacgggacaaaggauaauaucuacccugucuccccggagaucagaggaaaaaugcagggccucuggagcugguggaaccaugugggggccauuucugacgagaaguauaagcggcugauccgcuccgcgcccuuuaccgacgaagagaaaaugggcuucauuaauagacagcuuaccgaaacaagccaguccaccaaguuuaucgccgaucugcucaaagagcgguucccugacgcugaaguuguguacgucaaggccggacuggugucugauuuucgccacgaguucgaccugcccaaaagcagauccuauaacgaucuucauaacgcugccgacgcguuccugucuguuguggccggcaaugucuacgauaugcgguuuagcaagaagugguuccgcauugacgagaaauacuccgugaaggugaaaacaaucuuuacgcacgaagucaaguguagaggggauauuaucugggacggaaugccuaugcucgagaaaguugaagauaccgcucggaagaacacagcccacuucgugaaguaugcugccuuuaaaaccggcgggcuguucgaccaaaaucccgugaagaaaggaacaggccucaucccgcugaaggccgggcuuccuaccgagaaauacggcggauauaacaaggcuggcauuauguuucugauccccgucagauacaauauugggaagaaaucugaaauccucauucugccuguggagcugaugcauggaaagcacuuccuugaggauaaaguuuuugcgcgcaacuauacguucacccggcuggaaaauauccucggcaagaaagugggggaggucagcuuucccaugggaaugagaccuuggaagaucaacacaaugcuguccuucgacggcuuccgcgugugccucaccgggacaagcggccggggaaaaugccugguugcccagcccgugaugcaguuuucugcugacgaacauuggagauucuacgucaagcgccuugagcgguuuguggagaagauuggcaucaauccggaucugcucuaugacaaagaucacgacaagguuuccaaagaugaaaaccugaagcuguacgagcuuuacguggacaaacugcagaauaccauuuauaagaagagagucaacagcccugugcaaacgcuccugaaagggaaggaagaguucaaaaagcucucuaucgaagaacagugucaggugcugcuuaauauucaguccgucuuuggacgcaugacaggcgggugcgaucugacccugaucggaggcagcgcccacucugccgcuacaggcucccucagcaccaccaucuccaacuggaaaaagaaguacagcacaguucggauuaucgaccaaucucccagcgggaugugggagaaauccucugaaaaucugcuugauuuccuguga

SEQ ID NO: 4235 - RNA, 4092 nt, Artificial Sequence
  Cas9 variant
augaccaagcugggcaaacccuacgggaucggaguggacauuggcagcaacuccaucggguucgccgcugucgaugaaaauucucaccucauuagacugaagggaaaaacaguuaucggcgcccggcuuuuugaagaggggaaggcggcugccgaccgcagagccagccggacgacccgcagacggcugucccgcaacagauggcggcucucuuuccugcgcgacuuuuucgaaagccauauuacaccuaccgauccgaacuuuuucaugagacagaaauauuccgagaucucucccaaggauaaggcucgguacaaauaugaaaagcgccuuuuuaaugacagaacagaugccgaguucuaccaacaguauccuaccauguaccaucugcggaaucgccuccugacagaccccagcaaagcugaugugagagagaucuauuuugccauucaccacauccugaagucccggggacauuuccucaccagcggcuacgcgaaagacuuuaacacgaauaagguggcccugaacgaaauuuucccugcccuucaggaugcuuacgcucaggucuaucccgaccuggauaucaccuuugacgagaauaaggugaacgaguucaaaacaguucuccuggacgagaaggccaccccuucugauacacaaagagcgcuugugaaucugcuccuggccgaggacggcgauaaagacauucugaagcagcagaaacagguccucaccgaguucgcuaaggccgugguugggcugaaaaugaaacuuaacguggcucugggaacggaagucgauuccagcgaagccacagccuggaauuuuucucucggccaacuggacgauaagugggcugggaucgaguccgcgaugaccgacgaaggaacagagauucuugaucagauccgcgaccuguaccgggccagacuccugaacggcaucgugccggcugggaaaacccugagccaggccaagguggaugacuaugagcagcaccacgaagaccucgagcuguucaaagauuaccuuaagcaacuggaagacgauggaauggccaaagucauucgccagcucuaugaccgguacaucgauggcgacgaugcuaagcccuuuguuagagaggacuucgugaaggcccugaccaaagaagugacagcgcauccuaaugcuaagucucccgagcuucuggagcgccucguccagccugauuuuaugcugaaacaacggaacaaggccaacggcgccauucccgugcagaugcagcagagagaacuggaccaaaucauuaaaaaucaguccguuuauuacgauuggcucgcugccccgaacccuguggagaagcaccgccagagcaugcccuaccagcuggacgaacuucugaauuuccggaucccuuauuacgucgggccccucgugacggcuaaggagcaaaaagccgcgcagggaggcguuuuugccuggauggugagaaaggaucccgacgggaacaucaccccuuauaauuucgacgaaaaagucgaucgcgaggcuuccgccaacacauuuauucagcggaugaagaccacagacaccuaccugaucggagaggaugugcugccgaaacagucucuucucuaucaaagcuacgaaguccugaaugagcugaacaaugugagaguuaacgacaauaagcucuccuucgaucagaagcaacaggugcugggcgaacuuuuugagcggcauaacacggucacaauuaaacaguucguggacaaucugcucgcucacggggauuaugaccgcauccccgagguuagaggacuggccgaugaaaagcgguuucugagcucucuuuccaccuacaaccagcucaaaggcauucugcacgaggcgaucgacgauagcgacaagcagaccgauaucgaaaagauuaucgccuggucuacaauuuucgaggacaaggcuaucuucaaaaccaagcugaaugaaauuagcuggcucacagccggcaugaucaacucccuggcuaacauuagauaccgcggguggggacaauuuucucauaaacuucugaaugagcucacgcugagcaccggccggacaguguucgaggaacugcuuaucuccagccacaaccucaugcagauccugaccgacgagguccugaaacagaagauugccgaacucaaugcccaugagcugaaggcuucugggaucuaugcggccauugaugacgcuuacacauccccuagcaacaagaaagcccuuagacaggugcugucugugaucgaugacauuaccaaugccgcuggacaagcccccaacuggcucuauaucgaaacggcggauggcgacgggguuccuggcaagcgcaccaauuccagacagcggaagauccaggagauuuacgcuaacgccgcccaggagcugaucacaggaagcguccgcggcgaacuggaggauaaaauugcuuccagagccgacuuuaccgaucggcuugugcucuauuucaugcaagggggacgcgacaucuacacaggcgaaccccugaauauugauaaccugucuagcuaugacaucgaccacauccucccgcagucccugauuaaggauaauucucuugacaacagagugcugguccauccucucgugaaucgggagaaagauaccaucuuugcgagcacgcgcuucgcuaagcagaugaacgggauguggagacaguggcacgccgccggacugauuuccagccggaaacugcgcaaucuucaaaugagacccgacgaaaucgauaaguacgcuucuggcuuuguugcccggcagcugguggagacaagacagauuaucaagcucaccgagcaaaucgucgcugaccaguacccugaugccaaaauuaucgcggugaaggccgggcuguccagccagcuccgcaaagaacuggacuuccccaagaaccgggagguuaaccacuaucaucacgcuuuugaugccuuccuugcugccagaauuggcacauaccugcucaaacgcuauccuaaucuggaacccuuuuucaccuacggaaaguuuaagaaaaccgaggugaagaaacugaagucucuuaaauccuucaacuucauccgggacaugacacaugccaaggauaaaauugucgcuaaggagacgggcgaaaucgugugggacaaugcgagcgauauuaacgagcuggacagaaucuauaauuuuaagcgcaugcucaucacccacgaaguucgguucgagacagccucucuguuuaaacagacccucuacgcugccaagaacagcaaaaauagagggggaucccgccaacugauuccgaagaaaaagggcuaucuuguggacaucuacgggggauacacacaggaaaccggcagcuaucugucugucgugcggcucacgaagaaagccauguacgcuguggucaagguuuccacaagagaugccgcgaaacuggcuguggccaagagcauuuccgagcagaaagagaacgaaacccugaagaagaucauugacgggaaacuuucuaagaccagcaaaaagggcaaaacaacccaccagcuguucgagaucgugcucccucgggucggacaaaagacacuguuuaaaaauuccaaguauaaccaguuccucguuaauucugauacguacaugcauaacuaucaggaacuguggaugccccgcgaguaccagagaauguggaaggacauccuucugagcaaucacggcgaugcccaacuggaagggcagcucgaccagauuuuuaaauucaucgugucccaggugaacucuuauuuuaaucuguacgauauuaaccaauuccggaagaaaaucgcugacgccaccgauaaguuugcgaaacuucccacacaugacaccgauaacgcucgcggaaagauugccacaaucggccagcugcucaucgggcugcaggccaaugcuaugagaagcgaccuccggaaccuggauauuaagaccccuuucggacuucugcaaaucggcacggggauuacccuggaccucgacacauccaucauuuaccagagcccgaccggccuguucgagagagaggucccccuuacagaucuguga

SEQ ID NO: 4236 - RNA, 4092 nt, Artificial Sequence
  Cas9 variant
augagaggcaacuaccacaucgggcuggacauuggaaccagcuccaucggcugggccgugauugaugacaaugcuaaggucaugcgggccaaagggaagacagcgaucggagcucgccucuauaacgagggccagacggccgccgauagacggcuguuccgcaccacaagacggcgccuuaauagacggaaauggcgccugaagcuccuggacgaaauuuuugaucccuacaucaccccuguugacgcugccuucuuugcuagacuuaaacaaucuaaccugagcccgaaggaucagaaucgggacuggacaggguccaugcuuuuccccgaucgcaccgacagaaaguuucauaaagauuauccuacaaucuaccaccugagacauaagcugaugaccgaggaccaccaguucgauauucgcgaaaucuaucucgccauucaucacaucgugaaauacagaggaaacuuucugaauacgacccccgugucuagcuucuccgucucugacgugaaguuugacgagcaguucgaucggcuuaacgaacuguaugcggccguuagcccugacgagcccuuugcuauuaauggcgauaacuccaaagccaucgagacacuccugcuuagcgacgaaaccaagaaguucgauaaacaaaagcagucugcuaaacugauucucuccgagacaggcgacaaggcccuggauaaagaaaauaccaagguggcgacgcagaucagcaaagccauccugggguacaagacacagcucgacguccugcuuaaguacgaugcuauuaacucuuccgccuggaaaaucgagcuggacgaugagaauauugacgacacccucccuggacugcuuagccaacuggaugaaaacagacaggagauggugucuaucauucagaaucucuaugcucagguuacacugaaccaaaucgugccgaacggcaugucccugagcgaauccaugaucgagaaguacaaugcccaccgcgaccaucucaaacugcuuaagcagcuggaagauaaaauugacgaucccaagaagaaaaaggggcucgaggccgcuuaugacgcguacgucgggaaaaacaugaagguggccaaucaggauguguuuuaugcuucugucaaaaagaaccuggacgauagcgaccuugccaagcaaaucgccgaucugauugaggcucagaaauucaugccuaagcagcggaccucccagaauggcguuaucccccaccaacuccaucagcuggaacuggaccagauuaucgagaaccagagcaaauacuauccuuggcucaccgccgcgaaucccaacccgaagagaauccaccaagcuaaauacaagcuggaugaacuuguggccuuccgcauuccuuacuauguggggccccuggucacaccugaggaacaggagaagucugccaaucagguguuugcuuggaugaaacggaagcagcccggaacgaucacccccuggaacuucgaccaaaaaguugacagaauggccuccgcuaaucgcuuuauucggagaaugacaaccaaggauacauaccucaucggcgaggacgugcugccugaugccagccugauuuaugaacgcuucaaaguccuuaacgagcucaaucuggugaaggcgaacuaccaccggcuggccccggcucagaaacaggccgcuuauagagaccucuuugaaaaucagaagucuaucagcaccaagaaacugcaaaacuaccuuguugaucagggcuauuucacggccaagcccaaaauuacagggcuguccgacccugagcgcuuuaacucuagccucggaaccuacaucgauuucaaggaaaucuuuggcgaccagguggauaaucccgaccggcaagaugacuacgagaaaauuaucgagugguccaccgucuucgaagauagacagauuuaugaggcgaagcugcggacacuggacuggcuuaccgaagaccagauccaggcccucaagacaaaacgcuacaacggguggggaagacugagcaagaaacugcucacgggcauuguggaugagaauggggagcggaucaucgacguccuguggaacaccaaucaaaacuuuaugcaagugcagucucaggaauccuucgcuaagcggauucaugaggccaaugcuaaacagaugaagguuacaggaguggaagauauccuugccgacgccuauaccagcccucagaacaagaaagcuauucgccaggucauccgggugguugaugacauucagaaggcgaugggcggcguggcccccacaucugucuccaucgaguuuaccagaagcgaagaucaaaauccgcgcagaacgcagucccgggagucucagcugcaaaacaccuucaaaguggacgcuaaggagaucguggauagcgaccucguuacagaacuggagaccgucuccaaaucuaagaaggggcugacagaucgccuuuaccucuauuucacccagcugggaaaagacauguacacgggcgacccucugaauauugaugaacucagcacauaugacaucgaucacauucugccccaggccuuuaucaaggacgauucccuugacaacagagugcuggugagcaaagccgucaauaacgggaagucuaauaacgugccuguuaaacucuucggaggcaagaugggaggcuuuuggaaagagcuggcugaucaucggcugauuuccaagcgcaagcucaaacaccuccugaccgaccccgauacaaucgacaaguacaccaugagaggauucauccggcgccagcugguggaaaccagccaagucauuaaacucguggcccagauccugggcgauaaguaccagaacgacgauacaaaaauuaucgagguuacggcgaagaugaaucaucagaugagagagaacuuuaaacuuauuaagaaucgggaagugaacgacuaucaccacgcugucgacgccuaccugaccgccuucguggggcaauaucucuacaagcgcuauccuaaacugagacccuacuuuguuuauggaaauuucaagaaauuuaacgaggaucaugugucuuuccgguacuuuaauuuccugcacgaacuuauggacgagaacaauaagagaaucgucgaaccggagacaggcgagguggugcuggaacgcgagccugcuauugccuacaugaagcgggucuaucauuuuaaauucaugcucaucucccaggaaguuuacaccagacgcgaugcgauguucaaccagacaaucuaucccgcuaaggaggccaaucggagaaaacugauugccaucaagcacgggaaacccguggacguguacggaggcuauagcgggucugucgaugcuuacauggccauugugcgcauccacgacaagaagggcgauaaauauaagguugugggagucccuaugcgggcucucgagauucugaacgccacccaugacaaaaaggauuacgacgcgaaacuuaagcagauccuggugccgaaguuuacgaaaguuaagaaaagcagaaagacaggcgaaaucaccaaaaagguggaggauuucgaaauuguccucgggaaagugauguaccgccaacugguuaucgacggagauaagaaguuuauggugggcuccagcaccuaucuguacaaugcccggcagcuuguccugucugacuccagccucgacacacuggcuuccaaagggacccucgauucugacgccgauagcaagagacugguggcuguguaugacgagauugucgaaaaaguugauaaguacuucccccuuuaugacaaaaacgccuuucgguccggacugcacaagggccgcgauaaguaccuccugcugccuaauagaucuacauucaacggggccaaaaaggugcauagcggcaaacgggagauccuuaacgagauucugaauggacuccacgcuaacgcgacgcugggcgggcucaaggaccugaaaaucuccacccccuuuggaaagaugcagggccagucugggaucccucuuagcuccaauacaauuaucugcuaucaaagccccaccggacuguucgaacaucgcgugucucugaaggaucucuga

SEQ ID NO: 4237 - RNA, 4092 nt, Artificial Sequence
  Cas9 variant
auggagaacaauagauacaacgugggccuggacaucgggaccagcuccauuggauucgccgucacagaugaacaggacgagcucguucaagugaagggcaaaaauuauaucggggugcggcuguuuaaggaaggacagacggcuucugagcgccggagcuucagaaccacacgcagacggcuuaaacgcagaaaguggcggcugggccuccuggaagagauuuuugcccccuaccuugcgcagggggauccuuauuuccuggcucgcaugaaagaguccaacaucucuccgagagacgaacggaagaaguacuauggaagccuccuguuuuccgaugacaccgucuucuacgauaaauaucccacaguguaccaucugcgccacgcccucaugaccgaggacagaaaguuugauauucgggaaaucuaccuggccguucaccauaucauuaaauaucgcggcaauuuccuuaucaacacacugauuaaugaguuuucuagcaaggcuguggacuucaaaaaggaugccgacauccucaacgaucuguuugagcaguucuacauuuccgacaucaaugacagcuuucaacuuaacaccgcugauaugaaugaaauuucugagcugcuccuggacaacuccaagacgagacuggaucggcagagagaaagccucaaaaagcuggccaaaaaggucgacgauaucucuguggcgaaaaagcaccagaaaaucgccaccgaguucuccaaggcuauucuuggcaauaaggccaaauucgacguuauccugaacgugacaaccgauagcucuaaugacugguccuuuaagcucgaagaugaggacgcugaugagaaaauugucgugcugcuugaggaacugaacacaccucagcaagaagcccucaacaucauucaucagugguauagccagaucucccugaaugggaucgugcccgacggaaagucuauuagcgaggcgaugaucuccagcuacgaacugcacaaagagcaccucgcccugcuuaagcagcaaauuaacaauaccaaggacaaaaagaaagcucauggccugcacgaggccuauaacgaauacguccaugggaauaacaauaagaaacucaaccaggcugauuucuauucuaagguuaagcagaaucuggaguccagccuuaucacggacgaaauucuggagcucaucaacgccgaaaauuuuaugccuaaacaacgcacaucugccaacggagugaucccccaccagcugcaccagcaggagcuggaucggauuauccaaaaucaggcuaaguacuacccuuuccucgcggagaccaacccgaaugaaaagagaagcaagguggccaaauauaagcuggacgagcuugucgcuuuucgcgugcccuacuauguuggcccucugauuacagccaccgaucagaagaaaaccuccgggaaggaguucgccuggauggugcggaaacagcccggaagaaucacaccuuggaacuuugacgaaaaggucaacaaaauggagucugcuaauacguucauucgccggaugaccacaaaggauagcuaccucaucgccgaagacgugcugcccgaugagucccugcuuuaucaaaaauuuaagguucucaacgaacugaauaaccugagagcggacggccgcaagcucaaagugagcgucaagcagaaaguguucaaggagcuguuucagcagcaaaagaccauuacaaucgucaaacuucagaauuaccugaaggcugaaugcucuuuccucaccacgccggagaucuccggccugagcaaaccugagcauuuugugucuucccuggccacauauauugaucuuaagaaaaucuucggggaagacauugauaaccccgcccggcagaaugacuucgagagaaugaucgaaugggcuaccauuuuugaggacaagaacaucuacagcgaaaaacucaaugagaucaaguggcugaacgaucgccagaagaaagagcugaagaauaaaaacuaccacggauggggcaagcucuccgccaaacugcuuaaggggcugcgggacucugaugaauguagcauuaucgagcauauguggaauacccaacagaacuucaugcagguucaagcugaagaggacuuugcccagcggauucaggaagagaauaaccagcaccucaagggaaacacacuggaggaagugcuggcggaugccuauaccuccccucaaaauaaaaaggcuaucagacaggucgugaaaguuauugaggacauccagaaggccaugggcgggaucgcuccccagaaaauuucuaucgaguucacacgcgcccccgaagagaagccuagacggagcguggaaagacaacagcagauugagaaaaucuacaaguccgucgcgaacgaaguggagaaugccggagugaaggaugaacuucagcgcuuuagcgaccggaaacaaacgcucaccgauaaguauuuccuguacuuuacacagcugggcaaagacauguauaccggcaagucuauuaacaucgaucagaucgggaauuaccaaauugaccauauccucccgcaggcuuucauuaaagaugacucccuggacaacagaguucuugucagcgccgcugugaauaacggaaagucugauaaugugcccacaaagaacgaccgcuauaaagucagagagcacggccagcggcuguacgaucaggggcucaucuccaagcgcaaauuuaauaaccugauuaccgacccugauagcaucaauaaguucacggccagaggauuugugaaacggcaacugguugagaccucucaggugauucgccuugucgccgaguuccucuacaacaaguaucagagcaaguccgaaaucaucgaagugagagcuaaaaugaauagccagcugcggaaggacuuuggccugauuaaaaaccgcaacguuaaugauuaccaccaugcgcucgacgccuaucugacaaccuucaucgggaacuaccuuuauagacgguaccccaagcugcgcgcuuauuucacauacggcugcuuuaaaaagguggaugacucucaacucaaguacuucaauuuucugcacgauauugaggacgacaaaaagaaaaucauuaaggauaacgacaccggagaaauccuguggcauagagaugagggcaucgcccgguucaaaagaauuuauaauuuuaaguacaugcuugucacgcacgaggugcugacacgccagggggccauguucaagcagaccguuuauuccgcugccguggcgggaagcaaaaagcucaucccugucaaagaagaccggcccauugauaucuacggcggguauacaaacaauaacgacgcuuuucuggccauugugaaggugaccaaaaagaaacaguacauggucguuggaaucccgcaaagagccguggugaagcucaaugaugcugccaagcagggcuccaaagcguaucagaagguccuguacaacgugaucaaaccucaguucauuaagaaaaagaaggaccgcaaaaccgggaagaucacacaaaaacuugagaauuuugaaauuguugugucuaagacgcuguaccggcagcucaucauugauggcgaccagaaauauaugcugggaagcuccgcuuacaaguauaacgccaagcaacugguccuuucugaguacgcccuggaagugcucgauagaagcaucuucgagaaaaaggaguauaccacaguugaccuggauaauguguacgacgaaauucucgcucaggucgacaaauauuuuucccuguacgauaagaacaaauuccgccagaaacuucacgagucucggaagaucuucaccgaacugcccaucaauaaccucuuuagcggcacaaaacugcugaaguccgggaaaagagagacccuuaaugagauucuggaaggacuccaugccaacgcuacgaagaaagaccucaagagccugaaauucucuacaccucugggcaugauccaguaccccuccgggauuauccuuagcgagaacgccauucuguguuaucaaucuccuaccggaaucuuugaacgccgggugacccugaaggaucucuga

SEQ ID NO: 4238 - RNA, 4092 nt, Artificial Sequence
  Cas9 variant
augaccaagcugggcaaacccuacgggaucggaguggacauuggcagcaacuccaucggguucgccgcugucgaugaaaauucucaccucauuagacugaagggaaaaacaguuaucggcgcccggcuuuuugaagaggggaaggcggcugccgaccgcagagccagccggacgacccgcagacggcugucccgcaacagauggcggcucucuuuccugcgcgacuuuuucgaaagccauauuacaccuaccgauccgaacuuuuucaugagacagaaauauuccgagaucucucccaaggauaagagccgguacaaauaugaaaagcgccuuuuuaaugacagaacagaugcugaguucuacaaauaugagaauugcccuaccauguaccaucugcggaaccgccucaugacagaccccuccaaggccgaugugagagaaaucuauuuugcuauucaccacauccugaaaagccggggacauuuccugaccccuggcgacgccaaggauuuuaauacgaacaagguggcggucaauaaaauuuuccccgcccuccaagacgcuuacgcccagguguacccugaucuggacaucaccuuugacgagaacaagguuaaugaguucaaaacagugcuucugaacgagaaggcuaccccgucugauacacagagagcccucgucaaucugcuucuggcgaaagagggcgaccgcgauauucucaagcagcaaaaacaggcccugaccgaguucgcuaaggccgugguugggcugaagacgaaacucaacguggcucugggaacagaagucgacuccagcgaagccaccgccuggaauuuuucucuuggccagcuggaugacaaguggacagggaucgaguccgcuaugaccgaugaaggaaccgagauucucgaccagauccgggaucuguauagagcgcgccuucugaacggcaucgugcccgccgggaaaacacucagccaagcuaagguggacgauuacgcccagcaccacgaggaccuggaacuguucaaagacuaucucaagcagcuggaggaugacggaacggccaaggcuauucggcagcuuuacgauagauauaucgacggcgaugacgccaaaccuuuuguccgcgaagauuucguuaaggcgcugaccaaagaggugacagcucaucccaacgccaagucuccugaacuccuggagcggcuugcccaacccgacuuuaugcugaaacagagaaauaaggcuaacggcgccauuccggugcagaugcaacagcgcgagcucgaucagaucauuaagaaucaguccgucuacuaugacuggcuggcugccccuaaccccguggaaaaacacagaaagagcaugccuuaccaacuggaugagcuccugaauuuccggauccccuacuauguugggccccuugugaccgcgaaagaacagaaggccgcucagggaggcgucuuugccuggauggugcgcaaagacccugaugggaacaucacaccguacaauuucgacgagaagguugaccgggaggcuuccgccaacaccuuuauucagagaaugaagacgacagauaccuaucugaucggagaagacgugcuccccaaacaaucucugcuguaccagcgguaugagguccuuaaugaacucaacaaugugcgcgucaacaaugagaagcugagcauugaacagaaacagcaagugaucagagagcuguucgagcggcauaacuccguuaccauuaagcaguuugcggaaaaucucagagcccacggcgauuacgcucacaugccugagauccgcgggcuggccgacgaaaaacgguuccuuagcucucuguccacauauagacagcucaagagccugcugcccgaggcuaucgaugacccugccaaacaggccgauauugaaaacaucauugcuuggucuaccguguuugaggacgcggccaucuucaagacaaaacuuaaagagauuaacuggcucgauagccaaacgaucaccaagcuguccaauauucgcuacagaggauggggccaguucucucauaaauuucugaacggccucacacuggggaauggacacaccaucauccaggaacuuuuccugagcaacaauaaccucaugcaaauucugacagacgagacccugcagaagaaaaugacggaacuuaaugcugauaagcucaaggccgccaacaucaaugacgcuauugaugacgucuacaccucccccagcaacaaaaaggcccugcgccaggugcugcggguuaucgaggacauuaaaagagcggcugauggccaggacccgucuuggcucuauguggaaacagccgaugggggaggcaccccugggaagcggacacgcgccagacaacaucagcugcaggagaucuacgcuaaugccgcgcacgagcuuaucgacuccgcuguccggggcgaacuggaggauaaaauugccgacaaggccgauuuuaacgaccgccucgugcuguauuucaugcagggaggcagagauaucuacaccgggacgccccugaauauugaccaacuuagcucuuaugauaucgaccauauucucccucagucccugaucaaggacaacagccuggauaaucgggugcucguucacgcuaucauuaaccgcgaaaagaacgccacauuugcuuccaccaucuacgcccagaagaugaaugcgacauggagacaguggcacgaggccggacugauuucuggccggaaacuuagaaaccugcaaaugcgccccgaccagaucgauaaguaugcuagcggguucgucgcccggcagcucguggaaaccagacaaauuaucaaacugaccgagcagaucguggcugcccaguacccugagacaaagauuaucgccgucaaggcuggacugucccaucagcuucgcgaggaacuggaauuucccaaaaaucgggacgugaaccacuaccaucacgcguucgaugccuuucucgcugccagaauuggcacguaucugcucaagcgcuucccgaaucugcaagccuuuuucaccuacgggaaauuuaagaaagcugacguuaagaaacuucggggcuucaacuucaucagagauauuacacacgccgaggacaagaucguggucaaggauaccggagaggugauuugggacaaaaagcgcgauguugacgaacuggaucggaucuauaauuuuaaaagaaugcucaucacacaugaggugcacuucgaaaaggcggaccuguuuaaacagaccgucuacggcgcuaaggacucuaaggaggccgggggcaaaaagcagcugauuagcaaaaagaaaggauauccuguggauaucuacgggggauauacgcaggaaacaggcuccuaccuuagcguugugcggcugaccaagaaggccauguacgcugucgugaaagugucuacccgcgacgccgcgaagcucgcugucgccaaauccauuagcgagcaaaaggagaacgaaacacugaaugauaucauugacgagaaacucucuaagaucuccaagaacgggaaaaucacccaugaacuguucgagguugugcuucccagagugggccagaagacacuguuuaaaaauagcaaguauaaccucuuccuggucaauucugauacguacaugcacaacuaucaggaacuguggaugccccgggaguaccagaaaauguggaaggacauuagccuuuccaaguauggagaugcccaaaccgaggaccagcuggaucagaucuuuggcuucauugugagccagguuaauucuuacuuuaaccucuaugacaucaaccaauuccgcaaaaagcugaaugaugcugccgacaaauuugcuacacucccuaugagagauaccgacgacaugcaggggaagauugccacaaucggacagcugcuuaucggccugcaagcgaacgccgcucgguccgaucugagaaaucucgacauuaaaaccccgcuggggcuucugcagauccccaacggaauuagccucgauuccgacacgucuguggucuaccagagcccuaccggccugcucgaacgcgaggugcaucuguccgaucuuuga

SEQ ID NO: 4239 - RNA, 4092 nt, Artificial Sequence
  Cas9 variant
augaccaagcugaaccagcccuacggcaucgggcucgacauuggaagcaauuccaucggcuucgccguggucgaugcuaacucucaucugcuuagacugaaaggggagacagccauuggagcgcggcucuuucgcgaaggccaaagcgcugccgacagacgggagucccgcacgaccagacggcgccugucuagaacacgguggcgccuuagcuuccugagagacuuuuucgccccucacaucaccaagauugauccggacuuuuuccuccggcagaaauauuccgaaaucucucccaaggauaaagaucgcuuuaaguacgagaagagacuguucaaugaccggacagaugcugaauuuuaugaggccuacccuagcauguaucaucugcgccucagacugaugaccgacgcuucccaggccgauccccgggagaucuuccuugcgauucaccacauccugaaaagcagagggcauuuucucacaccuggagccgcuaaggacuucaacaccgaugaaguugaccugaaacacauuuuucccgcccuugcugaggccuacgcucagguguauccugaccuggaacucaauuucgauucugcccuggcugacgauuucaaggccaaacugcucgacgaggaugcuaagccguccgacauccaaaaggcccuggugaaccuucugcucagcucugauggcgagaaagaaauugucaagaaacgcaaacaggugcugacggaguuugccaaagcuaucaccggccuuaagacaaaauucaaucuggcgcucgggaccgaaguugacgaggccgaugcuuccaacuggcaguuuagcaugggacagcuggacgauaaguggucuaauauugaaacauccaugaccgaccaaggcacggagaucuucgagcagauccaggaacuguaccgggccagacuccugaacgggauugugcccgccggaaugagccuuucccaggcuaaggucgccgacuacggccaacacaaagaggaucuggaacucuuuaagacauauaucaaaaagcugaaugaccaugagcuugcgaaaaccauucgcgggcuguacgaucgguauaucaacggagacgaugcuaagccuuuccucagagaagacuuugugaaggcccugacaaaagagguuaccgcccaccccaaugaggugucugaacagcugcucaaccgcaugggccaggcuaauuucaugcugaagcaacggaccaaagccaacggcgcuauuccuguccagcuucagcagagagagcuggaucaaaucaucgccaaccagagcaaguacuaugacuggcucgcgaaacccaauccgguggaaaagcaucgcgccuccaagccuuaccagcuggaugagcugcuuacauuucggauucccuauuacguggggccucucaucacgcccaaacagcaagcugaaagcggagagaacgucuucgccuggaugguuagaaagaaucccucuggcaacauuaccccuuacaauuuugacgagaaaguggaucgcgaagcguccgccaacacauucauccagcggaugaagaccacagacaccuaucugauugaugaggacgugcugccgaaacagagccuccuguaccagaaguaugaaguccuuaaugagcugaacaaugugagaaucaacaaugaggcgcucucuacggaccaaaagcagcggcugauccgcgaaguuuuugagagacacagcuccgugacaauuaaacaggucgccgauaaccugguggcucacggggacuucgcccagcggcccgaaaucagaggacuugcugaugagaagcgcuuccucucuagccuguccaccuaccaucaacugaaagaaauucuccacggcgccaucgacgauccuaccaagcugcaugacauugagaauaucauuacauggagcaccguuuuugaggaugccgcuaucuucaaaacaaaacuugcggaaaucgacuggcuggaucccgccacgauuaagaagcucucuaacauccgguauagaggguggggacaguuuucccgcaagcugcuggacggccuuaaacucggcaaugggcacaccgugauucaggagcugaugcugagcaaccauaaccucaugcaaauccuggcugaugaaacacuuaaggagaccaugacagaacugaaucaggacaaacucaagaccgaugacauugaggacgucaucaacgaugccuacacgucuccuuccaauaaaaaggcccugagacaggugcugcgggucguggaggacaucaagcacgcugccaacggacaggaucccagcuggcuuuauauugaaaccgcggacggcccggggacagcuggaaaacgcacccaauccagacagaagcagauccagacaguuuacgccaaugccgcucaagagcucauugauucugccgugcggggcgaacuggaggacaaaaucgcggauaaggcuagcuucaccgaccgccugguccucuacuuuaugcaagggggcagagauauuuauacgggagccccucugaacaucgaccagcuuucccacuacgauaucgaccauauucugccccagucucucaucaaagacgauagccuggacaaucgggugcugguuaacgccacaauuaaucgcgaaaagaacaauguguucgcuuccacccuuuuugccggcaagaugaaagcuacauggagaaaguggcacgaggccgggcugaucagcggacggaaacuccgcaaccugaugcucagaccugaugagauugacaaguucgcgaaaggcuuugucgcccggcagcugguggaaaccagacagaucaucaaacuuaccgagcagauugcugccgcucaauaucccaauacaaagaucauugccgugaaggccgggcugucucaucagcuccgcgaggaacuggauuucccuaagaaccgggacguuaaucacuaccaccaugcuuuugaugcguuccuggccgcuagaaucggaacguaucuucugaaacgcuaccccaagcucaccccguuuuucacauauggcgaguucgccaaagucgacgugaagaaauuucgggaguucaacuuuauuggggcccugacccacgcuaagaagaacaucauugccaaagauacaggcgaaaucgugugggacaaggaaagagauauccaggagcucgaccgcauuuacaauuucaaacggaugcugaucacccaugaaguccacuuugauauggcggaccuuuucgaccagacgauuuacgcugccaaggauuccaaagagagaggaggcagcaagaaccugauccaaaagaaacagggguaucucacaggaauuuacggcggguauucuaccgagcgcggauccuacgugagcaucauccggaccuuuaagaaaggcgccccuauuuauaauaucguuaacauuucuacagcugacgugagccugcuguccgauaagcagagagucagcgaagccucugcggacgugcuucugaaagagcucaucaagaagaaacuggcuaagcggaaauccggggaaaauaccaagagcggcgccuucgagauuguucucccccgcgugggaaagaacacacuguuuaagaauaagaaauacggccuuuuccuggucgaauccacgaccgaguuucauaacuaucaggagcuguggcuccccagaaaugaucaaaugcugaucaagucuauccagagccacaaaauugaagaguccaaggccgacuacgaacuuacacggauguaccgcaacaucgcuucucagguggaucacuauuucgggcuguacaccauuagaaaauucagcgagaagcucacagccuccaucaaugacuauggagcucugccuguuuacaagucugaaaccacggauggcaaauaugaggugcucagcaaccuguuugaggggcuuggauccggcaccagcacagggaaucugaccgccgucaagcugcagccgaacuucggccggguguaccucacaucuggaauugugcuggaagacgauaccuccaucauuuaucaaagccccacaggccuuuuugagagaucugucaaacuggcggaccucuga

SEQ ID NO: 4240 - RNA, 4092 nt, Artificial Sequence
  Cas9 variant
augaccaagcugaaccagcccuacggcaucgggcucgacauuggaagcaauuccaucggcuucgccguggucgaugcuaacucucaucugcuuagacugaaaggggagacagccauuggagcgcggcucuuucgcgaaggccaaagcgcugccgacagacgggggucccgcacgaccagacggcgccugucuagaacacgguggcgccuuagcuuccugagagauuucuucgccccucacaucaccaagauugacccggacuuuuuccuccggcagaaauauuccgagaucucucccaaggauaaagaucgcuuuaaguacgaaaagagacuguucaaugaccggacagaugcugaguuuuaugaagacuacccuagcauguaucaucugcgccuccaccugaugacccacacacauaaagccgaucccagagagaucuuccuugcuauucaccacauccugaagucccggggacauuuucucaccccuggcgccgcgaaagacuucaacacggauaagguugaccuggaggacauuuuucccgcccuuaccgaggcuuacgcccagguguauccugaucuggagcucacauucgaccuggcuaaagccgaugacuucaaggcgaagcugcucgaugaacaggccaccccgagcgacacacaaaaagcucuggugaaucuucugcucucuuccgauggcgagaaggagaucgucaaaaagagaaaacaggugcugaccgaauuugccaaggcuauuacggggcuuaaaacaaaguucaaccuggcccucggaaccgagguugacgaagccgaugcuagcaauuggcaguuuucuaugggccagcuggacgauaagugguccaacaucgagacaagcaugaccgaccaagggaccgaaauuuucgagcagauccaggagcuguaccgcgcgcggcuccugaauggaaucgugcccgccggcaugucucuuucccaggcuaaagucgccgacuacgggcaacacaaggaagaucuggagcucuuuaaaacauaucugaagaaacuuaacgaccaugaacuggccaagacgauuagaggacucuacgaucgcuauaucaauggcgacgaugcuaagccuuuccugcgggaggacuuugugaaagcccugaccaaggaaguuacagcgcaccccaacgaggugagcgagcagcuccugaauagaaugggccaggcuaacuucaugcuuaaacaacgcaccaaggccaauggggccauuccuauccagcugcagcagcgggaacucgaucaaauuaucgcuaaccaguccaaauacuaugacuggcuggccgcucccaacccggucgaggcccacagauggaagaugccuuaccagcuggaugaacuucucaauuuucauauccccuauuacgugggaccucugauuacacccaagcagcaagcggagucuggcgaaaacguguucgccuggaugguccgcaaagaccccagcgggaauaucaccccuuacaacuuugaugagaagguugaccgggaggcuuccgccaauacguucauucagagaaugaaaacaaccgauaccuaucugaucggagaagacgugcucccgaagcagagccugcuuuaccagaaauaugaggugcugaacgaacucaauaacguccgcauuaauaacgagugccugggcacagaccaaaagcagcggcugaucagagagguguuugaacggcacucuuccguuaccaucaaacagguggcugauaaucuugucgcccauggggacuucgcgcgcagacccgagauucggggacucgccgaugaaaagagauuccugagcucucugagcacauaccaccagcucaaggagauccugcaugaagcuauugacgauccuacgaaacuucuggacaucgagaacauuaucaccugguccacaguguuugaggaucacaccauuuucgaaacaaagcucgccgagaucgaauggcuggaccccaaaaagaucaaugagcugucuggcauucgcuaucggggcugggggcaauuuagcagaaaacuucucgauggacugaagcugggcaacgggcacaccguuauccaggaacucaugcuguccaaucauaaccuuaugcagauucuggcugacgagacgcucaaggagaccaugacagaacugaaccaagauaaacugaagaccgacgauaucgaggacgugauuaaugacgccuacacaagcccuucuaacaaaaaggcccuucgccagguccucagaguggucgaagauaucaaacacgcugcgaauggacaggaccccuccuggcuguucaucgagaccgccgauggcacggggacagcuggcaagcggacccagagccgccaaaagcagauucagacaguguaugccaacgccgcucaggaacugaucgacucugccguuagaggagagcucgaggauaaaauugcggacaaggcuuccuuuaccgaucggcuggugcuuuacuucaugcaaggcgggcgcgacaucuacaccggagccccgcugaauauugaucagcucagccauuaugacaucgaucacauccugccucagucccugauuaaagacgacucucuugauaacagaguccuggugaaugccacaaucaaccgggaaaagaauaacguuuuugcuagcacgcucuuugccggcaaaaugaaggcgaccuggcgcaaguggcacgaggcugggcugauuuccggaagaaaacuccggaaucugaugcuucgccccgacgaaaucgauaaguuugccaaaggcuucguggccagacagcuggucgagacacggcaaauuaucaagcucaccgagcagaucgcugccgcucaguacccuaacacaaaaauuaucgccgugaaggcggggcugucucaucaacugagagaagaacuugacuuucccaagaaucgcgaugugaaccacuaucaucacgccuucgacgcuuuucuggccgcucggauuggcaccuaccuccugaaaagauauccuaagcucgcccccuucuucacguacggagaauuugccaaaguugaugucaagaaauuccgcgaguuuaauuucaucggcgcucugacacaugcgaagaaaaacauuaucgccaaggacaccggggaaauugugugggauaaggagcgggacaucagagagcuugaucgcaucuauaacuuuaaacggaugcugauuacccacgaaguguacuucgagacagcugaccucuuuaagcagaccaucuacgccgccaaagauagcaaggaaagaggaggcuccaaacagcugauuccgaagaagcagggguauccuacacaagucuacggaggcuauacgcaggagagcgggucuuacaaugcucuggugcgcguugccgaagcggacaccacagcuuaucaggugaucaaaauuuccgcccagaacgccagcaagaucgcuucugccaaucuuaaaucccgggagaagggcaaacaacugcucaacgagaucgucgugaagcagcuggcgaagagacggaaaaauuggaagcccagcgcuaacucuuucaaaauuguuaucccccgcuuuggaaugggcacccucuuccagaaugccaaguacgggcuguuuauggugaacagcgacacauauuacagaaauuaccaggaacuuuggcugucccgggagaaccaaaaacugcucaagaagcuguucagcauuaaauaugaaaagacccagaugaaucacgaugcccuucaggucuacaaagcuaucauugaccagguggagaaguucuuuaaacuguaugauaucaaccaauuccgcgccaagcucucugacgcuaucgaaagauuugagaagcugccuauuaauacggauggaaacaaaaucggcaagaccgagacacuccggcagauucugaucgggcuucaggccaauggaaccagauccaacguuaaaaaccugggcauuaagacagaccuggggcuccugcaagugggcagcggaaucaaacuugauaaggacacccagauugucuaccaguccccgucuggccuguucaaacgccggaucccccucgcggaucuguga

SEQ ID NO: 4241 - RNA, 4095 nt, Artificial Sequence
  Cas9 variant
augggcgacagaaaguacaaccuggggcucgauaucggaaccagcuccauuggcuucgccgcuguggacgagaauaaccagcccauccgggucaaagggaagacagccauuggaguucgccuguuugaagagggcaaaacggcggcugauagacggggguuccgcaccacaagacggcgccuuucuagacggcgcuggagaaucaaucugcucaacgaaauuuuugacgcccaccuggccgagguggauccuaccuuccuugcucggcugaaggaaagcaaucgcuccaaccucgacccgaaaaagucuuuucaaggaagccugcuguuccccgagagaaaggauuaucaguuuuacgaggaauauccuacaaucuaccaucuccggaaagcccugauggagaaggaccgcaaauucgauuuuagagaaaucuaucuugcugugcaccauauuaucaaguaccggggcaauuuccugaacggcacccccaugagauccuuuaaagucgagaauauugagcucgacacacuguucgaucagcuuaaccagcuguaugccgaaaucgugccugacaaugagcucgcguuugaucuggcccaaguugcugacgugaaggacguccugucuagcaccacgauuuacaagauggauaaaaagaaacagcucgugaagaugaugcugcuucccgccuccaacaaagcucugcagagcgaaaauaagaaaaucguuacccaguucgugaacgccauucucaauuacaaguucaagcuggacguccuucugcaaguggagacagaugcggacuggucucucaaacugaacgaugaaggggccgacgauaagcuggaggaguuuaccggagaccucgaugaaaaccgccuggagaucaucgaccuucugcagcggcuccacaauugguucucccugaacgaaauuacaaaagauggcaauagccuuucugcugccaugguggagaaguaugaaaaccaucaccaccaucuggggcuccugaaaaaggucaucgagaaucacccugacgcuaagaaagccaaggcccugaaagagaccuacacggcuuauguuggaaagacagacgauaaaacccagaaccaggacgauuuuuacaaggcgguggaaaagaaucucgacgauuccccggacgccaaagagauuaagagacugauccaacuugaucaguucaugcccaaacagcgcacaggccaaaacggggcuauuccucaucagcugcaccagcaggaacucgaccaaaucaucgagaagcagagcaaauauuaccccuuucuggccgaaccuaaucccaacgugaagcggagaaaggaugccccguauaaacuggacgagcuuauugcuuucaagaucccuuacuacgucggaccccucgugaccccugaggaacaggcccagaauggcgagaacguuuuugcguggaugaaacgcaaggcugccggccccauuacccccuggaauuucgaugaaaaaguggaccggauggagucugccaacagauuuauccgccggaugacaacgaaggauaccuaucuguucggggaggacguccugccugcugaauccaugauuuaccaaaaauuugugguucucaaugagcugaacaaccuuaagaucaauggaagacaccugagccucaaggacaaacaggauguguauaacgaccuguucaagcagcagaaaacagucuccaucaaggcccugcaaaauuacuaugugaccaaaaagaaggcugccacagcgccgaccgucggcgggcuugccgaucccaaaaaguuucucucuagccuguccacguacauugacuucaaaaacauguucggagaacgcgugaaugauccucaguuucaggaggaccuggaacagaucguugaguggagcacaauuuucgaggaucggggcaucuuuaaggcuaaacuccaagcccugggguggcuuucugaaaagcagauucagcaacugguggcuaagagauauaaaggauggggccggcucuccaagaaacugcugaccggccuuaagaacgccgagggguacagcauccucgacgaaauguggcgcucuaccggaaauuucaugcagauucagagcagacccgaguuugcggcccugauccagcaagcuaacgaaaaacaguucgagggcaaugauccugacaacgucugggagaauaucgaaaacauucugggggaugccuacacaucuccccagaauaagaaggcuaucagacaggugguuaaagugguccaagacauugagaaggccgugggaaacccgccugaaaagaucgccauugaguuuacccgggaagcugcggccaauccccagcgcacacagucccggcucagaacgcuggagaaacuuuaugagagcgcugaagaggugguugaugccggccugaccgccgaacucgcugaguucaaagagaacaagcauguccuguccgacaaauacuaucuguacuuuacacagcuugggcgcgacguguauaccggcgauacaaucagccucgacaagcugaacgauuacgacguggaucacauccugccucaaucuuucauuaaggacgauucccucgacaauagaguccugaccauccgggccgugaacaauggaaaaagcgauaacguucccgcgaagauguuuggcaaaaagauggggucuuucuggcgcuaucuucuggacaauggaaugauuuccaaaagaaaguacaacaaucucaucacggauccugacaacauuagcaaguacgcucagaaaggcuuuaucaaucggcagcugguggaaaccucccaagucaucaagcugacagccaacauucuuaaugggaucuaugacaaagauaccgagauuaucgaagugcccgccaagaugaacucucagaugcgcaaaauguucgaccugguuaaggugagagaggucaaugauuaccaucacgcuuucgacgccuaucucacaauuuuuaucggaaacuaccuguauaagugcuacccgaaacuccagccuuauuucguguacgauaauuuuaagaaauucggcaacaaggaagacaucgggcauaaacgguuuaacuuccugggcaagauugagcgcgagaagaaaguuguggcgcccgaaaccggagagauccuuuggagcaaugucgcucccaacgaaacgauuaagcagaucaaaaagguguacgauuauaaauuuaugauuguguccagagagaucacaacccggcgcgccgaacuguucaaucaaacagucuacccuaagaacuaucacggcaagcucauuccgaucaaagaggacagacccaccgaucuguacgggggauauucuggcaauaccgacgccuaccuggcuaucguugcccuugaggauaagaaaaaggggaaauauuuuaagguggugggcauuccuacacgggucgcugccaaacuggaaaagcucaagcagcaggacagccagcaauaccugcaggcgcuccacaaagugaucgcuccccaguucacgaaguccaccaaaaagggaauuaaaaagacagaguuugaaaucguucuggauaaggugcauuacagacagcuuguccaagacgggccugugaaaaugaugcugggcagcucuaccuauaaguacaacgccaaacagcucguucuguccgagaaggcccuucaggugauugcugacgaucgcaaauucgacgaaacacagaaggaugacaaucugaucgccgucuaugaugagauccugagcauugugaaccaaucuuucgaccucuacgauaucaauggauuucggaagaaacugaacgacaauagagaucaguucauugaccuccccgccgagaccaaguaugaaggccgcaaaguuguggcucacgggaagcgggagaugauccuggaaauucuuaaaggacugcaugcgaacgccgcuuuuggcaaucugaagccuaucggguucuccacggccuuuggacagcuccaaguccccaacggcaucauucugagcaagaaugccauccuuauucaccagucuccgagcgggcuguucgagagaaaaaucaagcucuccgaucuguga

SEQ ID NO: 4242 - RNA, 4095 nt, Artificial Sequence
  Cas9 variant
auggagaagcaggaauacuaucugggccucgacauggggaucagcuccgugggaugggccgucaccaacgauaaauacgagcugcuuagaaagaaaggcaaggacaugugggggauucgggaguucgaggaagcugauucuagcgccgagcgcagaacacaccggguuaaucgcagacggcgccaaagacagguggcgcggaugggacugcucaaagaguauuuuuccgacgcuaucgaaaagguggauucuaacuucuuuauucgcaucgagaauagcaaguacuucuuugaagacaaagauggcagacuguccucuaagaacgggauuuucgacgaugccgacuauaaagaugucgacuacuauacggaguaccccaccaucuuucaucuucggaaggcccugcucgauaucgaggacacaggaaaagaauacgacgugcgccugguuuaucuggcucucgugaauauguucaagcacagaggccauuuucugcuuaacaccgagggcgaugcccugagcuccgaacaggucaauacaaccuaccaggagcuccuggaaauucuugagaacaauuaugacaucagccuggagucucgggauauuaaggacgugaucgauauuaucuccagcucugacaacgggcgcaaaaagaaacacgaacaaauucucgagcuguucggaguuaagaaauccgauaagagagcuaaugaacugcucaaaugccuguguggccuuagcgugaacgccaagcugaucuuugacgagaauuacgaagagaaggucgaucucugcuuccaugacuuuucuuauacagauaaaaucccugaccugauggagaaacuuuccgaagaggaauacuaugugguggagcagcugaaaagcauuuacgacuacuccauccucgcggggacccugaagggauaugauuaccugucuugugcccgggucgaacucuaugagaaacacagagaggaccugaaacuucugaaggcucucuaccgccgguauaagacgaacgaagaguacaaugauauguucaagagcgacaaagaaggcaccuauuccgccuacguuaacagcuucaacucuuccgauagcucugugaagauuaaaaaguacagauggaauaugaaggggcgcacaaucgacaaccuguauggaaccauuaaaaaggcuuuuaaagauaauacagacgauaaggacgugcagagcaugauggaguccaucgauaaagagcaguuccuuccgaagcaacugaccggcgccaacggcgucauccccaaucaggugcacaagaaagaaauggagcggauucucaagaaagcgcagaacuaccugccuuuucugaaggaaaaagacgagucugaacucacgguuagcgagagaauccugcgccuuuucacauuucagauucccuauuacguggggccucugggagaaaauuccaagaccggcugggucgugcggagagaagggggacgcguucuccccuggaacaucgaugagaaaauugacaugagcgccacaucugaggcuuucaucggcaaucugauccggaagugcaccuaucuguccgacgaaaaggugaugccuaaagccagccuuucuuacgaaagauauuguguccucaacgagauuaauaacaucugcauugauggggagcgccuggacaccgaacugaagcaaaagaucuacacagaguguuuuaugaagggaaaacgggugacgagaaagcagauuugcaauuaccucgucgcucagggcuguaucaaguccgaugaacaagugaccggcauugacaucaacguuaauagcucccugucuagcuaugggaaaauguucgccaucuuuggagagcaucuuaaggaagaugccauucggaaaguggcugaggagaucauuuacuggggcacaaucuucuccgacucuaagaaaauguuucgcaagcaccugaccaaguaugucgaacaggggauucucggagagagccaggugaaaagaauccugggcuacaaguucaaagauugggggcgguuuuccaaggcgcugcuuacacuccagggcaucgacaaaagcaccggagaacugcugucucucgagaacgccaugugggaguauucccugaacuucauggaacuuauuaauagcgaugacuucacguuuaaggaugagcuggcuaacagacgcacaucugccaucaagucccucagcgaguucaccuacgaagaccuggaagauaccuauuuuucuguuccggugaaacggaugauuuggcaaacaauccuggucgugagagagauugagcagaucaugggcuacgcccccaagaaaguguucguugaaauggcucgcagcgaggaagagaagggggacaaaggaagaaaggacucccggggcacccagcuucucgaacuguacaaaaauaucaagaacacagagaaucaugauuggaagaaagagauuagcgaagccaacgagucugggaagcugcgcuccaaaaagcucuaucuguacuauacgcagaugggaagagacauguacaccggcgaagagaucaauauugauaugcuuuaugacgauagcauguacgacaucgaucacauuuauccucggcacuacgucaaagacgauuccaucgugaacaaucuggugcucgucaaccgcagagcgaaucaagacaucaagaaggaucuguaccccauuccugacaaaaucauuucuaaccccaaggugcaggaacuguggaaaaugcuucauaagcagaaucucaucacagacgagaaauauaagcggcugaugagccgcuccccguuuaccgagaagcagcugggggauuucauugcuagacaacucguugaaacacggcagggcaccaaaggaaucgccgagcugcuuggccagcuguuuaaggacacggaaauuguguacgccaaagcuaccaacgucucugauuuccgcagagacaauggguuuguuaagagccggcucgugaacgauuuccaccaugcccaggacgcuuaucugaacaucguggucggaaauguguacuauacaaaauuuaccaagaacccuuggaauuucaucaagaaagauuuugacaaggauagaaacaaaaauggcuacaaccuggccaagauguucgaccgcgauguugugagaggggacgauacagcguggauugccuccaaaaaggacacccaaggaacgaucgagacaguccggaagaugaugcgcaaaaauacaccccuuaugacccggaugucuuucgagcagcacggcgggauugcuaacgccacccuguauagcgcuaagaaagccaagguggaaaauuacaucccucucaaauccagcgacauuagacugucugaugugaagaaauacggcggauuuaccuccgcgacagucgccuauuacuucaucguucaucacaaggagggcaagaaagaaaacacgaccaucgaggcucucccccuguauugcaagcgcaaaguggaaaaugaggagaacgggcuucugaaguacugugaagaggugcucggauauggcgacgucaaaauucuguuuaauaagcugaagauccagagccuucuggauauuaacggguaccaagcccaccucucuggaaaaacaggcaaucagcugacccuccggaacgcuaugaaccugugcgugcccgaaaaguggacagccuauaucaaaaagcuggagaaacuuguuguggggcaugucaaggaacaggagauuuccagcgaggccaauaucgaacucuacgaccugcugaccgauaagcaccuuaacucuguguacgcuaaaagaccuaaugcguauggccagaagcugaucgacaaccgcucccgguucguuaaucucaaaccggagagccaaugcgaagccauucugcagauccucaagcugacgaaaauuggaaacaaugagacaaaccuuaagcugaucggcgaauccgagcauagcgggaagaugcugauuucuaaaaaucucaaggauaccgacaaacccgcuaucauuugucagagcgugaccggacuguacgagagaaagaucuauaucuuugaugaacagcuugacaaauga

SEQ ID NO: 4243 - RNA, 4095 nt, Artificial Sequence
  Cas9 variant
augaacaagagauacaauaucggccuggacauugggaccaacagcaucggaugguccguggucaaugaucagucucaacucguucggauuaaaggcaagcugggguauggagugcgccuuuacgacgagggccagacagccgaagauagacggcuguuccgcacgaccagacggcgccucaaaagacggaaguggcgccuggggcuucugagagagaucuuugaacccuauauuacaccucaggacgcuaccuucuuucuccggcagaaacaaagcaaccuguccccgaaggaucugcagaagcagcagccccaaaucggacucuucaaugaccgccuggauucugacuuucacuaccaguauccuacaaucuaccaucuuagauaugcccugaugaccgagaaacggcaguucgaucuccgcgaaauuuaccuggcgaugcaccauaucgugaaguacagaggccacuuucuuaacgcugccgccgcuagcuccuucaaaucuggcgagauugaccuggccaaggauuuugcugcccucaaucagaucuucgggacaauuuuuagcgaggucggauucucccugagcgaaucuaaccuggacgagaucaaauccauucuccuggauaauaaccuuagcgcgucugugcggcaaagaaaggcccugccccucaucuaucagaccgcugccuccaaggacagcgaaaaacaguacaaggcuaucgccacggagcugcuuaaagcgauucugggccucaaggccaaauuuaaucugaucaccgggauugagguugaagacgugaaggcuuggacacugucuuucaacgccgaggauuucgacgcuaaacucuccgaucugaauaucgccgacaacgaugacgccguccaaauuaucgaaauccuucgcgcucuguauagcggagugcuccugaccggcauuguuccugaggggcaguccaucucucaggcgaugauugauaaguacgaagcccauaaggcucaccuuaucaugcugcggagcauuagagagcagcucuccgacaaagagaauaaggcccuggaaaaagccuaugaugacuacaucgaucaccccgaggacaagcaacauggaagccgcgaagacuuuuaugcugccaucacaaaagugcugaagaaggauucugaggacaccaacauuaucgaaauucucaaacugaucgagcuugaucaguucaugccuaagcagcggacgaaagacaacggcgcgauuccgcaccagcugcaucaacaggagcucgaucagaucauugaaaaucagaagcaauacuaccccuggcuggcugacaucaacccuaaugagcagagacagaaaauggcccccuauaagcuggaugaacuugucacauuucgcgugccuuacuaugugggccccaugaucaccgccgaggaacaguuccaaacauccaacaagaaauuugcuuggaugauucggaaggagccgggggccaucaccccuuggaauuucgaccagaaagucgauagacaggcuagcgccaacgaguuuauuaagcgcaugaccacaacggacaccuaccuccuggcggaagauguucugcccaaacaaucucuccuguaucagcgguucgaggugcuuaaugaacugaacggaaucaagauugacgaucagccuaucacaguggagcagaagcaagccaucuuuaaugacaaauucaugcagcaggcucacgucaccgugaagaacauucaggccuaccucguuagcgagggccaauaugcuuccagacccaauaucacagggcugucugacggagaaaaauuuaacagcucccugagcaccuaccacgaucuuaagaaaauuuucggcgacaugaucgaugaccccaauaagcagacggauuuugagaaaaugauugaauggucuacaaucuucgaggacgggaagaucuucgccgauaagcuccgcgaaauuaacuggcugaccgacgagcagcggcagagacuguccaauaaacgguaccgcggauggggccaacucagcaccaagcugcuuacaaaaaucguggaucagaacggccagagaauuaucgacauucuguggaacaccaaugauaacuuuaugcggaucauccauucugacgauuucgaccaagcggucacacaggccaaucagaugcuccuggcugacaacgauacgcaggacgugauuaaugagcuguauaccuccccuagcaacaagaaagcccuuagacaaauccuccugguuguggcugauauucagaaggccaugaaggggcaggccccggcucgcauccugauugaauuugcgcgggagaaacaggccaaucccagacucuccacacaacgcagacggcaggucgaacagguguaccaggagcugaacaaugaccaacuuaacaaggaacuggcugauccucaguaugccaaucucucuaaagaccgccuguuccuguacuuuaugcagggaggcagagauauguauaccggggagagccuuaacaucgaccggcucuccgaguacgauauugaccacauccugccccaggccuucaucaaggauaauucucuggacaaccgcguccucgugagcgcuaaaaugaauagauccaagagcgaccauguuccucuggauuuuacagaggaacgguucggacaaaagaugcgcucucagugggaacagaugcuuagagccggccugcucacccggcgcaaauauaacaaccugacgcugaaucccgacucccuuaacaaguacaccaugagcggguuuauuaauagacaacugguggagacacggcaggucaucaaacucgcgaccaaccugcucguggaucaguacgcugacgaagauguucagcuggugacagucaagucuggccuuacccaccaaaugagagaggacuucgauuuuccgaaaaaucgcaaccugaauaacuaucaucacgccuucgacgccuaccucacggcuuuugugggacuguaucugcuuaagaaguacccuaaacuggcccacuauuucguguacggccaguaucagcagggguucaaggcgaaugaucaauggcggaacuuuaauuuccucaacggacugagacaggagcagcagguugacgcugaaacaggcgagcucauuuggcaaaaagaucaugaccuggccuacaugaauaagaucuacgauuuuaaaaagauucuugucacccgcgaagugcacacaaaccauggggcccuguauaaucagacccucuacaaagcuaaggacgacaaggccuccggacagggcgggcggcaacugaucgcugccaaagagaacagacccaccgcgaucuauggcggauacagcggcaagacaguggccuauaugugccugguccgcauuacggagaaaaagggggauuucuaccggaucuguggagugcagaccgcuuggguugacgaacuugagcacauugaagaugccacaaucaaacugcagagacucaccgcucugcucacaccucaguuuucugccaccaagaagcaaaaagacgagguggucacggugguuaagcccuucgaagugcugcuuccuaaaauucugaucaaccagcgcuuuuaugauggcgggcaggagcugacacucgccagcgcuaccuacaagaauaacgcgcaggagcugguccuugacaaaaaggccgugcaaguucugaauggacagcuccccaaggcugaacuggaggcccaggccaccguggucuacgaucagauccucgaacgggugcaaaaauauuucccgcuguacgacaugaacuccuuuagagagaaacuuuucgugggccgggauaaauuuaaugaacugccuuggcaggaccagugggagaaccacaagcugauucaggucgggcaaaagacaauccucgaucgcauucugaucggccuucaugcuaaugccgcgaugggagaccugaaggcucucaacaugagcacccccuucggcaagcugcagaaaucuaaugggauuucccucagccccgagacacagaucauuuaucaauccccuacgggacuguucgaaagacggguugcccuuaaggaucuguga

SEQ ID NO: 4244 - RNA, 4095 nt, Artificial Sequence
  Cas9 variant
augaagaaccugaaagaguacuauaucggccucgacauugggaccgccagcgugggaugggcugucacagaugaauccuacaauauccccaaguucaacggcaaaaagauguggggaguuagacuguuugacgaugccaaaacggcggaggaacggcgcacccagagagggucucggcgcagacuuaaucggcgcaaggagagaauuaaccugcuccaagaccuguucgcuacagaaaucagcaagguggauccuaauuucuuccuucggcuggacaacuccgaucucuaucgcgaggacaaagaugagaagcugaaaucuaaguacacccuguuuaaugacaaagauuucaaggacagagauuaucacaagaaauacccgacaauucaucaccucaucauggaccugaucgaagacgagggcaagaaagauauucggcuucuguaucucgccugccauuaccugcuuaagaaccgcgggcacuuuaucuucgaaggacagaaauuugacaccaagaauagcuucgauaaauccauuaacgaccugaagauccaucucagagaugaguacaauauugaccuggaguuuaacaaugaagaucugaucgagauuaucacagacaccacgcucaacaagaccaauaaaaagaaagaacugaagaacaucgugggcgauacaaaauuccuuaaggccauuucugcuaucaugauuggcagcucccagaagcuggucgaccucuuugaggauggggaauuugaggagaccacagugaaaagcguugacuucucuaccacggccuuugacgauaaguauuccgaauacgaggaagcucugggagacacaaucagccuucugaacauucucaaaucuaucuaugauuccagcauccuggagaaucugcucaaggacgccgauaaaucuaaggacggcaacaaguacauuuccaaagcguucgugaagaaauuuaauaagcacgggaaagaucugaagacccuuaagcggaucauuaaaaaguaucugcccagcgaauacgccaacaucuuccgcaauaaauccauuaacgacaauuaugucgcuuacacaaagucuaacaucaccagcaauaaaagaaccaaggccuccaaauuuacaaagcaggaggauuucuacaaguuuaucaaaaagcaccucgacacgauuaaagagaccaagcugaacagcucugaaaaugaggaucuuaaacugaucgacgaaaugcucacagauauugaguucaagaccuuuaucccuaagcugaaauccagcgacaacggagugauucccuaucaacugaagcucauggaacugaaaaagauccuugacaaucagucuaaauacuaugauuuccugaacgagagcgacgaguacggcacaguuaaggauaagguggaauccauuauggaguuucggaucccuuauuacgucgggccccucaauccugacucuaaauaugcuuggaucaagagagaaaacaccaaaauuacgccguggaacuucaaggauaucguggaccuggauagcucccgcgaggaguuuauugaccggcugaucggaagauguacauaccuuaaagaagagaaggugcuccccaaggccagccugauuuacaaugaguucaugguccugaacgagcucaauaaccugaaacuuaaugaguuccugaucaccgaggagaugaagaaagcgaucuuugaagaacucuucaagaccaaaaagaaaguuacacugaaggccgugucuaaccugcuuaagaaagaauuuaaucucaccggcgauauucugcuguccggcacagacggggauuucaagcagggacucaacagcuauaucgacuuuaaaaauauuaucggcgauaagguggaccgcgacgauuaccggauuaaaaucgaggaaaucauuaagcugaucguccuuuaugaggacgauaagacguaccugaaaaagaaaauuaagucugcuuauaaaaacgacuucaccgaugacgagaucaagaagauugccgcucucaauuacaaagauugggggagacuguccaagcgcuuucugacaggaaucgaaggcguggacaaaaccacaggggagaagggaagcaucauuuauuucaugcgggaauacaaccuuaaucucauggagcugauguccggccauuacaccuuuacggaagagguugagaaacugaacccuguggaaaauagagagcucugcuaugaaauggucgaugagcuguaccuuucucccagcgugaagcgcaugcuguggcagucccuccggguuguggacgagaucaagagaauuaucggcaaagauccuaagaaaauuuucaucgaaauggcccgcgccaaggaggcuaaaaacucucggaaggaaagcagaaagaacaaacugcuggaguuuuauaaguucgggaaaaaggcguuuauuaaugaaaucggagaggagcgguacaacuaucuucucaaugaaaucaacuccgaggaagagagcaaauuccgcugggacaaucuguaccuguauuacacccaacucggcagauguauguacucucuggaacccauugaccuugccgaucugaaguccaacaauaucuaugaccaggaucacauuuacccgaaaagcaagaucuaugacgauucucucgagaaccggguccuggugaagaaaaaucugaaccaugagaaggggaaucaguacccuauucccgaaaaaguccuuaacaagaaugcuuauggauucuggaaaauccuguuugacaagggccucaucgggcagaagaaauacacaagacugacccgccggacaccuuucgaggaaagagagcucgccgaauuuauugagcgccaaaucguggagaccagacaggccacgaaggaaacagcuaaccugcuuaaaaauauuugccaggauuccgagaucguuuauagcaaggccgaaaacgcgucucgguuccgccaagaguuugacauuaucaaauguagaaccgugaacgaucugcaccacaugcaugacgcuuaccucaauaucgucgugggcaacguuuacaauacaaaguucaccaagaacccccugaauuuuauuaaagauaaggacaacgugcggagcuauaaucuggagaacauguucaaauacgaugucgugcgcggauccuauaccgccuggaucgccgacgacagcgaaggcaaugugaaggcugccacaauuaaaaagguuaagagagagcuugaagggaaaaacuaccgguuuacgcgcaugucuuauaucggaaccggcgggcuguacgaucagaaucucaugagaaagggaaaaggccagauuccccagaaggagaacacaaauaaauccaacaucgaaaaguaugggggcuacaauaaagcuagcuccgccuacuucgcgcugauugagucugacggaaaggccggccgggagcgcacccucgaaacaaucccuaucauggucuauaaccaagagaaguacgggaauaccgaagcuguggauaaauaucugaaggacaaccuugagcugcaggauccgaaaauucucaaggacaaaaucaagauuaacagccugaucaagcuggauggauuucuuuacaauauuaaaggcaagacgggggacucccugucuaucgccggaagcgugcagcucaucgucaacaaagaagaacagaagcugauuaaaaagauggauaaguuccucgugaaaaagaaagacaauaaggauaucaaaguuacauccuucgacaacauuaaggaggaggaacugaucaaacuuuauaagacccugucugauaagcugaauaacggcauuuacagcaauaaaagaaacaaucaagcuaagaacaucuccgaagcccucgacaaauuuaaggagaucagcauugaagagaaaaucgacgugcugaaucagauuauccuucuguuccagucuuauaacaaugggugcaaccucaaguccauuggccugagcgcgaagaccggagucguguuuauccccaaaaagcucaauuacaaagaguguaagcugauuaaccagucuaucacaggccuuuucgaaaacgagguugaucugcugaaucucuga

SEQ ID NO: 4245 - RNA, 4098 nt, Artificial Sequence
  Cas9 variant
auguacaagaaagacuauaccgugggccuggauaucgggagcacauccgucggauucgccgcuauugacgaugacuaccagcccaucagacucaagggcaaacggguuauuggggugcgccuguuugaggaaggaaagacggccgcggagagacggaacuuccgcaccacaagacggcgccuuaauagacggaaauggcgccugucucuccuggaagagaucuuugauccuuauauggcuaagguggacccgaccuucuuugccagacuuaagcaaagcaaccuguuccccaaagauaagaauaaaaaguuuacaggcucccuccuguucccuaaaaccacagacucuaaguuuuacgaugaauaucccaccauuuaccaccuucgguaucaucucaugaacgacagccgcaaguucgaucugagagagaucuuucuugccauccaccauauugucaaauaccgggggaauuuccugaacuccgcuccuaucgccucuuuuagcacggacaagauuaaucucguggaugacuucgagaccguuaacgcugccuaccugcagaucaauuccagcaaccccgugcagcuugacacagaucaggcggaccaagucucucgcauucugcucgauaauaaacuguccaaccuggacaagcagaaacaggccgcuaaggcccucgcucagaaaagcggagauaagaagcaagacaaaaucaauaacaccacaauuaagcagaucugcaaagcccugcuuggcuauaaguucgaucuggcggugguucucaauaucgacucugaugaccacaacaaauggaagcugcagcuuuccgaugaaaacauugacagcagacuggccgagcucaccggcgaacugaaugaggcucagcuggacauccucaacgugcugucucggcuuuacucccaaauuacgcugaaugauaucgucccuagcgggaugacacucuccgaggccaugauugaaaaguauaaagcucauaagaaacaccugaagaugcuuaaagacuuugccagaucucugagcaagaaggauuacggacaggugauggaggccuaugcugaauacaucggcaacaucccggaguccgcgagcucuaaagcccagaagaaaauuucccaagacgauuucuauaagaaaaucaagcgcuaccucgacgauagcaagcuggggcagaaaauugcugaacugaucgccaagaaugaguuuaugcccaaacagcggaccaaccagaauggagugauuccuuaccaacuccaccugaaggagcuuaaccagaucaucgaaaaucagucuaaauauuaccccuggcuggccgagcucaacccuaaugaaaagagacgcggcaaagcuaaguauaagcugagcgagcuggucgccuuccggauucccuacuauguugggccgcuuaucacacaggaggagcaacagaaaaccuccaacgcgaauuuugcuuggaugauuagaaagucugagggacgcaucaccccuuggaacuucgacgaaaaaguggaucggauugccacagccaauagauuuaucaagcgcaugacgaccaaagacacauaccucauuggcgaggaugugcugcccgcucauagccugcucuaugaacgguucaagguccugaacgagcuuaacaugaucagagugaauaaccaccgccuguccguuggccagaagcaggacguguuugaaaaacucuuccaaaagcauaaaaccgucaagacacgggagcugaucaaacagcugauggccagcgggcuuccuacccagcccagaauuacgggacucucugaucccgcuaaguuuaauacaucccugggcaccuacaacaauuucgccaagauccugggggacgagauuaaccagccugaccggcaagaagauuuugagaaaaucauugaauggaucaccaucuucgacgauaaggacauucucaaaacaaagcugagcgagcuuucuuggcuggaugagaaacagaucaaugcgcucauuaacaagaauuacuccggauggggccgccugagcagaaagcugcuuaccgaacucacaaacaaaaaggggcaguccaucauugaccggauguggaauacgcaaaaaucuuucaucgagaucauuaacgaaccgguguuugccgagcagaucaaggaugcuaaucaggaccagcuggaugaagacgauuaugagaccguucugcacgacgccuacacaagcccccaaaacaaaaaggcuauuagacaggugaucaaagucguggaugacauuguccgcgccgcgggacgggccccuaaguucaucucccucgaguuugcuagagaagaccaggagucucgcagaacccagagccggcugucccgcaucaagaaaauuuaugaaacaaccacgaaggagcuuguggccaaugaucaaaucagagaggaacugggcaacguuaaagaccucaacgaucggcuguuccuguacuuuacccagcuuggccgcgacgcuuauacaggggagagaauuaauaucgaugacauuagcaccaaguacgauaucgaccacauuuucccccgggccuuuaucaaagaugacucucucgauaacaaggugcuggucaagcgcgccgugaauaacggaaaauccaauaacguuccucugaaacucuucggcgcuaagaugaagcccaucuggaaaauguggaaggaccaucagcugauuagcaagagaaaauaugaacaccuuaugacaaauccggacgcgaucgauaaguacaaagccaacggguuuauuaaucggcagcugaucgagacccgccaaauuaucaagcucgcugccaacauccuggccaauagauacucuacggaagacacaaaaauuaucgaggugaaggcuaaccugaaucaucagcuucggcagucccugcaccucuauaagaacagacaagucaaugauuaccaucacgccguggacggauaucugagcgcguucgugggccaguaccucuaucaccgcuacccuucucugcagagcuauuuuguuuacgggcaguaccaacgguucuuugauaaacagguccaggaaaacaugaaguucaacagauucaauuuucuuuaugaccugaccgaucgcgacaacgaucagauuguggugaaauccacaggcgagaucgucggagaaaagagcaaacucauugaacaaaucaaguggguguaccgguauaaguucaugcugguuucucaggagguguuuaccaaaaccggcccccuguucgaccagacaaucuacccugcuggguccaauaagagcagacuuauucccaucaaaaaggaucgcccuacggacauuuauggaggcuacuccucuagcaccgaugccuauaugucccugauccggguccccgacaaaaaggaagacaaauacaaggugguuggggugccgucuagaagccucgccucccugaaccgcgcugagaagcggggacaugaugccuaccucgaccagcugagacaagucauugcgaaaucucagaagaaagaguuucagaucauuaucccuaagcugcgguaucgccagcugaucauugauggcgggcucaaauacacacugggcagcuccgcuuaucaauacaaugccagacagcuggugcuuagcgaaaagucuauggagguucuggugaccgacuucuccaaggucacaaccgaucucgacaaacagaaccaaaagcugaucgccguguaugaugacauucucgauaaagugaaucggugucugccccuuuacgacaagaaccaguuucgcaaagcucugaauggagccagagauaaguucguccagcugcccauccucccuaaguuuaacggcaauaaaaaggaagaggcugggaaaguugaaauucugaacgagauccuucugggacuccacgacgaugccagcacgggcaaucugaagccgcucgggaucaaaacacccuucggaaugcugcagacccaaucuggcauuaccauguccagcaacgcggugaucgugaaucagucuccuacagggcuuuuugagcaucggauuuaucugaaggcccugcucaacaagcugaauaaauga

SEQ ID NO: 4246 - RNA, 4098 nt, Artificial Sequence
  Cas9 variant
augaccaagcugaaccagcccuacggcaucgggcucgacauuggaagcaauuccaucggcuucgccguggucgaugcuaacucucaccuucuuagacugaaaggggagacagccauuggagcgcggcucuuucgcgaaggccaaagcgcugccgacagacgggggucccgcacgaccagacggcgccugucuagaacacgguggcgccuuagcuuccugagagacuuuuucgccccucauaucaccaagauugauccggacuuuuuccuccggcagaaauauuccgagaucucucccaaggauaaagaucgcuuuaaguacgaaaagagacuguucaaugaccggacagaugcugaguuuuaugaagacuacccuagcauguaucaucugcgccuccaccugaugacccacacacauaaagccgaucccagagagaucuuccuugcuauucaccacauccugaagucccggggacauuuucucaccccuggcgccgcgaaagacuucaacacggauaagguugaccuggaggacauuuuucccgcccuuaccgaggcuuacgcccagguguauccugaucuggaacucacauucgaccuggcuaaagccgaugacuucaaggcgaagcugcucgaugaacaggccaccccgagcgacacacaaaaagcucuggugaaacuucugcucucuuccgauggcgagaaggagaucgucaagaaaagaaaacaggugcugaccgaauuugccaaggcuauuacggggcuuaagacaaaguucaaucuggcccucggaaccgagguugacgaagccgaugcuagcaacuggcaguuuucuaugggccagcuggacgauaaaugguccaauaucgagacaagcaugaccgaccaagggaccgaaauuuucgagcagauccaggagcuguaccgcgcgcggcuccugaacggaaucgugcccgccggcaugucucuuucccaggcuaaggucgccgacuacgggcaacacaaagaagaucuggagcucuuuaagacauaucugaaaaagcugaaugaccaugaacuggccaagacgauuagaggacucuacgaucgcuauaucaacggcgacgaugcuaaaccuuuccugcgggaggacuuugugaaggcccugaccaaagaaguuacagcgcaccccaaugaggugagcgagcagcuccugaacagaaugggccaggcuaauuucaugcuuaagcaacgcaccaaagccaacggggccauuccuguccagcugcagcagcgggaacucgaucaaaucauugcuaaucaguccaaguacuaugacuggcuggccaagcccaacccgguggagaaacacagagcuucuaagccuuaccagcuggaugaacuucucacauuucgcauccccuauuacgugggaccucugaucacccccaaacagcaagccgagagcggcgaaaacgucuucgcguggaugguucggaagaaucccuccgggaacauuacgccuuacaauuuugacgagaaaguggauagagaggccagcgcuaacacauucauccagcgcaugaagaccaccgacacauaucugauugaugaagacgugcucccgaagcagucucugcuuuaccagaaauaugagguccugaaugaacucaacaaugugcggaucaacaaugaggcccuguccaccgaccaaaagcagagacugauucaugagguuuuugaacggcacagcucugugacaaucaaacaggucguggauaaccuuguugcucauggagacuucgcccagcgccccgagaucagaggccucgcggaugaaaagcgguuccugagcucccugucuacguaccaccaacucaaagagauucugcauggggccaucgacgauagcaccaaacuucacgacauugaaaauaucauuacaugguccaccguguuugaggaugcugccaucuucaagacaaagcuggcugagauugacuggcucgauccugccaccaucaagaaacugagcaacaucagauaucgcggauggggccaguuuucucggaagcugcuugacggccucaaacuggggaauggacacacggucauucaggaacugaugcucuccaaccauaaucugaugcaaauccuugccgaugagacccugaaggaaacaaugaccgagcucaaccaggacaaacugaagacagaugacauugaagacgugaucaacgaugcuuacaccagccccucuaauaagaaagcgcugagacagguccuucgcgugguugaggacauuaagcacgccgcuaacggccaggauccuuccuggcucuauaucgagacggccgacgggacaggaaccgccggcaaaagaacacaaagccggcagaagcagauccagaccguguacgcuaaugccgcgcaagaacugauugauuccgcuguccgcggggagcuggaagacaaaaucgccgauaaggccucuuucaccgacagacucgugcuguacuuuaugcagggcggacgggauauuuauacaggcgcuccccuuaacaucgaccagcugagccauuacgauauugaccacauccucccgcagucccugaucaaggacgauucucuggacaaucgcguucuugugaacgccacgauuaauagagagaaaaacaaugucuucgcgagcacccuguuugcuuccaagauggccgccacauggcggaaauggcacgaagcugggcucaucagcggacgcaagcugagaaaccucaugcugcggccugaugagaccgacaaauucgcccauggcuuuguggcucgccaacuuguggagacaagacagauuaucaagcugaccgaacagauugccgcggcccaauaucccaauacgaagaucaucgcuguuaaagccgggcucucucaccagcugcgggaggaacuggauuucccuaagaacagagacgucaaucauuaccaccaugcuuuugaugccuuccuugccgcucgcauuggaacauaucugcucaaacgguaccccaagcuggcgcccuuuuucaccuauggcgaguucgccaaaguggacgugaagaaauuuagagaguucaacuuuaucggggcucucacccacgccaagaagaauauuaucgccaaagauacaggcgaaauugucugggacaaggagcgcgauauccaggaacuggaccggauuuacaacuucaaaagaaugcuuaucacccacgaggugcauuuugaaacagcugaucuguucgaccagacgaucuacgccgcgaaggacuccaaagagcgcggaggccggaugagccucauuccuaagaagcugggguaucugaccggaaucuacggcggguaucaaacagagagaggaucuuacguuuccauuauccgcaccuuuaaaaagggcgaaacaauuuauaaaguggucaacauccuuaccgcugaugugagccugcucucugagaaggaaaaaguuagcaagacgcuggccgacaucuaccucaaggagcugauugccaaaaagcuguccaaaggcaagagcgggaaaaauaucgcuucugaaccguucgagauugugcuuccucgggucggaaaggauucccuguuuaagaacaaaaaguauggccucuuccugaucgagagcgccaccgaacuucacaauuaccaggagcuguggcuccccagaaacgaccagcugcucauuaaacggauccaggcgcgccaaaucgaagaguccaaggcugauuacgaacugacaagaauguaucggaauauugccuggcaaguggaccauuacuuucgccuuuauaaaaucagaaaguucgccgagaagcugcaggcuucuguugaggauuucgccgggcugcccguguacaaaaacgaaaccagcgacggaaaggucgaggugcucgcuuccgugcugaaacggcuuaauggcgccgcggauaaggggagaacaaacccuaccacagucaaacugcagucugacuuuggacgcacccuccugacgaauggcauuguucucgaagaugacagcuccaucguguaucagucuccgacagggcuguucaagcggagcgugaaacuugucgaucuguga

SEQ ID NO: 4247 - RNA, 4098 nt, Artificial Sequence
  Cas9 variant
augaccaaggaguacuaucugggccucgacguggggacaaacagcgucggaugggccguuacggauucccaguacaaucugugcaaauucaagaaaaaggacauguggggcaucagacuuuuugaaucugcuaacaccgccaaagaucggcgccugcaaagagggaaucggcgcagacucgagcggaagaagcagcgcauugaccugcuucaggaaaucuucagccccgagauuuguaaaaucgauccuacauuuuucauuagacugaacgaaucccggcuccaccuggaggacaagucuaaugauuuuaaauauccgcuguucaucgagaaggacuacagcgauaucgaauauuacaaagaguuucccaccauuuuccaucuccgcaagcaccugaucgaauccgaggagaagcaggacauuagacuuaucuaucuggcgcuccauaacauuaucaaaacacggggacacuuucugauugauggcgaccuucaaucugcuaagcagcugcgcccuauccucgauaccuuccugcugagccuccaggaagaacagaaucuguccgugagccuuucugaaaaccaaaaagacgaguacgaagagauccugaagaauagauccauugccaaaagcgagaaggugaaaaagcucaagaaccuguuugaaaucucugacgagcuugaaaaagaggaaaagaaagcccaguccgcugucauugagaauuucugcaaguuuaucguggggaacaaaggagauguuuguaaguuccugcgggugagcaaggaggaacucgagauugacucuuucuccuuuagcgaaggcaaauacgaggaugacaucgucaagaaucuggaagagaaagugcccgagaagguuuaucuguucgaacagaugaaagccauguacgauuggaacauccucguggacauucuggagacagaagaguauaucuccuuugcuaaggucaagcaguacgagaaacauaagaccaaucuucgccugcucagagauauuauccugaaauauugcacgaaggacgaauacaaccggauguucaacgaugagaaagaagccggcucuuauaccgcguacguggggaaacuuaagaaaaauaacaagaaauacuggauugagaagaaaagaaauccugaagaguuuuauaagagccugggaaaacuccuggacaagaucgagccccugaaggaagaucucgaggugcugacaaugaugaucgaagaguguaaaaaccacacccuucugccuauucaaaagaauaaagacaacggcgucaucccgcaccagguucaugaaguggagcucaagaaaauucuggagaaugccaagaaguacuauuccuuccugacagaaaccgacaaagauggguacagcgugguccagaagaucgagucuauuuuucgcuuccggauccccuauuacgugggaccucuuuccacgagacaccaagaaaaaggcagcaacguuuggauggugcgcaagcccgggcgggaggacagaauuuauccuuggaauauggaagagaucaucgauuuugagaaaucuaacgaaaauuucauuacacgcaugaccaacaagugcacauaccucaucggagaggacguccugcccaagcauagccugcucuacuccaaauauauggugcugaaugaacuuaacaauguuaaggugcggggcaaaaagcugccgaccucucucaaacagaaggucuuugaggaucuguucgagaacaagagcaaagugaccggcaagaaccugcuugaauaccuccagauucaggacaaagauauccaaauugacgaucuguccggguuugacaaggauuucaaaacaagccugaagucuuaucucgacuucaaaaagcagaucuuuggagaggaaaucgagaaggaauccauucagaauaugaucgaggauauuaucaaauggauuacgaucuacggcaacgacaaggagaugcugaaaagagucauccgcgcuaauuauagcaaccagcuuaccgaggagcaaaugaagaaaauuacaggguuccaguacucuggauggggcaauuuuuccaagauguuccugaaggggaucagcggauccgacgugucuaccggcgaaacauuugauauuaucaccgccaugugggagacggacaacaaucucaugcagauucugagcaaaaaguucacauuuauggauaacguugaagacuucaauuccggcaaaguggggaagaucgauaaaaucaccuaugacucuaccgucaaggagauguuucugagcccugagaacaagcgggcuguguggcagacaauucaaguugccgaagagaucaaaaaggugaugggaugugaacccaaaaagauuuucaucgagauggcgagaggcggggaaaaagucaagaagcgcaccaaaucccggaaggcccagcuucucgagcuguacgcugccugcgaggaagauuguagagagcugauuaaagaaaucgaggaccgggaugagcgcgacuuuaauagcaugaaacucuuccuguacuauacacaguuuggaaagugcauguacucuggcgaugacauugauaucaacgaacuuaucagaggcaauuccaagugggaccgggaccacauuuauccucagagcaagaucaaagaugacucuauugauaaccuggugcucgugaauaagacguacaacgcuaaaaaguccaacgagcugcugagcgaagacauccaaaagaagaugcacucuuucuggcuuagccuccugaauaaaaagcugauuaccaaguccaaauaugauagacucacacgcaagggggacuucaccgaugaggaacugagcggauuuaucgcccggcagcuuguugagacaagacagucuaccaaagccaucgcugacauuuucaagcaaaucuacuccagcgaggucguguaugugaaauccucucuggucagcgauuuucgcaagaagccccucaacuaccugaaauccagacgggugaaugacuaccaucacgcgaaggaugccuaucugaacauuguugugggcaaugucuacaacaaaaaguucacgucuaaucccauccaguggaugaaaaagaaccgcgacaccaauuauagccuuaacaagguguuugaacaugacguugugauuaauggggaggucaucugggaaaaauguacauaccacgaggauaccaacacauaugacggaggcacccuggauagaauccggaagauuguggaacgcgacaauauccucuacacggaguaugcuuacugcgagaaaggggaacuguucaacgccacaauucagaauaagaacggaaacuccaccguuucucucaaaaagggccuggaugugaagaaauacgggggcuauuuuagcgccaauacauccuacuucagccuuaucgaguuugaagacaagaaaggagauagagcucggcauauuaucggcgucccuauuuauaucgccaacaugcuggagcacucuccguccgcguuccucgaauacugcgagcagaagggguaucaaaaugugcgcauccugguggagaaaauuaagaaaaacagccugcuuaucauuaauggauacccccugagaauccggggcgaaaacgaggucgacaccucuuuuaagcgcgcuauucagcucaagcuggaucagaaaaauuaugaacucguuagaaacaucgagaaguuccuggagaaauacguggaaaagaaagggaauuacccuaucgacgagaaccgggaucacauuacccaugaaaagaugaaucagcuuuaugaggugcugcucuccaagaugaaaaaguucaacaaaaagggaauggccgaccccagcgauagaaucgaaaaaucuaagccuaaguuuauuaaacuggaggaccugaucgacaagauuaaugucaucaacaaaaugcuuaaucugcuccgcugugauaacgacacaaaggccgaucugucccucaucgagcugcccaaaaaugcuggcagcuucgugguuaagaagaacacgauugggaaauccaagaucauucuugugaaccaaagcgucaccggccuguacgaaaaucggagagagcuguga

SEQ ID NO: 4248 - RNA, 4098 nt, Artificial Sequence
  Cas9 variant
auggacaccgccaagacaaacaaacagcccuacuauaucggccuggauauggggacgagcuccgugggaugggcugucaccgacgccucuuacaauguugugaagaaacacggcaaggcgcucuggggagugagacuguucgaggaagcucaaacagccgccgaucggcgccuucauagaaccgcucggcgccggauucagagacgcaaacagagacuggcccuccugcaggagcuuuuugcuaaggaaaucugcaaggucgacccuggguucuuuauucggcugcacgagagccgccucuggcaagaagauaaauccaucgaccagccgaacacacuguucaaugaugaggacuuugaugacaaggccuaucauaaagcguaccccaccauuuaucaccugagauacgcccucaugacagagaacaagucuuucgaugugcggcugguuuaucuugcuauccaucacaucauuaaacaccgcggccauuuucugcucgaaaauuacgaccugagcaaccaggagaccuccggguucgaugaaucuuacaucgcccuuacgaaugcuauuaaggagcugcuccagaaggagaucccugugggacacgucgagaaaauucaaaucauucugaaggacaaaagccuguccaagagagagaaaaccgaaaagauccuccaggugugggacguuaucaaagauaagcagcugaaggaggugguccagcuuauuuguggcggcacagccaaccugagcacccucuuuauggacgaaucucugaaagaggcgcuuaagguguucgagaucaaagauuccaagauuagcuuuucuacagccguguaugaagagaaagaauccgaccugcaaagcguccucgagcagcgguucgaucugguuuacgcugccaagaugcuguaugacuggucucuccuggcugaacuuaugggggaucgcaagacccuguccgaggccaaaaucgccauuuacgagacgcauaagaaagaccucgaagugcugaagagacuuacacggcaggauaaaagccuguauagaaagcucuuucgcggaaccgacaaggauuccuacucugcuuaugugggcagcugcaugauccacggggagaaacuggucaucgaaaagcggggauccacagaggaauuuuacaaauuccugaagaaagagauuagcaagcuccccgacugugaggacaagaucuacgugcugucuaaaauugaagcggagaauuuucuuccuaaggccguuuccaccaucaacggcauuauccccuaucaacugcaggaacaggagcucgauaucauucugaaaaaggcugagcaguaccugccuuuccuuauggaaaaagacgccuaugggaccaucagcgagaagauuaaacaacuccugacauuuagaaucccguucuacgugggaccccugaaucgccacucugauaagagcugggccguccauacggacaaggaaggccggauucucccuuggaacuuuaaugagagaaucaacgaagagaaauccgcugagaaguucauuacccgcaugacaaauaaaugcaccuaucugcuuggcaaggaugugcugcccaaaaacucucuccuguacacagaauauaugcuguuuaacgagcuuaauaacguuaagaucgggaaggccggaaccuaccucacggaagaacagaaagaaaagcuguggaaagagcuguuccucacaaccaagaaagugacccugagcaaguuuuccaaguuccuuaucaaagagggcauugacaaggaagaggcggucgaaaucaaagggcuggauggaggcuuuaagagcucucucgcuccuuggauugaccugaaaaauauccugggggaggauuucacacgggacaaggccgaagagauuaucaaggccaucacccuuuucuccauggauaaaaagauucucaaaaaguaccugaugagaaucgugagcgagcccgucgcuaaacagcugucuaagcuccgcuauacaggauggggccgguucuccaaagaguuccugacggaaauuaccccgagagugacagacgauguucaggugcuugucgacaccagcacaggcgaaaucaugaacauuaucaccgcccugaagaagacgucccucaaucugauggagauccugucuagcaccuacggguauuccgcugccauuucugaggcgaacaaagaacuugugggaaauacaguucucagcuacgagaccgugaaggaacugacagucuccccugccgugaaacgccccaucuggcaaacccugaagauuaucaaagagauuacgcacaucaugggcgcugaaccugcccggaucuuuauugagauggcuagagacaagcagcccgauaaggggcggacagacagccgcaaaaagcagcucaucgagcuguauaaaaaguguaaagaagaugugagaucuugguccaaccgggagagcaaggacuggguugaagagauugaaucuaaguccgauagccagcuuagaucuaauaaacuguuccucuacuauacccaaaugggaaagugcauguacacaggcaaacccaucgaccugggggcccugcuuaagggccagcuguacgaucgcgaccauauuuauccucagagccagaccaaagaugacucccucgauaaccuggucaucguggacaaucgggagaacagagauaagagcaauaccuacccgcucucuaagaacauucgcgagagacaaaucggauuuuggaaacugcuucgggacaagggcuucaucuccaaagaaaaguauuuucgccugacaagaaauacgcccuucagcgacgcggagaaagccgaauuuauugcucggcagcucguggagacccgccaguccacaaaggccgucgcugaaauccugaagagagugcugccuaaaucuauuaucguuuacgugaaggccgggcuuaccagccgguuccgccaauauggagaguuuauuaaagucagagaucugaacgacuaccaccaugccaaggaugcuuaucucaacaucgugacaggcaauguucacuacaccaaauucacguccaaccccauccgguuugugaaggacugucagauuuacucucugaaugagcacgcgcucuauaaauacacagucgaacgcaacggggugguugccugggcuccuaaugaggaaggaaugaugcccagcgugaccagauggaugaacaagaauaacauccuggucacccggauguccuaugugggccagggggagcuuuucgaucagcugccgcucaagaaaggcaagggacaagugucucugaaaaaggagggcgccauuagcgacaucuccaaauacgggggauauaauagcgccucuacagcuuacuuuauguaugucgaaggcgaggauaacaaggggaagccuguuuacgugauugaaaccaugccccugcaucuugccgcgagacugacaacgcucgaggaaaaacagaaguacugcgaggagcuguggauguccaccggaggcaaacucaagaauccuaaagugcugaucgaacagauccccauucagagccuuuucucugucgacggguuccgcgugacaaucgcuggcaagaccggaaagcaauauggcugucggcuggccgaggaacugguucucaacaauggguacgccaugacacugaaagcugugcuuaaguuugucaacagacgcaaaaugaauaaggaggcccugauuaccuccuaugaucaccucgaagagagccagcugcucgcgcuguacgacguguuccuugauaaacuggagcauucuugcuuuuccaagcgguucagcacgcagagagacguucugaagaacggacgcgaauccuauaucgcucucagccuggaggacaaaugucagauucuuucugaaauccugcaccucuuucaaugcaacgccacccugagcaaucucucccugcuuggcucuagcaagcaguccgggcggcuguacaugucuaaaaaccugagcgauaaggacuccugguauauuauccaccagucugugacaggauucuacgagcaacauaucccucucgcccccuacaaaaagagcuga

SEQ ID NO: 4249 - RNA, 4098 nt, Artificial Sequence
  Cas9 variant
auggugaagaaaaaguacgccaucggcauugacaucgggaccaacagcgucggaugguccguugugacagaugacuauaaagugcccucuaagaaaaugaaggucuucggcaauacggagaagagauacauuaaaaagaaccugcucgggacccugcuuuuugaugaaggaaauacagcugagaaccggcgccugaaaagaaccgcccggcgcagauauacacggcgcagaaaucggauccucuaccugcaggaaauuuucgcggaggaaaucaacaagaucgacgauagcuuuuuccaacgccuugacgauuccuuucugauuguggaggacaaacagggcucuaagcacccuaucuucgggacccuccaggaggaaaagaaauaucauaagcaguuuccgacaauuuaccaccugagaaaacaacuggcugauagcucccagaaggccgacauccggcucauuuaucuggcccuugcucauaucauuaaauaccgcggacacuuccuguuugagggcgaucucaagucugaaaauaaagacguucagcaucuguucaacgauuuuguggagauguucgacaagaccgucgagggcagcuaccuuuccgaaaaucugcccaacguggccgacguucucguggagaaggucagcaaaucuagacggcuggaaaauauccugcacuauuuuccuaacgagaagaaaaauggacucuucggaaacuuccuggcucuugcccugggccuccagcccaauuuuaagacgaacuucgaacuggcggaggaugccaaaauccaauuuuccaaggagaccuacgaagaggaccuugaggaacugcucgggaagauuggagaugacuaugcugaucuguucaucgccacaaaaagccuguacgacggcauucuccuggcugggauccuuucuaccacagauuccaccacgaaggccccucugucuagcuccauggugaaccgcuaugaggaacacaaaaaggaccucgcgcugcuuaaaaauuuuauucaucagaaccugagcgauuccuacaaggagguguucaaugacaagcucaaagauggauaugccggcuacaucgaaggcaagacaacccaggagaacuuuuacagauucaucaaaaaggcuauugagaaaaucgaagggucugacuauuuuauugacaagaucgaucgggaagacuuccugagaaagcagcgcacauuugauaauggaagcauuccccaccaaauccaucugcaggagaugcacgccaucauucggagacaggcugaguucuacccuuuucucgucgaaaaccaagacaaaaucgagaagauucugaccuuccgcaucccguauuacguuggcccccuugcccgggggaaauccgaauuugccuggcugaauagaaagagcgaugagaaaauucgcccuuggaacuucgacgagaugguggauaaggaaaccucugcugagaauuucaucacacggaugacgaacuaugaccaguaccuccccgaucagaaagugcugccuaagcacucccugcuuuaugaaaaguuugcggucuacaaugagcucaccaaagugaaguucauugccgaaggaaugagagacuaccaguuucuggauagcggccagaaaaaggacaucguuaaaacacuguucaagaccaagcgcaaagugacagcuaaggauaucaaagccuaucucgagaacucuaauggguacgccggagucgagcugaagggccuugaggaacaauuuaacgcuagccugcccaccuaucaugaccuccugaaaauucugcgggacaaggccuucaucgaugcggaagagaaucaggaaauucuugaggacaucgugcucacgcugacacuguuugaggauagagaaaugauucgcaagcggcucgagaaauacaaggacauccugaccgaggaacagagaaagaaacuugaacggcgccacuauaccggcugggggagacuguccgcuaaacucaucaacgggauucuggauaagguuacacggaagaccauccugggcuaccuuauugacgaugggacaucuaacagaaauuucaugcaacucaucaacgacgauacgcugagcuuuguggacgagauucgccuggcccagggauccggcgaggccgaagauuaucgggcugagguccagaaucucgccgggagcccggcuaucaaaaagggcauccugcagucucuuaaaauuguggacgaacugaucgaggucaugggauacgauccugagcauauugugguugaaauggccagagagaaccaauucaccaaucagggccgcagaaacucccagcagcgguacaagaaaaucgaaaaugcgauuaagaaccucgacagcaaucugaacucuaaaauccugaaggaguaucccacaaauaaccaagcccuucagaaugaccgccucuuucuguacuaucugcagaacgggaaggauauguacaccgacgaggaacucgauaucgaccaacugucccaguaugauauugaccacaucauuccucaggcuuucaucaaagaugacagccuugauaauaaggugcugacaaaauccgccaagaacagaggaaaaucugacgauguccccagccucgagauugugcauaagaagaaaaacuucuggaagcagcugcuggacucccaacuuaucucucagcggaaauuugacaaucugaccaaggcugaacgcggcgggcucacgaacgaggauaaagccagauucauucagcggcagcugguugaaacccgccaaaucacaaagcacguggcgagaauccucgacacccgguuuaauacaaagcuggaugaggccggaaaccgcauuagagaccccaaagucaauaucauuacccuuaagagcaaccuggugucccaguuccggaaagauuaccagcucuauaaggugagagaaaucaauaacuaccaccaugcucacgacgccuaccugaaugcuguugucgccacggcccugcuuaaaaaguauccucagcuggcuccggaguuuguguacggcgauuaucccaaguacaacagcuauaaaucucgcaaguccgcgacagagaaaguccucuucuacagcaauauuaugaacuuuuuccggagagugcugguguauucuaagaccggggaaguucgcauccggccugugaucgaggucaauaaagaaacaggcgagauugugugggacaagaaguccgauuuuagaaccguucgcaaagugcucagcuacccccaagucaacgugguuaagaaaguggaaaugcagaccggaggcuucucuaaggagagcauccugcagcauggggacuccgauaaacuuauuccucggaagacagagaaauuuuaccuggacacgaagaaguauggaggcuucgauagccccaccaucgccuacucuguccuccugauugcugacaucgaaaaagggaaggccaaaaagcugaaaagagugaaggagcuuaucggaauuacaaucauggaacgcauggccuucgagaagaauccgauugaguuucuggaacacaaaggcuauaagaacauccucgagaaaaacauuaucaagcugccuaaauacucccucuucgaacuggagaaugggcggagacggcuucuggcuagcgccaaggaacugcaaaagggcaacgagaugauucugcccccucaccucgugacccuucuguaucauuccucuaauauccacaaaaucacagagcccauucaucucaacuacgucaauaagaacaaacacgaauuuaaggagcugcuccgccauaucagcgacuucuccaccagauauauucuggcgcaggaucggcuuucuaaaaucgaggaacuguacgacaagaaugauggagacgauauuagcgaccugacguccucuuuuguuaaccuccugacauucaccgcuaucggcgccccugccgcuuuuaaguuccuugggagcgugaucgaucgcaaaagauacaccuccauugccgaaauccuggaggcgacacucauucaccagagcgugaccggacuguaugagacacggaucgaccucucuaagcugggcggggauuga

SEQ ID NO: 4250 - RNA, 4101 nt, Artificial Sequence
  Cas9 variant
augaagaaacccuacagcaucggccuggacauugggaccaacuccgugggaugggccgucaucacagaugacuauaagguuccugcuaaaaagaugaaagugcucggcaauacgaacaagaagaccauuaaaaagaaucugaucggggcccuucuguucgaugcgggaaacacagcugccgacagacggcucaaacgcaccgccagacggcgcuacacaagacggcgcaaucggauucuguaucuucaggagaucuuugcugccgaaaugaacaagcuggaugagucuuucuuucaccggcucgacgauagcuuccuggugccggaagacaaaggcggguccaaguaccccaucuuuggaacccuggaggaagagaaggaguaucauaaacaauucccuacaauuuaccaccuccgcaagucucuggcugauagcaaagaaaaggccgaccuuagacugaucuaucucgcgcuggcccauauuaucaaauaccggggccacuuucuuuacgaggauaccuucgacauuaagaauaacgauauccagaaaauuuuuaaugaguucacguccaucuauaacaauaucuuugaagagucuagccuguccaacgaaaaugcucaggucgaggaaauuuucaccgacaagaucagcaagucugccaaaaaggaccgcgugcucaaacuguuucccgaugagaaguccacaggccuguucagcgaguuccucaaacugauuguugggaacaaggcugacuuuaagaaacauuucgaucuugaagagauggccccucugcaguuuucuaaggacaccuacgaugaagaccucgagucccugcuuggacaaaucggcgaugacuaugcggaucuguucguggucgccaaaaagcucuacgacgcuauucugcuggccgggauccucagcgugaaagaucccgcuacaaaggccccucugucugccuccaugaucgaaagauaugacaaucaccagaacgaccuuagcgcucugaagcaguuuauucgguccaaccucccggagaaauacgcggaaguuuucucugaugacagcaaggauggauaugccggcuacaucgacgggaaaaccacgcaggagggauuuuacaaguauauuaaaaaucaaaucuccaaguucgagggcacaaaguacuuucuggaaaagauugagcgcgaagauuuccuuagaaagcagcggaccuuugacaacggcagcaucccccaccagauccaucugcaggagaugaaugcuauucuccaaaaccaagggggauauuacccuuuccugaaagccaauaaggaaagaaucgagcagauucugacauuucgcauccccuauuacgugggcccucucgcccgggggaacucugauuucgcuuggcugaccagaaauuccgacgaugccauucgccccuggaacuucgaggaagucguggacaaagcgagcucugcugaggauuuuaucaauaagaugaccaacuaugaccuuuaccugccggaagagaaagugcucccuaagcacagccugcuguacgagacauucgccgucuauaaugaacuuacgaagguuaaauuuauugccgaggcuaugaaggauuacgaguuccucgacuccggacaaaaacggaagaucguggaaaacaucuuuaaaaaucauagaaaggugaccgaaaaggacauuaucaacuaucugcacaaugucgauggcuacgacgggauugagaucaaaggaauugagaagcaguucaacgccucucugagcacauaucacgaucuccugaaaaucaucaaggacaaagaauuuauggauaaccccaagaauggcgagauucuugaauccaucauucauacccugacaaucuucgaggaccgcgaaaugauuaagcagcuccuggcucaguacaacagcguguuugaugagaaaguuaucaaggcccugucucggaaacacuauaccggcugggggaaacuuuccgcgaaacucaucaauggaauuagagacaagcaaacgggcaacagcauccuggauuaccugauggacgaugggaagucuaaucgcaacuucaugcagcucauuaaagacgauggacuguccuuuaaggagaucauugacaaagcccagguggucggcgaaacagacaaucuuagacaggugguucaaaaccugccugggagccccgcuaucaagaaaggcauccuccaguccauuaagcugguggaugagcuggucaaagugaugggaucugaccccgaaagcaucgucauugagauggccagagaaaaucagaccaccaacaagggcaaguccaaaucucagcaacgccuuaagacacucagcgaugcuaucuccgagcuggggagcaauauucugaaagagcauccuaccgacaacauccagcuccagaaugaucggcuguuccuuuacuaucugcagaacggaaaggacauguacacaggcgaagcccucgauauuaaucaacugucuaacuaugacaucgaucacaucauuccgcaggcguuuaucaaagacgauucccuggacaacagcgugcuuacgucuuccaaggacaauagaggaaagagcgauaacguucccucucucgagauuguggagaaaaugaagggguucuggcagcaacugcuggacagcaaacucaucuccgaacggaaguucaauaaccugaccaaagucgagcgcggcgggcuugaugaaagagacaaggugggcuuuauuaagcggcagcugguugagacaagacagaucaccaaacauguggcccagauccucgaugcucgcuucaaugccgaagucaacgagaagaaucaaaaacugcggagcgugaagauuaucacacugaaaucuaaccuuguguccaauuuuagaaaggaguucggacuguacaagguucgcgaaauuaacgacuaucaccacgcucaugaugccuaccucaaugccgucaucgcuaaagcgauucugaaggaguauccuaaacucgaacccgaguuuguguacggcgacuaccagaaguaugaucugaaaagauacaucagccggaccaaggacccuaaggaaaucgagaaagccacggaaaaguauuucuuuuacuccaaccuucugaauuucuuuaaagauaagguguauuacgcugacgggaccauuauccagcgcggaaacgucgaguauucuaaagauacaggcgagauugccuggaauaagaaaagagacuucgccaucgugcggaagguucucagcuacccccaggugaacauugucaagaaaaccgaggaacaaacagggggauuuuccaaggaaucuauccugccgaaaggcaacagcgacaagcugauuccucgcaaaaccaagaauauccagcuugauacgacaaaguacgggggcuucgacucccccgugaucgcuuauucuauucugcucguugccgauguggagaaaggaaagagcaaaaagcugaaaaccgucaagucccucaucggcauuacaaucauggaaaaggugaaauucgaggcgaacccuguugcuuuucuggaggggaagggauaccagaauguggucgaagagaacauuaucagacuucccaaauauagccuguucgaacucgagaauggccggcgcagaaugcuggccucuuccaaggagcugcagaaagggaacgaaauggugcuuccuagcuaccugcucgcccugcucuaucacgcuaagaagauccagaaaaaggacgagcccgaacaucuggaguacauuaaacagcaccacucugaauuuaaugaucuucugaacuucguguccgacuuuagccagaaguauguccuggccgagucuaaucucgagaaaaucaagaaccuguacauugauaaugaacaaaccaaccuugaggaaaucgcuaauuccuucauuaaccugcucaccuuuacagcguucggagccccggccguuuuuaaauucuuuggcaaggacaucgagcggaagcgcuacagcacggugaccgaaauccugaaagcuacacucauucaucaguccaucaccgggcuguaugagacaagaauugaucuuagcaagcugggcgaggaauga

SEQ ID NO: 4251 - RNA, 4101 nt, Artificial Sequence
  Cas9 variant
auggacaagaaauacaacaucggccuggauauugggaccagcuccaucggauucguggccacagacgaggauaaucacgucauuagagcuaagggcaaaaacguuaucggggugcggcucuuugacgaaggacagucugccgcggagcgcagaggcuuccggacgacccgcagacggcugaaucgcagaaaguggcggcuuaaccugcuccgcgaaauuuuugagccccauaucuauccuaucgaugcuagcuucuuuaugagacaaaaauacuccaaucugucuaagcaggacccgaaccagaagauugaguucaaagauauccuuuuuagcgacaaguccgaugccgaguucuaucggcaguaccccacaauuuaucaucugcgccaagcccucaugaccgagaaaagacaguuugaccugcgggaaaucuaccuggcuauucaccacaucgugaaguaucgcgggcauuuccucgaugagacaccuaccgacaaauuuucuuucgaucagcuggaccuuacacaggaauuugagagacugaauguccucuucagcgagcaaaaccccgaagaaccuuucgaaauugugguuaaucagaaccaguccaucgaggacauccugagcaaucagucuaugaccgccuccgaucggagaaagcaagcucuuguggucuuuuaccagcagagcgaaaacaaggagaaugagaaacaauacaaggccauugcgacggaaauccugaaccuccugcugggaaauaaagccaagcucaacgugauucuggcucaggagguugacaaagaagccgcuaaggauuggucucuuucccugagcucugagaccuucgacgaugaccucgaaaaagccuccagcggccugaacgauucccagcuugagauggugggcaucuuugagcgcauuuauucuagccugauccucaaguccaucauuggggaccacaauagccugucugcggccauggucgauaaguucaaaacacacgcucagcaucgggaccugcucaaggaugugaucaaaaacuccgacgccaccaagggagaacaacugcaguuugcuuacgaccacuaucuucagagacauagcgccgauggcaaagccuacgggaaggacgauuucuauaaggaggugaaaaagaaucuggacgauucugacgcugcgcagcaaauucagcagcucaucgauacagaccaguuuaugcccaaacaacgcaccaaggccaacggagcuauuccucaccagguccagcagaaagaacuggaucuuaucaucgagaaucaaugccaguacuauccguggcuggccgaagagaaccccaauagcgagcggcacaacguugccaaguacaagcucgacgaacugguguccuucagagugccuuacuaugucggcccccugauuucuccugcugaugacgagacggauccccaggccauccaaaauacaaaauuugcguggaugauucgcaaggacgcucaggggcggaucaccccguggaacuucgacgauaaaguggacagagaaaagagcgccgauaaauuuauuaagcgcaugacaaccaccgacacauaccucaucggagaggauguucugccugaccagucccuuauuuaucagcgguacaaggugcugaaugagcucaacaaugucagaaucaacggccgccccaucgaagugcaaauuaaacagaauaucuauacggaucuguucaagaaauuuaagagcguuucugugaaaaagcugcgguccuaccuugaggaaaugagcuauuacccuggcucuuucaaaauuuccgggcucaccaaccccggaaaguucgacaacggccugacaagcuaccuggauuauaagaauauccucggggacuccgucgaugccaacgacaaaagagcugauauugagcagaugaucgaauggucuaccaucuuugaggacaauaagauuuucgcccagaaacuggagagcaugacauggcuuaccgcugaacaacggaaggccaucucccgcaaaagauacacgggauggggccggcugucuaacaagcuccugacacagcugaagaaucaggacaacagaagcauuauggaucuucucugggagaccgaagagaauuuuaugaaaauccaguccgcgcccgacuucagcaagaugauugaagcccauaaccaacaguuuaucaaaaaugaggcuaacauccagcaagugauuucugaucuguauaccuccccucagaauaagaaagccauccgccagauucugcucgucguggacgauauccagaaggcuguugggcacgccccggagcauauugcgaucgaguucgccaagggagaggacaaaaacccccggagaacaaucagccgcgaaaugaagauucaagauguguaccagcagaucucugacgauauucuggucuccccugaggugagagcucagcuuaaugagaaaaucgaaaaccggcacggccgccugagcgacagacucuuucuguauuucaugcaaggcgggcgggauauguacaccggaaagcccauuaauaucaacaacauuucucauuaugacaucgaccacauccugccucaggccuuuauuaaagaugacagccuugauaaucgcguucucguguccgacaagcugaacagagaaaagagcgauacagucccccgggaccuguucggccgcgaaaugaugucuacgugggagaaaauggcugauagagggcucaucaccaagcggaaacuggccaaucuuaagacaauuccgggauccaucgacgcccacaaagcucagggcuuuauuaaccgccagcugguggaaaccagacaagugaucaagcucgcgguugggaucaugauugaucaguacccugagacacagaucgucagcgugaaagccaaucugacccaugagaugcgggaaauguucgaccuggugaagaacagagaugucaaugacuaccaccaugcuuuugaugccuaucuuacggccuucgugggcaacuaccuccugcagcgcuaucccaagcuggagccuuacuucguuuaugacaaauuuaagaaacucaaggaccaaaauauuuccaugcgggauuucaaccugcuuuacgaccugaaaaagaaugaagauguguaugaccagagaaccggacacucugcucacaagaucugggaucagcauggcagcauugacuacauccgccaccucuuugccuacaaaaagauccuggucucccaugaggugcaccaaaacgggggagcgcuguauaauaugacaguuuacggcaaagcugaugacgccaagcggaaacuuauucccaucaaggccgauaagccuaccgaacuguaugggggauacacaucuagaaaacucgcuuauauggccauugugaagaccaaaaagggcaaaaaggagcaguaccaggucacgggggugcccguuagcgcgcugacaacccuccgccaguucaaggaggacuccccggaacaaaaacaggcucuggaggaaaucgugcggagaaacuuugaugagaagacagaagucgagauuaucgugccuaaagugcuuuucaaucagcugauugucgacgagaagugucgcuuuaugguuggcucugauaccuaucgguacaacgcccagcaacucgugcugagcgccgacgaccuggaaaucaucaacgcuucccauaaagauauucagaccaucgacagcucugauuacucccagcagcuugaccaaguguaucagaauauucugacaaucgucgauaagcacuuccccauguacgacauuaacaaguuuagaacgaaacuccacgauaucuaugagcaguacaucgaacugcccaaugaggacgugugggaaaacaauaagcucaccacacugggaaaacauaccauuaucauucggauccuucaaggccugcacgccaacgcuacaguuguggaucucaagcagcuggggauuaaaaccccuuucggauuuaugcagcaggcccgcggcaucgucgugagcccggacgcgcaacugaucuaucagucucccacggggcuuuacgagagacggguucgccugggagaucucuga

SEQ ID NO: 4252 - RNA, 4101 nt, Artificial Sequence
  Cas9 variant
augggcgacagaaaguacaaccuggggcucgauaucggaaccagcuccauuggcuucgccgcuguggacgagaauaaccagcccauccgggucaaagggaagacagccauuggaguucgccuguuugaagagggcaaaacggcggcugauagacggggguuccgcaccacaagacggcgccuuucuagacggcgcuggagaaucaaucugcucaacggaauuuuugacgcccaccuggccgaaguggauccuaccuuccuugcucggcugaaggagagcaaucgcuccaaccucgacccgaaaaagucuuuucaaggcagccugcuguuccccgaaagaaaggauuaucaguuuuacaaagaguauccuacaaucuaccaucuccggaaggcccugauggaggaagaccgcaaauucgauaucagagagauuuaucuugcugugcaccauaucauuaaguaccggggcaauuuucugaacgggacccccaugagauccuucaaagucgaaaauaucgagcucgacacacuguuugaucgccuuaaccagcuguaugaggaaauuaucccugacaaugagcucgccuucgaucuggaacagguggcggacguuaaggaggugcugucuagcaccacgauuuacaagauggacaaaaagaaacaacucgucaagaugaugcugcuucccaccuccaacaaagcccugcagagcgaaaauaagaaaaucgugacacaguuuguuaacgcuauccucaauuacaaguucaagcuggaugugcuucugcaggucgagaccgacgccgauuggucucucaaacugaacgacgagggagcugaugacaagcuggaagaguucacaggcgaucucgacgaaaaccggcuggagauuaucgaucuucugcaaagacuccacaauugguuuucccugaacgaaauuaccaaagacgggaauagccuuucugccgcgaugguggagaaguauaaagaucaucgccaccaccuggagcuccugaagaaggugaucgaagaccauccugacgccaaaaaggcuaaagcccugaaggagacguacacagcuuaugucggaaaaaccgaugacaagacacagaaccaggaugacuucuacaaggccguugaaaagaaucucgaugacuccccggaugccaaggagauuaaacggcugauccagcuugaccaauuuaugcccaagcagagaaccggccagaacggggcuaucccucaccaacugcaucagcaggaacucgaucagauuaucgagaaacaaagcaaguauuaccccuuccuggcggagccuaaucccaacgugaagcgccggaaagacgccccguauaagcuggaugaacuuauugcuuuuaaaaucccuuacuacgugggaccccucgucaccccugaggaacaggcccagaauggcgagaacguguucgccuggaugaagagaaaaguugcuggccccauuacacccuggaauuuugacaagaaaguggaucgcauggagucugccaaccgguucaucagacgcaugacgaccaaggacacauaucuguuuggggaagacguccugccugcggaguccaugaucuacgaaaaguucgugguucucaaugagcugaacaaucuuaaaauuaacggacggcaccugagccucaaggauaaacaggacaucuauaacgaucuguuuaagcaacagaaaaccguguccauuaaggcucugcagaauuacuaugucacaaagaaaaaggccgccaccgcuccgacggugggcgggcuugccgaccccaaaaaguuccucucuagccuguccacauacaucgauuuuaaaaacauguucggagaacaggucaaugacccucaauuccaggaggaucuggagcagauuguggaauggagcaccaucuuugaggacagaggcauuuucaaggcuaagcuccaggcccugggguggcuuucugaaaaacaaauccagcagcugguugcgaagcgguauaaaggauggggccgccucuccaagaaacugcugaccggccuuaagaacgccgagggguacagcauccucgaugaaauguggagaucuacagagaauuuuaugcaaauucagagccggcccgaguucgcugcccugauccagcaggcuaacgaaaagcaauuugagggaaaugacccuaacaaugugugggaaaacauugagaauauccugggcgaugccuacaccucuccccagaacaaaaaggcgauuagacaggucgugaaaguugugcaggacaucgaaaaggccgucgggaauccgccugagaaaaucgcuauugaguucacacgcgaagccgcugccaacccccaacggacgcaguccagacuccgcacccuggagaaacuuuaugaaagcgccgaggaggugguggaugcuagacugacagcggaacucgccgaguuuaaagaaaauaagcacguucuguccgacaaguacuaucuguacuucacccagcuuggacgggacgucuauacaggcgauaccaucagccucgaccgccugaacgauuacgacguggaucauauucugccucagucuuuuaucaaagacgauucccucgacaacagagugcugacgauucgggcugucaauaacggcaagagcgauaaugugcccgccaaaauguucggcaagaaaaugggaucuuuuuggcgcuaucuucuggacaacggcaugaucuccaagagaaaguacaauaaccucaucaccgauccugacaauauuagcaaauacgcccaaaagggguucaucaaccggcagcugguugagacaucccaggugauuaaacugaccgcuaauauccuuaacggaauuuaugacaaggauacagaaaucaucgagguccccgccaaaaugaacucucaaaugcgcaagauguuugaccuggugaagguuagagaggugaaugauuaccaccaugcguucgacgcuuaucucaccauuuucaucggcaauuaccuguauaaaugcuacccgaagcuccggccuuauuuugucuacgggaaauucaagaaauuuagcgauaacgaagacauugaggugggagauggccgcuucaauuuucugaacagaaucgaacggcuuaagaacguuacggaccccgagacaggggaaauucugugguccaauguggcccccaacgagaccaucaagagaauuaaaaaggucuacaauuauaaauucaugaucgugucucgcgagaucacaacccggagagccgaacucuuuaaccagaccguguacccuaagaauuaucgcggcaaacugauuccgaucaaggaggaucggcccacagaccuguacggaggcuauagcgggaacacggaugcuuaccuugccauugucgcgcuggaagacaagaaaaagggaaaauauuucaagguugugggcaucccuaccagagcugccgccaaacucgagaagcugaaacagcaggauucccaacaguaccuccaggcugugcacgaagucauugcuccccaguuuacaaagagcaccaagaaagggaucaagaaaacagaguuccgcaucgugcuggacaagguucauuaccggcaacuugugcaggacggaccugucaaaaugaugcuggggucuuccaccuauaaguacaaugccaagcagcucgugcugagcgagaaagcccugcagguuauuaaggaugacagaaaauuugaugaaacgcaaaaggacgauaaccuuaucgcgguguaugacgagauucugucuaucgucaaucaguccuucgaucucuacgacauuaacggguuccgcaaaaagcugaaugauaaccggaaucaguuuaucgaccuccccgccgaaacaaaguaugagggcagaaaagugguugcucacggaaagcgggagaugauccuggaaauucuuaaaggccugcacgccaacgcuagcuucgggaaucugaagccuaucggauuugccacccccuucggccagaugcaaucuaaaaacgggauugagcucagcgaaaaugccuuucugauccaucaguccccgagcggacuuuucgagcacaagauuaagcugucugaucucuga

SEQ ID NO: 4253 - RNA, 4101 nt, Artificial Sequence
  Cas9 variant
augaccaagcugggcaaacccuacgggaucggaguggacauuggcagcaacuccaucggguucgccgcugucgaugaaaauucucaccucauuagacugaagggaaaaacaguuaucggcgcccggcuuuuugaagaggggaaggcggcugccuaucgcagagccagccggacgacccgcagacggcugucccgcaacagauggcggcucucuuuccugcgcgacuuuuucgaaagccauauuacaccuaccgauccgaacuuuuucaugagacagaaauacuccgagaucucucccaaggacaaggcucgguauaaauacgaaaagcgccuuuuuaaugauagaacagacgccgaguucuaucaacaguacccuaccauguaucaucugcggacacgccuccugaccgaucccagcaaagcugacgugagagagaucuacuuugccauucaccacauccugaagucccggggacauuuccucacgccuggcuacgcgaaagauuuuaauaccaacaagguggcccugaaugaaauuuuccccgcccuucaggacgcuuaugcucaggucuacccugaucuggacaucacauuugaugagaacaaggugaaugaguucaaaaccguucuccugaacgagaaggccacaccgagcgacacccaaagagcgcuugugaaucugcuccuggccaaagagggcgaccgcgauauucugaagcagcagaaacagguccucacggaguucgcuaaggccgugguugggcugaaaacaaaacuuaacguggcucugggaaccgaagucgacucuuccgaagccacagccuggaauuuuagccucggccaacuggaugacaagugggcugggaucgagucugcgaugaccgaugaaggaaccgagauucuugaccagauccgggaucuguauagagcccgccuccugaacggcaucgugcccgcugggaaaacacugucccaggccaagguggacgauuacgcccagcaccacgaggaccucgaacuguucaaagauuaucuuaagcaacuggaggacgacggaacggcuaaagccauucggcagcucuacgauagauauaucgacggcgaugacgcgaagccuuuuguccgcgaagauuucguuaaggcucugaccaaagaggugacagcccaucccaaugccaagagcccugaacuucuggagcggcucgcucagcccgacuuuaugcugaaacaaagaaacaaggccaacggcgcuauuccggugcagaugcagcagcgcgagcuggaucaaaucauuaaaaaucaggccgucuacuacgacuggcucgcggccccuaaccccguggaaaagcaccggcagucuaugaccuaucagcuggaugagcuucugaauuucagaaucccuuacuauguugggccccucgugacagcuaaggaacaaaaagccgcucagggaggcgucuuugccuggauggugcgcaaggaccccgaugggaacaucaccccuuacaauuucgacgagaaaguugaucgggaagcguccgccaacacguuuauucagagaaugaagacaaccgacaccuaucugaucggagaggacgugcugccgaaacagagccuucucuaccaauccuaugagguccugaaugaacugaacaaugugcgggucaacgauaauaagcucucuuucgaccagaagcaacaggugcugggcgagcuuuuugaacgccauaacacaguuaccauuaaacaguucguggauaaucugcucgcucacggggacuacgauagaauccccgagguccggggacuggccgacgagaagagauuucugagcucccuuagcacauacaaccagcucaaaggcauucugcacgaagcuaucgaugacgccgauaagcagacggacaucgagaauauuaucgccuggucuaccauuuucgaagauaaagcuaucuucaagacaaaacugaacgagauuuccuggcucaacgcgggcaugaucaauagccuggccaacauucgcuaucggggguggggacaauuuucucauaaacuucugaaugaacucacccugagcacaggcagaaccguguucgaggagcugcuuaucuccucucgcaaccucaugcagauccugacggacgaaguucugaagcagaagauugcugagcucaaugcccacgaacugaaggccagcgggaucuacgcugccauugaugacgcguauaccuccccuagcaacaaaaaggcucuuagacaggugcugucugucaucgacgauauuacaaaugccgccggacaagcucccaacuggcucuacaucgagaccgccgacggcgauggggugccuggcaaacggacaaauucccgccagagaaagauccaggaaauuuaugcgaacgcugcccaggagcugaucaccggaagcgugcggggcgaguuugaagacaagauugccucucgcgcugauuucacggacagacugguucuuuacuuuaugcaagggggacgggauaucuauacaggcgagccccucaauauugacaaccuguccagcuacgauaucgaccauauccugccgcagucccucauuaaagauaauucucuggacaaccgcguccuugugcacccucuggugaauagagaaaaggacaccaucuucgccagcacacgguuugcuaaacagaugaacgggauguggcgccaguggcaugccgcgggacucauuuccucuagaaagcugcggaaccugcaaaugagacccgaugagaucgacaaauacgccagcggcuucgucgcucgccagcuuguggaaacccggcagauuaucaagcugaccgagcaaaucguugccgaucaguauccugacacaaagauuaucgcugugaaagccgggcucuccagccagcugagaaaggagcucgauuuucccaaaaaucgcgaagucaaccacuaccaccaugccuucgacgcuuuucuggcggcccggauuggcacguaucuucugaagagauacccuaaucucgagcccuucuuuaccuauggaaaauucaagaagacagaagugaaaaagcugaaaucucugaagucccuuaagagcuucaacuuuauccgcgauaugacccacgcuaaggacaaaauuguugccaaggagacaggcgagaucgugugggauaaugccucugacauuaacgaacuggaucggaucuacaauuucaagagaaugcucaucacccaugagguccgcuuugaaacggcuucccuguucaaacagacacucuaugccgcgaagaacagcaaaaauagagggggaucucggcaacugauuccgaagaaaaagggcuaccuuguggacaucuacgggggauauacccaggagaccggcagcuaccuguccguugugcggcucacaaagaaagcuauguaugccgucgugaaggugagcacccgcgaugccgcuaaacuggccgucgcgaagucuauuuccgaacagaaagagaacgagacacugaagaagaucauugacgggaaacuuagcaagacguccaaaaagggcaaaaccacacaccagcuguuugaaaucguucucccuagagugggacaaaagacccuguucaaaaauucuaaguacaaccaguuucucgugaauagcgacacauauaugcacaacuaccaggagcuguggaugccccgggaauaucagcgcauguggaaggauauccuucuguccaaucauggcgacgcucaaauugaggggcagcuggaucagaucuucaaauuuauugucucucaggugaacagcuacuucaaccucuacgacaucaaucaauuuagaaagaaaauugccgaugccaccgacaaguucgcuaagcugcccacgcacgauaccgacaacgcccggggaaaaaucgcuacaaucggccagcuucugauugggcuccaggccaaugcgaugagauccgaucugcgcaaccucgacaucaagaccccuuucggacugcuucaaauuggcacagggaucacccuggaucuggacacaucuauuaucuaucagagcccgaccggccucuuugaacgggagguuccccugacggaucuuuga

SEQ ID NO: 4254 - RNA, 4101 nt, Artificial Sequence
  Cas9 variant
augaccaaggacuacagccugggccucgauaucgggacaggauccgugggcuucgccgcucuggacacgaacuauagacuucugcgggccaaagggaauaacgucauuggaguucgccucuuuacccccgcggagacagcugaagagagacggggcuuccgcaccgccagacggcgccugucuagacggcgcuggagacuuggggcccugaauggaaucuuugcuccugaacucgccaagguggauccgaacuuccugcaccggcugaaauacgcuugggugcaucccgccgaccagcaaaauaagggcaaauauagcgcggccccucucuuuaacgaugcugcccuggaccgccaguuccacgaugacuaccccacaauuuaucaucuuagacugaagcucaugaccgauacaucccagcacgaccugcgggaggucuaccuugcuauccaucacauuaucaaguuucgcggcaauuuccugagaggggaaggaccuaucaacgccucugaggcguuugauauuaauaccuucaucgaccagaugacggccuuuuaugaucaggcuuuccccgacuuuaaaauuguggaccaaguugaucagcagaucauuuucaagggccucaccgacaugacacugagcccugccgaucgggcuaacaaagcccugaugggguucaauaacgccgcucaacagccgaauaagagaaucuuuaaagcgauucucuccggacuggugggcaaccaggucgaccuuauggccaucuuccagcuggaugggauccccaaggaggaccaaaaggaauuuaaauucaaguuuguggauaaugacauugaggaaaaacucgcugcccugggagauaacccugcccuuucugacgagcagaacgaguuccugaccacacucuacgcugccuuuagcggccugacccugaagggccuccugggggaugcgacguccaucagcgcugccaugguugcccgcuacgcuucucaccggacagacuggaccuauauuaaagaccaugugcuuacaccccagaauaacagagaacugcgccucgccuacgcugaucugaugaccgacaaugaggauguccggcuuaaggccggaaagaaguucgcgaaggccaucgaagcugccgacauuccugcugccaaaaaguccgaguuuagccugaaaaucgauaacaaugaguuccuccccagacaacgcaccaaggcgaacggcacaaucccgcaccagcugcaucugaaugagcuccagcagauuaucgagaaccaagggcaguauuacccuuuucugaaagccacguucgaacaggacggacacacccuuaauaagauugagggccuggugaaguuucgggugcccuauuacgucgggccucucguucccaaacacaagguggcuggaaacaaugccaaccauuggauggugcccaaagaaccuggcgcuaucacaccguggaauuauaccgagaaggucgauagagacaaaucuggcaacgaguucauucgccggaugacagggaccgauacguaccugcugggagaacccacacuuccuaaaaauucccucguguaccaggaguucaacguucugcaagaacugaacaaucucagaaucgagaagcgccggcuggacaucgccgugaaacaggauauuuuugaacacgucuucaagaccaacaaaaccgugacaguuaagagaaucgaggaauaucuuaccacagaguuuggcagccccgugacgcugucuggguucgccaaugucaacgagcggaaacucaauuccagccuguccaccuaccauuauuuugugggaauuuucggcgcugaauuugucgacgauccuaagaaccugacacuucucgagcagaucguggaacugcagaccguuuucgaggaccgcaaggcgcugcaaagacagcucaaacugcggcccgagcuuucugaaaaacaggugaagcagcuggccagaacacacuacaccggguggggccgccucagccaaaagcugcugacguccaaaauuguccauguggcucuugagggagaacgggagccgggccaguauagcauccucgaaacccuguacgggacacagaugaauuuuauggagauuguuaacgacaugaaggauagauauggagugaaaucuuggcuggaccaagaaaauuccggcagcgaaaacaaucucucucugaagcagcgcauccuugauaugccugggcccaagaacaucaaaagaggaauuaaucaggccuuccacaucauugacgagaucacccgggccgucggcaacgcuccuagccgcauuuacaucgaauuugccagagagucccagcaaucuaaucugacaaacgcgcgggugaaccgccucaagcagcuguacagcaaucaggcucugaaaaaggaguucgccaaacuugccuccgaaaucaaggaucucaccaaggagcagcugaaagacgauagacuguaucucuacuaucugcaacaggggaaggacauguacacggaaacagauauugacaucaccaaaauuagcucuaacuaucagaucgaucacauuaucccccaggcuuacacaaagaauaacucccuugacaaucgggugcugguuaacagcgagaugaaugcccgcaaaucugauuccccuaccuuucuccccagccugauccaagaaagaaaggcgugguggcggcagcugcgcgacaccggccuuauguccacaauuaaguauaacaaucugacgagaaccucugacgauuucagcgcugaccagaaagagcgguucaucgccagaucccucgucgaaacacgccaagugauuaagaacguggccacccugaucaaagaguacuacgaugacucucaggucgaggcucucccgagcgaaauuacagccgagaugcggagauaucugaaugugcgcaagaaccgggauaucaaugacuaccaucacgcucaugaugcccuucuguuugcgaccgccggagaguucuccagaaaaguuggcaucauggaaaaggggcgcgugagcgacggagcuggcaacauuuauaaucgguacacgaaggauaucauucagagagcccgcgcuaaagccgggcaggacaagaaaguccggccuuuuacauucaucgugggaucuauggccaaccccgauaccaaguuucaaaccaaccagacaaccggcgagauuguuuggacacccgaagacguggcuuaucucagaaaagucaucgacuacaagaaaaugcuggugacgaagaugacccuggaucagacagggacccuuuauaaugagacacgguacggcuccggagacaagcacguugcgguggcccugagcaaagauaaggcugccgaccucuacggcggguucggaucucugaaaccugccuaugcugcccucgucuacuccaagaaaaaguuucgccuggugaacgugcuuagacuguggcucccggaaauuaagaaaaaugcgagcguccuggagcggaagguucagucugugcugggcgaugacaacgcuaaagugauccgcgcccacguccccugcgggcaacuucugaucaaggauggagcccucgugaccguuagcuccgcuacggaacugcauaauuucagacagcucuggcugccuaaagccgacuaucaggauauuagcauccuucugggcgcgcccgacaaggugaccgcugagaaccggcugcaggccgagucucacuuugaugacgucgaucaaagauucgaaucccuccugaaggacgugauugaccaggcccgccaguacuauccucuuaaaacacaucagaccagccuggagaagcucaucgggaaaauuggcaaguuugaugaacugaaauucgcucaaaagcagcagguuuucucccggcuccugucugcccuucacgcuaaugccacaaacagcgaccugaagcaaaucggacuguccaccgcguggggcagacucaucuaccccaaaggggugucucugacagaugaggacaaacuuauuaauagcuccuuuaccggacuguucaacgaugucaugucuaucaaggaauuucaugacuucagcauuaauuga

SEQ ID NO: 4255 - RNA, 4104 nt, Artificial Sequence
  Cas9 variant
augaagaaacagaaguucagcgacuacuaucugggcuuugauaucgggaccaacuccgugggauggugcauuacagaccucgauuacaauguccugagauucaacaaaaaggacauguggggcucucggcuuuuugaggaagccaaaacggcugccgagcgcagaguucaacggaauagccgcagacggcugaagcgcagaaaguggcggcucaaccugcuugaagagaucuucuccaaugaaauucugaaaaucgauucuaacuuuuuccgcagacucaaggagagcucccuguggcuggaggacaaaucuagcaaggaaaaauuuacccucuucaaugaugacaacuauaaggauuacgacuuuuauaagcaguaccccacaauuuuccaucugcggaaugagcuuaucaaaaacccugaaaagaaagauauccgccugguguaucucgcgauucacuccaucuuuaagagcagagggcacuuccuguuugagggacagaaucuuaaagagauuaagaacuucgaaacccuguacaauaaccucaucgcuuuccuggaggacaauggcauuaacaaaaucauugauaagaacaauaucgaaaagcuggagaaaaucgugugugacucuaagaaagggcucaaggacaaagaaaaggaguuuaaggagauuuucaacuccgauaaacagcuggucgccaucuuuaagcugagcgugggaucuuccguuagccugaaugaccucuucgauacagacgaauacaaaaagggcgagguggaaaaagagaagauuucuuuucgggaacaaaucuaugaggaugacaagccgauuuacuauuccauccugggcgagaaaaucgaacuucuggauauugccaagagcuucuacgacuuuaugguccucaacaauauccuggcugauucccaguauauuucugaggccaaagugaagcuguacgaggagcauaaaaaggaccucaagaaccugaaauauaucauucgcaaguacaauaaagggaacuacgauaaacuuuucaaagacaagaaugaaaacaauuauagcgcuuacaucggacugaacaaagagaagggcaagaaagagguuguggaaaaguccagacucaaaaucgacgaucugauuaaggucaucaaaggguaucuucccaagccugagcggauugaagagaaggacaaaaccguguuuaaugagauccugagcaagauugaacucaaaacaauccugcccaagcagagaauuucugauaacggaacccugccuuaccagauccacgagguggaacucgagaaaauccuggaaaaucaauccaaguauuacgacuuccuuaacuaugaggagaacggcgucagcacgaaggauaaacugcucaagaccuuuaaauuccgcauucccuacuacguugggccucuuaauucuuaucauaaggacaaaggaggcaacagcuggaucgugcggaaggaagagggcaagauucugccguggaauuuugaacagaaaguggauaucgagaaguccgccgaagaguucauuaaaagaaugacaaacaagugcaccuaccuuaauggggaggacgucauccccaaagauacauuccucuauucugaauacgugauccugaacgagcugaauaagguucaggugaacgacgaauuucucaaugaggaaaacaaacgcaagauuaucgaugagcuguucaaggagaauaaaaaggucagcgaaaagaaguuuaaagaguaucuucuggugaagcagauuguugacggaaccaucgaacucaagggcgugaaagauuccuucaacagcaauuacauuucuuauauccgguuuaaggacaucuucggggagaaacugaaccuggacauuuacaaggagaucuccgaaaagagcauucuuuggaagugucucuacggagaugacaagaaaaucuuugagaagaaaauuaagaaugaauauggcgauauccugacgaaagacgagaucaagaagauuaacacauucaaauuuaacaauugggggagacugucugaaaagcuccugaccggaaucgaguucauuaaccuugagacaggcgaaugcuacuccagcgucauggaugcgcugcgccggaccaauuauaaccucauggagcugcuguccucuaaauuuacccuucaagaaagcaucaauaacgagaauaaggaaaugaacgaggccuccuacagagaccucauugaggaaucuuaugugagcccuucccugaaacgcgcuaucuuccagacacugaagauuuacgaggaaauccggaagaucacgggcagaguccccaaaaagguguuuauugagauggcccgcgggggagaugaaagcaugaaaaauaagaaaaucccugcucggcaggagcaacucaagaaacuguaugacucuuguggcaacgauauugccaauuucuccaucgacauuaaggagaugaagaacagccuuaucucuuacgauaauaacucccugagacagaaaaagcucuaccuguauuaccugcaguucgggaaaugcauguauaccggacgggaaaucgaccuugaucgccuccugcagaauaacgacacauacgacauugaucacaucuaucccagaagcaagguuauuaaagacgauucuuuugacaaccuggugcucguccugaagaaugagaacgcggaaaagagcaaugaguacccggugaaaaaggagauccaagagaaaaugaaguccuucuggcgguuucuuaaagagaagaacuucauuagcgaugaaaaguauaaaagacugaccggcaaggacgauuuugagcuccgcggguucauggcccggcagcugguuaaugugagacagacaaccaaagaagucggcaagauccugcagcaaaucgagccugagauuaaaaucguguacucuaaggcugaaauugccuccagcuuucgcgagauguucgacuuuaucaaggugagagaacuuaacgauacgcaccaugcuaaagacgccuaccugaauauuguugccggaaacgucuauaauacaaaguucaccgagaaacccuaccgguaucuccaggaaaucaaggagaacuacgaugugaaaaagauuuauaauuacgacaucaaaaacgcuugggacaaggaaaauucccuggaaaucgugaagaaaaacauggagaagaauaccgucaacauuacacgcuuuaucaaagaagagaagggccaacucuucgaucugaauccuauuaaaaagggggaaaccucuaacgagaucauuagcaucaagcccaaaguguauaacggaaaggacgauaaacuuaaugagaaguacggcuacuauaaaucccugaaccccgcguacuuccucuauguugaacacaaggagaagaauaaaagaaucaagucuuuugaacgggugaaccuggucgacgugaauaacauuaaagaugaaaagagccugguuaaauaccuuaucgagaauaagaagcugguggaaccucgcgucauuaaaaagguguauaaaagacagguuauccucauuaaccauuacccguauuccaucgugacacuggacucuaauaagcucauggauuucgagaaccugaaaccccuuuuucuggaaaauaaguacgagaaaauccucaagaacgucauuaaguuccuggaagacaaucaggggaaaagcgaggagaacuacaaguuuaucuaucugaaaaagaaagaucgguacgaaaagaaugagacgcuugaauccgugaaggaccgcuauaaccuggaguucaacgaaauguacgauaaauuucucgagaagcuggacagcaaagauuauaagaauuacaugaacaauaaaaaguaucaggagcuccuggacgugaaggaaaaauucauuaaacuuaaccuguuugacaaagccuucacccugaagucuuuucucgaucuguucaauagaaaaacaauggcugacuuuuccaaggucggacuuaccaaguaccugggcaaaauccagaagauuagcucuaacguucucuccaaaaaugagcuguaccuccuggaagagagcgugacagggcuuuucgugaagaaaaucaagcuguga

SEQ ID NO: 4256 - RNA, 4104 nt, Artificial Sequence
  Cas9 variant
augaagaaacagaaguucagcgacuacuaucugggcuuugauaucgggaccaacuccgugggauggugcgucacagaccucgauuacaauguucugagauucaacaaaaaggacauguggggcucucggcuuuuugaugaggccaaaacggcugccgaacgcagagugcaacggaauagccgcagacggcugaagcgcagaaaguggcggcucaaccugcuugaggaaauuuucuccgacgagaucaugaaaauugauucuaacuuuuuccgcagacugaaggaaagcucccucuggcuggaggacaaaaauucuaaggagaaauuuacccuguucaaugaugacaacuauaaggauuacgacuuuuauaagcaguaccccacaaucuuccaccuccgggaugaacugauuaaaaauccugagaagaaagacauccgccuuaucuaucuggcgcuccauagcauuuuuaaguccagagggcacuuccuguuugaaggacagaaccuuaaagagaucaagaauuucgagacccuguacaacaaucucauuagcuuccuggaagacaacggcaucaauaaaucuauugauaaggacaacaucaagaaacuggagaagauuaucugugauuccgggaaaggacucaaggacaaagaaaaggaguuuaaggaaaucuucaacagcgauaaacagcugguggcuauuuuuaaacuuucugucggcuccagcgugucucugaaugaccucuucgauacagacgaguacaaaaaggaggaaguugagaaagaaaagaucuccuuucgggagcaaauuuaugaagaugacaagccgaucuacuauagcauucugggcgagaaaaucgagcuucuggauaucgccaaguccuucuacgacuuuauggugcucaacaauauucugucugacagcaacuauaucuccgaagccaaagucaagcuguacgaggaacauaaaaaggaucucaagaaucugaaauauauuauccgcaaguacaacaaagagaauuacgacaaacuuuucaaggauaagaacgaaaauaacuaucccgcuuacauugggcugaauaaagagaagggaaagaaagaggugguugaaaagagcggccucaaaaucgacgaucugaucaaggugauuaaaggguaucuuccuaagcccgagagaaucgaagagaaggacaaaaccauuuuuaacgagauccugaauaagauugaacucaaaacaauccugccuaagcagcggauuucugauaacggaacccugcccuaccagauccacgaggucgaacucgagaaaauccuggaaaaucaguccaaguauuacgacuuccuuaacuaugaggagaacggcgugagcacgaaggauaaacugcucaagaccuuuaaauuccggauuccuuacuacguggggccgcuuaauucuuaucauaaggacaaaggaggcaacagcuggaucguccgcaaggaagagggcaagauucugcccuggaauuuugaacaaaaaguugauaucgagaaguccgccgaagaguucauuaaacggaugacaaacaagugcaccuaccuuaauggggaggacgugaucccuaaagauucuuuccucuauagcgaauacaucauucugaacgagcugaauaaggugcaggucaacgacgaauuucucaaugaggaaaacaaaagaaagaucauugacgagcuguucaaggagaauaaaaagguguccgagaaaaaguuuaaagaguaucuucugguuaaccagaucgcuaaucgcacaguggaacucaagggaauuaaggauagcuucaacucuaauuacgucuccuauaucaaauuuaaggacaucuucggcgagaaacugaaccuggauauuuacaaggagaucagcgaaaaaucuauucuuuggaagugucucuacggggacgauaagaaaaucuuugagaagaaaauuaagaacgaauauggagacauccugaauaaagaugagaucaagaagauuaacuccuucaaauuuaauaccuggggccggcugagcgaaaagcuccugacggggaucgaguucauuaaccuugagacaggagaaugcuacuccucugugauggaggcccugagacgcaccaauuauaaccucauggaacugcugagcuccaaauuuacacuucaggagucuaucgacaauggcaacaaggaaaugaaugagguuagcuaccgggaucucauugaggaauccuaugugagccccucucugaaaagagcgauccugcaaacccucaagauuuacgaggaaaucaagaaaaucaccggccgcgucccuaagaaaguguucauugagauggccagagggggagacgaaacaaugaagaacaaaaagauccccgcuagacaggagcagcugaaaaagcuguaugauuccuguggcaaugacauugccaacuuuagcaucgauauuaagaaaaugaagucuucccugagcucuuacgacaauaacagccuccgccaaaagaagcuguaccuguauuaccuucaguucgggaaaugcauguauacgggacgggagaucgaccucgauagacugcugcagaauaacgacaccuacgauaucgaccacauuuauccgcgguccaaggucaucaaggaugacagcuucgauaaccucgugcugguucuuaaaaaugaaaacgcugagaagucuaaugaauacccugugaaaaaggagauucaggagaaaaugaaguccuuuuggcgcuuccugaaggagaaaaacuuuaucagcgacgagaaguauaaaagacucacaggcaaggaugacuucgaacugcggggguuuauggccagacaacuggucaaugugcgccagaccacaaaagagguuggcaagauucuucagcagaucgaacccgagaucaagauuguguacuccaaagcggagaucgccucuagcuuccgggaaauguuugauuucauuaaggucagagagcugaacgacacccaccaugcuaaagacgccuaccucaauaucguggcuggaaacguguauaauacgaaguuuacagaaaaaccuuaccgcuaucugcaagagauuaaggaaaacuacgauguuaaaaagaucuauaauuacgacauuaagaacgccugggauaaagaaaauucccucgagaucgucaagaaaaacaugaagaaaaauaccgugaacaucaccagauucauuaaggaagagaagggccagcuguuugaccuuaaucccaucaaaaagggggaaacaucuaacgagauuaucagcauuaaacccaagcuguauaacggaaaagaagagaagcucaaugagaaguacggcuacuauaaaucccugaacccugccuacuuccuguauguggaacacaaggagaaaaauaagcggaucaaaucuuucgaacgcgucaaccuuguggauguuaauaacaucaaggacgaaaagagccuggugaaauaccucauugagaauaagaaacuggucgaaccgagacucaucaagaaaguguauaagcggcagguuauucugaucaacgauuaccccuauuccauuguggcucuugacagcaauaaacugauggauuuugagaaccucaagccucuguuccuggaaaauaaguacgagaaaauccuuaagaacgucaucaaauuucuggaagacaaucaggggaagucugaggagaacuacaaauucauuuaucucaagaagaaagaucgcuacgaaaagaaugagacccuggaauccgugaaagacagauauaaccucgaguuuaacgaaauguacgauaaguuccuggagaaacuugacagcaaggacuauaagaauuacaucaacaauaaaaaguauaaaaaccugcuggauguuaaggagaaauuuauuaagcucaaucuguucgacaaggcguuuacacuuaaaucuuuccuggaucucuuuaaccggaagacgauggccgacuucuccaaagugggacugaccaaguaccucggcaaaauccaaaagauuagcucuaauguccuguccaagaacgaacuuuaccugcuggaggaaagcgugacagggcucuuugugaaaaagaucaaacuguga

SEQ ID NO: 4257 - RNA, 4104 nt, Artificial Sequence
  Cas9 variant
augaagaaacagcaauucagcgacuacuaucugggcuuugauaucgggaccaacuccgugggauggugcgucacagacuucaauuacaacguucucagauuuaauaagaaagauauguggggcucucggcuguucgacgaggccaagacggcugccgaacgcagagugcagcggaacagccgcagacggcuuaaacgcagaaaguggcggcugaaucuccuggaggaaauuuuuagcgaugagauccuuaagauugacucuaacuucuuucgcagacugaaagaaagcucccucuggcuggaggauaagucuagcaaagagaaguucacccuguuuaaugacgauaacuauaaagacuacgauuucuauaagcaguaccccacaaucuuucaccuccggaaugaacugauuaagaacccugagaaaaaggacauccgccuuguguaucuggcgcuccacuccaucuucaaaagcagagggcacuuucuguucgaaggacagaaucuuaaggauauuaaaaacuucgagacccuguacaauaaccucauggcuuuucuggaggacaaugacaucuacaagaacauugauucuuccuauaucggcaaccuggaaaauauuaucugugacagcaaaaaggggcucaaggauaaagagaaggaguucaaagagauuuuuaacucugacaagcaacuggucggauucuuuaaacuuuccgugggcagcucuguuucccugaaugaucucuucgacacagaugaauacaagaagggcgagguggagaaagaaaagaucagcuuucgggagcagaucuaugaagacgauaaaccgauuuacuauuccauccugggggagaagauugaguuccuugacaucgccaaaucuuuuuacgauuucaugguccugaacaauauucucgccgacagccaguauaucuccgaagcuaaggugaagcuguacgacgagcauaaacgcgaucugaagaaccucaaauacaucauuagaaaguauaauaaagaaaacuacgacaagcuguuuaaggauaaaaaugagagcaacuauucugccuacaucggacuuaauaaggaaaaaggcaagaaagagguuauugaaaagucccggcugaaaaucgacgauuucgcuaagauuaucaagggguaucuccccaaagccgagaagaucgacgagaaagauagaagcauuuuuaacgaaauccuggacaagauugagcuuaaaaccauccugccuaagcagcgcauuucugauaauggaacacuccccuaccaaauccacgaagcggagcuggagaagauucuggaaaaccaggccaaauauuacgacuuccucaaucaugaggaaaacggcaucagcaccaaggauaaacugcuuaugacguucaaguuucggaucccuuacuauguggggccccugaacuccuaccacaaaaauaagggaggcaacucuuggauugucagaaaggaggaaggcaaaauccucccuuggaauuucgagcagaagguggacauugagaaaagcgcugaagaguuuaucaagcgcaugaccaacaaaugcacauaucugaauggggaagaugugauuccgaaggacuccuuccuguacagcgaguauaucauccuuaacgaacucaauaagguccagguuaacgacgaguuucugaauaaagagauuaagaaaaagaucauugaagaucuguucaaaaagucuaaaaagaucuccgagaagaacuuucgggaauaccuccuggugaaucaaauuaccaacaaaacaguggagcuuaagggagucaaagacgccuucaauagcaacuaugugucuuacaucaaguuuaaagauaucuucggcgacaagcugaaucucgauauuuacaaggaaaucuccgagaaaagcauucuguggaagugucuguauggggacgauaaaaagaucuuugagaaaaagauuaaguccguuuacggagacauccuuaccaaagaugaaaucaagaaaauuaacucuuucaaguuuaacacguggggcagacucagcgagaaacugcugacagaaaucgaguucauugaccucgagaccggggaaugcuauuccucugugauggaugcucugcgccggacaaauuacaaccuuauggagcugcucagcuccaaguucacccugcaggaaaauaucgacaacgagaauaaggaagucagcgaguuuucuuauagagaucugguggaggaauccuacguuagccccucucuuaaacgcgccauucuccagacccugaagaucuaugaggaaauucggaaaaucacaggaagaaucccuaagaaaguguucauugagauggcgcgcggcggcgacgaaacgaugaagaacaagaaaauccccgcccggcaagagcagcugaagaaacucuacgacuccugugggaaggauauuagcaauuuuucuaucgacauuaaagagaugaagaacagccuuaauuccuacgauaacaauagccugagacagaaaaagcuguaucucuacuaucugcaguucggaaagugcauguacaccggcaaagaaaucgaccugaaccggcuucuccaaaauaacgauacauaugacaucgaucacauuuacccucgcucuaaggucaucaaagacgauuccuuugacaaucuggugcugguccucaagaacgagaacgcugaaaaauccaaugaguauccccugaagaaggaaauucaggagaaaaugaaguccuucuggaaauuucuuaaggagaaaaacuucaucucugaugaaaaguacaagagacugaccgggaaagacgaguuugaacuccggggauucauggccagacagcuggugaauguucgccagacaaccaaggaggcuggcaaaauucugcaacagaucgagccggaaaucaagauuguguacagcaaagccgagaucgccuccucuuuucgggaaauguucgacuucauuaaggucagagagcuuaacgauacgcaucacgcuaaggacgcguaucugaauaucguggccgggaacguuuacaauacaaaauuuaccgaaaagccuuaucgcuaccuccaggagauuaaagagaacuaugaugugaagaaaaucuacaauuaugacauuaagaacgcuugggauaaagaaaagagccuggagaucgucaagaaaaauauggaaaagaacaccgugaauaucacaagauucauuaaagaggaaaagggccagcucuuugaccugaaccccauccggaaaggagagaccuccaaugagauuaucgccauuaagccuaaguucuacgaaggcucuacagagaaacuuaacgaaaaguacggguauuacaaaagccugaaucccgccuauuuuaucuacguggagcauaaggagaaaaacaagaucauucgcuccuucgaaagaguuaaccucgucgaugugaauaagaucaaagacgaaaagagccugauuaaauaucugaucgaaaacaagggacuuauugagcccaaagugaucaagaaggucuacaaacggcaagugauccugauuaauaacuuuccuuauucuaucguugcucucgauuccaauaagcugauggacuucgaaaaccucaaaccgcuguuucuugagcgcaaguacgagaaaauucugaagaaugccaucaaauuccucgaagauaaccagggcaagacggaggaauacuauaaguuucuguaccugaaaaagaaagacagaaaugagaagaacgaaaccauugauagcgugaaagagcgguauaauaucgaguucaacgaaauguacgacaaguuucuugagaagcuggacucuaaagauuauaagaauuacauuaacaauaaaaaguauuccgaacucgucaacgugaaagagaaguucaucaagcugaaccucuucgacaaagcguuuacacuuaagagcuuccuggaucuguuuaaucgcaaaaccauggcugacuucucuaagguugggcugacaaaauaccucggaaagauccagaagauuuccagcaacgugcuguccaaaaaugaacuucaucugcucgaggagagcgucaccggccuguuugugaagaaaaucaagcucuga

SEQ ID NO: 4258 - RNA, 4104 nt, Artificial Sequence
  Cas9 variant
augaaggacuacuaucugggccucgauauggggagcuccucugugggaugggcccugagcgacgagagauacaaccuucugcgggcuaaaggcaaggaucucuggggaguccgccuguucgacgaagccaaaaccgcggcugagagacggacauuucgcucccagagacggcgccuugaaagaucuaaguggcggcugagccuccugacgucccuguucgaggaagagaucucuaaaauugaugacaaguuuuucgaucgccucaaggacagcaaauuuuucaucgaugacaaguccgaucaacagcccaauacccuguuuaacgacguuaauuucacagauaaagaguaucacaagagauacccuagcauuuaucaucuucggaacgcccuguuuaaucagaacgacaaauucgacauccgccucauuuuucuggcccuuucucacaucgugaagaagagagggcauuuccuguuugauggcgacaaagcuggguucggagaagauaucgacgugauucucgaugagcugaaggccuaccugcaggacgcuuuccacaccaaacucgaauuuacauccgaguucaagagcaucaugcuggauaaaaaucuucggaagaaacaaaaggaggaagaacugaagaacucuauuaaaaucuccagcgacaccauuaauucuaaggauggcaaauccauccucauuaagcuguuucuuggcuaugaagccaaccugaaaccguucuuucucgaguacaaggucgaaaaggacaaugaguacaaaaucaacuucagcaaggaggauuaugaagagaaacugcuggacaugacauccaaguuugaagagaccacguacuucaucgaaauugcgaaaaagauccaugacuauuuucuccuggaggagauuaugcuuggguucaagaauaucucugccagcaaaguguccauuuaccagaagcacaaaaacgaucugaagacccucaaaaauaucguuaagaaccagaucaacaauagcuauaacgcuauuuuuaaggacaucggacuggauaauuaccccgccuaugugucuugcuggaacuccaaaaagcacaaagaaaagcagaaaggcuguacaaaggacaaauucuacgcuuuucuuaagaccaagcugaaaaauauuaacaaugccaaggagauccucgauagcauugacaacgaugacuuccugccucgccuggucgauaaaaauucuaucaucccccaucaaauucaccucgcggaacugaucaagauuaucgacaaccagagccaguacuauccuuuccuuaaagagauuaaggauaagaucauuuccaucuuuaaauucagaauccccuuuuacguggggccucugaauaacuuccauaaggacaaaggaggcaaugccuggauugaaaagcucaaagaugagcggaucuuuccguggaacuucaaugacguuguggaccugaacaagucugcugccaacuuuauugagaagaugaucaaugaaugcagcuaucugaaaggggagaagguccuugcuaaaaacucccuccuguacacaaaguauagcgugcugaaucucauuaacaaacugaagaucaauggaaccgccgugucugucgaaacgaagcagaaaaucuacaacgagcuucugcucaagcaaaagaauauuaagaaaacagccaucaagaaauuccugauuaacaauuccaucauugauaagaacgacgagaucagcggcaucgaugacucucugaccuccaaucuugcuguuuuuauugauuucgaaaagaucagcaacagacuccgcuaugaccagaaagaggauauuaucaaguccauuucucuguuuggcuacgacaaugcgaugcugaaaaagcagaucaucacaauugcccccgaucucagcgaagacgagcuggaaaaacuuuccaagcugcgguacucuggguucggaagacucagcaagcgccugcugaccuccaucaaacacaacggcaagagcauuaucgagaugcuuugggauaccaaugacaaccucauggagcugcugucugaucgguauacauuuauugaacaaaucaacaaacacaaugacggguucaaggaggacauuaaccucaauuuccagaacguggauacgcuguacguguccccuagcgucaaaagacagaucuggcaggcuuuuaaggugaucaaugaacuuauuucuguuaugggacgcgagcccaagaaaaucuucguggaaauggcccgggaggagggcgaaaagaaaagaacccaagcccgcaaggacaaaguccuggagcucuauaaguccauuaagaacaaugaaaucagcacauuucugaccaacuucaaagauauuaagacaaaacuggagggggaaucuaaucuuaacagcaagaaacucuaccuguauuaccugcagcucggaguggacaucuauaccggcgagaagaucccuuuugagaagcuguucgaucagaauauuuacgacaucgaucauguuauuccccggucccuuaaaaaggacgauagcuuugacaaccuggugcucacgucuaaaacaaauaacgcuaagaaaaccgaugaguucccggucuccagcgagauccaguccaagaugcaaaccuuuuggaaagugcugaaggacaaggaccugaugucugaaauuaaauacacaaaucuuaccagaaagacacaccugagcgaugacgagcucggcgauuucaucgcccgccagcuggucgagacgcggcaguccaccaaagcgcucacacagauccugaagaacguguaugcuaacucugacauuguuuacgugaaagccgggaucgucagcgaauuuagacaacaguucgauaugcuuaagauucgggagcugaaugacuuccaucacgccaacgaugcuuaucucaauaucgugauuggaaacguuuacaauaucaaguuuaccaaaaacccucgcaauuaugugaaggaauacuauaaaaagggcgagcauuacaaccugaaaauugaaaagaugcuggagaaggacaucgccagagggggaaauuucggcugggauaaaaagcacuccaucgagacaguccagaaaaccaugaagaaacagucuccccuuauuacguaccggaccuuugaaaacaagggggaguucuuuaaucaacagccuagcaaggcuuccgccaaccugcucgcgcugaaaagcucugacaagagacuccuggauacagugcgcuauggcggauacaaaggcacccaguaugcccacauguuccuuguggaacauuuuaaugggaagaucauuaaagagaucaugggaguucccauuuaccuguccaaggaaaucaaagacgauaaggcuaagcuccuggaguauuguaacgacguccugaaacuuaagaaucccaaaauccuguucagcaagauuccuuacaacucucucaucguguauaauggcuacccgauucugcuccgggggcugacaggagugagaggcgccgcucaacuuaaacuggaccagaccuccacgcaggucgugaagaacaucguuaagcuguacgauuggcucagccagaaacaaaaggagcugucugaccuuuccaaaaagauugaauuuuuccaggagaacaauaaaaaggaugaagugaaggccgcgaugcuggaggccgacaacauccucuuuauccugaaugaucgcuucaaaaacacaaagauugggaaagacaucaugaaugauaaccaccucaauaaccuguaugacaccuuuauuaauaaacuugaaaacagcaucuacaaaaauaagcccggcggaaagcaggauguccugaugaaagagaagagagaccuguuccucuccuucagcaugucuaaaaagugcauuacacuguauaaaaucauuaagaucuuuggcagcugugaucaggggguggacuucuccgauaucgcugagaaaauuucuaagagcggaggcaucgggggaaagaaccuuggcaaaaauaccuuugaccugguuuucaaggaaaacuccaccuacacacucgugcaaucuagcgucacggggcuguaugccaaaaagaccgaccuccauaaacuguga

SEQ ID NO: 4259 - RNA, 4104 nt, Artificial Sequence
  Cas9 variant
augaagaaacagaaguucagcgacuacuaucugggcuuugauaucgggaccaacuccgugggauggugcgucacagaccucgauuacaauguucugagauucaacaaaaaggacauguggggcucucggcuuuuugaggaagccaaaacggcugccgagcgcagagugcaacggaauagccgcagacggcugaagcgcagaaaguggcggcucaaccugcuugaagagauuuucuccaaugaaauccugaaaauugauucuaacuuuuuccgcagacucaaggagagcucccuguggcuggaggacaaaucuagcaaggaaaaauuuacccucuucaaugaugacaacuauaaggauuacgacuuuuauaagcaguaccccacaaucuuccaucugcggaaugagcuuauuaaaaacccugaaaagaaagauauccgccugguguaucucgcgauccacuccauuuuuaagagcagagggcacuuccuguuugagggacagaaucuuaaagagaucaagaacuucgaaacccuguacaauaaccucauugcuuuccuggaggacaauggcaucaacaaaauuaucgauaagaacaauauugaaaagcuggagaaaaucgucugugacucuaagaaagggcucaaggacaaagaaaaggaguuuaaggagaucuucaacuccgauaaacagcugguggccauuuuuaaacuuagcguuggaucuuccgugagccugaaugaccucuucgauacagacgaauacaaaaagggcgaggucgaaaaagagaagaucucuuuucgggaacaaauuuaugaggaugacaagccgaucuacuauuccauucugggcgagaaaaucgaacuucuggauaucgccaagaccuucuacgacuuuauggugcucaacaauauucuggcugauagccaguauaucuccgaggccaaaguuaagcuguacgaggagcauaaaaaggaccucaagaaccugaaauauauuauccgcaaguacaauaaagggaacuacgauaaacuuuucaaagacaagaaugaaaacaauuauucugcuuacauuggacugaacaaagaaaagagcaagaaagaggugaucgaaaaguccagacucaaaaucgacgaucugauuaagaauaucaaaggcuaucuucccaaggucgaggaaauugaggagaaggacaaagccaucuuuaacaagauucugaauaaaaucgaacucaagacaauucugccuaaacagcggaucagcgauaacgggacccugcccuaccagauccacgaggcggaacucgagaagauucuggaaaaccaaucuaaguauuacgacuuccuuaauuaugaggagaacggaaucauuacgaaagauaagcugcucaugaccuuuaaauucagaaucccuuacuacgugggcccccuuaauuccuaucauaaggacaaagggggaaacagcuggauugugcgcaaggaagagggcaagauccugccuuggaauuuugaacagaaagucgauaucgagaagucugccgaagaguucauuaaacggaugacaaacaagugcaccuaccugaauggcgaggacguuaucccgaaagauacauuccucuauagcgaauacgugauucugaacgagcugaauaaggugcaggucaacgacgaauuucucaaugaggaaaacaaaagaaagaucauugaugagcuguucaaggagaauaaaaagguguccgaaaagaaguuuaaagaguaucuucugguuaagcagaucguggacgggaccaucgaacucaagggagucaaagauucuuucaacagcaauuacauuuccuauauccgcuuuaaggacauuuucggcgagaaacugaaccuggacaucuacaaggagauuagcgaaaaaucuauccuuuggaagugucucuacggggaugacaagaaaaucuuugagaagaaaauuaagaacgaauauggagauauccugacgaaagacgagauuaagaagaucaauacauucaaauuuaacaauuggggccggcuguccgaaaagcuccugaccgggauugaguucaucaaccuugagacaggagaaugcuacagcucugugauggaugcucugagacgcaccaauuauaaccucauggagcugcuguccagcaaauuuacccuucaagaauccauuaauaacgagaauaaggaaaugaacgaggccucuuaccgggaccucaucgaggaaagcuauguuucccccucucugaaaagagcuaucuuccagacacugaagauuuacgaggaaauccgcaagauuacgggccgggugccuaaaaaggucuuuaucgagauggccagaggcggggaugaaagcaugaaaaauaagaaaauucccgcgcgccaggagcaacucaagaaacuguaugacuccuguggaaacgauaucgccaauuucagcaucgacauuaaggagaugaagaacucucuuaucuccuacgauaauaacagccugcggcagaaaaagcucuaccuguauuaccugcaguucggcaaaugcauguauaccgggagagaaauugaccuugaucggcuccugcagaacaaugacacauacgacaucgaucacauuuauccucgcucuaaggugaucaaagacgauuccuuugacaaccugguccucgugcugaagaaugagaacgcugaaaagagcaaugaguaccccguuaaaaaggagauccaagaaaagaugaagucuuucuggagauuucuuaaagagaagaacuucauuagcgaugaaaaguauaaacggcugaccggaaaggacgauuuugagcucagaggcuucauggcccgccagcuggugaauguccggcagacaaccaaagaaguggggaagauccugcagcaaauugagccggagaucaaaauuguuuacuccaaggcugaaaucgccagcucuuuuagagagauguucgacuuuauuaaggugcgcgaacuuaacgauacgcaccaugccaaagacgcuuaccugaauaucgucgcgggcaacguguauaauacaaaguucaccgagaaaccuuacagauaucuccaggaaaucaaggagaacuacgaugugaaaaagauuuauaauuacgacaucaaaaacgccugggacaaggaaaauucccuggaaauuguuaagaaaaacauggagaagaauaccgucaacaucacacgguuuauuaaagaaaagaaaggacaacucuucgaucugaaccccaucaagaagggcgagaccagcaaugaaaucauuuccaucaaaccuaagguguauaacgggaaagacgauaaacuuaaugagaaauacggauacuauaagucucugaaccccgcuuacuuccucuauguggagcacaaggagaaaaauaagcgcauuaagagcuuugagagagucaaccugguggacguuaauaacaucaaggaugaaaaaucccuggugaaguaccuuauugagaauaagaaacuggucgagccccgggugaucaagaaaguuuauaagcgccaggugauccucauuaacgacuacccuuauucuaucgucacacuggauagcaauaaacucauggacuucgaaaaccugaagccgcuuuuucuggagaauaaauacgaaaagauucucaagaacgugaucaaauuccuggaggauaaucagggcaaguccgaagagaacuacaaauuuauuuaucugaagaaaaaggacagauacgagaagaacgaaacgcuugagucuguuaaagaucgguauaaucuggaguucaacgaaauguacgacaaguuucucgaaaaacuggauagcaaggacuauaaaaauuacaugaacaauaagaaguaucaggagcuccuggacgugaaagagaaguucaucaaacuuaaccuguuugauaaggccuucacccugaaauccuuucucgaccuguucaaucgcaagacaauggccgauuuuagcaaggucgggcuuaccaaauaccugggaaagauucagaaaaucucuuccaacgugcucagcaagaaugaacuguaccuccuggaggaaucugugacaggccuuuucgucaaaaagaucaagcuguga

SEQ ID NO: 4260 - RNA, 4104 nt, Artificial Sequence
  Cas9 variant
augaagaaacagaaguucagcgacuacuaucugggcuuugauaucgggaccaacuccgugggauggugcgucacagacaugaauuacaacguucucagauucaauaaaaaggauauguggggcucucggcuguuugaggaagccaaaacggcugccgagcgcagagugcaacggaacagccgcagacggcuuaagcgcagaaaguggcggcugaaucuccuggaagagauuuucuccaacgaaauccuuaaaauugacucuaacuuuuuccgcagacugaaggagagcucccucuggcuggaggauaaaucuagcaaggaaaaauuuacccuguucaaugacgauaauuauaaggacuacgauuuuuauaagcaguaccccacaaucuuccaccuccggaacgagcugauuaaaaauccugaaaagaaagacauccgccuuguguaucuggcgauccauuccauuuuuaagagcagagggcacuuccucuuugagggacagaaccugaaagagaucaagaauuucgaaacccuuuacaacaaucugauugcuuuccucgaggauaacggcaucaacaaaucuauugacaaggauaaucuggaaaagcuggagaaaaucgucugugacuccgggaagggacucaaagacaaggaaaaagaguuuaaggagauuuucaacagcgauaagcagcugguggccaucuuuaaacuuucuguuggccuguccgugagccucaaugaccuguucgauacagacgaauacaagaaaggcgaggucgaaaaggagaaaaucucuuuucgggaacaaauuuaugaggaugacaagccgaucuacuauuccauucuuggggagaagaucgaacugcucgauauugccaagagcuucuacgacuuuauggugcugaacaauauccuggcugauucccaguauaucucugaggccaagguuaaacucuacgaggagcauaagcgcgaccugaaaaaccuuaaguauauuaucagaaaguacaaucgggaaaacuacgauaaacuguucaaggacaaaaaugagagcaacuaucccgcuuacauuggacucaauaaggagaaauccaagaaagaagugaucgaaaagagcaagcugaaaauugacgaucuuaucaagucuaucaaaggcuaucugccuaaggucgaagagauugaggaaaaagacaaggccaucuuuaacgagauucucaauaagaucgaacugaaaauuauccugcccaagcagagaauuuccgauaacgggacccucccuuaccagauccacgaggcggaacuggagaaaauccuugagaaucaaagcaaguauuacgacuuccugaacuaugaagagaacggaauuaucacaaaagauaagcuccugaugaccuuuaaguuccgcauucccuacuacgugggcccucuuaauucuuaucauaaagacaaagggggaaacagcuggaucgugcggaaagaagagggcaagauucugccguggaauuuugaacagaaagucgauaucgagaaguccgccgaggaguucaucaagagaaugacgaacaaaugcaccuaccucaauggcgaggacguuauucccaaggauucuuuccuguauagcgaauacaucauucugaacgagcucaauaaaguccaggugaacgacgaauuucugaaugaggagaacaagcgcaaaaucauugaggaacuuuucaaggggaauaaaaagguguccgaaaagaaauuuaaggaguaucugcucgugaaccagaucacaaccggaacaaucgagcugaaaggcauuaaggauagcuucaauucuaacuacaucuccuauauuaaauuuaaggacaucuucggggaaaagcugaaucuugauauuuacaaagagaucagcgaaaagucuauccucuggaaaugucuguacggagacgacaagaaaauuuuugagaagaagaucaaaaacgaauauggcgauauucugaccaaggacgagaucaaaaagauuaacacguucaaauuuaauaacugggggcggcucuccgagaagcugcuuacaggaaucgaguucauuaaucuggaaaccggcgaaugcuacagcuccguuauggaggcucucagacgcacaaacuauaaucugauggaacugcuuucuagcaaguuuacccuccaagagaacaucgauaaugagaacaaagacaucucccaguucucuuaccgggaucugguggaagagagcuaugucuccccuagccugaagagagccauucuccagacccugaaaaucuacgaagagauuaagaaaaucacaggccgcgugcccaagaagguuuuuauugaaauggcuagagggggagacgagucuaugaaaaauaagaaaaucccugcccggcaagagcagcuuaagaaacuguaugauuccuguggcaacgacaucgcgaauuucagcauugauaucaaggaaaugaaaucuucccucagccuguacgacaacaauucucugcgccagaagaaacuuuaccucuauuaccugcaguucgggaaaugcauguauacgggacgggagauugaucuggacagacuccugcaaaacaaugauaccuacgacaucgaccacauuuauccccggagcaaggugaucaaagaugacuccuuugauaaccuuguccuggugcucaagaacgaaaaugccgagaaaagcaacgaguacccggucaagaaggaaauccaggagaaaaugaagucuuucuggcgcuuucugaaagaaaagaauuucauuuccgacgagaaauauaagagacugacaggcaaggaugacuuugaacuucggggguucauggcuagacagcuggugaacguucgccagaccacaaaagaggugggcaagauccuccaacagauugagccugaaaucaaaauugucuacagcaaggccgagaucgcuuccucuuuucgggaaauguucgauuuuauuaaagugagagagcugaaugacacccaccaugccaaggaugccuaccucaacaucguugcuggaaauguguauaacacgaaguucacagaaaaacccuaccgcuaucugcaggagaucaaggagaauuacgacgucaaaaagauuuauagcuacgauaucaaaaacgcgugggacaaggaaaauucccuugagauugugaaaaagaacauggaaaagaauaccgugaacaucaccagauuuauuaaagaggaaaagggccagcuguucgaccucaauccuaucaaaaagggggagacaucuaacgagaucauuagcaucaaacccaagguuuauaauggaaaggaugacaaacugaacgaaaaguacggcuacuauaaaucccugaaccccgccuacuuccuuuaugucgagcacaaggaaaagaauaagcggauuaagucuuuugagcgcgugaaccugguggaugucaauaacaucaaagacgaaaagagccucauuaaauaccugguggaaaauaagaaacucguugagccuagagugaucaagaaggucuauaaacggcaagugauccugauuaacgauuacccguauuccaucguugcucuugacagcaauaagcugauggauuucgaaaaccucaaaccccuguuucuggagcgcaaguacgagaaaauucuuaagaaugugaucaaauuccuggaagacaaccaggggaagucugaggaaaauuacaaguuuauuuaucucaaaaagaaagauagauacgagaagaacgaaacccuggaguccguccgggaacgcuauaauaucgaguucaacgagauguacgacaaauuucucgaaaagcugaauagcaaggauuauaaaaacuacauuaacaauaagaaauaucaggaccuucuggaugugaaggagaaauucaucaagcugaaccucuuugacaaggccuucacacugaaaucuuuucuugaccuguucaauagaaagacgauggccgauuuuuccaaaguuggacucaccaaguaccugggcaaaauccagaagauuagcucuaacgugcucuccaagaaugaacuguaccuucuggaggaaagcgucacagggcuguucgugaaaaagaucgagcucuga

SEQ ID NO: 4261 - RNA, 4104 nt, Artificial Sequence
  Cas9 variant
auggugaagaaaaaguacgccaucggcauugacaucgggaccaacagcgucggaugguccguugugacagaugacuauaaagugcccucuaagaaaaugaaggucuucggcaauacggagaagagauacauuaaaaagaaccugcucgggacccugcuuuuugaugaaggaaauacagcugagaaccggcgccugaaaagaaccgcccggcgcagauauacacggcgcagaaaucggauccucuaccugcaggaaauuuucgcggaggaaaucaacaagaucgacgauagcuuuuuccaacgccuugacgauuccuuucugauuguggaggacaaacagggcucuaagcacccuaucuucgggacccuccaggaggaaaaggaguaucauaaacaguuuccgacaauuuaccaccugagaaagcaacuggcugauagcucccagaaagccgacauccggcucauuuaucuggcccuugcucauaucauuaaguaccgcggacacuuccuguuugaaggcgaucucaaaucugagaauaaggacguucagcaucuguucaacgauuuuguggagauguucgacaaaaccgucgaaggcagcuaccuuuccgagaaucugcccaacguggccgacguucucguggaaaaggucagcaagucuagacggcuggagaauauccugcacuauuuuccuaacgagaaaaagaaugggcuuuucggaaacuuccugacgcuugcucugggccuccagcccaauuuuaaaaccaacuucgaacuggccgaggaugcgaagauccaauuuuccaaagaaacauacgaggaagaccuugaggaacugcucgggaagauuggagaugacuaugccgaucuguucaucgcuaccaagagccuguacgacggcauucuccuggccgggauccuuucuacaaccgauuccacgacaaaagcuccucugucuagcuccauggugaaccgcuaugaggagcaccagaaggaccucgcccugcuuaaaaauuuuauucaucagaaccugagcgauuccuacaaggaaguguucaaugacaaacucaaggauggauaugcgggcuacaucgagggcaagaccacacaggaaaacuuuuacagauucaucaaaaaggccauugagaaaaucgaagggucuaauuauuuuauugacaagaucgaccgggaggauuuccugagaaaacaacgcaccuuugacaacggaagcauuccccaccagauccaucugcaggagaugcacgcuaucauucggagacaagccgaauuuuacccuuuucucgucgagaaucaggauaagaucgaaaagauucugaccuuccgcaucccguauuacguuggcccccuugcucgggggaaauccgaguucgccuggcugaacagaaagagcgacgagaaaauucgcccuuggaauuuugaugaaaugguggacaaggagacaucugccgaaaacuucaucacgcggaugaccaauuaugaucaguaccuccccgaccagaaagugcugccuaagcacucccugcuuuaugagaaauuugcugucuacaacgaacucacaaaggugagauacguuaccgagcaaggaaagagcuucuuuuucgaugcgaauaugaaacaggagauuuuugacggcguguucaaggucuaucgcaaagugacaaaggaaaaacugauggauuuucuggggaaggaguucgacgaauuucggaucguugaucuccugggacuugacaaggacaacaaaucuuucaaugccagccugggcaccuaccaugaucucaagaaaaucguguccaaggaccugcuggauaaccccgagaacgaagacauucuugagaaugucgugcucacgcugacacuguuugaggauagagaaaugauccgcaaacggcucgagaaguauaaggacguccugaccgaggaacagcggaaaaagcucgaacggcgccacuacaccggcugggggagacugucugcuaaacucauuaacggaauccgggauaaggugacaagaaaaaccauucuggacuaucugaucgaugacggcacaagcaaucgcaacuucaugcagcuuaucaaugaugacacgcucuccuucguugaugagauucggcuggcccaagggagcggagaggccgaagacuacagagcugaggugcagaaccuggccggcucuccggcgaucaagaaggggauucuccagucccugaaaaucgucgacgaacuuauugaggugaugggcuaugauccugagcauaucguuguggaaauggcucgcgagaaucaguuuaccaaccaaggaagacggaauagccagcagcgcuacaagaaaaucgaaaacgccauuaagaaucuggacucuaaccucaauuccaaaauccugaaggaguaccccacaaacaaucaggcccugcaaaacgauagacuuuuccucuauuaccugcagaacggcaaagacauguauaccgaugaggaacuggacauugaucagcucagccaauacgacaucgaucacauuaucccucaggcuuuuaucaaggacgauucccuggacaauaagguccuuacaaaaucugccaagaaccgggggaaaagcgacgaugugcccucccuggagauugugcauaagaaaaagaauuucuggaagcagcuccuggacucucagcugaucagccaacgcaaauuugauaaccuuaccaaggcugaaagaggaggccugacgaaugaggacaaagcccgguucauucagcgccagcucguugaaaccagacagaucacaaagcacgucgcgcggauucuggauacccgcuuuaacacaaaacucgacgaggccgggaauagaauccgggaucccaaggugaacauuaucacccugaaguccaaucuugugagccaauucagaaaagacuaucagcuguacaagguccgcgaaaucaacaauuaucaccaugcucacgaugccuaccucaacgcugugguugccacggcgcugcugaaaaaguacccucagcuugccccggaguuuguguauggagacuaccccaaauauaauucuuacaaguccagaaagagcgcuacagagaaaguccuguucuauucuaacauuaugaauuucuucagacgcgugcucguuuacuccaagaccggcgaagugcggaucagaccugucauugaggugaacaaagaaacaggggagaucguuugggauaagaaaagcgacuuccgcaccgugcggaagguccugucuuauccccaggugaacguggucaagaaaguugaaaugcaaaccggcggauuuagcaaggaguccauucuccagcauggcgauagcgacaaacugaucccuagaaagacagagaaauucuaccuugacacgaagaaauacgggggauuugauucucccaccaucgccuauuccgugcugcucauugcugacaucgaaaagggcaaggccaaaaagcugaaacgcgugaaggagcugauugggaucacaauuauggaacggauggccuucgagaaaaauccgaucgaguuucuugaacacaagggauacaagaacauccuggagaaaaauauuaucaagcucccuaaauauagccuguucgaacucgagaacggcagacggcgccugcuugcuuccgcgaaggaacugcagaaagggaaugagaugauucugcccccucaccucgucacccugcuuuaccauucuagcaacauccacaagauuacagagcccauccaucugaauuaugugaacaagaauaaacacgaauuuaaggagcuccugagacauauuuccgauuucucuacccgguacauccucgcccaagaccgccugagcaaaaucgaggaacuuuaugauaagaacgacggcgaugacauuuccgaucugacgucuagcuuuguuaaucugcucacauucaccgcuaucggagccccugccgcuuuuaaauuccugggcuccgugauugacagaaagcgguacaccagcaucgccgaaauucuugaggcgacacugauccaccagucugucaccgggcucuacgagacaagaaucgaucuguccaagcucggaggcgacuga

SEQ ID NO: 4262 - RNA, 4104 nt, Artificial Sequence
  Cas9 variant
auggugaagaaaaaguacgccaucggcauugacaucgggaccaacagcgucggaugguccguugugacagaugacuauaaagugcccucuaagaaaaugaaggucuucggcaauacggagaagagauacauuaaaaagaaccugcucgggacccugcuuuuugaugaaggaaauacagcugagaaccggcgccugaaaagaaccgcccggcgcagauauacacggcgcagaaaucggauccucuaccugcaggaaauuuucgcggaggaaaucaacaagaucgacgauagcuuuuuccaacgccuugacgauuccuuucugauuguggaggacaaacagggcucuaagcacccuaucuucgggacccuccaggaggaaaaggaguaucauaaacaguuuccgacaauuuaccaccugagaaagcaacuggcugauagcucccagaaagccgacauccggcucauuuaucuggcccuugcucauaucauuaaguaccgcggacacuuccuguuugaaggcgaucucaaaucugagaauaaggacguucagcaucuguucaacgauuuuguggagauguucgacaaaaccgucgaaggcagcuaccuuuccgagaaucugcccaacguggccgacguucucguggaaaaggucagcaagucuagacggcuggagaauauccugcacuauuuuccuaacgagaaaaagaaugggcuuuucggaaacuuccuggcucuugcccugggccuccagcccaauuuuaaaacgaacuucgaacuggcggaggaugccaagauccaauuuuccaaagaaaccuacgaggaagaccuugaggaacugcucgggaagauuggagaugacuaugcugaucuguucaucgccacaaagagccuguacgacggcauucuccuggcugggauccuuucuaccacagauuccaccacgaaagccccucugucuagcuccauggugaaccgcuaugaggagcaccagaaggaccucgcgcugcuuaaaaauuuuauucaucagaaccugagcgauuccuacaaggaaguguucaaugacaaacucaaggauggauaugccggcuacaucgagggcaagacaacccaggaaaacuuuuacagauucaucaaaaaggcuauugagaaaaucgaagggucuaauuauuuuauugacaagaucgaccgggaggauuuccugagaaaacaacgcacauuugacaacggaagcauuccccaccagauccaucugcaggagaugcacgccaucauucggagacaagcugaauuuuacccuuuucucgucgagaaucaggauaagaucgaaaagauucugaccuuccgcaucccguauuacguuggcccccuugcccgggggaaauccgaguucgccuggcugaacagaaagagcgacgagaaaauucgcccuuggaauuuugaugaaaugguggacaaggagaccucugcugaaaacuucaucacacggaugacgaauuaugaucaguaccuccccgaccagaaagugcugccuaagcacucccugcuuuaugagaaauuugcggucuacaacgaacucaccaaggugagauacguuacagagcaaggaaagagcuucuuuuucgaugccaauaugaaacaggagauuuuugacggcguguucaaggucuaucgcaaagugaccaaggaaaaacugauggauuuucuggggaaggaguucgacgaauuucggaucguugaucuccugggacuugacaaggacaacaaaucuuucaaugcuagccugggcacauaccaugaucucaagaaaaucguguccaaggaccugcuggauaaccccgagaacgaagacauucuugagaaugucgugcucacccugacgcuguuugaggauagagaaaugauccgcaaacggcucgagaaguauaaggacguccugacagaggaacagcggaaaaagcucgaacggcgccacuacaccggcugggggagacugucugccaaacucauuaacggaauccgggauaaggugaccagaaaaacaauucuggacuaucugaucgaugacggcaccagcaaucgcaacuucaugcagcuuaucaaugaugacacacucuccuucguugaugagauucggcuggcccaagggagcggagaggcugaagacuacagagccgaggugcagaaccuggcgggcucuccggcuaucaagaaggggauucuccagucccugaaaaucgucgacgaacuuauugaggugaugggcuaugauccugagcauaucguuguggaaauggcccgcgagaaucaguuuacgaaccaaggaagacggaauagccagcagcgcuacaagaaaaucgaaaacgccauuaagaaucuggacucuaaccucaauuccaaaauccugaaggaguaccccaccaacaaucaggcucugcaaaacgauagacuuuuccucuauuaccugcagaacggcaaagacauguauacagaugaggaacuggacauugaucagcucagccaauacgacaucgaucacauuaucccucaggccuuuaucaaggacgauucccuggacaauaagguccuuaccaaaucugcuaagaaccgggggaaaagcgacgaugugcccucccuggagauugugcauaagaaaaagaauuucuggaagcagcuccuggacucucagcugaucagccaacgcaaauuugauaaccuuacaaaggccgaaagaggaggccugaccaaugaggacaaagcgcgguucauucagcgccagcucguugaaacgagacagaucaccaagcacgucgcccggauucuggauacacgcuuuaacaccaaacucgacgaggcugggaauagaauccgggaucccaaggugaacauuaucacacugaaguccaaucuugugagccaauucagaaaagacuaucagcuguacaagguccgcgaaaucaacaauuaucaccaugcccacgaugcuuaccucaacgccgugguugcgaccgcccugcugaaaaaguacccucagcuugcuccggaguuuguguauggagacuaccccaaauauaauucuuacaaguccagaaagagcgccacggagaaaguccuguucuauucuaacauuaugaauuucuucagacgcgugcucguuuacuccaagacaggcgaagugcggaucagaccugucauugaggugaacaaagaaaccggggagaucguuugggauaagaaaagcgacuuccgcacagugcggaagguccugucuuauccccaggugaacguggucaagaaaguugaaaugcaaaccggcggauuuagcaaggaguccauucuccagcauggcgauagcgacaaacugaucccuagaaagaccgagaaauucuaccuugacacaaagaaauacgggggauuugauucucccacgaucgcuuauuccgugcugcucauugccgacaucgaaaagggcaaggccaaaaagcugaaacgcgugaaggagcugauugggaucaccauuauggaacggauggcuuucgagaaaaauccgaucgaguuucuugaacacaagggauacaagaacauccuggagaaaaauauuaucaagcucccuaaauauagccuguucgaacucgagaacggcagacggcgccugcuugcguccgccaaggaacugcagaaagggaaugagaugauucugcccccucaccucgucacacugcuuuaccauucuagcaacauccacaagauuaccgagcccauccaucugaauuaugugaacaagaauaaacacgaauuuaaggagcuccugagacauauuuccgauuucucuacacgguacauccucgcucaagaccgccugagcaaaaucgaggaacuuuaugauaagaacgacggcgaugacauuuccgaucugaccucuagcuuuguuaaucugcucacguucacagccaucggagccccugcugccuuuaaauuccugggcuccgugauugacagaaagcgguacaccagcaucgcggaaauucuugaggcuacccugauccaccagucugucacagggcucuacgagaccagaaucgaucuguccaagcucggaggcgacuga

SEQ ID NO: 4263 - RNA, 4107 nt, Artificial Sequence
  Cas9 variant
auggacaagaaauacagcaucggccuggauauugggaccuccucuaucggauucgugggcgucgacgagaacggguggccccucaauauuaagggaaaaagagccaucggcgcucaccuguuucgggaaggggaggccgcggcugaaacacgcggauucagaacgacccggcgcagauauaaccggcgcaaguggagacuucggcugcuccgcgagauuuuugaugaaccuaucagcagaguugacccgacauucuuugcccggaugaaagaguccucugugagccccaaggauccuaauuacgacggccuggccaaggagauccuuauuccccgcgauaaagacggcaagauccuguauccuaccauuuaccaucucagacacgcucugauguaugaagaucaucaguucgacauccgggagauuuaccuggccauccaccauauugugaaauaucgcgggcacuuucuccuggauggagcugccaagaacuucgaauccucuaaucuugaccugaaaagcgauauccacgagaucaacgcgauucucgucggcaucuuugggaaugagcaagugcaguucaacgaccaguacguugaaaagcugaaggaggugcuucuggacuccacacagagcagaucugaucggcaaaaagccgcugccaagguccuccugcccaccaaugaccuggauaaagacacaaccaagauucucaaaacgguguccaccgaaaucacaaaggcuauuaccggacugaaagccaaguuuuucguuaucacaggcaacgauaucgcgaaggaccagcagaaagauuggaccuuuagcauugacacgcuugaugagaagaugucugugaucgaaccuuccuucagcgagaaaaauuucucucugauuacaauccuccagaagcuguacuccagcgucacccuugccgggauugugccgaacggacugucccucucugaggcuaugauccaaaaauaugacagacaugccagcgaucuggugcugcucaagaaguacugggacacaaaacccaagguccugaaacaccagcuucagaauaccuaugcugaauacaucgagauucaucagguuguggacgaauuuuauuccgaucugagcaagcucaucaaaaacgacgaugacacccuggcccaagagauuaagucuaagaucacaauuggcaauuuccuuccuaaacagcgcacgaccgaaaacggcgugauccccuaccagcugcaacagcgggagcucgauacaauuaucaagaaccagcaggaguauuacccuuggcuggccgaagagaaucccgucgcugaccaccaaaucgcguuuccguacaaacuggaugaacucgugggguuccgcauuccuuauuacguuggacccaugaucgccaaggaggacaccuccaacagcaaaaauucuaaguuugcuuggaugauuagaaagcagagcggcgaagugacaccuuggaacuucgaugagaaaaucgaccggaccgccuccgccacggcuuuuauugauagaaugacaaccaccgacacauaucugaucggggaggauguccuucccaagcagucucugaucuaccagcgcuucgaagugcucaaugagcugaacaaaauuagcaucgacggacaacccauuacccggaagcagaaacaguccguuuauacacacguguuugaaaagaaaaagacgguccaggugaaggacguccaaaaauuccuggugagcucuggcgagguuaugucccuuccuaagaucgggggacucgccaaugagaaacaguuuaacagcucucuguccacccuguacgauuauaauaagauuaucccggacgcgcucgaagauagaaacaaaguggacgauaucgagaagauuauccuguggagcacaauuuucgaagacaauuccaucuuugucgagaaacuugauucuauugacuggcugaccagcucccagcgcaaacggcucgcucagaagagauaccgcggcuggggccggcugucucugagacuucucacaaccuucaaaaacaaggauggguacagcauccuggacgaacuguggaacuccaaucauaauuucauggagauccaagcccagagcgauuuuucugagcagauugccacggcuaacaacaauaaccucucccaagugcugcccgccaaaugggaaccuggacggaagaaucuugcuagccuggacgaguucaucucuaaccucuauaccagcccccagaauaagaaagcccugcgcaaggcgauuagaguugugcaggauaugaugacagccgcuggccacaugccugaaaagaucuuuauugaggucgcccgggacaccuccaacucucaucagcaaacaaucgcuagacagcgccagcugcagcaacuuuaccagagcgaagccaaggaggugauugacuccagcgugcggucugagcucgaugacauccugaaaaauagagcgaacaucaaggaucagcuguuccucuauuuucagcaagggggacgcgaccuguacaccggcaaggccauuaauaucgauaaacuuucccuguaucacauugaccauauccucccccagagccugguuaaggaugacucccuggauaacagaguccuugugucucagaaaacgaaugaagacaagggggugacauucgucagcgauaaauacaugaacaauaugcucccgaccuggaagcgguggcacgagaugggccugauuuccgcucgcaaacugaagaaccucacaaugagaccugacgaaaucgacaaguaugcccccggauuuauccaacggcagcugguggagacccgccagguuaccaaacuugugauugaacugcucgaugcucugcugggcaauucucagacagagaucauuacgaucaaggccagccuuucccaccaauucagacagcaguuugaccuggucaaaauucgggaggugaacgauaaccaucacgccuucgacgcuuuucucgcggcccgcaucgggaccuaccuguacaagagauauccuaaacuccggcccuacuucguuuauggacaguacaugcaaaaucauaagaaccugaagucuaucaaucuuauuaaaacacuggauagcgacaaggcuaucguggaugaaggcaccggggagauucucugggacaaaaaguccgaucuggccaaaaugaucaagauuuauaacuaccagcgccugcuuaucacacacgaaagcagaaccucuuuuggagccauguauaagcagaaaauucugaaggcuacggacgccaaacagaauggcgggggcuucaagcucgucccuacaaaacggaacuggcccguggauaucuacggaggcuacaccgggcaaaccgcggcuuaucugacaaucguuagaguguacuccaagaagaccagcgagcuccgcguccugccgauuuauacaaauaaagugcagcagaucgagaaggccaugacgcagggagacaaagccaccaugcuugcuuucaagaaagugauugccccucaacugggcaaggaaaacaagaaaacacacgagaucaagauucccgaauuugaugucguuauccccaaagugcuccuggaccagcuggugaucgacgauauugcggggucuccucaucgguucagacuuggaaccgacacauacuaucacaauucccagcaacuguuucucccgcugagcaugcagcgccagcucauggaucgggagucugacgauaaggucuaccuggacaucuucaacgaugugcuuaaacagguugacuccuauuuuaaucuguacgaugugaacggcuucagagcugcccugcaaaagagcaaaaaggccuuugaacagcuccccauuaaugacuucccuaaggauguccccgacaacaaaaagaaaaaggggaaacgcuccauccugaaggagauuuuuaucggccuucaugcuaaugccacccugggaaaccucaagcagaugggcaucaaaacggauuucgggaagcugcagaaaagcaacggacuccggauuaccgagaauugcaagaucauucaccaaucuccuacaggccuguuugaaagaaucgugcccauuaaauga

SEQ ID NO: 4264 - RNA, 4107 nt, Artificial Sequence
  Cas9 variant
augagcagacccuacaacaucggccuggacauugggaccuccucuaucggauggagcguggucgaugaccaguccaagcucguuucugugcggggcaaauauggguacggagugcgccuguaugaugagggccaaacagccgcugaaagacggagcuuccgcacgaccagacggcgccuuaagagacggaaauggcgccuggggcuccugagagagauuuuugaaccuuacaucacaccggucgacgauaccuucuuucuucggcagaagcaguccaaucugucucccaaagaccagcgcaagcucuauccucaaacaagccuguucaacgauagaaccgaccgggccuuuuacgaugacuaucccacaauuuaccaucugcgcuacaagcucaugaccgagaaaagacaguucgauauccgggaaaucuaucuggcgaugcaccacauugugaaguacagaggacauuuucuuaaugaggcuccuguuuccagcuucaaaucuuccgagaucaaccugguggcccacuuugaccgccucaauacgauuuucgccgaucuguuuagcgaaucuggcuuccagcuugagaccgacaagcuggcugaagucaaagcccuccugcuggacaaccagcaauccgcuagcaaucggcagagacaggcccucucucugaucuauacacccuccaccaacaaggcgguggagaagcagaauaaagccauugcuacagagcuucugaaggccauccucggccugaaagcuaaguuuaacguucuuaccgggauugaagccgaggaugugaaagcguggacgcugacauucaaugccgaaaacuucgacgaggaaauggucaagcucgagagcucccuggaugacaaugcucaucaaaucaucgagucucugcaggaacucuacagcggagugcugcuugccggcauugugccugagaaccagucccugagccaagcuaugaucaccaaauaugaugaccaccagaagcaccucaagaugcugaaagccguccgcgaagcccuugcuccggaggaucggcagagacugaagcaggcguacgaccaauauguugaugggcaggaaaauacaaaagccuacucuaaggaggacuuuuacggagauauuaccaaagcucucaagaacaaccccgaccauccuaucguguccgagauuaagaaacugaucgaacuggaccaguucaugcccaagcagcgcaccaaagauaauggcgccaucccucaccaacuccaucagcaggagcuggaccggauuaucgaaaaccagcaacaguauuaccccuggcuugccgagcugaauccgaacagcaagagacagacaguggcuaaauauaagcucgaugaacuggucgccuuucgcgugccuuacuauguugggccccugauuacggcggagcagcaacggcagucuagcgacgcuaaguucgccuggcuuaucagaaaagccgagggacgcauuaccccuuggaauuuugaugacaagguggaucggcaggcuuccgccaacgaguucaucaaaagaaugacaaccacagacaccuaccuccuggcugaggauguccugcccaagcaaucucucaucuaucagcgguuugaagugcugaaugagcuuaacggccugaaaauugacgaucagcccaucacgacagagcucaagcaggccauuuucaccgaccuguuuaugcaaaagaucagcguuaccgugaaaaauauucaggauuaccuggucuccgaaaagcgcuacgcgagcagaccugccaucacaggccuuucugacgagaacaaauucaauucccggcucagcaccuaucacgaccugaagaugauugugggggaugcugucgacgauguggacaaacaggccgaucuggaaaagugcaucgaguggucuacaaucuuugaagacggaaaaauuuacuccgcuaagcucaacgagaucgauuggcugacggaccagcaaagaguucagcuugccgcgaagcgcuaucggggcugggggagacugagcgccaaacuccugacccagauugugaaugcuaacggacagcgcaucauggaucugcuuugggacacaaccgauaauuucaugagaauuguccacuccgaggacuuugauaagcucaucacagaagccaaccaaaugaugcuggcugagaacgacgugcaggacguuaucaaugaucuguacaccucuccgcagaacaaaaaggcccuccggcaaauucugcuuguggucaaugacauccagaaagccaugaagggccaggcucccgaacgcauucugaucgaguucgcgagagaagaugaggugaacccucggcucagcgugcagcgcaagagacaaguugagcaggucuaucagaauauuuccaacgaacugcugaauaacacggagauccggaaugaacuuaaagaccucucuaacagcgcccuguccaauacccgccuguuccucuacuuuaugcaagggggaagagauauguauacaggcgacagccugaacaucgaucggcuuucuaccuacgacauugaucauauccugccccaguccuucgugaaggacaauagccucgauaaccgcgugcuggucucucagaaaaugaauagauccaaggcugaccaggugccuacagacuuuaccagcguugagcugggcaaaaagaugcagcuucaaugggaacagaugcugcgggccgggcucauuacgaagaaaaaguacgauaaccugacacucaaccccgaccacaucucuaaauaugccaugaagggauucauuaauagacagcugguggagacccgccaggucaucaaacuugcuacaaaccugcucauggagcaauacggcgaagauaauaucgagcugauuaccguuaagagcgggcugacccaucagaugcggacagaauuugacuucccgaagaacagaaaucuuaacaaucaccaucacgccuuugaugcguaucugacggcuuucgugggacucuaccugcucaaacgcuauccuaagcugaaacccuacuuuguguauggcgaguaccagaaggccucccaacaggacaaauggcggaacuucaauuuucuuaacgggcugaagaaagaugagcucgucgacgaaaauaccgaggccgugaucugggauaaggaaagcggccuggcuuaccugaacaagauuuaucaguucaaaaagauccuuguuacaagagaggugcacgaaaauucuggagcccuguuuaaccagacccucuacgcggcuaaagacgauaaggccuccggccaagggggaaaacagcugauuccugccaagcaggaccgccccacagcucucuauggcggguacagcggaaagaccuccgccuaucugugucuugucaaaaucaagaauaaaucugaguacauuuaucggaucuucggcgugaacacgagcugguccucugagcugaagcagauccaagauccugcugaaagacuggugcgccucgagaaacugcuuacaccccagcugaccauuaacaagaagaaaaagggggaaccggucccuguuaccaaagacuucaagaucauucucccccggauccugauuaaucagaaauuuuacagcagaggccaggacaucuccaucgccucugaguucuaccuccauaacgaacaagagcuggugcuugauaagagcgacauuaagauccugaauggagcgauuaaagugaacaauuccaacaagcaggucaucaaucuguuuaaccacauucucgaacaggugaaucaauauuuccccguuuacgauaucuauaaaagccgggaagugcugaacucuuccaaggagaucuuugaaaaucuuacauggaacgaccaguggcgcaauagaaaacugauuaacgucggccagaagaccauccucaaucggauucugaucgggcuccaugccaacgcugcccgcauuaagaucagcgagcugggauucaaaaaugauuuuggccuucugacacagacgucugggauuaccuucacaccugacacccaaaucaucuaccaguccccgacaggacuguuugaaagacggguggcucucagagaucuguga

SEQ ID NO: 4265 - RNA, 4107 nt, Artificial Sequence
  Cas9 variant
augaagagaagcuacaacaucggccuggacauugggaccaauuccaucggaugggccauuguggaugaccagucuaaacucaucagcgucaagggcaaauauggguacggaguucggcuguaugaugagggccaaacagcugccgaacgcagauccuuccggacgacccgcagacggcuuaagcgcagaaaauggcggcuggggcuccugcgcgagauuuuugaacccuacaucacaccuaucgacucuaccuucuuucuuagacagaagcagagcaaccuguccccgaaggaucagcggaaacucuauccccaaacaucucuguucaaugaccgcccugaugcggacuuuuaccagcaguaucccaccauuuaccaccugagauaccagcucaugacagagaagcggcaauucgauauccgcgaaauuuaucuggcuaugcaucacaucgugaaauacagaggacauuuucuuaacgaggccccuguggccagcuucaaguccagcgagauuaaucuggcugaacacuuugaccagcucaacaccaucuucgccgaucuguuucgggagucuggcuuccagcuugaaacggacgagcuggucgcugugaaagcccuccugauggauaaucagcaauccgcgagcaacagacagcgcaaggcccugcccaagcucuauaccccuucugcugacaaauccauugagaagcagcggaaagccaucgcuacagaaauccugaaggccauucuuggccugaaagcgaaguuuaauguugugaccgggaucgaggccgaagacgucaaggcuugggcccucacauucaacgcugagaauuucgaugaagaacuggccaagcuggagagcucucuggacgauaacggacaugaagugauuggcauccuccaagagcuguacuccgggauucugcucgccggaaucguuccggaaaaucagagccugucccaggcuaugaucaccaaguaugaggaacaccaggcgcaccuuaaaaugcugaaggccgugagagacgaucucgcuacggccgaccaacagaaacugaagaaagccuacgaucaguauauugacggccaggagaacacaaaggcuuacucuaaggaggccuuuuacgaugacgucaccaaagcgcuuaaggauuauagcgaacaaccccugguguccgagauccagaaacucauugaacuggaccaguucaugccuaagcagcgcacaaaagacaauggggcuaucccccaucaacugcaccagcaggagcucgaucggauuaucgaaaaccagcaacaguacuauccuuggcuggccgagcuuaaccccaauccgaagagacagaccguggccaaguacaaacuggacgagcucgucgcuuuucgcguuccuuauuacgugggaccccugaucaccgccgaacaacagcagcagagcucuaacgcuaaguucgccuggaugauucggaaaacagagggcagaaucacgccuuggaauuuugaugacaagguggaucgccaagcguccgccaacgaguucauuaaacggaugaccacaaccgacacauaucugcuugcugaggauguccuccccaagcagagccugaucuaccagagauuugaggugcugaaugaacucaacggccugaagauugacgaucagcccaucaccaaugagcuuaaacaagccauuuucaacgaccuguuuaugcagaagacgucuguuagcgugaaaaauauccaggauuaccucgucuccgaaaagcgcuaugcuucucggccugccaucacagggcugagcgacgagaaaaaguucaacuccagacugagcaccuaccaugaucuuaaagugauuguuggagacgcgguggacgaugucgacaagcaggccgaucucgaaaagugcaucgaguggucuaccauuuuugaggacggcaaaaucuauuccgcuaagcugaaugaaauuacauggcugaccgagcaacagcgggggcagcucgccacaaaacgcuacagaggauggggccggcugagcgcuaaacuucugacgcaaaucgugaacgccaaugggcagagaaucauggaucuccugugggacaccacagauaacuucaugcgcauuguccacuuugaagacuucgauaaacugaucaccgaggccaaucagauggugcuugcugaaaacgacguucaggaugugauuaacgaccucuauacaucuccgcaaaauaagaaggcgcugcggcagauccugcucgucgugaacgauauucagaaagccaugaagggacaggcucccgagagaauccugaucgaguucgcccgcggcgcccaaaaagacaagucccuuaccguuagacggaaacgcaagcuggacgaaauguacagccagauuuccgaugcugugcucgccgacgagucugucagacaggaacuuaagagcuccaaucaggaugaccuggugaaagagaagguguaucuuuacuuuaugcaaggcgggcgggaucucuacacgggaaacgcgcugaauaucgaccgccugucugauuaucacguugaccauauuaucccucaggcuuacauuaaagaugacagccucgauaacaaggcccuggucuccagcagaaugaaugaaaucaaagccgaccgggugccccuucaggugguccagaagcaauucggcaagaacauggcuucugaguggggguauaugcaccgcgccggacugaucuccagaaagaaguacgacaaucucauguuuaacccugagaaucugaacaaauaucagauuaaucgguucaucagccgccagcugguggaaacccaacagguuauuaaacuuguggcgaaccugcucucuaaucaguacgagggcgauaacgucaaaaucauuacagugaaguccaaacugacccagacaaucagaagcgaauuugacuuccccaagaaccgggagguuaauaacuaucaucacgcuuuugaugccuaccucaccgccuucguggggauguaccugcuuaagagauauccgaaacugucuagcuacuuuacguauggcgaguaccucaagggaaaucaacaggacaaaugguccagcuucaacuuucugaaugaucugaagcgcgcuaaacuugaagacaagacaaacaaggagauuuucuggcauaaagaaucuggccuggccuaucucaauaagaucuaccaguuuaaaaagauccuggucacccgggaggugcacgaaaacuccggggcucucuucaaucagacacuguaugccgcgaaagaugacaaggccagcggacaaggcgggaagcagcuuauuccugcuaaacaggccagacccaccgcucuguacggaggcuacuccgggaagaccguugccuauauguguaucgugcgcauuaaaaacaagaaaggcgaucucuacaaggucugcggaguggagacaucuuggcuggcccagcugaagcaacuuaaagacgaggauagccagaaggcuuuccugaaacagaagaucuccccucaauuuacgaaagcgaagaagcagaaaggcaccauugugaaggucguugaagacuucgaggugaucgcuccccacauccucauuaaucagcggcuguuugauaacgggcaggaacucacacugggaucugccaccuauaaacauaaugagcaagaacuuauccuggacaagacagccgugaaacugcucaacggcgagcugccucuugcccagagcgaggaacuggcugagcucgucuacgacgaaauucuggaucaggugaugcacuauuucccccucuacgacaccaaucaguuuagagccaagcugcuugcggggaaaacggcuuucaugcaacugccguggaaguccaacccugaugacaacaagacaguucagaucacccagcccauugugcugaaaaagauccuccagggacugcaugccgaugccggccgcgucucucuuaaagagcuggggaugaccacagacuuuggcaugcuccaaaaggcuaccggaaucacauucacgcccgauacccagauuaucuaucagagcccuacaggccuguuugaacggagaguggcccuccgcgaccuguga

SEQ ID NO: 4266 - RNA, 4107 nt, Artificial Sequence
  Cas9 variant
auggacaagaaauacagcaucggccuggauauugggaccaacuccgugggaugggccgucaucacagacgauuauaagguucccucuaaaaaguucaaagugcugggcaauacggacagacacagcauuaagaagaaccugaucggggcccuucuguuugauuccggagagaccgccgaagcgacacggcucaaacgcaccgcuagacggcgcuacacaagacggaagaaucgcauuugcuaucugcaggagaucuucucuaacgaaauggccaaaguggacgauagcuuuuuccauagacuugaggaauccuuucuggucgaggaggacaagaaacacgaacggcauccuaucuucggcaauauuguggaugagguugccuaccacgaaaaguauccgaccaucuaccaucuccgcaagaaacugguggacucuacagauaaggcugaccugagacucauuuaucuggcccuugcucacaugaucaaauuucgggggcacuuccugauugagggagaucucaaccccgacaauagcgacgucgauaagcuguuuauccaacuugugcagaccuacaaccagcuguucgaggaaaauccuauuaacgccuccggcguugacgcgaaagccauccucagcgcucgccugucuaaguccagacggcuggagaaucucaucgcccagcugcccggcgaaaagaagaacgggcuuuuuggaaaucugauugcucucagccugggccuuacgccuaacuucaagucuaauuuugaucuggccgaggacgcgaaacuccaacuguccaaggauaccuacgacgaugaccuggauaaccuccuggcccagaucggggaccaguaugcugaucuuuuccuggccgcuaaaaaccucagcgacgccauucugcuuucugacauccugcgcgugaauacagaaauuaccaaggcuccccucuccgcuagcaugaucaaaagauacgaugagcaucaccaggaccugacacugcucaaggcgcugguccggcaacagcuuccugagaaguauaaagaaaucuucuuugaucaguccaagaacggauacgccggcuauauugacgggggagcuucucaggaggaauuuuacaaauucaucaagccgauucuggagaaaauggauggcaccgaggaacuccuggugaagcugaauagagaggaccuucuccgcaagcaacggacguucgauaacggcagcaucccccaucagauucaccugggggaacugcacgccauccucagacgccaggaggacuuuuauccuuuccugaaagauaaucgggaaaagaucgagaaaauucuuacauuuagaauccccuacuacgugggaccucuggcccgcggcaacucccgguucgcuuggaugaccagaaagagcgaagagacaauuacccccuggaauuuugaggaagucguugacaaaggggccucugcgcaauccuucaucgagcgcaugaccaacuuugauaagaaucucccgaacgaaaaggugcugccuaaacauagccugcuuuaugaguacuucacaguguauaaugagcucacgaaggucaaauacgugaccgaaggaaugcggaagcccgcuuuucugucuggcgagcagaaaaaggccauuguugaccuucucuucaaaacaaacagaaaggugaccgucaagcagcugaaagaagauuauuucaagaaaaucgaguguuuugacagcguggaaauuuccgggguugaggaccgcuucaaugccucucuuggaacauaccacgaucugcucaagaucaucaaagacaaggauuuucuggacaacgaggaaaaugaggauauucuggaagacaucgugcuuacccucacgcuguucgaggaucgggaaaugauugaggagagacugaagacauaugcucaucucuuugacgauaaagucaugaagcagcugaaacggcgcagauacaccggcuggggccggcuuagcagaaagcugaucaacgggauucgcgacaaacaauccggaaagaccauccucgauuuccuuaagagcgacggcuuugccaaccggaauuucaugcagcugauccacgaugacucucugacauuuaaagaagacauucagaaggcucagguguccgggcaaggagauagccuccaugagcacaucgccaaccuggcgggcucuccugccauuaaaaaggggauccugcagaccgucaaagugguugacgaacucgugaaggucaugggcagacacaagcccgagaauauugugaucgaaauggcucgcgagaaccagacaacgcagaaaggacaaaagaacuccagagagcggaugaaacgcaucgaagagggcauuaaggaacuggggagccagauccuuaaagagcaucccguugagaauacccagcugcagaaugaaaagcucuaccuguauuaccugcaaaacggaagagauauguauguggaccaggagcuugauauuaaucggcuguccgacuacgaugucgaccacaucgugccucagucuuuccucaaagaugacagcauugauaacaaggugcugacacgcuccgacaagaauagaggcaaaucugacaacguuccgagcgaagaggucgugaagaaaaugaagaauuauuggcggcaacuccugaacgccaaacuuaucacccagcgcaaguuugauaaucugacaaaggcugaaagagggggacucuccgagcuggacaaagccggcuucaucaagcggcagcugguggagacccgccagauuacgaaacaugucgcgcaaauccuugauagcagaaugaacaccaaguacgacgaaaacgauaaacugauucgggaggugaagguuaucacacucaagucuaaacugguguccgacuuuagaaaggauuuccaguucuauaaaguccgcgaaauuaauaacuaccaccacgcccaugacgcuuaccucaaugccgugguugggaccgcucugaucaagaaauaucccaagcuggagagcgaauuuguguacggcgauuauaaggucuacgacgugcggaaaaugauugccaagucugagcaggagaucggaaaagccacagcuaaguauuucuuuuacuccaacaucaugaauuucuuuaaaaccgaaauuacgcuggcgaacggcgagaucagaaagcgcccucucauugaaacaaauggggagaccggagaaaucguuugggauaagggccgggacuucgccacagugagaaaaguccugagcaugccccaggugaacauugugaagaaaaccgagguccaaaccgggggauuuucuaaggagagcauccugccuaaacgcaauuccgauaaacuuaucgcucggaaaaaggacugggaccccaagaaauauggcggguucgauagcccgacaguugccuacucugugcugguggucgccaagguggaaaaaggcaaguccaaaaagcucaagagcguuaaagagcugcucggaauuacgaucauggaaagauccucuuuugagaagaacccuauugacuuccuggaggcuaaaggcuacaaggaagugaaaaaggaucuuaucauuaagcugcccaaauauagccuguuugagcucgaaaaugggcgcaagcggaugcuggccuccgcgggagagcuucagaaaggcaacgaacuggcucucccuucuaaguacgucaauuuccuguaucucgccagccacuacgagaaacugaaggggucccccgaggacaacgaacagaagcagcuuuucguggagcaacauaaacacuaucuggaugaaaucaucgagcagauuucugaauuuagcaagagaguuauccuggccgacgcuaaucucgauaaagugcuguccgccuacaacaagcaucgggacaaaccuauucgcgagcaggcggagaacaucauucaccuuuucacccugacaaaucucggagcucccgccgccuuuaaguauuucgauaccacaaucgacagaaaacgguacaccagcacgaaggaaguccuggaugcuacacucauucaccaaucuaucaccggccuguacgagacccgcaucgaccuuucccagcucgggggcgauuga

SEQ ID NO: 4267 - RNA, 4107 nt, Artificial Sequence
  Cas9 variant
auggacaagaaauacagcaucggccuggauauugggaccaacuccgugggaugggccgucaucacagacgauuauaagguucccucuaaaaagcucaaaggccuggggaauacggacagacacggaauuaagaagaaccuuaucggcgcucuccuguucgauagcggggagaccgccgaagcgacacggcugaaacgcaccgcuagacggcgcuacacaagacggaagaaucgcauuugcuaucuucaggagaucuuuuccaacgaaauggccaaaguggacgauucuuucuuucauagacuggaggaauccuuccucguggaggaggacaagaaacacgaacggcauccuaucuuuggaaauauugucgaugagguggccuaccacgaaaaguauccgaccaucuaccaucugcgcaagaaacuggcugacuccacagauaagguugaccucagacugauuuaucuugcccuggcucacaugaucaaauuccggggccacuuucucauugagggcgaucugaaccccgacaauucugacguggauaaacuuuucauccaacugguccagaccuacaaccagcucuuugaggaaaauccuauuaacgccagccgcguggacgcgaaagccauccuguccgcuagacugagcaagucucggcgccucgagaaucugaucgcccagcuucccggggaaaagaagaacggacuguucggcaaucucauugcucugucccuugggcugacgccuaacuuuaagagcaauuucgaucucgccgaggacgcgaaacugcaacugucuaaggauaccuacgacgaugaccucgauaaccugcuugcccagaucggagaccaguaugcugaucuguuucucgccgcuaaaaaccuguccgacgccacacuucugagcgacauucucagaguuaauucugaaaucaccaaggcuccccuguccgccagcaugauuaaacgguacgaugagcaucaccaggaccugacacuccugaaggcgcuugugagacaacagcugccugagaaguauaaagaaaucuucuucgaucaguccaagaacggcuacgccggguauaucgacggaggcgcuucucaggaggaauuuuacaaauucauuaagccgauccucgagaaaauggauggcaccgaggaacugcuggccaaacuuaaucgcgaggaccuccugcggaagcaaagaacguuugauaacgggagcauucccuaucagauccaucugggagaacuccacgccauucugcgccggcaggaggacuucuacccuuuucuuaaggauaauagagaaaagaucgagaaaauccugacauuccgcauucccuacuaugucggcccucucgcucgggggaacuccagauuugccuggaugacccgcaagagcgaagagacaaucacccccuggaauuucgaggaagugguggacaaaggagcgucugcucaauccuuuauugagcggaugaccaacuucgauaagaaucugccgaacgaaaagguccugccuaaacacagccuucucuacgaguauuuuacaguuuacaaugagcugacgaaggugaaauaugugaccgaaggcaugagaaagcccgccuuccugucuggggagcagaaaaaggccaucgucgaccuccuguuuaaaacaaaccgcaaggugaccguuaagcagcuuaaagaagauuacuucaagaaaauugaguguuucgacagcguggaaaucuccggagucgaggaccgguuuaaugcuucucugggcacauaucaugaucuccugaagauuaucaaagacaaggauuuccuggacaacgaggaaaaugaggauauccuugaagacauugugcucacccugacgcuguuugaggauagagaaaugaucgaggagcggcucaagacauacgcccaccuguucgacgauaaaguuaugaagcagcuuaaacgcagacgguacaccggcugggggagacugagccgcaagcucauuaacggaauccgggacaaacaauccggcaagaccauucuggauuuucuuaagagcgacggguucgcuaacagaaauuuuaugcagcugauccaugaugacucucucacauucaaagaagacauccagaaggcccagguguccggacaaggcgauagccugcacgagcauauugcgaaccuggccgggucuccugcuaucaaaaagggcauucuccagaccgucaaaguggucgacgaacuggugaagguuaugggacgccacaagcccgagaauaucgugauugaaauggccagagagaaccagacaacgcagaaaggccaaaagaauagccgggagcgcaugaaaagaaucgaagaggggaucaaggaacuuggaagcgauauucugaaagaguaucccgucgagaacacccagcuccagaaugaaaagcuguaccuguauuaccuucagaacggccgggacauguauguggaucaagagcuggacaucaaucgccucuccgauuacgacguugaucacauugugccucagucuuuucugaaagacgauagcaucgacaacaagguccucacaagauccgacaagaaucgggggaaaucugauaacgugccgagcgaagaggugguuaagaaaaugaagaauuauuggcgccagcugcuuaacgcuaaacugauuacccaaagaaaguucgacaaucucacaaaggccgaacggggaggccuguccgagcuggauaaagucggguuuaucaagcgccagcuuguggagaccagacagaucacgaaacauguggcgcagauucuggacagccggaugaacaccaaguacgaugaaaacgacaaacucaucagagagguccgcgugauuacacugaagucuaagcucguuuccgauuuccggaaagacuuucaauucuacaaggugagagaaaucaauaacuaucaccaugcccacgaugcuuaccugaaugccgucgugggcaccgcucuuauuaaaaaguaucccaaacuggagagcgaguucguuuacggagacuauaagguguacgauguccgcaagaugaucgccaaaucugaacaggagauuggcaaggccacagcuaaauacuuuuucuauuccaacaucaugaacuuuuucaagaccgaaaucacgcucgcgaauggggagauucggaaaagaccucugaucgaaacaaauggagagaccggcgaaauugugugggacaaggggcgcgauuuugccacaguucggaaggugcugagcaugccccaggucaacaucgugaaaaagaccgaggugcagaccggaggcuucucuaaagagagcauucuuccuaagagaaauuccgacaaacugaucgcucgcaagaaagacugggaucccaagaaguacgggggcuuugacagcccgacagucgccuauucuguucucgugguggccaaagucgaaaagggaaaauccaagaaacucaagagcgugaaggagcugcugggcaucacgauuauggaacgguccucuuucgagaaagauccuaucgacuuucuugaggcuaagggguacaaagaaguuagaaaggaucugauuaucaaacugcccaaguauagccucuucgagcuggaaaacggacggaagcgcaugcuugccuccgcgggcgagcugcaaaaagggaaugaacucgcucugccuucuaaguacgugaacuuucucuaucuggccagccacuacgagaaacuuaagggaucccccgaggacaaugaacagaaacagcuguucgucgagcagcauaagcacuaucuggaugaaauuaucgagcaaaucucugaguucagcaagagagugauucucgccgacgcuaaccuggauaaaguucuuuccgccuacaauaagcaucgggacaaaccuauccgcgaacaggcggagaacauuauccaccuguuuacccucacaaaccugggcgcucccgccgccuucaaguacuuugauaccacaauugacagaaaacgguauaccagcacgaaggaagugcucgaugcuacacugauccaucagucuauuaccgggcuuuacgagaccagaaucgaccugucccaacugggcggagacuga

SEQ ID NO: 4268 - RNA, 4107 nt, Artificial Sequence
  Cas9 variant
auggacaagaaauacagcaucggccuggauauugggaccaacuccgugggaugggccgucaucacagacgauuauaagguucccucuaaaaaguucaaagugcugggcaauacggacagacacagcauuaagaagaaccugaucggggcccuucuguuugauuccggagagaccgcugaagcgacacggcucaaacgcaccgcuagacggcgcuacacaagacggaagaaucgcauuugcuaucugcaggagaucuucucuaacgaaauggccaaaguggacgauagcuuuuuccauagacuugaggaauccuuucuggucgaggaggacaagaaacacgaacggcauccuaucuucggcaauauuguggaugagguugccuaccacgaaaaguauccgaccaucuaccaucuccgcaagaaacuggcugacucuacagauaaggccgaccugagacucauuuaucuggcucuugcccacaugaucaaauuucgggggcacuuccugauugagggagaucucaaccccgacaauagcgacguggauaagcuguuuauccaacuuguccagaccuacaaccagcuguucgaggaaaauccuauuaacgcgucccgcguggacgccaaagcuauccucagcgccagacugucuaagucccggcgccuggagaaucucaucgcucagcugcccggcgaaaagagaaacggccuuuuugggaaucugauugcccucagccugggacuuacgccuaacuucaagucuaauuuugaucuggcggaggacgccaagcuccaacuguccaaagauaccuacgacgaugaccuggauaaccuccuggcucagaucggcgaccaguaugccgaucuuuuccuggcugccaagaaccucagcgacgccauucugcuuucugacauccugcggguuaauuccgaaauuacaaaagcuccccucagcgcguccaugaucaagagauacgaugagcaucaccaggaccugacccugcucaaagcccuggugcgccaacagcuuccugagaaguauaaggaaaucuucuuugaucagucuaaaaacggguacgcuggauauauugacggcggggccagccaggaggaguucuacaaguuuaucaaaccgauucuggaaaagauggauggaacagaggaacuccuggccaaacugaaucgggaggaccuucucagaaagcaacgcaccuucgauaacggcuccaucccccaucagauucaccugggcgaacugcacgcuauccuccggagacaggaggacuuuuauccuuuccugaaggauaaucgcgagaaaaucgaaaagauucuuacguuucggauccccuacuacgucgggccucuggccagaggaaacagccgcuucgcguggaugacacggaaaucugaagagaccauuacacccuggaauuuugaggaagugguggacaagggcgcuuccgcccagagcuucaucgagagaaugaccaacuuugauaaaaaucucccgaacgaaaagguccugccuaagcauucucugcuuuaugaguacuucaccguuuauaaugagcucacaaaagugaaguacgugacggaagggaugcgcaaacccgaguuucugagcggagaacaaaagaaagccauugucgaccuccuguucaagaccaaccggaaagugacaguuaagcagcugaaggaggauuauuucaaaaagaucgaauguuuugacuccguggagauuucuggcgucgaggacagauucaaugcuagccuugggaccuaccacgaucugcucaaaaucaucaaggacaaagauuuucuggacaacgaagagaaugaagauauucuggaggacaucgugcuuacacucacccuguucgaagaucgggagaugauugaggaacgccugaagacguaugcccaucucuuugacgauaagguuaugaaacagcugaagagacggagauacacaggauggggccgccuuucccggaaacugaucaacggcauuagagacaagcaaagcgggaaaaccauccucgauuuccugaagucugacggauuugcuaaccgcaauuucaugcagcugauccacgaugacucccuuaccuuuaaggaggacauucagaaagcccaggugagcggccaaggggauucucuccaugaacacaucgcgaaccuggccggauccccugcuauuaagaaaggcauccugcagacagucaagguggucgacgagcucgugaaaguuauggggagacacaagcccgaaaauauugugaucgagauggcccgggagaaccagaccacacagaagggccagaaaaauagccgcgaaagaaugaagcggaucgaggaaggaauuaaagagcugggcuccgauauccuuaaggaguaccccgucgaaaacacgcaacugcagaaugagaaacucuaucuguacuaucugcagaacgggcgcgacauguacguggaucaagaacuugacauuaauagacugucugauuaugacguugaucauaucgugccucagagcuucauuaaggacgauuccaucgacaacaaaguccucacccggucugacaagaaucgcggaaagagcgauaacgugccguccgaggaagugguuaaaaagaugaaaaauuacuggaagcagcugcucaacgcuaaacugaucacacaaagaaaguuugacaaucuuaccaaggccgagcggggcgggcugagcgagcucgauaaagcgggauucauuaagcgccagcuggucgaaacaagacagaucaccaaacacguggcccagauucuggacucucggaugaacacgaaguaugaugagaacgacaaacuuaucagagaagugaaggucauuacccugaaguccaaacucgugagcgauuuucgcaaggacuuccaauucuacaaaguucgggagaucaauaacuaccaucacgcucacgaugccuaucugaaugcuguggucggcacagcccucauuaagaaauaccccaagcuggaaucugaguuuguguauggggacuacaagguuuaugaugugagaaaaaugaucgccaaguccgagcaggaaaucggcaaagcuaccgcgaaguacuucuuuuauagcaacauuaugaauuucuuuaaaacagagaucacccuugccaacggagaaauucgcaagcggccucugaucgagacgaauggcgaaacaggggagauugucugggacaagggaagagauuucgcuaccgugcgcaaaguucucucuaugccccaggugaacaucgucaagaaaacagaggugcagaccggcggguuuagcaaggaauccauccugccuaaacggaauagcgacaagcugauugcccgcaaaaaggacugggaucccaagaaauacggaggcuucgacucuccgaccguggccuacuccguccuuguuguggcuaagguggagaaaggcaagagcaaaaagcugaaguccgucaaagaacuccuggggaucacaauuauggagagaucuagcuuugagaagaacccuaucgauuuccucgaagccaaaggauauaaggaggugcggaaagaccugauuaucaaacuucccaaguacucccuguuugaacuggagaauggcagaaaacggaugcucgcgucugcuggggaacugcaaaagggaaacgagcuugcccugccuagcaaauauguuaauuuccucuaccuggccucccauuaugagaagcucaaaggcucucccgaagauaacgagcagaagcagcuguucguggaacagcacaagcauuaccuugacgagaucauugaacaaaucagcgaguuuuccaaacgcgucauucuggcugaugccaaucuggacaaggugcucagcgcguauaacaaacacagagauaagccuauccgggagcaggcugaaaacauuauccaucuguucacgcuuaccaauuuuggggcccccgccgcuuucauuuacuuugacacaaccaucggacgcaacagauacaaaucuaucaaggagguucuggaugccacacucauucaccaguccaucaccggccuguaugaaacgcggauugaccucagccaacucgggggcgauuga

SEQ ID NO: 4269 - RNA, 4107 nt, Artificial Sequence
  Cas9 variant
augaaguacgagagcgaagaguauuacaucggccuggacauggggaccuccucugugggaugggccgucacagauccccacuaucaucucauuagaaagaagggcaaagaccuguggggagcucggcuuuucgaaaaggccaacacggcgcaggagcgcagaaccaaucggaucaaccgcagacggaaucaacgcagaaaacagcggauugcuuuuauccgcgaagccuucagaaaggagguugagaagguggaugugaacuuuuuccggcgccuggacgaaagccagcucuaccuggaggauaaauccauuaaggaaccuuaucuucuguuuaaugaccucaacuacacagauaaagacuucuaucaccaguacccgaccgucuuucaucugaucacagaucugcucaccucugacagaaaguucgauauccgggagauuuacaucgccgugagcucccuguauaaucaccgcgggaacuuucuuaauaaaucucugggcaacgagacacaagacgaagaucucguuuucaagaaucuggacgaggcuuuuagcgccugcgggaugaacuggaauaccaaggcugaaaacauugagguggucaaacagauccuuugugacagaucccugaauaagaaagaaaagcaggaucagcucgcccauugccuggagauuaacaaaaagacggagaaagaaaagaucgaguuccugaagcuccugaccggaggcaaagcggacagcaagaaaauguuuccccaauaccacuaugaacgggaugagaaacuuucuuucgccuucgcugacgaaaacggcgaugagaauugggaggaaacacugaacgccauugaggaaagacucaccuccgacgaguacgggcugauccuugcucugaaaagcguguaugauuggucuauccucgccgaccugaugaagaaugaaaagacaggagagaccuacccuuaucuguccauggcgcgcaaagauagcuacgagaagcacaaagccgaccuccggcugcuuaagucuguuauuaaaagacugauccccaacgaauacaaucauuucuuccgccaguaugauggcaaggggaagacguacacaaacuauauuggauccgugcaguaccacgagaaacggcauagauuuaagcacaucaccacaaaagaauuuuaugacggccucaagaaacugcuuaagccuuacagcgaggacgaggaaauuaagcagauccugcaagauaucgaguccgaaaccuuucuccccaaacagauuaccaauaugaacggggucaucccuaaucaggugcacgcuaaggagcugaaagugauucuggaaaaggccucucaacauuaugacuuccucaacgagacaaaugagagcggacugacggucaaagaacagaucaugcagauguuuaccuuccagauuccguacuacguuggcccccuugcuaaccugaauggcaaggggaacggaugggccgugcgcuaugugggcaaagagcggacaaaggucuacccuuggaauauggaugaagugaucgacgagaaggaaaccgccgaucaauuuaucaaaagaaugauuuccacauguaccuaucucggggacgaguacguucugcccaagagcucuauccuguaugagaaauucgcugugcuuaacgaacucaacucccugaagauuaauggacagccugucagcguggaucugaaacagaagaucuaccgcgaccucuuuacgaagggcaaacggguuacacagaaggggcugcuucuguaucucaaaagagagggagugauuucuaagagcgaagagaccauccuguccggcuucgauauugacuuuaaaaacacccugucuagcuaccgcaaguucugcgaagucuucgcgacaaaugagcuuaacgaugagcaaauccggauggccgaagacaucauugaguggcucaccguguuuggcgauuccaagaaauucgucagagaaaagauccacgggaauuacccccagauuacagcuaaccagcugaaacggauccugagcuuuaauuucaaggacuggggaaaacucucuaagcaguuucuggagcuugagggcgaagaccgcgagacggggaaguccuguagccugauucaagcccucugggauaccaacaauaaccugaaucagcugcuuucuuccagauucacauauaaagaaaaccucgagaagaaacggaagaaaaucgaaauggaccuguuugaguucacccaugaggaucuggacgaucucuacaucagcgccccggugaagagaaugauuuggcaggcucugaaaaucaugaaggacauuguuaucgugaugaaggaauccccuacaaaacuuuuuauugagaugacccgcaauaacgaaaaugagaagacgcggaccgucucuagaaagaacaagcugguggaucucuauaaaaagaucaagggagaaagccgcgacuggaucaaagagcuggagagauacgaagagaaggauuuccgguccaaaaagcuguaucuuuacuauacacagaugggcaaaucugccuacagcggggaacccauugacauggauaagcucuuugacaagaacguuuacgauaucgaccacauuuauccuaaauccaaggugaaagacgauagccugcugaauaacugcguccucgugaagcgcaaagagaauauggacaagggcaacaauuuccccaucgaucccgacauucaaaccaagcaggaacaucuguggaaauuuuggcuugagaagggacugaucacacaggagaaauucaacagacucacccggaagaaaccuuucacgaaugaugaacuggcggacuuugugaaccgccaacugguugagacaggccaggcuaccaagacaaucgccgaucuuuucaagaugaccuuucccaauucugacauugucuacgugaaagccgggaacgugaccgauuucagacaguauaucgaagucuacaagugucgggaggugaauaaccugcaccacgcuuaugacgccuaccucaauguuguggucggaaacguguaugauacaaaauuuacgaagaaucccaugaacuacauuaaagagcagcgcaaggaaaacuccaaugagagauaccauauggacaaaaucuucgaauuuccuguuauucggaacggcaaggaggcuuggaucaccaagaaagacgaaagcauuaauaucgugcgcaagacacuggccagaaaaaccccgcucgucacaaagcggaacuucgaggcgaaugggaccaucgccaaagcuacgauuuauccuaagggaaacgugaaggaucaaggcuaccugcccagaaaaacaucuaucccggcccuucgcgacaugaagaaauaugggggcguuaccuccauucagaucgcuuacuuuuuccugguggagcacgaagucaagaaaaagcggauuagaaccaucgagugcgugccuaucuaucgcaaggaggaacucaaaacaaaggaacagcuggagcgguacuguagagaggaacugaaacuuauuaaucccagcauccgccuggagaagauuaaaccuuauucucuccugaagaugaacggaaacuuuuucuacaucaccggcaagacaaaugaucgguucagccucgccaaugcgauggaacuguacguggacaaagucuccgagaaccauauuagagaucuuguuaaguauaaaaauugcggguacuuuaacguggacgauaaggaagcccgcaaacggaaugagagacuguauacgauccucaccaagaaacaccugacaguguucaagggaagccccaagccuaugggcgagaaacugcagcaauaccagcagcuuuuucuggaacucgaggucucuaaacagguguauguucugcuccaaauccugcagcuuaccgcuacaaacgugaaaaccaaggccgaccugacggcuauugggggaaaagccaaugaaggcaccauggauaucuccaagaaccuggagaacgucauuaagaaucagaucaaaaaggggcucgugcccgagcugaugcuuauuaaccaaagcccgacaggccuguucgaauccgagaucgaccuccugaccauuuga

SEQ ID NO: 4270 - RNA, 4107 nt, Artificial Sequence
  Cas9 variant
augagcagacccuacaacaucggccuggacauugggaccuccucuaucggauggagcguggucgaugaccaguccaagcucguuucugugcggggcaaauauggguacggagugcgccuguaugaugagggccaaacagccgcugaaagacggagcuuccgcacgaccagacggcgccuuaagagacggaaauggcgccuggggcuccugagagagauuuuugaaccuuacaucacaccggucgacgauaccuucuuucuucggaagaaacaguccaaucugucucccaaggaccagcgcaagcucuauccucagacaagccuguucaacgauagaaccgaccgggccuuuuacgaugacuaucccacaauuuaccaucugcgcuacaaacucaugaccgagaagagacaauucgauauccgggaaaucuaucuggcgaugcaccacauugugaaauacagaggacauuuucuuaaugaggcuccuguuuccagcuucaagucuuccgagaucaaccugguggcccacuuugaccgccucaauacgauuuucgccgaucuguuuagcgaaucuggcuuccagcuugagaccgacaaacuggcugaagucaaggcccuccugcuggacaaccaucaguccgcuagcaaucggcagagacaagcccuccugcuuaucuauacacccucuaccaacaaggcgguggagaaacagaauaaggccauugcuacagagcugcucaaagccauccugggccuuaaggcuaaauuuaacguucugaccgggauugaagccgaggaugugaagacguggacacucaccuucaaugcggaaaacuucgacgaggaaauggucaaacuggaguccagccuggaugacaaugcccaccagaucaucgagucccuccaggaacuguacucuggagugcuucuggcuggcauugugccugagaaccaaagccucucccaggccaugaucacaaaguaugaugaccaccagaagcaucugaaaaugcuuaaggcuguccgcgaagcccuggccccggaggaucggcaaagacucaaacaggcuuacgaccaguauguugaugggcaggaaaauaccaaggcguacagcaaagaggacuuuuacggagauauuaccaaggcccugaagaacaaccccgaccacccuaucgugucugagauuaaaaagcugaucgaacucgaccaauucaugcccaaacagcgcacaaaggauaauggcgcuaucccucaucagcugcaccagcaagagcuugaccggauuaucgaaaaccagcagcaguauuaccccuggcuggccgagcucaauccgaacuccaaaagacaaacgguggccaaguauaagcuggaugaacuggucgcuuuucgcgugccuuacuauguugggccccuuauuaccgccgagcagcagcagcaaagcucugacgcgaaauucgcuuggaugauccggaaggccgagggacagauuacaccuuggaauuuugaugacaaaguggauagacaggccagcgcuaacgaguucaucaagcgcaugaccacaaccgacacguaccuccuggccgaagauguccugcccaaacaaucccucaucuaucagcgguuugaagugcugaaugagcuuaacggccugaagauugacgaucagcccaucacaaccgagcucaagcaggcuauuuucaccgaccuguuuaugcagaaaacaucuguuaccgugaagaauauccaggauuaccuggucagcgaaaagagauacgccucccggccugcgauuacaggccuuagcgacgagaacaaguucaauucucgccucuccacguaucacgaccugaaaaccaucgugggggaugccgucgacgauguggacaagcaggcugaucuggaaaaaugcauugaguggagcacaaucuuugaagacggaaagaucuacucugccaagcucaacgagauugauuggcugaccgaccagcaaagaguucagcuugcugccaaacgguauagaggcugggggcgccuguccgcgaagcuccugacacagaucgugaaugccaacggacagcggauuauggaucugcuuugggacaccacggauaauuucaugagaaucguccauagcgaggacuuugauaaacucauuaccgaagcuaaccaaaugaugcuggccgagaacgacgugcaggacguuaucaaugaucuguacacauccccgcagaacaagaaagcucuccgccaaauccugcuuguggucaaugacauucagaaggccaugaagggccaggcccccgaaagaauccugauugaguucgcucgggaagaugaggugaacccucgccucucugugcagagaaaacggcaaguugagcaggucuaucagaauaucagcaacgaacugcugaauaacaccgagauucgcaaugaacuuaaggaccucuccaacucugcgcugagcaauacaagacuguuccucuacuuuaugcaagggggacgggauauguauaccggcgacucccugaacaucgaucgccuuagcacguacgacaucgaucacauucugccccaaucuuucaucaaagacaauucccucgauaacagagugcuggugagccagcggaugaaucgcucuaaggccgaccaggucccuacagacuuuaccuccguggagcugggccagaaaaugcaaauucagugggaacagaugcuuagagcugggcugaucacaaagaagaaauacgauaaccucacccugaaccccgaccauauuagcaaguaugccaugaaaggauucaucaaucggcagcucguugagaccagacaagugaucaagcuggccacaaaccuucugauggagcaguacggcgaagauaauauugagcucaucacggucaaaucugggcugacccaccagaugcgcacagaauuugacuucccgaagaaccggaaucugaacaaucaucaccacgcuuuugaugccuaucuuaccgcguucgugggacuguaccuccugaagagauauccuaaacucaagcccuacuuuguuuauggcgaguaccaaaaagcuagccagcaggacaaguggcgcaacuucaauuuucugaacgggcuuaaaaaggaugagcugguggacgaaaauacagaggccgucauuuggaacaaagaauccggccucgccuaccugaauaagaucuaucaguucaagaaaauucuggugacccgggagguucaugaaaacagcggagcucuuuuuaaucaaacgcuguacgccgcgaaggaugacaaagccucuggccaagggggaaagcagcucaucccugccaaacaggauagacccacagcccuguauggcggguacuccggaaagaccguggcuuauauguguauuguccgcaucaagaacaaaaagggcgaccucuacaaagugugcgggguggagaccagcuggcuggcccagcuuaagcagcugacagaugaggacuccaaaaaggcuuuccugaagcagaaaaucucuccucaguucaccaaggucaaaaagcaaaaaggcacaauuguuaaggugguggaagacuuugaggucaucgcuccccacauucucaucaaccagcgguucuuugauaauggacaggaacugacgcuuggcagcgcgaccuauaagcauaacgagcaagaacugauucucgacaaaacagccgugaagcugcucaauggggcucugccgcuuacccaguccgaggagcuggccgaacagguuuacgaugagauccuggaccaggugaugcacuacuucccucucuaugauacaaaccaauuuagagcuaaacugucugccggaaaggccgcuuucaugaaacuucccuggaaaagccagugggacggcaauaagaugguccagguggggcagcaaguuauccuggaucgcgugcucauuggacugcacgcgaacgccgcugucuccgaccucggcgugcugaaaaucucuacgccccuugggaagaugcagcagccuagcggcauuucccugagcccggauacccagaucauuuaccaaucucccaccggacuguuugaacggagaguugcccuccgggaccuguga

SEQ ID NO: 4271 - RNA, 4107 nt, Artificial Sequence
  Cas9 variant
augagcagacccuacaacaucggccuggacauugggaccuccucuaucggauggagcguggucgaugaccaguccaagcucguuucugugcggggcaaauauggguacggagugcgccuguaugaugagggccaaacagccgcugaaagacggagcuuccgcacgaccagacggcgccuuaagagacggaaauggcgccuggggcuccugagagagauuuuugaaccuuacaucacaccggucgacgauaccuucuuucuucggcagaagcaguccaaucugucucccaaagaccagcgcaagcucuauccucaaacaagccuguucaacgauagaaccgaccgggccuuuuacgaugacuaucccacaauuuaccaccuucgcuacaagcucaugaccgagaaaagacaguucgauauccgggaaaucuaucuggcgaugcaucacauugugaaguacagaggacauuuucuuaaugaggcuccuguuuccagcuucaaaucuuccgagaucaaccugguggcccacuuugaccgccucaauacgauuuucgccgaucuguuuagcgaaucuggcuuccagcuugagaccgacaagcuggcugaagucaaagcccuccugcuggacaaccagcaauccgcuagcaaucggcagagacaggcccucucucugaucuauacacccuccaccaacaaggcgguggagaagcagaauaaagccauugcuacagagcuucugaaggccauccucggccugaaagcuaaguuuaacguucuuacccgcauugaagccgaggaugugaaagcguggacgcugacauucaaugccgaaaacuucgacgaggaaauggucaagcucgagagcucccuggaugacaaugcucaucaaaucaucgagucucugcaggaacucuacagcgggauucugcuugccggaaucgugccugagaaccagucccugagccaagcuaugauuaugaaauaugaugaccaccagaagcaccucaagaugcugaaagccgugcgggaagcccuugcuccggaggauagacagcgccugaagcaggcguacgaccaauaugucgauggccaggaaaauaccaaagccuacucuaaggaggacuuuuacggggauaucacaaaagcucucaagaacaaccccgaccauccuauuguuuccgagaucaagaaacugaucgaacuggaccaguucaugcccaagcagcggaccaaagauaauggagccauuccucaccaacuccaucagcaggagcuggacagaaucauugaaaaccagcaacaguauuaccccuggcuugccgagcugaauccgaacagcaagcgccagaccguggcuaaauauaagcucgaugaacugguggccuuucgggucccuuacuaugugggcccccugaucacagcggagcagcaaagacagucuagcgacgcuaaguucgccuggcuuauucgcaaagccgaggggcggaucacgccuuggaauuuugaugacaagguugauagacaggcuuccgccaacgaguucaucaaacggaugaccacaaccgacacauaccuccuggcugaggaugugcugcccaagcaaucucucauuuaucagcgcuuugaaguccugaaugagcuuaacggacugaaaaucgacgaucagcccauuaccacggagcucaagcaggccaucuucacagaccuguuuaugcaaaagaccagcguguccguuaaaaauauucaggauuaccuggugagcgaaaagagauacgcgucucggccugccaucaccggccuuuccgacgagaacaaauucaauagcagacucucuacauaucacgaccugaaggcuauugucggcgaugccguggaagacgucgauaaacagguggaccuggagaagugcguugaaugguccaccaucuuugaggaugggaaaaucuacagcgcuaagcucaacgagauugacuggcugacagaucagcaacgcgugcagcuugccgcgaagcgguauagaggauggggccgccuguccgccaaacuccugacgcagaucgucaaugcuaacgggcagagaauuauggaccugcuuugggauaccacagacaauuucaugcggaucgugcacucugaagauuuugacaagcucauuaccgaggccaaccaaaugaugcuggcugaaaacgauguucaggacgugaucaaugaccuguacacaagcccgcagaacaaaaaggcccuccgccaaauccugcuugucgugaaugauauucagaaagccaugaagggacaggcucccgagagaauccugauugaguucgcgcgggaagacgaggugaacccucgccucuccguucagagaaagcggcaagucgaacagguguaucagaauaucucuaacgagcugcugaauaacaccgaaauucgcaaugagcuuaaagaucucagcaacuccgcccugagcaauacgagacuguuccucuacuuuaugcagggcgggcgggacauguauaccggagauucucugaacaucgaccgccuuuccacauacgauaucgaccauauucugccccaaucuuucaucaaggauaauagccucgacaacagagugcuggucucccagaaaaugaaucggagcaaggcugaucaggugccuaccgacuuuacaucuguugaacugggcaaaaagaugcagcuucaaugggagcagaugcugagagccggccucauuaccaagaaaaaguacgacaaccugacgcucaaccccgaucacaucagcaaauaugccaugaagggguucauuaaucgccagcugguggagacacggcaggucaucaaacuugcuaccaaccugcucauggaacaauacggagaggacaauaucgaacugauuacagugaaguccggccugacccaucagaugagaaccgaguuugauuucccgaagaaccgcaaucuuaacaaucaccaucacgccuuugacgcguaucugacagcuuucguugggcucuaccugcucaaacgguauccuaagcugaaacccuacuuuguguauggagaguaccagaaggccagccaacaggauaaauggagaaacuucaauuuucuuaacggccugaagaaagacgaacucgucgaugagaauacggaagccgugaucugggacaaggagucugggcuggcuuaccugaacaagauuuaucaguucaaaaagauccuuguuacccgcgaagugcacgaaaauuccggcgcccuguuuaaccagacacucuacgcggcuaaagaugacaaggccagcggacaaggcgggaaacagcugauuccugccaagcaggaucggcccaccgcucucuauggaggcuacuccgggaagacagucgccuauauguguaucgugagaauuaaaaauaagaaaggagaccuguacaaggugugcggcgucgagaccucuuggcuugcucagcugaaacaacugacggaugaagacagccagaaggccuuccucaagcagaaaaucuccccucaguucacaaagguuaaaaagcaaaaagggaccaucgugaagguggucgaggacuuuaaggugauugcgccccauauccugauuaaccagcgcuucuuugauaacggccaggaacuuacccugggaucugccacauauaaacacaaugagcaagaacucauccuggacaagaccgcuguuaaacuccugaacggcgcccuuccgcugacacagagcgaggagcuggcugaacagguguacgaugagauucucgaccaggucaugcauuacuucccucuguaugauacgaaucaauuucgggccaagcuguccgccgggaaagcugcguucaugaagcugcccuggaagucuaucugggacggaaacaaaaugacccagaucggccagcagauuauccucgaucggauucugaucgggcuccacgccaaugcugccgugagcgaccugggaguucuuaagauuuccacaccccugggcaaaaugcaacagccuagcgggaucucucuguccccggauacccagaucauuuaccagagccccacaggccucuuugaaagacgcguggcccugagagaccuuuga

SEQ ID NO: 4272 - RNA, 4107 nt, Artificial Sequence
  Cas9 variant
augguggagaagaaaagcuacuccaucggccuggacauugggaccaacucugucggaugggccguuaucacagaugacuauaaggugcccgcuaaaaagaugaaagugcucggcaauacgagcagacaguccauuaagaagaacaugaucggggcccugcuuuucgaugaaggaggcccugcggcuucuacccgggucaaacgcacaaccagacggcgcuacacaagacggaagaaucgccugugcuaucucagagacauuuuugagagcgaaaugcacaccaucgauaaacauuucuuucugcggcuugaggacuccuuccugcacaagucugauaaacgcuacgaagcccauccgaucuuugggacacuccaagaggagaaggccuaucacgacaacuaccccaccauuuaucaucugagaaaggcucuggccgauaauacggaaaaagcugaccuccggcugaucuaccuugcccuggcgcacauuaucaaguuccgcggacacuuucucauugagggcgcccugagcgcuaacaauaccgaugugcagcagcuuguucaugcccugguggacgcuuacaacaucauguucgaagaggaucagcucgacauugaggccaucgacgucaaagcgauccugacagaaaagauuuccaaaaccagacggcuggagaaucucaucagcaacauuccuggccaaaagaaaaaugggcuguuuggaaaccuuaucgcccugucucucggccugacacccaauuucaagucccacuuuaaccuuccugaagaugcuaagcugcagcucgccaaagacaccuaugaugaggaacugaauaaccugcucacgcagauuggggacgaguacgcugaucuguuccuuagcgccaagaaccugucugacgccauccuccuguccgauauccuuacagugaauggagacggcacccaggcuccccugagcgcgucucucauuaaacgcuaugaggaacauagacaagaucuggcccugcucaagcagauguuuaaagagcagcugccugaccuuuaccgggauguuuucacagacgaaaacaaggacggguaugcuggauacaucuccggcaagaccagccaggaggccuucuauaaauacauuaagccgauccuggaaacccucgauggcgccgaggacuuucugacaaaaauuaauagagaggauuuccugcgcaagcaacggacguuugacaacggguccaucccccaccagauccaccuuggagaacuccaggcuauucuggagagacaacaggccuacuauccuuuccugaaagauaaucaggaaaagaucgagaagauucucaccuuucgcauccccuacuauauuggcccucuggcgcgggggaacucuagauucgcuuggcuuacacgcaccagcgaccagaaaaucacacccuggaauuuugaugaaaugguggaccaagaggccuccgcccaggcuuucauugagcggaugaccaacuuugaugaauaccugccgcaggagaagguccucccuaaacauagccugacguaugaauacuucacaguguauaaugagcugaccaaggugaaauacgucaccgagggaaugacaaagcccgaauuucuuucugccggccagaaggagcaaaucguugaacuccuguucaaaaaguacagaaaagugaccgugaagcagcugaaagaggacuuuuucuccaagaucgaauguuucgauacagucgacauuagcgggguggaggauaaauuuaacgcuucucucggaacguaucacgaccugcuuaagaucauuaaggacaaagccuuccuggauaauagcgagaacgaaaauaucauugaggacaucauccucacccugacacuguuugaagauaaggagaugauugcgaaccgccuugccguuuacgaagaccucuucgaucagaaugugcugaaacagcugaagcggagacauuauaccggcuggggccgccucuccaaacaacugaucaacgggaugcgggacaagcacacaggaaagaccauucuugauuuucugaaagcugacggcuucaucaacagaaauuuuaugcagcucauuaacgaugacaaucugucuuucaaggaggagaucaaaaaggcccaggaagggggacugaaagauagcaucaacgaccagauucgggaucuugcuggcuccccugccaucaagaaggggauucuccaaacgaucaauauugucgacgagaucgugaaaaucaugggcaaggcgccccagcauauuguuguggaaauggcccgcgacguccagaaaaccgauaucggagugaagcaaagcagagagcggaugaaaagaguccaggaagugcugaagaagcugggcucucagcuccugaaagagcaccccguugagaacuuucagcuucaaaaugaacgccuguaccucuauuaccugcagaacgggaaggacauguauacaggagaggaacuguccauuagcaaucuuucucacuacgauaucgaccauauuaucccucgguccuucauuaaagaugacagcaucgauaacaaggugcugaccagauccgagcacaaucgcggcaaaacagacaacgucccgucuaucgaggugguuaagagaaugaaacccuacuggcagaagcuccuggauaccaaggugauuagccagcggaaauuugacaaucucacgaaggcugaacgcgggggacugcaagaguccgauaaagccaacuucauccagagacagcuugucgaaacacggcagauuaccaagcauguggcucaaauccuggacucucgcuuuaauacagagagagacgaaaaagaucggccuauucgcagagugaagguuaucacccucaagagcaaauucgucuccgacuuccggcaggauuuuggcuucuauaagcugcgcgagaucaacgacuaccaccacgcccaugaugccuaucugaacgcugugguggggaccgcgcuucugaaaauguaccccaagcucgccagcgaguuugucuauggcgacuaccagaaauaugaucugaagagaauggugggaaagucuggcaaagccuccgggcacgccacagccaaguacuucuuuuacagcaaucucaugaacuucuuuaaaucugaaguuaagcuggcuaauggaaacauuaucaaacgguccccuauugaggugaaugaagagacgggcgaaaucgucugggacaagaccaaggauuucgggacagugagaaaaguucuuagcgcuccccaagugaacauugucaagaaaaccgagauccagacaggaggcuuuucuaaugagaccauccugagcaaggggaaauccagcaagcucauuccgcgcaagaacaaauggcgggacacgacaaaguauggcggauucaauaccccuaccguggcguacucuguucugguggucgcuaaaguggaaaagggcaaagccaagaaacugaagcccgugaaggagcuugucgggaucacaauuauggaaagaaccaaauuugaggccaacccuaucgcuuuccuggaauccaagggauaucaugauauucaggagcaccucaugaucacacugcccaaauacagccucuucgagcuggaaaauggccgccggagacuucuggccuccgcgacggagcugcagaaggggaacgaaaugguucucccucaacaucuggugaccuuucuuuaucgcgugucuaaacgggacaagggaacacagagcgagaauauggaguacauuuccaaccacaaggaaaaauucaucgagaucuuucacuauauuaucagauacgcugaaaagaaugucauuaaacccaaggugaucgagcgccugaacgauaccuucaaccagaaauuuaaugacucugaccucacagaacugagcauuuccuuccucaaccuguuuaaguucaccucuuuuggcgccccggagaaguucacguuucuuaauagcgagaucaaacaggaugacguucgguacagauccaccaaggaaugccugaacagcacacugauccaucaaucugugaccgggcucuaugagacacggauugaucugucccaguucggcggagacuga

SEQ ID NO: 4273 - RNA, 4107 nt, Artificial Sequence
  Cas9 variant
auggacaagaaauacagcaucggccuggauauugggaccaacuccgugggaugggccgucaucacagacgauuauaagguucccucuaaaaaguucaaagugcugggcaauacggacagacacagcauuaagaagaaccugaucggggcgcuucuguuugauuccggagagaccgccgaagcgacacggcucaaacgcaccgcuagacggcgcuacacaagacggaagaaucgcauuugcuaucugcaggagaucuucucuaacgaaaucgccaaaguggacgauagcuuuuuccauagacuugaggaauccuuucuggucgaggaggacaagaaacacgaacggcauccuauuuucggcaauaucguggaugagguugccuaccacgaaaaguauccgaccauuuaccaucuccgcaagaaacuggcugacucuacagauaaggccgaccugagacucaucuaucuggcucuugcccacaugauuaaauuucgggggcacuuccugaucgagggagaucucaaccccgacaauagcgacguggauaagcuguuuauucaacuuguccagaccuacaaccagcuguucgaggaaaauccuaucaacgcgucccgcguggacgccaaagcuauccucagcgccagacugucuaagucccggcgccuggagaaucucauugcucagcugcccggcgagaaaagaaacggccuuuuugggaaucugaucgcccucagccugggacuuacgccuaacuucaagucuaauuuugaucuggcggaagacgccaagcuccaacuguccaaagauaccuacgacgaugaccuggauaaccuccuggcucagauuggcgaccaguaugccgaucuuuuccuggcugccaagaaccucagcgacgccauccugcuuucugacauucugcggguuaauacagaaaucaccaaagcuccccucuccgcgagcaugaucaagagauacgaugagcaucaccaggaccugacacugcucaaagcccuggugcgccaacagcuuccugagaaguauaaggaaauuuucuuugaucaguccaaaaacggguacgcuggauauaucgacggcggggccucucaggaggaguucuacaaguuuauuaaaccgauccuggaaaagauggauggaaccgaggaacuccuggccaaacugaaucgggaggaccuucucagaaagcaacgcacguucgauaacggcagcauuccccaucagauccaccugggcgaacugcacgcuauccuccggagacaggaggacuuuuauccuuuccugaaggauaaucgcgagaaaauugaaaagauccuuacauuucggauucccuacuacgucgggccucuggccagaggaaacucccgcuucgcguggaugacccggaaaagcgaagagacaaucacccccuggaauuuugaggaagugguggacaagggcgcuucugcccaauccuucauugagagaaugaccaacuuugauaaaaaucucccgaacgaaaagguccugccuaagcauagccugcuuuaugaguacuucacaguuuauaaugagcucacgaaagugaaguacgugaccgaagggaugcgcaaacccgccuuucugucuggagagcagaagaaagcuaucgucgaccugcuguucaagacaaaccggaaagugaccguuaagcagcugaaggaagauuauuucaaaaagauugaguguuuugacagcguggaaaucuccggcgucgaggacagauucaaugccucucuugggacauaccacgaucugcucaaaaucauuaaggacaaagauuuucuggacaacgaggaaaaugaggauauccuggaagacauugugcuuacccucacgcuguucgaggaucgggaaaugaucgaggagcgccugaagacauaugcucaucucuuugacgauaagguuaugaaacagcugaagagacggagauacaccggauggggccgccuuagccggaaacugauuaacggcaucagagacaagcaauccgggaaaaccauccucgauuuccucaagagcgacggauuugccaaccgcaauuucaugcagcugauucacgaugacucucuuacauuuaaggaagaccuccagaaagcucagguguccggccaaggggauagccugcaugagcacaucgccaaccuggcuggaucuccugccauuaagaaaggcauccuccagaccgucaagguggucgacgaacuggugaaaguuauggggagacacaagcccgagaauauugugaucgaaauggcucgggagaaccagacaacgcagaagggccagaaaaauucccgcgagagaaugaagcggaucgaagagggaauuaaagaacuuggcagcgauauccugaaggaguaccccgucgagaccacacaacuccagaacgaaaaacuguaucuguacuaucuucagaaugggcgcgacauguacguggaucaagagcuggacauuaacagacucuccgauuaugacguugaucauaucgugccucagucuuuccugaaggacgauagcauugacaauaaaguccucacccgguccgacaagaaccgcggaaagucugauaaugugccgagcgaagaggugguuaaaaagaugaaaaacuacuggaagcagcugcuuaaugccaaacugaucacacaaagaaaguuugacaaccucaccaaggcggaacggggcgggcuguccgagcuggauaaagccggauucaucaagcgccagcuugucgagacgagacagauuaccaaacacguggcucagauccuggacagccggaugaauacaaaguaugaugaaaacgacaaacucauuagagaggugcgcgucaucacccugaagucuaagcucguguccgauuuucggaaagacuuccaauucuacaagguuagagaaauuaacaauuaccaucacgcccacgaugcuuaucugaacgccguggucggcacagcccuuaucaaaaaguaccccaaacuggagagcgaauuuguguauggggacuacaagguuuaugauauucgcaagaugaucgcuaaaucugagcaggagaucggcaaggcgaccgccaaauacuucuuuuauuccaauauuaugaacuucuuuaagacggaaaucacacucgcuaauggagagauucggaaaagaccucugaucgaaaccaacggcgagacaggggaaauugugugggacaagggacgcgauuucgccaccguccggaaggugcugagcaugccccagguuaauaucgugaaaaagaccgagguccagacaggcggguuuucuaaagagagcauccuuccuaagagaaacuccgacaaacugauugcccgcaagaaagacugggaucccaagaaguacggaggcuucgacagcccgacgguggcuuacucugugcucgucguugccaaaguggaaaaggggaaauccaagaaacucaagagcgugaaggagcuggucggcaucaccauuauggaacgguccucuuuugagaaagauccuguggacuuccuggaggcgaagggauauaaagaaguuagaaaggaucuuaucauuaaacugcccaaguacagccuguuugagcucgaaaauggccggaagcgcaugcuggcuuccgccggggagcuucaaaaaggaaacgaacuggcccucccuucuaaguaugugaauuuccuguaccucgcuagccauuaugagaaacugaagggcucccccgaggacaacgaacagaaacagcuuuucgucgagcagcacaagcauuaccuggaugaaaucaucgagcaaauuucugaauuuagcaagagagugauccuggccgacgcgaaucucgauaaaguucuguccgcuuauaacaagcaccgggacaaaccuauucgcgagcaggccgagaauaucauucaucuuuucacacugaccaaccucggggcccccgcugccuuuaagugcuucgauacaaccaucggaagaaaccgguacaaaagcauuaaggaagugcuggacgcuacgcucauccaccagucuaucacaggccuguacgagaccagaauugaucuuucccaacucgggggcgacuga

SEQ ID NO: 4274 - RNA, 4107 nt, Artificial Sequence
  Cas9 variant
auggacaagaaauacagcaucggccuggauauugggaccuccucuaucggauucgugggcgucgacgagaacggguggccccucaauauuaagggaaaaagagccaucggcgcucaccuguuucgggaaggggaggccgcggcugaaacacgcggauucagaacgacccggcgcagauauaaccggcgcaaguggagacuucggcugcuccgcgagauuuuugaugaaccuaucagcagaguugacccgacauucuuugcccggaugaaagaguccucugugagccccaaggauccuaauuacgacggccuggccaaggagauccuuauuccccgcgauaaagacggcaagauccuguauccuaccauuuaccaucucagacacgcucugauguaugaagaucaucaguucgacauccgggagauuuaccuggccauccaccauauugugaaauaucgcgggcacuuucuccuggauggagcugccaagaacuucgaauccucuaaucuugaccugaaaagcgauauccacgagaucaacgcgauucucgucggcaucuuugggaaugagcaagugcaguucaacgaccaguacguugaaaagcugaaggaggugcuucuggacuccacacagagcagaucugaucggcaaaaagccgcugccaagcuccugcugcccaccaaugaccucgauaaagacacaaccaagauucugaaaacggucuccaccgaaaucacaaaggcuauuaccggacuuaaagccaaguuuuucgugaucacaggcaacgauaucgcgaaggaccagcagaaagauuggaccuuuagcauugacacgcuggaugagaagaugucuguuaucgaaccuuccuucagcgagaaaaauuucucucucauuacaauccugcagaaacuuuacuccagcgugacccuggccgggauugucccgaacggacucucccugucugaggcuaugauccaaaaauaugacagacaugccagcgaucuggugcuccugaagaaguacugggacacaaaacccaaggugcuuaaacaccagcugcagaauaccuaugcugaauacaucgagauucaucaggucguugacgaauuuuauuccgaucucagcaagcugaucaaaaacgacgaugacacccuugcccaagagauuaagucuaagaucacaauuggcaauuuccugccuaaacagcgcacgaccgaaaacggcgugauccccuaccagcuccaacagcgggagcuggauacaauuaucaagaaccagcaggaguauuacccuuggcuggccgaagagaaucccguggcugaccaccaaaucgcguuuccguacaaacucgaugaacuggucggguuccgcauuccuuauuacgugggacccaugaucgccaaggaggacaccuccaacagcaaaaauucuaaguuugcuuggaugauuagaaagcagagcggcgaaguuacaccuuggaacuucgaugagaaaaucgaccggaccgccuccgccacggcuuuuauugauagaaugacaaccaccgacacauaucuuaucggggaggaugugcugcccaagcagucucucaucuaccagcgcuucgaaguccugaaugagcugaacaaaauuagcaucgacggacaacccauuacccggaagcagaaacaguccguguauacacacguuuuugaaaagaaaaagacggugcaggucaaggacgugcaaaaauuccuugucagcucuggcgaggugaugucccucccuaagaucgggggacuggccaaugagaaacaguuuaacagcucucuguccacccucuacgauuauaauaagauuaucccggacgcgcuggaagauagaaacaaaguugacgauaucgagaagauuauccuuuggagcacaauuuucgaagacaauuccaucuuuguggagaagcuggauucuauugacuggcucaccagcucccagcgcaaacggcuggcucagaagagauaccgcggcuggggccggcugucucuuagacuccugacaaccuucaaaaacaaggauggguacagcauccuggacgaacucuggaacuccaaucauaauuucauggagauccaagcccagagcgauuuuucugagcagauugccacggcuaacaacaauaaccugucccaaguccuucccgccaaaugggaaccuggacggaagaaucuggcuagccucgacgaguucaucucuaaccuguauaccagcccccagaauaagaaagcccugcgcaaggcgauuagagugguucaggauaugaugacagccgcuggccacaugccugaaaagaucuuuauugagguggcccgggacaccuccaacucucaucagcaaacaaucgcuagacagcgccagcuucagcaacucuaccagagcgaagacaaggaggucauugauuccagcgugcggucugagcuggacgauauccugaaaaauagagccaacaucaaggaccagcuguuccucuauuuucagcaagggggacgcgaucuuuacaccggcaaggcgauuaauaucgacaaacugucccucuaucacauugaucauauccugccccagagccuggugaaggacgauucccuugacaacagaguucucgucucucagaaaacgaaugaagauaagggggugacauucgugagcgacaaauacaugaacaauaugcugccgaccuggaagcgguggcacgagaugggccugauuuccgcccgcaaacucaagaaccugacaaugagaccugacgaaaucgauaaguaugcucccggauuuauccaacggcagcuugucgagacccgccaggugaccaaacugguuauugaacuccuggacgcccugcuuggcaauucucagacagagaucauuacgaucaaggcuagccugucccaccaauucagacagcaguuugaucucgugaaaauucgggaggucaacgacaaccaucacgccuucgaugccuuucuggcugcgcgcaucgggaccuaccucuacaagagauauccuaaacugcggcccuacuucguguauggacaguacaugcaaaaucauaagaaccuuaagucuaucaaucugauuaaaacacucgacagcgauaaggccaucguugacgaaggcaccggggagauucugugggauaaaaaguccgaccuggcuaaaaugaucaagauuuauaacuaccagcgccuucugaucacacacgaaagcagaaccucuuuuggagccauguauaagcagaaaauucucaaggccacggaugcuaaacagaauggcgggggcuucaagcuggugccuacaaaacggaacagacccgucgacaucuacggaggcuacaccgggcaaaccgccgcguaucucacaaucgugcgcguuuacuccaagaagaccagcgagcugcgggugcuuccgauuuauacaaauaaaguccagcagaucgagaaggcuaugacgcagggagauaaagccaccaugcuggccuucaagaaagugauugcuccucaacucggcaaggaaaacaagaaaacacacgagaucaagauucccgaauuugacguggucauccccaaaguucugcuggaccagcuugugaucgaugacauugccgggucuccucauagauuccgccugggaaccgauacauacuaucacaauucccagcaacucuuucugccgcucagcaugcagcggcagcugauggacagagagucugaugacaagguguaccuugauaucuucaacgacguccugaaacagguggauuccuauuuuaaucuguacgacguuaacggcuuccgcgcggcucuccaaaagagcaaaaaggccuuugaacagcugcccauuaaugauuucccuaaggacgugcccgauaacaaaaagaaaaaggggaaacgguccauccuuaaggagauuuuuaucggccugcaugccaaugcuacccucggaaaccugaagcagaugggcaucaaaacggacuucgggaagcuccagaaaagcaacggacugagaauuaccgagaauugcaagaucauucaccaaucuccuacaggccuuuuugaacgcaucguccccauuaaauga

SEQ ID NO: 4275 - RNA, 4107 nt, Artificial Sequence
  Cas9 variant
auggacaagaaauacagcaucggccuggauauugggaccaacuccgugggaugggccgucaucacagacgauuauaagguucccucuaaaaaguucaaagugcucggcaauacggacagacacagcauuaagaagaaccugaucggggcccuucuguuugauuccggagagauugccgaagcgacccggcucaaacgcacagcuagacggcgcuacaccagacggaagaaucgcaucugcuaucugcaggagaucuucucuaacgaaauggccaaaguggacgauagcuuuuuccauagacuugaggaauccuuucuggucgaggaggacaagaaacacgaacggcauccuauuuucggcaauaucguggaugagguugccuaccacgaaaaguauccgacaauuuaccaucuccgcaagaaacugguggacucuaccgauaaggcugaccugagacucaucuaucuggcccuugcucacaugauuaaauuucgggggcacuuccugaucgagggagaucucaaccccgacaauagcgacgucgauaagcuguuuauucaacuugugcagacauacaaccagcuguucgaggaaaauccuaucaacgccuccggcguugacgcgaaagccauccucagcgcucgccugucuaaguccagacggcuggagaaucucauugcccagcugcccggcgaaaagaagaacgggcuuuuuggaaaucugaucgcucucagccugggccuuaccccuaacuucaagucuaauuuugaucuggccgaggacgcgaaacuccaacuguccaaggauacguacgacgaugaccuggauaaccuccuggcccagauuggggaccaguaugcugaucuuuuccuggccgcuaaaaaccucagcgacgccauccugcuuucugacauucugcgccucaauuccgaaaucaccaaggcuccccugagcgcuuccaugaucaaaagauacgaugagcaucaccaggaccugacacuccugaaggcgcuugugcggcaacagcugccugagaaguauaaagaaauuuucuuugaucagucuaagaacggauacgccggcuauaucgacgggggagcuagccaggaggaauuuuacaaauucauuaagccgauccucgagaaaauggauggcaccgaggaacugcuggccaaacuuaauagagaggaccuccugcgcaagcaacggacauucgauaacggcuccauuccccaucagauccaccugggggaacuccacgccauccugagacgccaggaggacuuuuauccuuuccuuaaagauaaucgggaaaagauugagaaaauccugaccuuucgcauucccuacuacgucggaccucucgcuagaggcaacagccgguucgccuggaugacgagaaagucugaagagacaaucacccccuggaauuuugaggaagugguggacaaaggggcguccgcucaaucuuucauugagcgcaugacaaacuuugauaagaaucugccgaacgaaaagguccugccuaaacauagccuucucuaugaguacuucaccguuuauaaugagcugaccaaggugaaauacgugacagaaggaaugcggaagcccgccuuucugagcggcgagcagaaaaaggccaucgucgaccuccuguucaaaacgaacagaaaggugaccguuaagcagcuuaaagaagauuauuucaagaaaauugaguguuuugacuccguggaaaucucuggggucgaggaccgcuucaaugcuagccugggaacauaccacgaucuccugaagaucauuaaagacaaggauuuucuggacaacgaggaaaaugaggauauccuugaagacauugugcucacccugacacuguucgaggaucgggaaaugaucgaggagagacucaagaccuaugcccaucuguuugacgauaaaguuaugaagcagcuuaaacggcgcagauacacgguguggggccggcuguccagaaagcucauuaacggcauccgcgacaaacaaagcgggaagacaauccuggauuuccugaagucugacggauuugcuaaccggaauuucaugcagcuuauucacgaugacucccucaccuuuaaagaagacauccagaaggcccaggucagcggccaaggggauucucugcaugagcacauugcgaaccuggccggauccccugcuaucaaaaagggcauucuccagaccgugaaagucguggacgaacugguuaaggugauggggagacacaagcccgagaauaucgucaucgaaauggcccgcgagaaccagacaacccagaaaggccaaaagaauagcagagagcggaugaaacgcauugaagagggaaucaaggaacuuggcucccagauucugaaagagcaucccguggagaacacacagcuccagaaugaaaagcuguaccuguauuaccuucaaaacgggagagauauguauguugaccaggagcuggauaucaaucggcucucugacuacgauguggaccacauugucccucagagcuucaucaaagaugacuccaucgauaacaaggugcugacgcgcucugacaagaauagaggaaaaagcgacaacgugccguccgaagagguugucaagaaaaugaagaauuauuggcggcaacuccugaacgcuaaacuuauuacccagcgcaaguuugauaaucugacaaaggccgaaagaggcgggcucagcgagcuggacaaagcgggauucaucaagcggcagcugguggagacccgccagauuacaaaacauguggcccaaauccuugauucuagaaugaacaccaaguacgacgaaaacgauaaacugauucgggaggucaaggugaucacgcucaaguccaaacugguuagcgacuuuagaaaggauuuccaguucuauaaagugcgcgaaauuaauaacuaccaccacgcucaugacgccuaccucaaugcugucgugggcaccgcccugaucaagaaauaucccaaacuugagucugaauuuguuuacggggauuauaagguguacgacguccggaagaugcuggccaaguccgagcaggagaucggcaaagcuacagcgaaguauuucuuuuacagcaacauuaugaauuucuuuaaaaccgaaaucacacucgccaacggagagauuagaaagcgcccucugaucgaaaccaauggcgagacgggggaaauugugugggauaagggacgggacuucgcuacaguuagaaaagugcugucuaugccccaggucaacaucgugaagaaaaccgaggugcaaacaggcggguuuagcaaggaguccauccuuccuaaacgcaauagcgauaagcugauugcccggaaaaaggacugggaccccaagaaauauggaggcuucgauucuccgaccgucgccuacuccguucucgugguggcuaaggucgaaaaaggcaagagcaaaaagcugaaguccgugaaagagcuccuggggaucaccauuauggaaagaucuagcuuugagaagaacccuaucgacuuccuugaggccaaaggauacaaggaaguucgcaaagaucugauuaucaagcugcccaaguauucccucuuugagcuggaaaauggccggaaaagaaugcuugcgucugcuggggagcugcagaagggaaacgaacucgcccugccuagcaaauacgugaauuuccucuaucuggccucccacuacgagaaacuuaagggcucucccgaggacaacgaacagaagcagcuguucgucgagcaacauaagcacuaucuggaugaaaucauugagcagaucagcgaauuuuccaaacgggugauucucgcugacgccaaucuggauaagguucuuagcgcguacaacaaacaucgcgacaagccuaucagagagcaggcugagaacauuauccaccuguucacacucacgaaucugggggcccccaccgccuuuaaauauuucgauacaaccauugaccggaagcgcuacacaucuaccaaagaagugcucgaugcuacguuuauccaccaauccaucacaggacuguacgagaccagaauugaccuuagccagcugggcggggauuga

SEQ ID NO: 4276 - RNA, 4107 nt, Artificial Sequence
  Cas9 variant
auggacaagaaauacagcaucggccuggauauugggaccaacuccgugggaugggccgucaucacagacgauuauaagguucccucuaaaaaguucaaagugcucggcaauacggacagacacagcauuaagaagaaccugaucggggcccuucuguuugauuccggagagaccgccgaagcgacacggcucaaacgcaccgcuagacggcgcuacacaagacggaagaaucgcauuugcuaucugcaggagaucuucucuaacgaaauggccaaaguggacgauagcuuuuuccauagacuugaggaauccuuucuggucgaggaggacaagaaacacgaacggcauccuaucuucggcaauauuguggaugagguugccuaccacgaaaaguauccgaccaucuaccaucuccgcaagaaacugguggacucuacagauaaggcugaccugagacucauuuaucuggcccuugcucacaugaucaaauuucgggggcacuuccugauugagggagaucucaaccccgacaauagcgacgucgauaagcuguuuauccaacuugugcagaccuacaaccagcuguucgaggaaaauccuauuaacgccuccggcguugacgcgaaagccauccucagcgcucgccugucuaaguccagacggcuggagaaucucaucgcccagcugcccggcgaaaagaagaacgggcuuuuuggaaaucugauugcucucagccugggccuuacgccuaacuucaagucuaauuuugaucuggccgaggacgcgaaacuccaacuguccaaggauaccuacgacgaugaccuggauaaccuccuggcccagaucggggaccaguaugcugaucuuuuccuggccgcuaaaaaccucagcgacgccauucugcuuucugacauccugcgccucaauuccgaaauuacaaaggcuccccugagcgcuuccaugaucaaaagauacgaugagcaucaccaggaccugacccuccugaaggcgcuugugcggcaacagcugccugagaaguauaaagaaaucuucuuugaucagucuaagaacggauacgccggcuauauugacgggggagcuagccaggaggaguucuacaaauuuaucaagccgauucucgagaaaauggauggcacagaagaacugcuggccaaacuuaauagagaggaccuccugcgcaagcaacggaccuucgauaacggcuccaucccccaucagauucaccugggggaacuccacgccauccugagacgccaggaggacuuuuauccuuuccuuaaagauaaucgggaaaagaucgagaaaauucugacguuuagaauccccuacuacgucggaccucucgcucgcggcaacagccgguucgccuggaugacaagaaagucugaagagaccauuacacccuggaauuuugaggaagugguggacaaaggggcguccgcucaaucuuucaucgagcgcaugaccaacuuugauaagaaucugccgaacgaaaagguccugccuaaacauagccuucucuaugaguacuucaccguuuauaaugagcugacaaaggugaaauacgugacggaaggaaugcggaagcccgccuuucugagcggcgagcagaaaaaggccauugucgaccuccuguucaaaaccaacagaaaggugacaguuaagcagcuuaaagaagauuauuucaagaaaaucgaguguuuugacuccguggaaauuucuggggucgaggaccgcuucaaugcuagccugggaaccuaccacgaucuccugaagaucaucaaagacaaggauuuucuggacaacgaggaaaaugaggauauucuugaagacaucgugcucacacugacccuguucgaggaucgggaaaugauugaggagagacucaagacguaugcccaucuguuugacgauaaaguuaugaagcagcuuaaacggcgcagauacacaggcuggggccggcuguccagaaagcucaucaacgggauucgcgacaaacaaagcggaaagaccauccuggauuuccugaagucugacggcuuugcuaaccggaauuucaugcagcuuauccacgaugacucccucaccuuuaaagaagacauucagaaggcccaggugagcgggcaaggagauucucugcaugagcacaucgcgaaccuggccggcuccccugcuauuaaaaaggggauccuccagacagucaaaguggucgacgaacuggugaagguuaugggcagacacaagcccgagaauauugugaucgaaauggcccgcgagaaccagaccacacagaaaggacaaaagaauagcagagagcggaugaaacgcaucgaagagggcauuaaggaacuugggucccagauccugaaagagcaucccgucgagaacacgcagcuccagaaugaaaagcuguaccuguauuaccuucaaaacggaagagauauguauguggaccaggagcuggauauuaaucggcucucugacuacgauguugaccacaucgugccucagagcuucauuaaagaugacuccaucgauaacaagguccugacccgcucugacaagaauagaggcaaaagcaacaaugugccguccgaagaggugguuaagaaaaugaagaacuauuggcggcaacuccugaaugcuaaacuuaucacacagcgcaaguuugacaaccugaccaaggccgaaagagggggacucagcgagcuggauaaagcgggcuucauuaagcggcagcuggucgagacacgccagaucaccaaacauguggcccaaauucuugacucuagaaugaacacgaaguacgaugaaaaugacaaacugauccgggaggugaaggucauuacccucaaguccaaacuggugagcgauuuuagaaaggacuuccaguucuauaaaguucgcgaaaucaacaauuaccaccacgcucaugaugccuaccucaacgcuguggucgggacagcccugauuaagaaauaucccaaacuugagucugaauuuguguacggcgacuauaagguuuacgaugugcggaagaugaucgccaaguccgagcaggagaucggaaaagcuaccgcgaaguauuucuuuuacagcaauauuaugaacuucuuuaaaacagaaaucacccuggccaauggcgagauuagaaagcgcccucucaucgaaacgaacggggagacaggagaaauugucugggacaagggccgggauuucgcuaccgugagaaaaguucugucuaugccccaggugaauaucgucaagaaaacagaggugcaaaccgggggauuuagcaaggaguccauccugccuaaacgcaacagcgacaaacuuauugcccggaagaaggauugggaccccaagaaauauggcggguucgacucuccgaccguggccuacuccguccugguuguggcuaagguggaaaaaggcaagagcaaaaagcucaaguccgucaaagagcugcucggaaucacaauuauggaaagaucuagcuuugagaagaauccuaucgauuuccuggaggccaaaggcuacaaggaagugcgcaaagaccuuauuguuaagcugcccaaguauucccuguuugagcucgaaaacgggcggaaaagaaugcuggcgucugcuggagagcuucagaagggcaaugaacuggcccucccuagcaaauacgugaacuuccuguaucucgccucccacuacgagaagcugaaagggucucccgaggauaaugaacagaagcagcuuuucgucgagcaacauaagcacuaucuggacgaaaucaucgagcagauuagcgaauuuuccaaacgggugauccuggcugaugccaaccucgacaagguucugagcgcguacaacaaacaucgcgauaagccuauuagagagcaggcugagaauaucauucaccuuuucacgcugaccaaccucggagcccccgccgcuuuuaaauauuucgacacaaccaucgaucggaagcgcuacacaucuaccaaagaagugcuggacgccacguuuauucaccaauccaucacaggccucuacgagaccagaaucgaucugagccagcuugggggcgacuga

SEQ ID NO: 4277 - RNA, 4107 nt, Artificial Sequence
  Cas9 variant
augagcagacccuacaacaucggccuggacauugggaccuccucuaucggauggagcguggucgaugaccaguccaagcucguuucugugcggggcaaauauggguacggagugcgccuguaugaugagggccaaacagccgcugaaagacggagcuuccgcacgaccagacggcgccuuaagagacggaaauggcgccuggggcuccugagagagauuuuugaaccuuacaucacaccgauugacgauaccuucuuucuucggcagaagcaguccaaucugucucccaaagaccagcgcaagcucuauacacaaaccagccuguucaacgauagaacagaccgggccuuuuacgaugacuauccuaccaucuaccaucugcgcuacagacucaugacggagaagcggcaguucgauaucagagaaauuuaucuggcgaugcaccacaucgucaaauaccgcggacauuuucuuaaugaggcucccguguccagcuucaagucuuccgagauuaaccugguugcccacuuugaccggcucaauaccaucuucgccgaucuguuuagcgaaucuggcuuccagcuugagacagacaaacuggcugaagugaaggcccuccugcuggacaaccagcaauccgcuagcaauagacagcgccaggcccucucucugauuuauaccccuuccacaaacaaagcggucgagaagcagaauaaggccaucgcuaccgagcuucugaaagccauucucggccugaaggcuaaauuuaacgugcuuacggggaucgaagccgaggauguuaaggcguggacacugaccuucaaugccgaaaacuucgacgaggaaauggugaaacucgagagcucccuggaugacaaugcucaucaaaucauugagucucugcaggaacucuacagcggaguccugcuugccggcaucgugcccgagaaccagucccugagccaagcuaugauuacaaaguaugaugaccaccagaaacaccucaagaugcugaaggccgugcgggaagcccuugcuccuggggauagacagcgccugaaacaggcguacgaccaauaugucgauggacaggagaauaccaaggccuacucuaaagaagacuuuuacggcgauaucaccaaggcucucaaaaacaacccggaccaucccauuguuuccgagaucaagaagcugaucgagcuggaccaguucaugccuaaacagcggacaaaggauaauggggccauuccccaccaacuccaucagcaggaacuggacagaaucauugagaaccagcaacaguauuacccuuggcuugccgaacugaaucccaacagcaaacgccagacgguggcuaaguauaaacucgaugagcugguggccuuucgggucccguacuaugugggaccucugaucaccgcggaacagcaaagacagucuagcgacgcuaaguucgccuggcuuauucgcaaggccgagggccggaucacacccuggaauuuugaugacaaaguugauagacaggcuuccgccaacgaguucaucaagcggaugaccacaaccgacacguaccuccuggcugaagaugugcugccuaaacaaucucucauuuaucagcgcuuugagguccugaaugaacuuaacggccugaagaucgacgaucagcccauuacaaccgagcucaaacaggccaucuucaccgaccuguuuaugcaaaagauuagcgugacaguuaagaauauccaggauuaccugguguccgagaaaagauacgcgagccggcccgccauuaccgggcuuucugacgaaaacaaguucaauuccagacucagcacauaucacgaccugaaaaugaucgucggagaugcuguggacgaugucgacaagcaggccgaucuggagaaaugcaucgaauggucuacgauuuuugaggacggcaagaucuacuccgcuaaacucaacgaaauugauuggcugaccgaccagcaacgcgugcagcuugccgcgaagcgguauagaggguggggacgccugagcgccaagcuccugacacagaucguuaaugcuaacggccagagaauuauggaucugcuuugggacaccacagauaauuucaugcggaucgugcacuccgaggacuuugauaaacucaucaccgaggccaaccaaaugaugcuggcugaaaacgacguccaggacgugauuaaugaucuguacacgucuccucagaacaagaaagcccuccgccaaauccugcuuguugugaaugacauucagaaggccaugaaagggcaggcuccggagagaauccugauugaguucgcgcgggaggaugaagucaacagccgccucuccgugcagagaaagcggcaaguggagcagguuuaucagaauaucucuaacgagcugcugaauaacaccgaaauccgcaaugagcuuaaggaccucagcaacuccgcccugagcaauacaagacuguuccucuacuuuaugcagggaggccgggauauguauaccggcgacucucugaacauugaucgccuuuccacauacgacaucgaucauauucugccccagagcuucaucaaagacaauucucucgauaacagaguccuggugucccaaaagaugaaucggagcaaagcugaccaggugccuaccgacuuuacgucugucgaacuggggcagaagaugcaaauucagugggagcagaugcuuagagccggacugaucacaaagaagaaguacgauaaccucacccugaaccccgaccacaucagcaaauaugccaugaagggcuucauuaaucgccagcucguggaaacacggcaaguuaucaaacuggcuaccaaccuucugauggagcaguacggggaggauaauauugaacucaucaccgugaaguccggacugacacaucagaugagaacggaguuugacuucccuaaaaaccgcaaucugaacaaucaccaucacgccuuugaugcguaucuuaccgcuuucgucggccuguaccuccugaagcgguaucccaagcucaaaccguacuuuguguauggggaauaccaaaaggccagccagcaggacaaauggagaaacuucaauuuucugaacggccuuaagaaagaugagcugguugacgagaauacagaagccgugauuugggauaaggagucuggacucgcuuaccugaacaaaaucuaucaguucaagaagauucuggucacccgcggcgugcacgaaaauuccggggcccuuuuuaaccaaacacuguacgcggcuaaagacgauaaggccagcggacagggcgggaaacagcucaucccugccaagcaggaccgguccaccgcucuguauggaggcuacucugggaaaacgguugccuauauguguaucgugagaauuaagaauaagaaaggcgaucucuacaaggucugcggaguggagacaagcuggcuggcucaacuuaaacagcugaccgacgaagacucccagaaggccuuccuggagcagaaaaucucuccccaauucaccaaggugaagaaacagaagggcaacauuaucgaggcggucgaagaguuugaaguuauugccccucauauccucaucaaccagcgcuucuuugauaaugggcaagagcugacacuuggaagcgcuaccuauaaacacaacgaacaggagcugauucucgacaagacagccgugaaacugcucaauggcgcucugccccuuacgcaguccgaggaacuggccgaacagguguacgaugaaauccuggaccaagucaugcauuacuucccucucuaugauaccaaccaguuucgggccaagcugucuacagggaaggcugcguucaugaaacuucccuggaaaagccagugggacggaaauaaaauggugcagguuggccaacaggugauucuggauagaauccucauugggcugcacgccaacgcugccauguccgaccucaagguccugaaaaugaccacaccguuuggcaugauccagcagagcaccggaaucacgcuuucugccgauacccaaauuaucuaccaguccccuacaggccuguucgagcggcgcguggcucugagagaccucuga

SEQ ID NO: 4278 - RNA, 4107 nt, Artificial Sequence
  Cas9 variant
auggacaagaaauacagcaucggccuggauauugggaccaacuccgugggaugggccgucaucacagacgauuauaagguucccucuaaaaaguucaaagugcucggcaauacggacagacacagcauuaagaagaaccugaucggggcccuucuguuugauuccggagagaccgccgaagcgacacggcucaaacgcaccgcuagacggcgcuacacaagacggaagaaucgcauuugcuaucugcaggagaucuucucuaacgaaauggccaaaguggacgauagcuuuuuccauagacuugaggaauccuuucuggucgaggaggacaagaaacacgaacggcauccuaucuucggcaauauuguggaugagguugccuaccacgaaaaguauccgaccaucuaccaucuccgcaagaaacugguggacucuacagauaaggcugaccugagacucauuuaucuggcccuugcucacaugaucaaauuucgggggcacuuccugauugagggagaucucaaccccgacaauagcgacgucgauaagcuguuuauccaacuugugcagaccuacaaccagcuguucgaggaaaauccuauuaacgccuccggcguugacgcgaaagccauccucagcgcucgccugucuaaguccagacggcuggagaaucucaucgcccagcugcccggcgaaaagaagaacgggcuuuuuggaaaucugauugcucucagccugggccuuacgccuaacuucaagucuaauuuugaucuggccgaggacgcgaaacuccaacuguccaaggauaccuacgacgaugaccuggauaaccuccuggcccagaucggggaccaguaugcugaucuuuuccuggccgcuaaaaaccucagcgacgccauucugcuuucugacauccugcgccucaauuccgaaauuacaaaggcuccccugagcgcuuccaugaucaaaagauacgaugagcaucaccaggaccugacccuccugaaggcgcuugugcggcaacagcugccugagaaguauaaagaaaucuucuuugaucagucuaagaacggauacgccggcuauauugacgggggagcuagccaggaggaauuuuacaaauucaucaagccgauucucgagaaaauggauggcacagaggaacugcuggccaagcugaauagagaggaccuccugcgcaagcaacggaccuucgauaacggcuccaucccccaucagauucaccugggggaacuccacgccauccugagacgccaggaggacuuuuauccuuuccuuaaagauaaucgggaaaagaucgagaaaauucugacguuuagaauccccuacuacgucggaccucucgcucgcggcaacagccgguucgccuggaugacaagaaagucugaagagaccauuacacccuggaauuuugaggaagugguggacaaaggggcguccgcucaaucuuucaucgagcgcaugaccaacuuugauaagaaucugccgaacgaaaagguccugccuaaacauagccuucucuaugaguacuucaccguuuauaaugagcugacaaaggugaaauacgugacggaaggaaugcggaagcccgccuuucugagcggcgagcagaaaaaggccauugucgaccuccuguucaaaaccaacagaaaggugacaguuaagcagcuuaaagaagauuauuucaagaaaaucgaguguuuugacuccguggaaauuucuggggucgaggaccgcuucaaugcuagccugggaaccuaccacgaucuccugaagaucaucaaagacaaggauuuucuggacaacgaggaaaaugaggauauucuugaagacaucgugcucacacugacccuguucgaggaucgggaaaugauugaggagagacucaagacguaugcccaucuguuugacgauaaaguuaugaagcagcuuaaacggcgcagauacacaggcuggggccggcuguccagaaagcucaucaacgggauucgcgacaaacaaagcggaaagaccauccuggauuuccugaagucugacggcuuugcuaaccggaauuucaugcagcuuauccacgaugacucccucaccuuuaaagaagacauucagaaggcccaggugagcgggcaaggagauucucugcaugagcacaucgcgaaccuggccggcuccccugcuauuaaaaaggggauccuccagacagucaaaguggucgacgaacuggugaagguuaugggcagacacaagcccgagaauauugugaucgaaauggcccgcgagaaccagaccacacagaaaggacaaaagaauagcagagagcggaugaaacgcaucgaagagggcauuaaggaacuugggucccagauccugaaagagcaucccgucgagaacacgcagcuccagaaugaaaagcuguaccuguauuaccuucaaaacggaagagauauguauguggaccaggagcuggauauuaaucggcucucugacuacgauguugaccacaucgugccucagagcuucauuaaagaugacuccaucgauaacaagguccugacccgcucugacaagaauagaggcaaaagcgacaacgugccguccgaagaggugguuaagaaaaugaagaauuauuggcggcaacuccugaacgcuaaacuuaucacacagcgcaaguuugauaaucugaccaaggccgaaagagggggacucagcgagcuggacaaagcgggcuucauuaagcggcagcuggucgagacacgccagaucaccaaacauguggcccaaauucuugauucuagaaugaacacgaaguacgacgaaaacgauaaacugauccgggaggugaaggucauuacccucaaguccaaacuggugagcgacuuuagaaaggauuuccaguucuauaaaguucgcgaaaucaauaacuaccaccacgcucaugacgccuaccucaaugcuguggucgggacagcccugauuaagaaauaucccaaacuugagucugaauuuguguacggcgauuauaagguuuacgacgugcggaaaaugaucgccaaguccgagcaggagaucggaaaagcuaccgcgaaguauuucuuuuacagcaacauuaugaauuucuuuaaaacagaaaucacccuggccaacggcgagauuagaaagcgcccucucaucgaaacgaauggggagacaggagaaauugucugggauaagggccgggacuucgcuaccgugagaaaaguucugucuaugccccaggugaacaucgucaagaaaacagaggugcaaaccgggggauuuagcaaggaguccauccugccuaaacgcaauagcgauaaacuuauugcccggaagaaggacugggaccccaagaaauauggcggguucgauucuccgaccguggccuacuccguccugguuguggcuaagguggaaaaaggcaagagcaaaaagcucaaguccgucaaagagcugcucggacugacaaucauggaaagaucuagcuuugagaagaacccuauugacuuccuugaggccaaaggcuacaaggaagugaaaaaggaucugaucauuaagcugcccaaauauucccucuuugagcuggaaaaugggcgcaagcggaugcuugcgucugcuggagagcugcagaaaggcaacgaacucgcccugccuagcaaguacguuaauuuccucuaucuggccucccacuacgagaaacuuaaggggucucccgaggacaacgaacagaagcagcuguucguggagcaacauaaacacuaucuggaugaaaucaucgagcagauuagcgaauuuuccaagagagucauccucgcugacgccaaucuggauaaagugcuuagcgcguacaacaagcaucgggacaaaccuauucgcgagcaggcugagaacaucauucaccuguucacgcucaccaaucugggagcccccgccgcuuuuaaguauuucgauacaaccaucgacagaaaacgguacacaucuaccaaggaaguucucgaugccacgcugauucaccaauccaucacaggccuuuacgagacccgcaucgaccugagccagcuugggggcgauuga

SEQ ID NO: 4279 - RNA, 4110 nt, Artificial Sequence
  Cas9 variant
augaagagaauccugggccucgaccuggggaccaacagcauuggaugggcccuugugaaugaggcugaaacagucaacgagaaauccucuaucguuaagcugggcgugcgggugaauccccucacggucgaugaacagaaaaacuucgaggccggaaagagcauuccuaccaaugcgggacgcacacugaaaagaggcaugcggcgcaaccuucaaagauacaagcugcggcgcgacuaucucauccagugccugaaggaauacggguggauuaccuccgauacacugcucuaugaguguggaaauagaaccacauuugagaccuaccggcugcgcgcuaaagccguggacgaagagaucgcccuugaagaacugggcagaguucuccugaugaucaacaagaaacggggcuauaagucuaaucgcaaagcuaagagcuccgaugaggggcagcuuauugacggaauggccaucgcuauggauauguaccacaacggcacgaccccgggggaauauguguacucucugcucagcaaggggaaaaaguacauucccgucuucuauagauccgaccugcuggaugaguuugaccggaucugggauuaccagugcgccuauuacccugacauucucacaagccaauucaaagaacugauccgcggcaagucuucccaggugaccagcaaacuuuuuaagcagcaguauaaucuguucacagcggauaacaaagagaaggacaagagacuccaagccuacugucggagagcugacgcccugaaaaagcgccuucccguugaagagguggcugccgcgcugugcgaugucaaucgggacgugaacgccucuuccggguaucucggaaccauuagcgauagaucuaaaaagcuguuuuucaauaaacagacggugggccaguaccugaugcucgagcuggacaaggauucccauuuuagcgucaagaacgaaguuuucuaccgccaggacuaucuuaacgaguuugaagcuaucugggagaaacaagccgaauaccacccugagcugacacccgaucggaagaaaauccucagagacguggugauuuucuaucagcgcccucugaagucccagaaagaucuugucgcuuguugcgagcuggaacggagacgcaucgaggugaugaaggacggcaagguucggucuguggaaauugggccgaaagucugucccaagagcuccccucucuuucaagauuucaaaaucuggcaugugcugaauaaccugaagguuagagacaaagccaccggagacgagcgcuuccucgaacuggaugagaaggagauucuuuuuagcgaacuggccaucaagucuaaacucuccaagacagaggcucugaaacugcuuuaccagaagcccaaaggccucgaccugaauuaugauagcguggaagggaacaccacccaggcggcccuguucgaggcuuaccagacagucaucgccaugacgggacacggcgaguauguguuuucuaagaugagcgccuccgaagucaugucugugguugaggggguguucggaggccucggcuuuaauaccagcguccugcgguucgacucccuucugcaagggaaagaacucgagaagcaggauagcuacagacuguggcaucugcuuuacucuuaugaaggagacaacuccgugacaggcaccgaugggcucguugcuaagguggccagccugcugcggugcgacgaggaguacgcgaaagucguggcuggagugacauuucagccugauuauggcucucucuccgccaaggccauucgcagaauccugccccacaugcgggcugggaaugaauacagccuugccugugaguaugcuggcuacaaacacuccagacgcucucugaccaaggaggagcucgaacagaaagacuauaaggaucaucuggagcugcuuccgcggaacagccucagaaauccuguugucgagaagauucugaaccaaauggugaauguggucaacgccgugguugacgcguacggaaaacccgaugaaauccgcauugagauggccagagaacugaagaaauccgcuaaggagcgggaagagaugacggccgcuaucaauaaagccacaucugagcacgaacgcaucaaggagauucucaacaaggaauuuggcauccagcaugugagccacaaugacauugucagauacaaacuguauugcgagcuuaagaacaacggguacaaaacccuguauuccgacaccuacaucccucaggagaagcucuuuagcaaagaaguggauauugagcacauccugccccaggcgcggcuguucgacgauucuuuuuccaauaagacacuugaauaucgcagcguuaacauugagaagucuaaucaaaccgccugggacuacguggcugccaaauggggagaagagggcucccucagauauaagaaacgggucgaugaccugcuggcugccggggugaucggaaagagcaaacaugauaagcuccugaugaaacaggaggacauccccacagauuucauuaaccgcgaccuuagagauacgcaguacaucgcccggaaggcucgcgaaauucuggaggaccucguuccuaugguggucucuaccacaggcgcggugaccgauagacugcgggaagacuggcagcugguggacgucaugcaagagcuuaauugggauaaguacgccaugaaagggcugacagaagaguggaccgacaaggauggcagacgcaucagccggauuaaagaguggacgaagagaaacgaccaccgccaucacgcuauggaugcccucaccaucgccuuuacaaaacauuccuucauccaguaucugaauaaccucaaugcucggagcgacaagucuggauccauuuacgccaucgaacagaaggagcuguauagagauaaccacggcaaacuucgcuucauuaugccguuugaaggguuccggagcgaggcgaagagacaacuggaaaauauccucguuuccauuaaagcuaagaacaaaguggugacccgcaaugucaacaaugcccggagaggaucuggccggcaggccaaggugcagcugacaccccgcgggcagcugcacaacgagaccaucuacggaagcauccauagauauguuacgaaacuugagaaggugggcgggaacuuugacggcgaacaaauugcuaaggucgccaaucugcgguaccgcgaggcgcuccaggcuagacacgaagccuucggaggcgaugccaaaaaggcuuuuacagggaaaaacgcccuggacaagaauccucucuaucugaaggauacccggacagaggugccccuuaaaguuaagaccguguccaccgagacacuguacacgaucagaaaagcugucgccccugaccucaacguggacaagguuauugaugcgaaagugcgcaagguccuggaggaacggcugcaggaauacggaggcgaccccaagaaagccuucgugaaucuugaugagaacccgaucuaucugaauaaggcuaaagggauuaccaucaagagaguggccaucacaggagucaacaaugcuauugcccuccaugacaaaaaggauguuggcgggcacgugaugcuggacgccucuggccgcaaacagccuguggauuuugucaacaccggaaauaaccaccauguggcuaucuaccgggacgcggaaggcagccuccaagagguuguggucuccuucuaugaggccguggcuagaguuucucuggggcuucccgugauugaucgcgaauaccggaaggaggacggauggcaguuucuguucacaaugaagcagaaugaauauuuugucuucccuaaccccgagaccggcuuuaauccucaggaaguggaucugacggacgagacaaacuacgcccucaucagccccaaccuguucagaguccaaaaauucaccauuaaggauuauuucuuccgccaccaucuugagaccacaguggaagacagaaaagagcugaaggacaugaccuggaaacggugugggcucggaggcaucauuggcaucguuaaggugcgcgucaaucacaucgggagaauuguguccguuggagaauacuga

SEQ ID NO: 4280 - RNA, 4110 nt, Artificial Sequence
  Cas9 variant
auggccaagaccuacaacaucggccuggacauugggacaaauagcaucggaugggcuguggucgaugaccagaaccaccucauguccauuaaaggcaaguauggguacggaguuagacuguaugaugagggcaaaacggccgaagaacggcgcucuuucagaaccacacggcgcagacuuaagcggcgcaaauggagacugagccuccugcgggaaaucuuugagccccaaauuaccccucuugacaauacauucuuucugcgccagaagcaguccucucucagcuccaaggauaacagaaaacuguacccggaaaugucucuguucaaugaccggaccgauacagacuuuuauacccaguaccccacgaucuaucaucucagccgcgaucugaugaccaagaacaaacaauucgacaucagagagauuuaccuugcgauguaccacaucgugaaguaucgggggcauuuucugaaugaguccccugugagcucuuucaaauccagcgaaauuaagcucgcugagaacuuugaaacacugaaucagaucuucaacgagcgcuuuaaugagucuauguuccagcuugccgucaacgauuuugacgaucugaaggcccuccugcugaaugaccagcaauccgcuagcaacagacagaaaaaggcccucggaaugauuuacgugcccaaugaaaacaaaucucuggagaagcagaacaaagcuaucgccaccgaacuucugaaggcgauucucggccugaaagccaaguucaauguucuuacaggcaucgagguggacgaugcuaagccuuggacccuguccuucaacagcgaauccuuugacgaggauaucgacaaagccgcuacgaauauugaugacgauucucgggagaucauugccauccuccaggggcuguauagcgggauucugcucgcgggcaucauccccgaaaaccaaucccugagcgaggccauggucgaaaaguacgaccagcacgcugcccaucuuaaacagcugaagucuauuuauccucuccuguccaucagcgauaaaaaggcuauucaacaggccuacaauuauuacaucgacgggcaggauaacgccaaggcuuacucuagagaggacuucuaugcggccacaaccaaagcucuuaagagcuaccaggacaaugaaacaauugccgagauccugaaacucaucgagcuggaacaauuuaugccgaagcagcgcaccaaagauaacggagccauuccccaccagcugcaccagcaagagcucgaacggaucauugagaaucagcagaaguauuacccuuggcuggcugaacuuaaccccaaugaguccagacgcaagaucgccaaauauaagcuggacgagcucguggcguuccggguuccuuacuaugugggcccccugauuaccucugaacagcaacagcagagcuccaacaaaaaguuugcuuggaugaucagaaaagccgaggggaagauuacaccguggaauuucgaugaaaaggucgaccgccaggccagcgcuaacgaguuuaucaaacggaugacgaccacagauaccuaccugcuugccgaggacgugcucccuaagcaaucucugguguaccagagauucgaaguccugaaugagcucaacggaaucaaaauugaugacguucccaucacaguggaacagaagcaacgcauuuuuaacgaucuguucaugaugcaggcuuccgugagcgucaaaaauauccaggacuaucuugugucuaagggcuacuuugccucccggccugagauuaccggccugagcgaugaaaacaaaguuaucuccagacucucuacguaucaugaccugaaggcgauccuugggggaauuguggaugaggccaauaagcaggcugaccuugagaaaugcgucgaauggagcacaaucuucgaggacggcaagauuuuuguggaaaaacucaacgagaucgaauggcugaccgaugagcaacgcaagcggcuguccucuaaaagauaccggggguggggacgccucagcaauaagcugcuuaaccagauuguuaaugagaacggccagagaaucauggaccugcucugggauaccacagacaauuucaugcggaucgugcacuccgaagaguucgauaagcugauuagcgccgcuaaccagacccugcuuucuaaaaaugacguccaagaugugaucaacgaccucuauacaagcccccagaauaagaaagcccugagacagauucugcucgucguguccgauauccagaaggcgaugaaaaaccaagcccccucuaagauucugaucgaauuugcucgcgaggacgaagccaauccucggcuuuccguucagagaaagcgccagguggagcaagucuaccagaacaucagcaaagauauucugucugacagcgaugugaaggcugagcucaaagaccugacgaacaccgcccuggccaauacaagacuuuuccucuauuuuaugcagggaggacaugacauguacaccggcgaaacacugaacaucgaucggcuguccgaguacgacauugaucacauccucccgcaggcuuucauuaaggacaauagccuggauaaccgcguucuugugucugcgaaaaugaauagauccaagagcgaccaagucccccugaacgauuauaccgaggagcgguuuggcuccaagaugcgcgugcagugggagcagaugcucagagccgggcugaucacgaaacggaaguacgacaaucugacccuuaacccugaucgcauuucuaaauaugcuaugaagggauucaucaauagacagcugguggaaacacggcaaguuaucaaacucgucaccaaccugcucauggaccacuacgaggaugacgaagugcagcugauuacagucaagagcggccuuauccaucagaugcgcgagauguuugacuuccccaaaaauagaaaccugaauaaccaccaucacgccuuugaugccuaucucaccgcuuucguggggauuuaccugcugaagcgguauccuaagcugacgcccuuuuucguguacggauccuaccagaaaaauaacacaaacgacaaguggagaaauuuuaacuuccugaaugaucucaaaaaggaagagguuaucgacucugauagccaugaggugauuuggaacaaagcccaaggccuggucgaacucgacaagaucuaucaguucaagaaaauccuggugacccgcgagguucacgaaaauacaggggcgcuuuacaaccagacccuguauuccgcuaaggaugacaaagccucuggccagggaggcaagcaacucauuccggccaaacaggaucggccuaccgcucuguacgggggauauagcggcaagacaguggccuacauguguaucgucagaauuaaguccaaaaaggaggacacguauaaagugugcgggguuaagaccagcuggguggcggaacuggagcgccuuucugauuccaaugagcagcuggcuagccucaaagccaagcugaugcccaaguuuacaaagaacaagaaacaaaagggaaaaaccauccaggucacagaagacuucgagauuaucgugccucgggugcucaucaaucagagauuuuacgauaacggccaggaaauuacccuggggucugccacguacaagcacaaugagcaagaacuuaugcugaacaagaaagcugucaagcugcucaauggccagcugucccuuguugaggccgagacacuggcuccccagguguaugacgaaauccucaaacaggugaugaaguacuucccucuguaugacaccaaccaauuucgcaccaaacucaagaugggaaaagagcaguucauuaagcugcccuggaagaauaaaugggauggcaacaaacuuauccaugucgggcagcagacagugcuggaccggauucugaucggacuccacgccaaugcggccguuagcgaucugucuacccuuaaagugacaacgccguuuggcaagcugcaacagccuuccgggauugcucucagccugaacaccaaaaucaucuaccagucccccacaggacucuucgaaagacgcgucgcccugcggggccuuuga

SEQ ID NO: 4281 - RNA, 4110 nt, Artificial Sequence
  Cas9 variant
auggacaagcccuacaacaucggccuggauauugggagccacuccaucggauggaccguggucgacgauaauucuaaacucguuagaauuaagggcaaacugggguauggagugcggcuuuucgacgagggcaagacagccgaagaacgcagacaguuucggacgacccgcagacggcugaaacgcagaaaguggcggcuccgccugcuuagagaaaucuucgagccucauauugcuccgcuggaugaaacauuuuuccuccggcaaaagcagagcaaccuggugcccacccagaaaaagcugccucagcucucccuguuuaaugaccgcucugaugccgaguucuaccacaaauaucccacaaucuaccaucuuagaaacgcgcugaugaccgagaagcggcaauuugaccuccgcgaaaucuaucuggcuauucaccauaucgucaaauacagagggcacuuccuuaaugccgccccugcugccagcuuuaaguccggaaaguucgaucuggagaacaaauuugaccagcucaaucugcuguucgcuucugccuauagcgaucucgacuuuacacugcggaccgauaacguggaccagguuaaggcgauucuucugaaugaagaccucuccgccagcacgagacagcgccaagcucugccccuuaucuaccagaccucugccgaucagaaagcugccaagaaacugacaaagucccucgcgaccgagcugcugaaagccauucucggccugaaggcuaaguucgacgugcuuacaggcaucgagaccgaugacacgaaagccuggcggcugacauucaacgcugaagauuuugacgauaagcucaaugagcugaacgucaccgacaaugaagccgccacacagauuaucgagauccuuagagaacuguacagcucuauucuccuggcugcgaucgugccugagaacuauacccugucccaagccaugauggcuaaauacaaugcccacaagcagcaucucagccugcuucgccagguuaaaaccacacugccggccaagaagcaaaaagagcuccaggcugccuaugaugacuacauugaucagcaucugccccuggacaaguucuaugcgaaacuuacgaaggugcucccuaaagaaaaggacaccgauaacccccagaucauucaaauccugaaccugaucgaccucgaucaguuucugccuaagcagcggacaaaagacaauggggcuauuccccaccagcuucaccaacaggagcuggaucagaucauugacaaccagaaggccuacuauccguggcucgcccaacugaauccuaacgaaaagagacagaagaucgcuaaauacaagcuggaugagcuugucgccuuccgcgugcccuacuaugugggaccucucauugaagcuaagacccagcagaaaacaucuggcgccaauuuugcguggaugauccggaaggagcccgggaccacgacacccaucaccccuuggaacuucgacgagaaagucaauagacaagccuccgcuaacgaauuuauuaagcgcaugaccacaaccgauacauaccugcugggagaggacguucucccgaaacacagccugcuuuaucagcgguucgaagugcugaaugagcucaacggcaucaagauugaucagaaaagagugacgguccgccaaaagcaggccaucuuuaaugaccuguuccugaagcagcccaacgugaccguuaaaaagcuccagcaauaccuucaggcuaaaggggaauaugccuccgcgccuauuaucacaggacugucugaucccaagaaauuuaauagccagcuguccaccuaccaugaguauaagaagauuuucggcggccucaucgacgacccugauaaacaggccgacuuugagaagugcaucgaauggagcacaauuuucgaggauucucaaauccugaaagacaaacuuaaagaaauuaacuggcugacccccgagcagcggcacaagguggcuaauaagagauaccagggguggggacggcucuccaaaaagcugcugacgcagcuugucgauuacaacggccaacgcaucauugacauccucuggaacaccacagauaauuucaugcagaucgugcauagcgaggccuuugacaaagcuauuaucaaggaaaaccaggcccugcugacccaauauaauccgcaggccguuauugaugaccucuacacaucuccucagaacaaaaaggcucugagacagauccuucugguggucaaugauauucaaaaggcgcucaaagggcaggcccccagccggauccugaucgaguucgcuagagaaggacaggagaacccucgccuguccacccagcggaagcaacagguggaaaaugccuauaaagaggccucugacgcccuucugagcuccgcugaggucagacaggaacucaagggccuggauaacaaagcgcucgcuaauacgcgccuguuucuuuacuucaugcaagggggaagagacauuuauacaggcaagagccugaacaucgacgaucucucuaaauacgacauugaucacauccugccccaggccuuuauuaaggacaauucccuggauaaccgggugcuuguuagcgccaagaugaaucgcucuaaauccgaccaggugccucugaacgauuucgcugagaucagauauggcaagcagaugcggcagcaaugggagaaaaugcuccgcgccgggcugaucaccagaaagaaauaccauaaucucacacugaaccccgagagcauuaacaaguacaccgcgaagggauuuaucaaucggcagcuugucgaaacccgccaggugacaaaacuggcuacgaaccuccugguugaccaauaugccgaggaugacgugcagcugauuaccgucaaguccaaucuuacacaccagaugagagaggaguucgauuuuccgaaaaaccggaaugugaacaaucaccaucacgccuucgacgcuuaccugaccgccuuugugggccucuaucugcucaagcgcuacccuaaacuggcucccuauuucguuuacggggacuaucagaagggagccucucaaaacagcaaguggagaaauuuuaacuuccuuggcaaucugcaucgggagaaagucguggauaagaacacaggggaaaucauuuggcagagagacgcgggccugggagagcucaaucgcaucuacaacuucaaaaagauucuggugacccgggcccuuagagucaaucgcggccccauguuuaaacagacgaucuacaaggcugaagaggauaaguccucugggcggggaagcaaacagcugaucccuacaaagaaaaacagaccgaccgagcucuauggcggguacaccaacaaggaaacagccuaucugugucucgugaaagagccccacaagaagggagacauuuaccgcaucugcuccguucugaauauguggcuuaccgaacuggaucggauugcugacccuaucgccaaagcccaaaagcugacagagcuccugacgccccaguucaccacaaccaaaaagaaacagggccagaagauuccuguggucaaacccuuuaaggugguuaucccuaagauccuuauuaaccaaagauucuuuagccgcgggcaggagcugacaguggcuucucccauguauaugcacaaugaacaggaacucuuccugaacaaaaagaccaucaaacuccugaauggccaacuugcgaagaacgaagcccaugagcuggcuccgaaaauuuaccagcagauccuggaucaggucaaugacuauuuuccucucuacgauauguacaaguuccgggacacgcugaacgccuccaaggaaauuuuugugaaucuucccuggcaagaucagagacaggacaaaaagaucagccagucuggacaaaaauccauccugaacaagauucucaucggccugcacgccaaugcugcccggauuaaacucaccgagcugaacuucaagagcgauuuugggcuucugucucagcgcagcggaaucgcguucuccccugacgaccagauuaucuaucagagccccacaggccuguucgagagacggguuacccucaaggaucuguga

SEQ ID NO: 4282 - RNA, 4110 nt, Artificial Sequence
  Cas9 variant
augaaggugaacaauuaccacaucggccuggacauugggaccagcuccaucggaugggucgccaugggcgaggaugggaaaccccucagaguuaagggaaaaacagcuauuggcgcccggcuguuccgcgaagggaacccugcggcugacagacggauguuucgcacgaccagacggcgccuuaauagacggaaguggcgccugaaacuccuggaugagaucuucgacccguauauuacacccguggauucuaccuuuuucgccagacuuaagcagagcaacugguccccuaaggacucucggaaagccuuuaaggauagcacacuguuccccgaccucaccgauaaacaauaccaucuggacuauccuacaaucuaccaccuucgccaugcucucaugacccaggauaagcaguuugacaucagaaugguguaucuggcccuucaccauauugucaaauaccggggaaauuuccugaacuccacgcccguggauucuuuuaaggcuagcaagguuaauuucgacgaccaguuuaaaaagcucaacgaacuguauaccgccaucaauccugaggaauccuuccaaauuaacuuugcgaauagcgagaaaaucggccagcaguuccuugauccgucuauucgcaaguucgacaaaaagaaacagaucuccaagauugugcccgucacaauggaugacaaggccguggauaaacugaacggcaagaucgcuagcgagaucguuaaugccauucucggguacaaaucuaagcuggacguggcuguccaaugcgauccugaagacuccaaacccugggccgugaaguuugaugacgaggauaucgacgcgaagcugcagaaaauucucccugaaauggacgagaaccagcagagcaucauuggaaucauccaagaucuguacucucaggugacccuuaaucagauuguccccaacggcaugucccugagcgaguccaugaucaagaaauauaacgaccaccacgaucaucucaagcuguacaaaaagcugauugggcaaaucucugacagcaagaaaaagacagcccugaaaaaggcuuaugaucaguacguuggaaaugacggcaaagugauugaacaggaugacuucuauuccagcgugaagaagaaccucgaugacucugagcuguccaaacagaucauggaucugaucgacgccgauaaguuuaugccgaaacaaagaaccagccagaauggggucauuccucaccagcuccaucagcgggaacuggacgagaucauugaacaccaaucuaaguacuaucccuggcuugcugagagcaacccuaauaaacacgaccugcaucucgccaaguacaaaaucgaggaacugguggccuuccgcauucccuacuauguuggacccaugaucacgccugaggaucagaagaaguccggcgcugcgguguuuucuuggaugaaaagaaaggaaccgggccagauuacacccuggaacuucgaccagaaagucgaucggauggagagcgccaauaaguuuaucaaaagaaugaccacaaaggacaccuaccuuaucggggaagaugugcugccugacgagucccuccuguaugagaaguucaaaguucugaacgaacucaauauggugcgcgucaacggagauagccugaagguggcugacaaacaagccauuuaccaggaucuuuuugagaauuauaagcacaucucugucaaaaagaugcagaacuacauuaaggacaaaaccggccugcccaauaacccugauaucuccgggcucagcgaccccgaucauuucaauaacucucugggaacauauaacgacuuuaagaaacuguucggcgacaagguggaugacccggaucuucaggacgauuuugaaaagauuguugagugguccacgguguucgaagacaagaagauccuccgggccaaacugaaugagaucagcuggcuguccgauaagcaaaaagacgaucucgagucuagcagauaccagcgcugggggcggcuguccaagaaacuucugaccggaauugucaacgaccagggcgaaagaaucauugaugagcucuggaauacaaacaagaauuucaugcaaauccagucugacgacgauuuugcuaaacgcauucacgaagccaacgcggaccagaugaaggcuaccgauguggaggacguucuggccgaugccuacacaagcccucagaauaagaaagcuauccggcaaguggucaaggugguggacgauauccagagagccaugggcgggguugcucccaaauucauuuccaucgaguuuacccgcagcgaagaccggaacccuagacggacgauuucucgcgagagacagcuggaagauacacuuaaggacaccgccaaaacccucgucaaguccaugaaucccgauauccugagcgagcuggacaacgcgucuaaguccaaaaagggacucacagaucggcuguaucuuuacuucacccagcugggcagagacauguauacagggaaaccuauuaauaucgacgaaaucagcaacuacgauauugaccauauccucccccaagccuuuauuaaggaugacucucugagcaaucgcgugcugguguccaaagcugucaacaauggaaagagcgccaacgugccgcuuaaacucuucggcguuaaaauggcucacuuuuggaagcagcuggccgaggcggggcugaucaacaaacggaagcucaaaaaucugcagacgaacccugauaccauuucuaaguucgccaugcacggcuuuaucagacgccagcuuguggagacaucccaagucauuaagcugguggcuaauauccucggagacaaauauagaaacgaugacaccaagaucauugaaaucacagcccggaugaaucaucagaugcgcgaugaguucgcuuuuauuaaaaacagagaaaucaaugacuaccaccaugccuucgaugccuaucugaccgcuuuucugggccgguaccuuuaccaccgcuauauuaagcucagacccuacuucguuuauggggacuucaaaaaguuucgggaggauaaggugacgaugcgcaacuucaauuuucugcacgaccugaccgacgauacacaggcgagaaucgccgacaccgaaacaggagaggucaucugggaucgggagaccagcauuaaacaacuccgcgacguguaccauuauaaguucaugcugaucucccaggaaguuuacacgcuuagaggcgcuauguuuaaccagacaauuuaucccgccgaugaggccgggcggaaaaagcugaucccuaccaaagcugacaaggccguggaugucuacggaggcuacucugggagcaaugacgcguauauggcuauugugagaauccacgauaaaaagggcgacaaguacaaaguggucggaguuccgaugcgcgcccucgaucggcugaacgccgcuaagaauguguccgacgccaaauaugaccaggugcugaaggauguccuuacaccccaauucaccaaaucuaaaaagagcagaaagaccggcgaaaucucccagacaguggaggacuuugaaguugugcuggggaaggucauguaccgccagcucgugauugauggagacaaaaaguucaugcugggcucuagcacguaucaguacaacgcgaaacaacucguucuguccgaugagagcgugaagacccuugcuucuaaggggaaacuggacgaggcccaggaauccgccgcuuaugauaaugucuacgacgagauccucgauaagguggaccgguacuuugcccuguaugaucagagaaacuaccgcacaaaccugcaugaaggagagcagaaauucauuggccuuccucugcacgacaccuuugaugggagcaagaaaguugcuaauggcaagcgggagacaaucucugacauucucaacggacugcaugccaaugcgaccaugacgaaccucaaggugcugggcaucuccagccccuucgggauguuccaaucucacggaccuauuaaucuuaaccccgaaacaaucauccugugucaguccccuaccggccucuuugagagacgcauuauccugcgggaccuguga

SEQ ID NO: 4283 - RNA, 4113 nt, Artificial Sequence
  Cas9 variant
augaagaaaagaaacuacaauaucggccuggacauugggaccagcuccaucggauggacaauuguggaugacaacgcccagaucaugcgggcuaagggcaaaaauggguauggaguccgcauuuucgccgagggcaagacggcggcugauagacggggguuucgcaccacaagacggcgccucaaaagacggaaguggcgccugagacuucugcaagaguucuuugaacccuacauccucccuaucgacgaaaacuucuuuaugcggcagaaggagucuaaucugguuccgcaggaucccaacaaacacuucaagggaagcauucuuuuuaaugaccgcaccgaucaggaguuccaugaacaauauccuacaaucuaccaccugagauaugcccucaugaccgagcaucggcaguuugacgugcgcgaaauuuacugggccauccaccauauugugaaauauagaggccacuuccugaacuccacacuggcuucuaaguuuaaaggcggggagcuccggcuggccgauaaguucgaaagccuuaauaagcuguuucucagaguccaggcugagaccggauucgagcuguccgaagacaacguggauaaaaucaagacgguucuucuggacaauggcaaaucucgccucgaucggcagagagaggugcugaagauugucuaccugaccagcgaagacaaagacacagagaagaaacgcaaggccguggcgaccgaguucaucaaggccguucucgggcugaaaacaaaacuuuuuaucgugcuggcuaaaaaccccaccgccgaaacggauuggaaguucuccuuugacgcugaggauauugacgauaaacucgacagcaucucugaacaacugacagaugacgaucacgagauugucgaacuuaucuccgagauucauagcaucaucacccugacaggaguggugccugaaggcauggggcucucugaguccaugauugccaaguacgaccagcaccagcuggaucugaagaaacucaagagccugaugcgggaccuugacgucaaacaggcgagaaagcugcaagaugccuaugacgaguacaucgauggacucaaacccucugaagaggcuuucuauuccgccguuagcuccgugauucagaagauggacgauccucgcgcuaagaaaaucaccgccgaaauugagcuggaagaguuuaugccgaagcagcggaccaaagccaauggccaaaucccccaucagcuucaccagcaggagcuggaccaaaucauugaaaaccagaaggaguacuauccuuggcucgcugaagagaaucccaacaaaagagagcacaacgcggccccucauaagcuggauggccuggugacauuccgcguccccuacuauguggggccgcucaucgaggcuucuguucagcagaagacgagcaauuccaacuuugccuggauggaacggaaagugaagaaugacaccagcagaauuacaccuuggaacuucgaagagaaagucgaucgcaaugccucugcugaaaacuuuaucaagcggaugaccacaaaagacaccuaccugcuuaaugaggaugugcugccccaacagucccuccuguaccagagauaugagguucugaacgaacuuaauaacgugcgggucaaugacaagaaacucgagaacaauugcaagcaggauguguacaaggaccuguucaaaaacaauacgacagucagcauuaagaaauuuaaggacuaucugguggccaacugugaauacgcggauaacccuaaaaucgagggacucgcugacgaaucuauuuuccugagcucccuuucuaccgagaauaaguuuaaggauaucuucggcgcccaaaucgacgaucccaacuauuucgaggacuuugaacacauuaucgagugggccaccauuuucgaagauaauaaaauccugcgcgcuaagcucgacgagauuagcuggcugaacgaaucccagaaaaaggagcuggccaaacuuagaaugcggggguggggaagacucagccgcaagcugaucgcugagaucacagaugaaaauggcucucggauuaucgaccugcucugggagcauauggauaacuuuaugguuguggucaaucaggacguguucaaggaaaagauuguugccgagaacaaacagguguuuaaggagcugaauccccuugauaucauuaacgaacaauucaccuccccucagaauaagaaagcgcugagacagauccuccuggucguggccgacauccaaaaggcuaugaacggggugacaccgagcaauauuuuuaucgaguucgcccgcgaagacgagagaaacccccggcgcucuauucagagacugcggcagguugaaaauauguaccgcgauaucuccgacacgguccuugcugauccugaggugagaaacgagcucagcaacauuaagaauaccgaacuggcccgggaccgcguguuucuguauuuccuccagggaggcagagaugucuacacaggcgagccccugaacaucgacaaacuuuccgaauacgauaucgaccacauucugccucaagcguuuaucaaggauaauucucucgacaaccgggugcugguuagcgccucccugaaucgcucuaaaagcgauuccgugccccuugacgacuucaccagcgagauguuugggagaaagauggaaccgcucugggagcagaugcagcgggcuggacugauuucuaaaaagaaacuggccaaccucaaguucaauccugagaacaucaauaaguauacaagaaacggcuucauuaaucgccagcuggucgaaacccggcaagugaucaaacuugcugccaacauucugaaggaucauuacggggaggaaacggagaucguuaaugugaaagccggacucacccaccaguuuagaaaggacuucgauuuucccaaaaaccgcaaugucaacaacuaucaccaugcuuucgacgcguaccugacagcccuggugggcaccuaucuucugaagaaguacccuaaacucgaauccuauuuuguuuacgggaaguucaaaaagggcgauggaaucacaaaucugaaaaacuuuaauuuccuccacggcuuuaacaagcccgggaagauuaucaauaaagagaccggagagauucuguucgaccgggauaagcagcuuggcuacaugaacagcaucuaugaccugagaaaagugauugucacgcaugaacucucuacacgccacggggcuauguacgaucagacccuguauaaggccuccgacgauaaagacagcggacggggcgggaagcaacugaucagaaagaaagauaaucuuccuacagagaucuacggcggauauaccggcucuaccgacgccuuuaugagcauuauccgcaugaagaaaaaggacaaacuguacuauaaggugauuggggugcccacacgggucgcucacgaaguucuccaguccgauggaaagaucaacauuuucacgcugaauaaauucaucgagcagaagcucaccaaagagaaggugaacaaaaagacaggcgccaucaccagaauuacagacugguuugaacuggugaucgcgaaagucauguacgggcaagugauugaugacggaggccagccguucaugcuugggagcucuacccugccuuacaauguucgggagcucuaucuggcuaaggaucuggugaaggucaucaacaaaggcuccacgagcaaguccucuuaccuugacguguaugaugaacugguuaaaagccucaauaaguacuuucccauguaugaccgcaacauguucagacagaaaauuacagaugcccgggacaaguuugagaagcugcccaaacgcgauaagguguccaauggaaaacuccagcaaaucggccaggucaccauuaucgacagaauccugauugggcuucauaccaacgccggagugucuaaucugaaggaucugggcaucgcuacaccuuucggguuuaugcagcagggaaacggcauuagccucaccuccacagccaaaaucauuuaccaaucuagcacggggcuguucgaaaaguccaaggcgcuugacgaccugaacccgcucgcuuga

SEQ ID NO: 4284 - RNA, 4113 nt, Artificial Sequence
  Cas9 variant
augaacaagcccuacagcaucggccuggacauugggaccaauuccgugggauggucuaucauuacagaugacuauaaggucccugccaagaaaaugagaguucucggcaacacggauaaggaguacaucaaaaagaaucugauuggggcccuucuguucgacggaggcaacaccgcugcggaucggcgccucaagagaacagcucggcgcagauauacccggcgcagaaaucggauccuguaccuucaggaaaucuuugccgaggaaaugagcaaaguggacgauuccuucuuucaccgccuggaggacucuuuccucguggaagaggauaagagagggagcaaauauccgauuuuugccacaaugcaagaggaaaaguacuaucaugagaaauuccccaccaucuaccaucugcggaaggaacuggcugacaagaaagagaaggccgaucuccgccugauuuaccuugcucuggcccacaucauuaaauuuagaggacacuuccucaucgaggacgaucgguuugacguccgcaacacagacauucagaagcaguaucaggcguuccuggaaaucuuugauaccacguucgagaauaacgaccuucugucccaaaauguggauguugaagccauccucaccgacaaaauuucuaagagcgcuaaaaaggauagaauccuggcccgguacccuaaccagaaguccacaggcauuuuugcugaguuccugaaacucaucgugggcaaucaggccgacuucaagaaacauuuuaaccuggaagauaagacaccccuucaguucgcgaaagacagcuaugaugaggaccuggagaaucuccuggggcaaauuggagaugaauuugccgaccuuuucucugcugccaagaagcuguacgacuccguccuccugagcggcauccugaccgugaccgaucucucuacgaaagcuccucuguccgccagcaugauccagagauaugacgagcaccgcgaagaucuuaagcagcugaaacaguuuguuaaggccucucuccccgagaaauaccaagaaauuuucgcugacuccagcaaggauggguaugcgggauacaucgagggcaagacaaaccaggaggccuuuuacaaauaucuguccaaacuucugaccaaacaggaagggucugaguaccuccuggaaaagauuaaaaaugaggacuuccugcggaagcaaagaacauuugauaacggaagcaucccucaccaggugcaucucaccgaacugcgcgcuauuauccggagacaguccgaguauuacccguuccuuaaggagaaccuggaccgcaucgaaaagauucucaccuuucggauccccuauuacgucggcccucuggccagagaaaagagcgauuucgccuggaugacacgcaaaacggacgauucuauucggcccuggaauuuugaagaccugguggauaaggagaaauccgcugaggccuucauccacagaaugaccaacaaugaccuuuaucucccugaagagaaggugcugcccaaacauagccugauuuacgaaaaguucacagucuacaacgagcucaccaagguucgcuuucuggcggaaggcuucaaagacuuucaguuccuuaaucggaagcaaaaagagacaaucuuuaacucucuguucaaggagaaaagaaaggugaccgaaaaggauauuaucagcuuucucaauaaaguggacggguaugagggaaucgcuauuaagggcaucgaaaaacaguucaacgccucccugucuacguaccacgaucugaagaaaauucuugggaaggacuuucucgauaauacagacaacgagcugauccuggaagauauuguccagacccucacccuguucgaggaccgggagaugauccgcaagagacuugauaucuauaaagacuuuuucacagaaagccagcugaagaaacucuaccggagacacuauaccggauggggccgccuguccgccaagcugauuaaugggauccggaacaaagagaaucaaaagacaauucuugauuaccucaucgacgauggaagcgcuaacagaaauuuuaugcagcugauuaaggacgccggccugucuuucaaaccgaucaucgacaaggcucgcacgggcucccauagcgauaaccucaaagaagugguuggggagcuggccggaucuccugcgauuaagaaaggcauccuucagucccugaagauuguggacgaacucgucaaagugaugggguaugagcccgagcagaucguuguggaaauggccagagagaaccaaaccacagcuaagggacugagccggcugcgccagagacuuaccacacuccgggaaucccuggccaaucugaagucuaacauucucgaggagaaaaagccuaaauacgucaaggaucagguggaaaaucaccaucugagcgacgaucgccuuuuccuguacuaucuccagaacggcaaagacauguacaccgaugacgagcuggauaucgacaaucugucccaauaugauaucgaccuuauuaucccccaggcuuuuauuaaggacgauucuaucgacaacagaguccuggugagcuccgccaagaaucgggggaaaagcgaugacguucccucuguggaaauugucaaggauugcaaaguguucuggaagaaacuccuggacgcgaagcucaugucccagcgcaaguacgauaaccugacgaaagccgagagaggcggacuuaccagcgacgauaaggcucgguuuauccaacgccagcugguugaaacaagacagauuaccaaacacguggcccggauccucgacgagagauucaauaacgagcuggauucuaagggccgccggaucagaaaagucaagauugugacacugaaguccaaucuugugagcaacuuucgcaaagaauuuggguuuuauaagauccgggagguuaauaacuaccaucacgcucacgacgccuaucugaaugccgucguggcuaaagcgauucucaccaaguacccucagcuggaaccggaguucguguacggagauuaucccaaauacaacucuuauaagacgagaaagagcgccacagaaaaacucuuuuucuacuccaacaucaugaauuucuucaagaccaaagucacacuggcugacggcaccgugguugugaaggacgauauugaggucaacaaugacaccggggagaucgugugggauaaaaagaaacauuucgccacaguucgcaaggugcuuagcuauccucaagucaacaucgugaagaaaacggaaauucagaccggaggcuuuucuaaggaguccauccuggcccacgggaauagcgacaaacucauuccccggaagacaaaagauaucuaccuggacccuaagaaguauggcggauucgauucccccauuguugcuuacucugugcuggucguggccgacaucaaaaagggcaaagcgcagaaacuuaagaccgugacagaacugcucgggaucaccauuauggagagaagccgcuuugaaaagaacccguccgcuuuccuggagucuaagggauaccucaauauccgggaugacaaacugaugauucuuccuaaguauagccuguuugagcuggaaaacggcagacggcgccuccuggccuccgccgaugagcuucagaaagggaaugaacuggcucuccccacgcaauucaugaaguuucuguaccucgccucuagauauaacgagcugaaaggaaagccugaggaaaucgagcagaagcaggaguucgucguucagcaugugagcuacuuugacgauauucuucaaaucauuaaugacuucuccaaccgggugauccuggcggacgcuaaucuggagaaaaucaacaagcucuaucaggauaauaaagaaaacauucccgucgacgagcuggccaacaauaucauuaaccuuuuuacauucaccagccugggcgccccugcugccuuuaaguucuucgauaaaaucguggaccgcaagagauacaccucuacaaaagagguucucaauuccacccugauucaccagagcaucacagggcucuaugaaacgcggaucgaucugggcaaacuuggagaggacuga

SEQ ID NO: 4285 - RNA, 4113 nt, Artificial Sequence
  Cas9 variant
augaccaagaaaaacuacagcaucggccuggacauugggacaaauuccgugggaugggccgucaucacggaugacuauaagguucccgcuaaaaagaugaaagugcucggcaacaccgauaagaaguacauuaaaaagaaucugcuuggggcccuucucuucgacucuggagagacagcggaagcuaccagacugaaacggacagcccgcagacgguauacccgcagaaagaaccggcuucgcuaccugcaggagaucuuugccgaagagaugacaaaaguggaugagagcuucuuuuauagacucgacgaguccuuccugaccacggaugagaaggacuuugaacggcacccuauuuucggcaauaaggcugaggaagaugccuaccaucaaaaauuuccgaccaucuaucaucugcgcaacuaccucgcugacucuagcgagaaggccgaucugagacuugucuaccuggcgcucgcccacaugaucaaauaucgggggcacuuccugauugagggaaagcugaaugcugaaaacacagacgugcagaaacuguuuaccgauuucguuggcguguacgaccgcacauuugacgauucccaucucucugagaucaccgucgacguggccagcacgcugacagaaaagauuuccaaaagcagacggcuggagaaucucaucaaguauuaccccaccgaaaagaaaaacacacuguucggcaaucuuauugcucuggcccucgggcugcagccuaacuuuaagaugaauuucaaacuuucugaggaugcgaagcugcaguucuccaaagacaccuaugaggaagaucucgaggaacugcugggaaagaucggcgacgauuacgccgaccucuuuaccagcgcuaagaaccuguaugaugccauucuucugucugggauccucacaguugacgauaauuccacgaaagcuccccugagcgccucuaugaucaagcgcuacguggagcaccacgaagaccuugagaaacugaaggaguucauuaaagccaacaaguccgaacucuaccaugacaucuuuaaggauaaaaacaagaauggauaugcuggcuacauugagaacggggucaaacaagacgaguucuauaaguaccugaaaaauacccugagcaagaucgauggauccgacuauuuucucgauaagauugagagagaagacuuccugcggaaacagagaacauuugauaacggcucuaucccucaccagauccaucuucaggagaugcacgcgauucugcgccggcaaggcgacuacuaucccuuccucaaggagaaacaggauagaaucgaaaagauucugaccuuucgcaucccuuacuacguggggccgcuggugcggaaagacagcagauucgccugggcugaguaucgcuccgaugaaaagauuacacccuggaauuuugacaaagucaucgauaaggaaaagagcgccgagaaauucaucacccggaugacgcuuaacgaccucuaccugccugaagagaagguucugcccaaacacucucauguguaugaaacauacgccguguauaaugagcucaccaagauuaaauacgucaacgaacagggaaaggaguccuuuuucgacagcaauaugaagcaggagaucuucgaucacguguuuaaagaaaacagaaagguuaccaaagagaagcugcuuaauuaucugaacaaagaguucccugaauaccgcauuaaggaccucaucggccuggauaaggaaaauaaaucuuuuaacgcuagccuggggacauaccaugaccuuaagaaaauucucgauaaggccuuccuggacgauaaagugaaugaggaggucaucgaagacauuaucaagacccugacacucuuugaggauaaggacaugauccacgaacggcugcaaaaauauuccgauauuuucacggcgaaccagcuuaagaaacuggagagacgccauuacaccggauggggccggcucucuuauaagcugaucaacgggauuagaaauaaagaaaacaauaagacaauccuggacuaccuuauugaugacggaagcgcuaaccggaauuuuaugcagcucaucaacgacgauacccugcccuucaaacaaaucauucagaagucccaggugguuggcgacguggaugacaucgaggccgucgugcacgaucugccgggcagcccugccauuaagaaagggauccuccagucugucaagauuguggacgagcugguuaaagugaugggagauaaucccgacaacaucgucaucgaaauggcucgcgagaaucaaacaaccaacagaggccggucccagagccagcagagacuuaagaaacugcaaucuucccucaaggaacuggggagcaauauucugaacgaggagaagccuuccuauaucgaagauaaaguggaaaauucucaccuucagaacgaccagcucuuucuguacuauauucagaauggaaaggauauguacacgggcgacgaacuggacaucgaucaucucagcgacuacgauauugaccacaucaucccccaagccuucauuaaagaugacuccaucgauaaccgcguucugaccucuagcgcuaagaaccgggggaaauccgacgaugugcccagccuugacauugucagagcccgcaaggcggagugggugagacuguauaagucuggccucaucuccaaacggaaguuugauaaucugacaaaagccgaacgcggaggccugaccgaggcugacaaggccggguucauuaaaagacagcuuguggagacacggcagaucaccaagcauguugcucagauucuggaugcccgcuuuaacacggaacacgacgagaaugacaaggucaucagagaugugaaagugaucacacucaagagcaaccuggucucucaauuccggaaagacuucgaauuuuacaaggugcgcgagauuaaugauuaucaccaugcgcacgacgccuaccucaacgcuguugugggaaccgcccugcuuaaaaaguauccuaagcuggcuuccgaguucgucuacggcgaauauaaaaaguacgauaucagaaaauuuauuacaaauagcucugacaaggccaccgccaaauacuucuuuuauagcaaccucaugaauuucuuuaagaccaaagugaaguacgcugaugggacaguuuucgagcggccgaucauugaaacgaacgcggacggagagaucgccuggaauaagcagaucgauuuugaaaaagugcgcaagguccuguccuauccccaggugaacauuguuaaaaagguggagacccaaacaggcggguucagcaaagaaucuauccugccuaagggcgacuccgauaaacuuauucccagaaagaccaagaaagucuacugggacacaaagaaauauggaggcuuugauagcccuaccguggcuuacuccguguucgucguugccgacguggagaaggggaaggccaaaaagcugaaaacggugaaggagcucgucggaaucucuauuauggaacggagcuucuuugaggaaaaucccguggaguuccuggagaacaaaggcuaucauaauaucagagaagacaagcucaucaagcugccgaaauacucccuuuuugaguucgaagggggacgccggagacugcucgcuucugccagcgagcugcagaagggcaacgaaaugguucugccuggguaccuuguggagcugcucuaucacgcgcaucgcgcugauaacuuuaauuccacagaguaccugaacuaugucucugaacacaaaaaggaguucgaaaaagugcucagcugcguugaggacuuugccaaucuguacguggaugucgaaaagaaccuuuccaaaauucgggccguggcugacagcauggauaauuucucuaucgaggagauuuccaacagcuuuaucaaucugcugacccucaccgcccugggcgcgcccgcugacuucaacuuucuuggagaaaagauuccuagaaagcgcuauacaucuaccaaagagugucugacagccacgcucauccaccaguccauuaccggccuguacgaaacacggaucgaucucagcaagcugggggaggaauga

SEQ ID NO: 4286 - RNA, 4113 nt, Artificial Sequence
  Cas9 variant
augaagaacgccaauaaagugaccggcaaguacuaucugggguucgacaucggaacaaacagcgucggcugggcuguuacggaugagaauuacaaccucugcaaauuuaagaaaaaguccaugugggggauuagacuguucgaagacgccaagaccgcggaggaacggcgcggacagagagcuucucggcgcagacuucaacggcgcaaacagagaaucgaucugcuccaggagauuuuugccgaagagaucaauaagguggacgagacauucuuuauucggcugaacgaaagccgccuucaccuggaugacaaaaccguguccgagaagcauccccucuucaucggcucugaauauagcgagaaagaguacuauagagaauacccuacaaucuuucaucugcggaaggagcugauggaauccucugagccgcacgauauucgccucgucuaucuggccauccaccauauucuuaagaauagagggcacuuccugaucgacggagaacucagcaaagcuaacuccuuugaugccgcuuucuaccagaugaaggaggugcuguguaaugagcuugaccuggaaauugauggcgagaacaccacagaaguugagcggacccuccgcgacagaaauaucagcaaaucugauaaggugaaacugcuggccgcgcuccuggccaugaaccaaaaugaaacggaguccaaggagaccaaaaagaagauugaaaacaucugcaaacuucuggcuggcaauaagggggacaucagcaaaauuuuuggacagacacccgagggcgucgaaaagaccucuuucuccuuuggggaggccgacuacgaugaaagcauccggccuaaccucgaggagucuauucccgaccaguguuucgugaucgauuccauuaaagcucuguaugacuggaacguucuugccgauauccugaauggacagacauaccucagcugcgcgaaggugaaccaauaugaaacccacaagaauaaccugaaagagcugaagcuccuggucaauagauacuguucccgcgaagaguauaaacgguucuuuaagucugccguggagaaagcuaacuacagcaauuauaucggcuccgccaagcaggggaacaagauuaucgacgugaaaagaugcgcugaagaggauuucuacaaggaacuuaaaauucugcucagcaagaucgagccugaagaggccgaccgcgagcuguacgaacggauuaaaagagaggccgaagagggaucucuucugccccuccagcgcaauaaggauaacuccgucguuccuaaucagaugcauaaggcugaacuggcgcugauccucgagaacgccggcagcuaucugggcuuucuuaaugagaaagacgaagaugggcugucuccggcugagaagaucauugaacucuucagcuuucggauccccuacuaugugggaccucuguccgacagacacaaagaccgcggcucuaacgccuggauugugcggaaggccgaggggagaauccugcccuggaauuucgaugaaaaagucgaccgcgaaaagagcaacgaggcuuuuauugaacggaugacgaacaaauguacauaccuucucggaaaggaugugguugccaaaaauucccugaucuauagccauuucauggugcugaacgagcucaauaaccugucugucugcggcaauaaaauuuccgugcaaguuaagcaggacaucuacagagaacuuuuucagcggcacaccaaagugagcaagaaaaugcugcuccaauauugucgcgagaagaugaugaacaaggaucuggaggaagaggaccugucuggguucgauggagacuuuaaagcgaaacuuuccagcuaccucgauuucgaaaagaaggucuuuggcgcuaaaauggaggaagacagaauccggaagauuacagaggauaucauuagauggaagaccaucuacggcgacgaugggaaaaugcugcaggccguggucgagaaggaauauccuggagagcuggacuccgaccagcucaaagccgugaagcaguuccgcuacucuggcugggggaauuucagcgaagaguuucugaacggaauuguuggcaccgaaaaacccacagggcaaauguucacgaucaucgaggcucuuuggcagaccaauugcaaccugaugcagcuccuguccaagaauuuuacauucauggaggaaauugagaagcacaaccgggaacuggccggccagaucaccgauauuucuuaugacaaacuugugaaggaucucuacaucagcccggcuaauaaaagagccgucuggcaaacagugcgcauugcggaggaaguuaagaaaaucaugggaugugagccugccaagaucuuuguggagauggcuagaggcggggaaaaagagaagaagcggaccauuucccgcaaaaagaaacugcuggaacucuaugccgcuugcaagaaagacgccagagauuggaaccgggagaucgaggaccgcgaugaaagagaguucaauagcgacaagcuguaccuuuauuacacgcagaugggacggugcauguacucuggcgaacgcauugaucugcaugagcucauguccgcgaacagcaagugggacaucgaucacauuuauccccagucuaaagucaaggacgauucccuggacaacagagugcugagccuuaaaaagaucaauaacgaaaaagggaauaagccucucucucgggacauccagcaaagccagcagaagugguggacagagcugcugcagcucgaguuuauuaccaaaaagaaauacgaucgccugaugcauagaggagaacuuuccgaggaggagcugagcggcuucaucaaccggcaacucguggaaaccagacagucuacaaaggccgcugccgagcugcuggggcgcauguauaauaacuccaaaguugucuacgugaaggcuccccuugugagccaguuucggaaggacgaucugaauauucucaaauccagacuggccaacgacuaucaccaugccaaggaugcuuaccucaauaucgcggucggcaacguguauaaugagaaauucaccgacaacccccugcgcuggauugaaaagcacgccggagagaauuacucuaucaaccggguuuuugauuacgacauuguggcuggcgauggggccccugucugggccgcuccgcuuagagacgaaaagaauaagcugcgcaagaacgaggugggagaaaaauauggcgggacaaucgauguuauccggaagacggugaaaagaaacgacguccucuacaccgagcacacauauuguggaaagggcgagcuguucaaugccaccauugcgaaaaaggacgggggcgcugaaaucccccugaaagccggacuucaaacaggcaaguacgggggauauaagagcccuaacaccuccuacuuugccgcuauugaguucgauggcaaaaagggggaacgcgugaaaaauaucauggagguucccguguauauugccaacauccugcuccaugacaucgaugcguacauucgguacugcgagacggucaagggacugaaaaaugugaagauccucagaccuuguauuaagaaaaacgcucugaucucuguggacggcuaucccaugcggauucgcggggccaaugaaaagaacauccuucugaaaaauaaccuccagccgaucuucggcagacacgaggaaaccguccggcgcauugagaaguacguugagaaaaaucaggaauuugagguggaugaaaaguucgacggacugaacgaggccaaucugacagaucuuuaugacgauaucaccgaaaagcugugcggcccuuacguggagagacccagcaaccagggggaauaucucauggagaaucgggagaaauuucugaacauuucccucaaggaaaaagcuaagcugcuugcccaaaugaucaaacuggucagaugugacacagagaccaaggcugaucugcgcucuauuggagccagcaagaaugcgggcgugaucuccguuaacaaaaacacgcucgggggaaagcggcugauucuuaucaaucagagcgugacaggccuguucgaaaacagaaucgagcucuga

SEQ ID NO: 4287 - RNA, 4113 nt, Artificial Sequence
  Cas9 variant
augaacaagcccuacagcaucggccuggacauugggaccaauuccgugggauggucuaucauuacagaugacuauaaagucccugccaagaaaaugagaguucucggcaacacggauaaggaguacaucaaaaagaaucugauuggggcucugcuguucgacggaggcaacaccgccgcggaucggcgccucaagagaacagcucggcgcagauauacccggcgcagaaaucggauccuguaccuucaggaaaucuuugccgaggaaaugagcaaaguggacgauuccuucuuucaccgccuggaggacucuuuccucguggaagaggauaagagagggagcaaauauccgauuuuugccacaaugcaagaggaaaaguacuaucaugagaaauuccccaccaucuaccaucugcggaaggaacuggcugacaagaaagagaaggccgaucuccgccugauuuaccuugcucuggcccacaucauuaaauuuagaggacacuuccucaucgaggacgaucgguuugacguccgcaacacagacauucagaagcaguaucaggcguuccuggaaaucuuugauaccacguucgagaauaacgaccuucugucccaaaauguggauguugaagccauccucaccgacaaaauuucuaagagcgcuaaaaaggauagaauccuggcccgguacccuaaccagaaguccacaggcauuuuugcugaguuccugaaacucaucgugggcaaucaggccgacuucaagaaacauuuuaaccuggaagauaagacaccccuucaguucgcgaaagacagcuaugaugaggaccuggagaaucuccuggggcaaauuggagaugaauuugccgaccuuuucucugcugccaagaagcuguacgacuccguccuccugagcggcauccugaccgugaccgaucucucuacgaaagcuccucuguccgccagcaugauccagagauaugacgagcaccgcgaagaucuuaagcagcugaaacaguuuguuaaggccucucuccccgagaaauaccaagaaauuuucgcugacuccagcaaggauggguaugcgggauacaucgagggcaagacaaaccaggaggccuuuuacaaauaucuguccaaacuucugaccaaacaggaagggucugaguaccuccuggaaaagauuaaaaaugaggacuuccugcggaagcaaagaacauuugauaacggaagcaucccucaccaggugcaucucaccgaacugcgcgcuauuauccggagacaguccgaguauuacccguuccuuaaggagaaccuggaccgcaucgaaaagauucucaccuuucggauccccuauuacgucggcccucuggccagagaaaagagcgauuucgccuggaugacacgcaaaacggacgauucuauucggcccuggaauuuugaagaccugguggauaaggagaaauccgcugaggccuucauccacagaaugaccaacaaugaccuuuaucucccugaagagaaggugcugcccaaacauagccugauuuacgaaaaguucacagucuacaacgagcucaccaagguucgcuuucuggcggaaggcuucaaagacuuucaguuccuuaaucggaagcaaaaagagacaaucuuuaacucucuguucaaggagaaaagaaaggugaccgaaaaggauauuaucagcuuucucaauaaaguggacggguaugagggaaucgcuauuaagggcaucgaaaaacaguucaacgccucccugucuacguaccacgaucugaagaaaauucuugggaaggacuuucucgauaauacagacaacgagcugauccuggaagauauuguccagacccucacccuguucgaggaccgggagaugauccgcaagagacuugauaucuauaaagacuuuuucacagaaagccagcugaagaaacucuaccggagacacuauaccggauggggccgccuguccgccaagcugauuaaugggauccggaacaaagagaaucaaaagacaauucuugauuaccucaucgacgauggaagcgcuaacagaaauuuuaugcagcugauuaaggacgccggccugucuuucaaaccgaucaucgacaaggcucgcacgggcucccauagcgauaaccucaaagaagugguuggggagcuggccggaucuccugcgauuaagaaaggcauccuucagucccugaagauuguggacgaacucgucaaagugaugggguaugagcccgagcagaucguuguggaaauggccagagagaaccaaaccacagcuaagggacugagccggucccgccagagacugaccacacuucgggaaucucucgccaaucuuaagagcaacauucuggaggagaaaaagccuaaauacgucaaggaucagguggaaaaucaccaucucuccgacgaucgccuguuccuuuacuaucugcagaacggcaaagacauguacaccgaugacgagcucgauaucgacaaucugucucaauaugauaucgaccacauuaucccccaggcuuuuauuaaggacgauagcaucgacaacagaguccugguguccagcgccaagaaucgggggaaaucugaugacguucccuccguggaaauugucaaggauugcaaaguguucuggaagaaacuucuggacgcgaagcucaugagccagcgcaaguacgauaaccugacgaaagccgagagaggcggacucaccucugacgauaaggcucgguuuauccaacgccagcugguugaaacaagacagauuaccaaacauguggcccggauccuugacgagagauucaauaacgagcuggauuccaagggccgccggaucagaaaagucaagauugugacacucaagagcaaucuggugucuaacuuucgcaaagaauuuggguuuuauaagauccgggagguuaauaacuaccaccacgcucaugacgccuaucugaaugccgucguggcuaaagcgauucuuaccaaguacccucagcuggaaccggaguucguguacggagauuaucccaaauacaacagcuauaagacgagaaaguccgccacagaaaaacucuuuuucuacagcaacaucaugaauuucuucaagaccaaagucacacuggcugacggcaccgugguugugaaggacgauauugaggucaacaaugacaccggggagaucgugugggauaaaaagaaacacuucgccacaguucgcaaggugcucucuuauccucaagucaacaucgugaagaaaacggaaauucagaccggaggcuuuuccaaggagagcauccuggcccauggcaauuccgacaaacuuauuccccggaagacaaaagauaucuaccuggacccuaagaaguaugggggauucgauucucccauuguugcuuacagcgugcucgucguggccgacaucaaaaagggcaaagcgcagaagcugaaaaccgugacagaacugcuugggaucaccauuauggagagaucccgcuuugaaaagaacccgucugcuuuccuggagagcaagggauaccucaauauccgggaugacaaacugaugauucucccuaaguauucccuguuugagcuugaaaacggcagacggcgccugcuggccucugccggggagcuccagaaaggaaaugaacuggcccuucccacgcaauucaugaaguuucuguaccucgcuagcagauauaacgagcugaaaggcaagccugaggaaaucgagcagaagcaggaguucgucguucagcacguguccuacuuugaugacauucuccaaaucauuaaugauuucagcaaccgggugauccuggcggacgcuaaucuugagaaaaucaacaagcuguaucaggacaauaaagaaaacauucccgucgaugagcuggccaacaauaucauuaaccucuuuacauucaccucucugggggccccugcugccuuuaaguucuucgacaaaaucguggaucgcaagagauacaccuccacaaaagagguucuuaauagcacccugauucaccagucuaucacaggccucuaugaaacgcggaucgaccugggaaagcucggcgaggauuga

SEQ ID NO: 4288 - RNA, 4113 nt, Artificial Sequence
  Cas9 variant
augaccaagaucaaagacgauuacauugugggccuggacaucgggacagauagcugcggaugggucgccaugaacuccaauaacgacauucucaagcugcagggcaaaacggcuaucgggucuagacuuuucgagggaggcaagagcgccgcggaacggcgccuguuuagaaccacacaccggcgcauuaaaagacggcgcuggagacucaagcugcuugaggaguucuuugaucccuauauggcugagguugacccuuacuucuuugcccggcugaaggaauccgggcucucuccgcuggauaaacgcaagaccgugagcuccaucguguuccccacaucugccgaggacaaaaaguuuuaugaugacuacccuaccaucuaucaucugagauacaaacucaugacagaggaugaaaaguucgaccugcgggaggucuaucuugcuauucaccauaucauuaaguaccgcggaaauuuucuguacaacaccagcgugaaagauuucaaggccuccaaaaucgacguuaagagcucuauugaaaaacucaaugagcuguaugagaaccuuggccuggaccucaauguggaauuuaacaucuccaauacggcugagauugaaaagguccugaaagauaagcaaaucuucaagagagacaaagugaagaaaaucgccgagcuguuugcgauuaagaccgauaacaaagaacagagcaagcggaucaaggacauuucuaaacagguugccaaugcugugcucggcuacaagacacgcuucgauaccaucgcccugaaagagauuuccaaggacgagcuuagcgauuggaacuucaaacugucugacaucgaugcugacuccaaguuugaagcccucauggggaaucuggaugagaacgaacaggcgauccuucugacaauuaaggaacucuucaaugaagucacccugaacggaaucguggaggacggcaacacgcugagcgaguccaugauuaauaaauauaacgaccacagagaugaccucaagcugcuuaaagaagugaucgagaaucauauugaucggaagaaagccaaggaacuggcucucgccuacgaccuguaugucaacaauagacacgggcgccuucugcaagcuaagaaaaagcucggaaaaaucaagccccggucuaaagaggauuuuuacaagguugugaacaaaaaucuggacgauagcagagccuccaaggaaaucaagaaaaagauugagcuggacagcuucaugccuaaacagcgcacaaacgccaauggcgugauccccuaucagcuccagcaacuggagcuugauaagauuaucgaaaaccagucuaaauacuacccuuuucugaaggagauuaauccggucuccagccaccucaaggaagcucccuauaaacuggacgagcugauccgguucagagugccuuacuauguugggccccuuauuucuccuaacgagagcaccaaggauauccagaccaaaaagaaucagaacuuugcguggaugauccgcaaagaagagggacggauuacacccuggaauuucgaccaaaagguggauagaaucgaauccgccaacaaguuuauuaaacgcaugaccacaaaggacacguaccucuucggcgaggacguccugccggcuaacucucugcucuaucagaaauuuaccgugcugaaugaacuuaacaauauccggauuaacggcaagagaaucagcguugaucugaaacaggagaucuacgagaaucucuucaagaagcauacaaccgugacagucaaaaagcuggaaaacuaucugaaagagaaucacaaccuugugaaggucgaaauuaaagggcucgccgacgagaagaaauuuaauuccggacugaccacguacaaccgcuucaagaaucugaacaucuucgauaaucaaauugacgaucucaaguaccggaacgacuuugagaaaaucauugaguggagcacaaucuucgaggauaagucuaucuauaaagaaaagcugagauccauugacuggcuuaaugagaaacagaucaacgcccugagcaacauucggcuccagggcugggggcgccugucuaagaagcugcuugcucagcuccaugaucacaauggacaaaccaucauugaacagcugugggacucccagaacaauuuuaugcagaucgugacccaagccgauuucaaagacgcgaucgcuaaggccaaccagaaucugcucguugccacaagcguggaggauauucugaacaaugcuuacaccuccccugccaacaaaaaggcuaucagacaggucauuaaagugguugacgacaucgugaaggccgcgucuggcaagguccccaaacagauugccaucgaauuuacacgggaugcugacgagaauccuaagagaagccaaacgcgcggguccaaacuucagaagguguauaaagaucugucuaccgagcucgccagcaagacaauugcugaagaacugaacgaagccaucaaggacaaaaagcuggugcaggauaaauacuaucuuuacuucaugcagcucggacgggacgcguauaccggcgagcccaucaauauugaugagauccaaaaguacgacauugaucacauccugccccaguccuuuauuaaagacgaugcccuggacaacagaguucucgucagccgcgcugugaauaacggcaagucugacaaugugccugucaagcuguucgggaacgaaauggccgcuaaccuuggaaugacaaucagaaaaaugugggaggaauggaagaauaucggccugauuuccaaaaccaaguacaacaaucuccugacggauccggaccauaucaacaaauauaagagcgccggguuuauucggcgccagcugguggagaccucucaaaucauuaaacuuguuuccacaauccugcagagcagauaccccaauaccgaaaucauuacagugaaggccaaguauaaccacuaccuccgggagaaauucgaucuguauaagucucgcgaggucaaugacuaccaucacgcuaucgaugcguaucucagcgccauuuguggaaaccugcuuuaccagaauuacccuaaccugagacccuuuuucguguauggccaguacaaaaaguuuuccagcgacccugauaaagaaaaggagaucuucaauaagacccggaaauucucuuuuauuucccaaauccucaagaacaaaagcgaaaauuccaaggagauugcugaaaaacugaagcgcgccuaucaguucaaguacaugcugguuucuagagagacggagacaaaagaccaggaaauguuuaagaugaccguguucccccgggagacaccggggaaccuuaucccuaaaaagaaaggcauggcccccgaaaucuauggaggcuacaccaagaauagcgaugcuuauauggucauugugaagaucgacaaaaagaaagagaccgaauaccgcauucuggggaucccuacaagagagcucguuaaccugaagaaagccgagaaggaagaucauuacgaguccuaucucaaagaaauucuggcgccccggauccuuuacaauaagaacggaaagagagacaaaaagaucacgucuuuugagauugugaaaagcaagaucccuuauaaacaggucauucaagauggcgacaagaaguucaugcugggguccucuaccuacguguauaacgcuaaacagcucacacugagcaccgaguccaugaaggccaucacaaauaacuuugacaaagauagcgacgaaaaugaugcccugauuaaggcuuacgacgagauccuugauaaaguggacaaguaucugccccucuucgauaucaacgccuuucgcaagaaacugcacucuggacgggaaaaguucgucgagcucucccuggaagacaaaaaggauauuauccuuaaaguucugauuggccugcacgacaauccggcgaccagcgaucucaagacgcugggguuuucuuccacagagcuuggcaagaugcagaaaaacagcggaaucgugcugucuggcaaugcuaagcucauuuaccaguccccuaccgggcuguucaaaaagagcgugaaaaucuccgaccucuga

SEQ ID NO: 4289 - RNA, 4113 nt, Artificial Sequence
  Cas9 variant
augaccaagaucaaagacgauuacauugugggccuggacaucgggacagauagcugcggaugggucgccaugaacuccgacaaugauauucucaagcugcagggcaaaacggcuaucgggucucaccuuuucgaggccggaaagagcgcggcugacagacggcuguuucgcaccacacauagacggauuaaacgcagacgguggcgccucaagcugcuugaagaguucuuugaucccuauauggccaagguugacccuuacuucuuugccagacugaaagaauccggccucucuccgcuggauaagcggaaaaacguguucagcaucguguuucccaccgcugccgaggacaagaaauucuaugaugacuacccuacaaucuaucaccuccgcuacaagcucaugaccgaagaugagaaguuugaccugagagaggucuaucuugcuauucaucacaucauuaaauaccgggggaauuuccuguacaacacauccgugaaggacuuuaaagccucuaagaucgauguuaaaagcuccauugaaaagcucaaugagcuguaugaaaaccuuggacuggaccucaauguggaguucaacaucagcaauaccgcggagauugaaaaaguccugaaggauaagcaaaucuuuaaacgcgacaaggugaaaaagaucgccgagcuguucgcuauuaaaacggauaacaaggaacagucuaagagaaucaaagacauuuccaagcagguugccaaugcugugcucggcuacaaaacccgguucgauacaaucgcccugaaggaggucagcaaagacgaacuuucugauuggaacuuuaagcuguccgacauugaugcggacagcaaguucgaggcccucaugggcaaucuggacgagaacgaacaggcuauccuucugaccaucaaagagcucuuuaaugccgugacacugaacgggauuguggaagauggaaacacccugucugaguccaugaucaauaaguauaacgaccaucgcgaugaccucaaacugcuuaaggaagucauugagaaucacaucgauagaaagaaggcuguuaagcuggcccucgccuacgaccuguaugugaacaaucggcacggccaacuuauucaggcuaaaaagaaacuggggaagaucaaacccggaagcaaggaggauuucuacaaaguggucaacaagaaucucgacgauucccaggcgucuaaggaaaucaaaaagaaaauugagcuggacagcuuuaugccuaagcagagaacgaacgccaauggcgugauccccuaucaacugcaucagcucgaacuggauaaaauuaucgagaaccaguccaaguacuacccuuuccuuaaggaaauuaauccgguuagcucucaccugaaagaggcucccuauaagcucgacgagcugauccgcuuucgggugccuuacuaugucgggccccugauuuccccuaacgaaagcacaaaagauauccagaccaagaaaaaucaaaacuucgccuggaugaucagaaaggaggaaggacgcauuacacccuggaauuuugaccagaagguggaccggaucgagucugccaacaaauucauuaagagaaugaccaccaaagauacauaccuuuuuggcgagaacguucucccggcuaauagccugcuguaucagaaguucacggugcucaacgaacugaauaacauccgcauuaauggcaaacggaucuccgucgaccuuaagcaagagaucuacgaaaaccuguuuaagaaacauaccacagugaccgucaagaaacucgagaauuaucugaagcagaaccacaaucuggugaaaguugaaauuaaggggcuugccgaugagaaaaaguucaacucuggacucacaaccuacaauagauucaagaaccugaauaucuuugacaaccagauugaugaccugaaauaccgcaaggauuucgagaaaaucauugaauggagcacgaucuuugaggacaaguccaucuauaaagaaaagcuccggagcauugauuggcugaaugagaagcagaucaacgcgcuuucuaacauuagacugcaaggcugggggcgccucuccaaaaagcugcuggcucagcuucacgaccauaauggacagacaaucauugaacagcucugggauagccaaaacaauuucaugcagaucgugacccaggccgacuuuaaagaugccaucgcuaaggccaaccagaaucugcuggucgcuaccucuguggaggacauucucaacgacgccuacacauccccugcgaauaaaaaggccauccggcaaguuauuaagguggucgaugacaucgugaaagcugccagcggcaaggugcccaaacagauugcuaucgaguucaccagagaugccgacgauaacccuaagcggucccagacacgcgggucuaaacugcagaagguuuauaaggaccuuagcacggaacuggcguccaaagccauugcugaggaacucaaugaggccaucaaggauaaaaagcugguccaagacaaauacuaucuguacuuuaugcagcuuggaagagaugcuuauaccggcgaacccaucaacauugacgagauccagaaguacgauauugaccacauccucccccaaucuuucauuaaggacgaugcccuggacaaucgggugcuggugagcaaagccgucaacaaugauaaguccgacaacgugccuguuaaacucuuuggcaaugagauggcugggaaccugggaaucacaaucagaaagaugugggaagaguggaaaaacauuggccuuaucagcaagaccaaauacaauaaccugcucacagauccggaccauauuaauaaguaugaaucugcgggguucauccgccggcagcugguggagaccucccagauuaucaagcuggucagcacgauccuucagucuagauaccccaacaccgagauuaucacagugaaagccaaguauaaucacuaccugcgcgaaaaauuugaucucuauaaguccagagagguuaacgacuaccaucacgcuauugaugccuaucugagcgccaucuguggaaaucuccuguaccaaaacuacccuaaucuucggcccuucuuuguguauggccaguacaaaaaguucucuagcgacccugauaaggaaaaagagauuuucaacaagacccgcaaauuuuccuucaucagccagauucugaagaauaaaucugaaaacuccaaggagaucgcugagaagcucaaaagagccuaucaguuuaaguacaugcuggucagccgggaaacagagaccaaagaccaagaaauguucaagaugacgguguuuccccgcgagacaccggggaaucugaucccuaaaaagaagggcauggcgaccgaaauuuauggaggcuacaccaaaaacuccgaugcuuauaugguuaucgugaagauugacaaaaagaaagagacagaguacagaauccuugggauucccacccgggaacuggucaaucucaagaaagccgagaaggaagaccacuacgagucuuaucugaaggaaauccucgccccucgcauccuguacaacaaaaauggaaagagagauaaaaagauuacgagcuucgagaucgugaaauccaagauucccuauaaacaggugauccaggacggcgauaaaaaguuuaugcuugggucuagcacauacgucuauaacgcuaaacagcugacccucuccacagagucuaugaaggccauuaccaacaauuucgacaaagauagcgacgaaaacgaugcgcugaucaaggcuuacgacgagauccuggauaagguugacaaauaucuuccucuguuugauauuaaugccuuccggaagaaacuccauuccggacgcgaaaaguuuguggagcugagccucgaggacaaaaaggauaucauucugaaggugcuuaucggccugcacgacaaccccgccacaucugaccugaaaacccucggguucuccagcacggaacugggcaagaugcagaaaaauucuggaauuguccuuuccggcaacgcuaagcugaucuaccaaagcccgacagggcuguucaaaaagucugugaaaauuuccgaucuguga

SEQ ID NO: 4290 - RNA, 4113 nt, Artificial Sequence
  Cas9 variant
augaacaagcccuacagcaucggccuggacauugggaccaauuccgugggauggucuaucauuacagaugacuauaaagucccugccaagaaaaugagaguucucggcaacacggauaaggaguacaucaaaaagaaucugauuggggcucugcuguucgacggaggcaacaccgccgcggaucggcgccucaagagaacagcucggcgcagauauacccggcgcagaaaucggauccuguaccuucaggaaaucuuugccgaggaaaugagcaaaguggacgauuccuucuuucaccgccuggaggacucuuuccucguggaagaggauaagagagggagcaaauauccgauuuuugccacaaugcaagaggaaaaguacuaucaugagaaauuccccaccaucuaccaucugcggaaggaacuggcugacaagaaagagaaggccgaucuccgccugauuuaccuugcucuggcccacaucauuaaauuuagaggacacuuccucaucgaggacgaucgguuugacguccgcaacacagacauucagaagcaguaucaggcguuccuggaaaucuuugauaccacguucgagaauaacgaccuucugucccaaaauguggauguugaagccauccucaccgacaaaauuucuaagagcgcuaaaaaggauagaauccuggcccgguacccuaaccagaaguccacaggcauuuuugcugaguuccugaaacucaucgugggcaaucaggccgacuucaagaaacauuuuaaccuggaagauaagacaccccuucaguucgcgaaagacagcuaugaugaggaccuggagaaucuccuggggcaaauuggagaugaauuugccgaccuuuucucugcugccaagaagcuguacgacuccguccuccugagcggcauccugaccgugaccgaucucucuacgaaagcuccucuguccgccagcaugauccagagauaugacgagcaccgcgaagaucuuaagcagcugaaacaguuuguuaaggccucucuccccgagaaauaccaagaaauuuucgcugacuccagcaaggauggguaugcgggauacaucgagggcaagacaaaccaggaggccuuuuacaaauaucuguccaaacuucugaccaaacaggaagggucugaguaccuccuggaaaagauuaaaaaugaggacuuccugcggaagcaaagaacauuugauaacggaagcaucccucaccaggugcaucucaccgaacugcgcgcuauuauccggagacaguccgaguauuacccguuccuuaaggagaaccuggaccgcaucgaaaagauucucaccuuucggauccccuauuacgucggcccucuggccagagaaaagagcgauuucgccuggaugacacgcaaaacggacgauucuauucggcccuggaauuuugaagaccugguggauaaggagaaauccgcugaggccuucauccacagaaugaccaacaaugaccuuuaucucccugaagagaaggugcugcccaaacauagccugauuuacgaaaaguucacagucuacaacgagcucaccaagguucgcuuucuggcggaaggcuucaaagacuuucaguuccuuaaucggaagcaaaaagagacaaucuuuaacucucuguucaaggagaaaagaaaggugaccgaaaaggauauuaucagcuuucucaauaaaguggacggguaugagggaaucgcuauuaagggcaucgaaaaacaguucaacgccucccugucuacguaccacgaucugaagaaaauucuugggaaggacuuucucgauaauacagacaacgagcugauccuggaagauauuguccagacccucacccuguucgaggaccgggagaugauccgcaagagacuugauaucuauaaagacuuuuucacagaaagccagcugaagaaacucuaccggagacacuauaccggauggggccgccuguccgccaagcugauuaaugggauccggaacaaagagaaucaaaagacaauucuugauuaccucaucgacgauggaagcgcuaacagaaauuuuaugcagcugauuaaggacgccggccugucuuucaaaccgaucaucgacaaggcucgcacgggcucccauagcgauaaccucaaagaagugguuggggagcuggccggaucuccugcgauuaagaaaggcauccuucagucccugaagauuguggacgaacucgucaaagugaugggguaugagcccgagcagaucguuguggaaauggccagagagaaccaaaccacagcuaagggacugagccggucccgccagagacugaccacacuucgggaaucucucgccaaucuuaagagcaacauucuggaggagaaaaagccuaaauacgucaaggaucagguggaaaaucaccaucucuccgacgaucgccuguuccuuuacuaucugcagaacggcaaagacauguacaccgaugacgagcucgauaucgacaaucugucucaauaugauaucgaccacauuaucccccaggcuuuuauuaaggacgauagcaucgacaacagaguccugguguccagcgccaagaaucgggggaaaucugaugacguucccuccguggaaauugucaaggauugcaaaguguucuggaagaaacuucuggacgcgaagcucaugagccagcgcaaguacgauaaccugacgaaagccgagagaggcggacucaccucugacgauaaggcucgguuuauccaacgccagcugguugaaacaagacagauuaccaaacauguggcccggauccuugacgagagauucaauaacgagcuggauuccaagggccgccggaucagaaaagucaagauugugacacucaagagcaaucuggugucuaacuuucgcaaagaauuuggguuuuauaagauccgggagguuaauaacuaccaccacgcucaugacgccuaucugaaugccgucguggcuaaagcgauucuuaccaaguacccucagcuggaaccggaguucguguacggagauuaucccaaauacaacagcuauaagacgagaaaguccgccacagaaaaacucuuuuucuacagcaacaucaugaauuucuucaagaccaaagucacacuggcugacggcaccgugguugugaaggacgauauugaggucaacaaugacaccggggagaucgugugggauaaaaagaaacacuucgccacaguucgcaaggugcucucuuauccucaagucaacaucgugaagaaaacggaaauucagaccggaggcuuuuccaaggagagcauccuggcccauggcaauuccgacaaacuuauuccccggaagacaaaagauaucuaccuggacccuaagaaguaugggggauucgauucucccaaaguugcuuacagcgugcucgucguggccgacauuaagaaaggcaaggcgcagaaacugaagaccgugacagaacugcuugggaucaccaucauggagagaucccgcuuugaaaagaacccgucugcuuuccuggagagcaaaggauaccucaauauucgggaugacaagcugaugauccucccuaaauauucccuguuugagcuugaaaacggcagacggcgccugcuggccucugccggggagcuccagaagggaaaugaacuggcccuucccacgcaauucaugaaauuucuguaccucgcuagcagauauaacgagcugaagggcaagccugaggaaauugagcagaaacaggaguucgucguucagcacguguccuacuuugaugacauccuccaaauuaucaaugauuucagcaaccgggugauucuggcggacgcuaaucuugagaagaucaacaaacuguaucaggacaauaaggaaaacauccccgucgaugagcuggccaacaauauuaucaaccucuuuacauucaccucucugggggccccugcugccuuuaaauucuucgacaagauuguggaucgcaaaagauacaccuccacaaaggagguucuuaauagcacccugauccacaagucuauuacaggccucuaugaaacgcggaucgaccugggaaaacucggcgaggauuga

SEQ ID NO: 4291 - RNA, 4113 nt, Artificial Sequence
  Cas9 variant
augaacaagcccuacagcaucggccuggacauugggaccaauuccgugggauggucuaucauuacagaugacuauaaagucccugccaagaaaaugagaguucucggcaacacggauaaggaguacaucaaaaagaaucugauuggggcccuucuguucgacggaggcaacaccgccgcggaucggcgccucaagagaacagcucggcgcagauauacccggcgcagaaaucggauccuguaccuucaggaaaucuuugccgaggaaaugagcaaaguggacgauuccuucuuucaccgccuggaggacucuuuccucguggaagaggauaagagagggagcaaauauccgauuuuugccacacugcaagaggaaaaggacuaccaugagaaauucuccaccaucuaucaucugcggaaggaacucgcugauaagaaagagaaggccgaccugcgccuuauuuacaucgcucuggcccacauuaucaaauuuagaggacacuuccucauugaggaugacucuuuugacguccggaacacagauaucagcaagcaguaccaggacuuccuggaaaucuuuaauaccacguucgagaacaaugaucuucugucccagaacguggacguugaagcgauucucaccgauaaaaucagcaagucugccaaaaaggaccgcauucuggcucaauaucccaaucagaaguccacaggcaucuuugccgaguuccugaaacucauugugggcaaccaggcugauuucaagaaauacuuuaaucuggaagacaagaccccucuucaguucgccaaagauagcuaugacgaggaucuggagaaccuccuggggcaaaucggagacgaauuugcggaccuuuucucugccgcuaagaagcuguacgauuccguccuccugagcggcauccugacagugauugaccucucuaccaaagcuccccuguccgcuagcaugauccagagauaugaugagcaucgggaagaccuuaagcagcugaaacaguuuguuaaggccucccucccugagaaauaccaagaaauuuucgccgauucuagcaaggacggguaugcuggauacaucgagggcaagacgaaucaggaggcguuuuacaaauaucuguccaaacuucugacaaagcaggaagauagcgagaacuuccucgaaaagauuaaaaacgaggacuuucugagaaagcaacgcaccuucgauaaugggucuaucccccaccaggugcaccugacagaacucaaggccaucauucggagacaguccgaguacuauccuuuucugaaagagaaccaggaccgcaucgaaaagauucuuaccuuccggaucccguacuauauuggaccccuggcuagagagaaaagcgauuuugccuggaugacccgcaagacagacgauucuauccggccuuggaauuucgaagaccucgucgacaaagaaaagagcgccgaggcuuucauucauagaaugacgaacaaugauuuuuaccugcccgaagagaaagugcugccuaagcacucccuuaucuaugaaaaguucaccguguacaacgagcucacaaaaguccgcuacaagaaugaacaaggcgagaccuauuucuucgacucuaacaucaaacaggagauuuuugauggcguuuucaaggaacaucggaaagugagcaagaagaaacugcuggacuuucucgccaaggaguacgaagaguucagaaucguggaugucauugggcuggacaaagaaaauaaggcguuuaacgcuucccuuggaacauaucacgaucuggagaaaauccucgacaaggauuuccuggacaaucccgauaacgagagcauucuggaagacaucgugcagacccuuacgcucuuugaggaucgcgaaaugaucaagaaacggcuggagaauuacaaggaccuguucacagaaucucagcucaaaaagcuguauagacggcacuacaccggcugggggcgccuuuccgccaaacugauuaacggaaucagagacaaggagagccaaaagaccauucucgauuaucugaucgacgauggccggucuaauagaaacuuuaugcagcugauuaacgacgaugggcuuuccuucaaaagcaucaucuccaaggcccaggcuggaucucauagcgacaaucucaaagagguugugggcgaacuggccggcuccccggcuauuaagaaagggauccugcagucucucaagauugucgaugagcuggugaaaguuaugggauacgaaccugagcaaaucguggucgagauggcccgcgaaaaccagacaaccaaucagggccggagaaacagccgccagagauacaaacuucuggacgauggggugaagaaucucgcguccgaccugaacggaaauauucugaaggaguaucccacagauaaccaagcccuucagaaugaacgccucuuccuguacuaucugcagaacggccgggacauguacacgggggaggcucucgacaucgauaaucugagccaauaugacaucgaucacauuaucccucaggccuuuauuaaggacgauucuaucgacaacagaguccuuguguccagcgcuaaaaaucggggcaagucugaugacguucccucccuggaaauugugaaagauugcaaggucuucuggaagaaacuccuggacgccaagcugaugagccagcgcaaauacgauaaccuuaccaaggcggagagaggaggccugacaucugacgauaaagcccgguuuauccagcgccaacucguggagaccagacagauuacaaagcauguugcucggauccuggacgaacgcuucaauaacgagcucgacagcaaggggagacggaucagaaaagugaagauugucacccugaaauccaaccuugugagcaauuuucgcaaggaauuuggauuuuauaaaauccgggaggugaacaauuaccaccaugcccacgaugcuuaccugaacgccguugucgccaaggcuauucucacgaaguauccccagcuggaaccugaguucguguacggcgacuauccgaaauacaauucuuauaagaccagaaaauccgcgacagagaagcuguuuuucuacagcaacaucaugaacuuuuucaaaaccaaggugacacuugccgaugggaccgucgugguuaaggacgauauugaagugaauaaugacacgggagagaucgucugggauaaaaagaaacacuucgcuacagugcgcaagguucuguccuauccccagaacaauaucgugaaaaagaccgaaauucaaacaggcggguuuucuaaagagagcauccucgcccauggcaacuccgacaagcugauuccucggaagaccaaagauaucuaccucgaccccaagaaauacggaggcuucgauucuccuauugucgccuauagcgugcugguuguggcugacaucaagaaagggaaggcccagaaacuuaagaccgucacagaacugcucggaaucacgauuauggagagaucccgcuuugagaagaaucccucugcguuccuggaaagcaaaggcuaccugaacauccgggcugauaaacuuauuauccugccgaaguauucccucuuugagcuggaaaaugggagacgccggcuccuggccagcgccggagagcuucagaagggcaacgagcuggcucugccuacccaguucaugaaguuucucuaccuggccucuagauauaacgaauccaaagggaagcccgaggaaauugagaaaaagcaagaguucgugaaucagcacgugagcuacuuugacgacauccuucagcugauuaacgauuucucuaaacgggucauccucgcggacgcuaaucuggagaagaucaacaagcucuaucaagauaauaaagagaacauuuccguugacgaacuggccaauaacaucauuaaucuuuuuacauucaccagccugggcgccccugcugccuuuaaguucuucgauaaaaucguggaccgcaagagauacacaucuaccaaagaggugcugaacuccacgcucauucaucagagcaucacaggacuguacgaaacccggaucgaucuuggcaagcugggggaggacuga

SEQ ID NO: 4292 - RNA, 4113 nt, Artificial Sequence
  Cas9 variant
augaacaagcccuacagcaucggccuggacauugggaccaauuccgugggauggucuaucauuacagaugacuauaaagucccugccaagaaaaugagaguucucggcaacacggauaaggaguacaucaaaaagaaucugauuggggcccuucuguucgacggaggcaacaccgccgcggaucggcgccucaagagaacagcucggcgcagauauacccggcgcagaaaucggauccuguaccuucaggaaaucuuugccgaggaaaugagcaaaguggacgauuccuucuuucaccgccuggaggacucuuuccucguggaagaggauaagagagggagcaaauauccgauuuuugccacacugcaagaggaaaaggacuaccaugagaaauucuccaccaucuaucaucugcggaaggaacucgcugauaagaaagagaaggccgaccugcgccuuauuuacaucgcucuggcccacauuaucaaauuuagaggacacuuccucauugaggaugacucuuuugacguccggaacacagauaucagcaagcaguaccaggacuuccuggaaaucuuuaauaccacguucgagaacaaugaucuucugucccagaacguggacguugaagcgauucucaccgauaaaaucagcaagucugccaaaaaggaccgcauucuggcucaauaucccaaucagaaguccacaggcaucuuugccgaguuccugaaacucauugugggcaaccaggcugauuucaagaaauacuuuaaucuggaagacaagaccccucuucaguucgccaaagauagcuaugacgaggaucuggagaaccuccuggggcaaaucggagacgaauuugcggaccuuuucucugccgcuaagaagcuguacgauuccguccuccugagcggcauccugacagugauugaccucucuaccaaagcuccccuguccgcuagcaugauccagagauaugaugagcaucgggaagaccuuaagcagcugaaacaguuuguuaaggccucccucccugagaaauaccaagaaauuuucgccgauucuagcaaggacggguaugcuggauacaucgagggcaagacgaaucaggaggcguuuuacaaauaucuguccaaacuucugacaaagcaggaagauagcgagaacuuccucgaaaagauuaaaaacgaggacuuucugagaaagcaacgcaccuucgauaaugggucuaucccccaccaggugcaccugacagaacucaaggccaucauucggagacaguccgaguacuauccuuuucugaaagagaaccaggaccgcaucgaaaagauucuuaccuuccggaucccguacuauauuggaccccuggcuagagagaaaagcgauuuugccuggaugacccgcaagacagacgauucuauccggccuuggaauuucgaagaccucgucgacaaagaaaagagcgccgaggcuuucauucauagaaugacgaacaaugauuuuuaccugcccgaagagaaagugcugccuaagcacucccuuaucuaugaaaaguucaccguguacaacgagcucacaaaaguccgcuacaagaaugaacaaggcgagaccuauuucuucgacucuaacaucaaacaggagauuuuugauggcguuuucaaggaacaucggaaagugagcaagaagaaacugcuggacuuucucgccaaggaguacgaagaguucagaaucguggaugucauugggcuggacaaagaaaauaaggcguuuaacgcuucccuuggaacauaucacgaucuggagaaaauccucgacaaggauuuccuggacaaucccgauaacgagagcauucuggaagacaucgugcagacccuuacgcucuuugaggaucgcgaaaugaucaagaaacggcuggagaauuacaaggaccuguucacagaaucucagcucaaaaagcuguauagacggcacuacaccggcugggggcgccuuuccgccaaacugauuaacggaaucagagacaaggagagccaaaagaccauucucgauuaucugaucgacgauggccggucuaauagaaacuuuaugcagcugauuaacgacgaugggcuuuccuucaaaagcaucaucuccaaggcccaggcuggaucucauagcgacaaucucaaagagguugugggcgaacuggccggcuccccggcuauuaagaaagggauccugcagucucucaagauugucgaugagcuggugaaaguuaugggauacgaaccugagcaaaucguggucgagauggcccgcgaaaaccagacaaccaaucagggccggagaaacagccgccagagauacaaacuucuggacgauggggugaagaaucucgcguccgaccugaacggaaauauucugaaggaguaucccacagauaaccaagcccuucagaaugaacgccucuuccuguacuaucugcagaacggccgggacauguacacgggggaggcucucgacaucgauaaucugagccaauaugacaucgaucacauuaucccucaggccuuuauuaaggacgauucuaucgacaacagaguccuuguguccagcgcuaaaaaucggggcaagucugaugacguucccucccuggaaauugugaaagauugcaaggucuucuggaagaaacuccuggacgccaagcugaugagccagcgcaaauacgauaaccuuaccaaggcggagagaggaggccugacaucugacgauaaagcccgguuuauccagcgccaacucguggagaccagacagauuacaaagcauguugcucggauccuggacgaacgcuucaauaacgagcucgacagcaaggggagacggaucagaaaagugaagauugucacccugaaauccaaccuugugagcaauuuucgcaaggaauuuggauuuuauaaaauccgggaggugaacaauuaccaccaugcccacgaugcuuaccugaacgccguugucgccaaggcuauucucacgaaguauccccagcuggaaccugaguucguguacggcgacuauccgaaauacaauucuuauaagaccagaaaauccgcgacagagaagcuguuuuucuacagcaacaucaugaacuuuuucaaaaccaaggugacacuugccgaugggaccgucgugguuaaggacgauauugaagugaauaaugacacgggagagaucgucugggauaaaaagaaacacuucgcuacagugcgcaagguucuguccuauccccagaacaauaucgugaaaaagaccgaaauucaaacaggcggguuuucuaaagagagcauccucgcccauggcaacuccgacaagcugauuccucggaagaccaaagauaucuaccucgaccccaagaaauacggaggcuucgauucuccuauugucgccuauagcgugcugguuguggcugacaucaagaaagggaaggcccagaaacuuaagaccgucacagaacugcucggaaucacgauuauggagagaucccgcuuugagaagaaucccucugcguuccuggaaagcaaaggcuaccugaacauccgggaugacaaacuuaugauucugccgaaguauucccucuuugagcuggaaaaugggagacgccggcuccuggcuagcgccggagagcuucagaagggcaacgagcuggcccugccuacccaguucaugaaguuucucuaccuggcuucuagauauaacgaauccaaagggaagcccgaggaaaucgagaaaaagcaagaguucgugaaucagcacgugagcuacuuugacgauauucuucagcugaucaacgacuucucuaaacgggucauucucgccgaugcgaaucuggagaagaucaacaagcucuaucaagacaauaaagagaacaucuccguugaugaacuggcuaauaacauuaucaaucuuuuuacauucaccagccugggcgccccugccgcuuuuaaguucuucgacaaaauuguggaucgcaagagauacacaucuaccaaagaggugcugaacuccacgcucauccaucagagcauuacaggacuguacgaaacccggaucgaccuuggcaagcugggggaggauuga

SEQ ID NO: 4293 - RNA, 4113 nt, Artificial Sequence
  Cas9 variant
augaacaagcccuacagcaucggccuggacauugggaccaauuccgugggauggucuaucauuacagaugacuauaaagucccugccaagaaaaugagaguucucggcaacacggauaaggaguacaucaaaaagaaucugauuggggcucugcuguucgacggaggcaacaccgccgcggaucggcgccucaagagaacagcucggcgcagauauacccggcgcagaaaucggauccuguaccuucaggaaaucuuugccgaggaaaugagcaaaguggacgauuccuucuuucaccgccuggaggacucuuuccucguggaagaggauaagagagggagcaaauauccgauuuuugccacaaugcaagaggaaaaguacuaucaugagaaauuccccaccaucuaccaucugcggaaggaacuggcugacaagaaagagaaggccgaucuccgccugauuuaccuugcucuggcccacaucauuaaauuuagaggacacuuccucaucgaggacgaucgguuugacguccgcaacacagacauucagaagcaguaucaggcguuccuggaaaucuuugauaccacguucgagaauaacgaccuucugucccaaaauguggauguugaagccauccucaccgacaaaauuucuaagagcgcuaaaaaggauagaauccuggcccgguacccuaaccagaaguccacaggcauuuuugcugaguuccugaaacucaucgugggcaaucaggccgacuucaagaaacauuuuaaccuggaagauaagacaccccuucaguucgcgaaagacagcuaugaugaggaccuggagaaucuccuggggcaaauuggagaugaauuugccgaccuuuucucugcugccaagaagcuguacgacuccguccuccugagcggcauccugaccgugaccgaucucucuacgaaagcuccucuguccgccagcaugauccagagauaugacgagcaccgcgaagaucuuaagcagcugaaacaguuuguuaaggccucucuccccgagaaauaccaagaaauuuucgcugacuccagcaaggauggguaugcgggauacaucgagggcaagacaaaccaggaggccuuuuacaaauaucuguccaagcugcugaccaaacaggaagggucugaguaccuccuggaaaagauuaaaaaugaggacuuccugcggaagcaaagaacauuugauaacggaagcaucccucaccaggugcaucucaccgaacugcgcgcuauuauccggagacaguccgaguauuacccgcuucugaaggagaaccucgaccgcaucgaaaagauucugaccuuccggauccccuauuacgucggcccucuggccagagagaaguccgauuuugccuggaugacacgcaaaacggacgauucuauucggcccuggaauuucgaagaccuuguggauaaggagaaauccgcugaggccuuuauccacagaaugaccaacaaugaccucuaucugccugaagagaaggugcugcccaaacauagccucauuuacgaaaaguucacagucuacaacgagcugaccaagguucgcuuccuugcggaaggcuuuaaagacuuccaguuucugaaucggaagcaaaaagagacaaucuucaacucucucuuuaaggagaaaagaaaggugaccgaaaaggauauuaucagcuuccugaauaaaguggacggguaugagggaaucgcuauuaagggcaucgaaaaacaguuuaacgccucccugucuacguaccacgaucuuaagaaaauucucgggaaggacuuccuggauaauacagacaacgagcugauccucgaagauauuguccagacccugacccuuuuugaggaccgggagaugauccgcaagagacuggauaucuauaaagacuucuuuacagaaagccagcucaagaaacuguaccggagacacuauaccggauggggccgccuguccgccaaacuuauuaaugggauccggaacaaagagaaucaaaagacaauucucgauuaccugaucgacgauggaagcgcuaacagaaauuucaugcagcugauuaaggacgccggccucucuuuuaaaccgaucaucgacaaggcucgcacgggcucccauagcgauaaccugaaagaagugguuggggagcuugccggaucuccugcgauuaagaaaggcauccugcagucccucaagauuguggacgaacuggucaaagugaugggguaugagcccgagcagaucguuguggaaauggccagagagaaccaaaccacagcuaagggacugagccggucccgccagagacuuaccacacuccgggaaucucuggccaaucuuaagagcaacauucucgaggagaaaaagccuaaauacgucaaggaucagguggaaaaucaccaucuguccgacgaucgccuuuuccuguacuaucuccagaacggcaaagacauguacaccgaugacgagcuggauaucgacaaucugucucaauaugauaucgaccacauuaucccccaggcuuucauuaaggacgauagcaucgacaacagaguccuuguguccagcgccaagaaucgggggaaaucugaugacguucccuccguggaaauugucaaggauugcaaaguguuuuggaagaaacugcucgacgcgaagcugaugagccagcgcaaguacgauaaccucacgaaagccgagagaggcggacugaccucugacgauaaggcucgguucauccaacgccagcuuguugaaacaagacagauuaccaaacauguggcccggauccuggacgagagauuuaauaacgagcucgauuccaagggccgccggaucagaaaagucaagauugugacacuuaagagcaaucuggugucuaacuuccgcaaagaauuuggguucuauaagauccgggagguuaauaacuaccaccacgcucaugacgccuaucuuaaugccgucguggcuaaagcgauucugaccaaguacccucagcucgaaccggaguuuguguacggagauuaucccaaauacaacagcuauaagacgagaaaguccgccacagaaaaacuguucuuuuacagcaacaucaugaauuucuuuaagaccaaagucacacucgcugacggcaccgugguugugaaggacgauauugaggucaacaaugacaccggggagaucgugugggauaaaaagaaacacuucgccacaguucgcaaggugcugucuuauccucaagucaacaucgugaagaaaacggaaauucagaccggaggcuucuccaaggagagcauccuugcccaugggaauagcgacaaacugauuccccggaagacaaaagauaucuaccucgacccuaagaaguauggcggauuugauucucccauuguugcuuacagcgugcuggucguggccgacaucaaaaagggcaaagcgcagaagcugaaaaccgugacagaacuucuggggaucaccauuauggagagaucccgcuucgaaaagaacccgucugcuuuucucgagagcaagggauaccuggauauccgggacgauaaacucaugauucugccuaaguauucccuuuucgagcuggaaaauggcagacggcgccugcucgccucugccggggagcugcagaaaggaaacgaacuugcucugcccacgcaauuuaugaaguuccucuaccuggccagcagauauaaugagcucaaaggcaagccugaggaaaucgagcagaagcaggaauuugucguucagcacguguccuacuucgacgauauucugcaaaucauuaacgacuuuagcaaucgggugauccuugcggacgcuaaccuggagaaaaucaauaagcuguaucaggauaacaaagaaaauauucccgucgacgagcucgccaacaacaucauuaaucuguucacauuuaccucucuuggggccccugcugccuucaaguuuuucgauaaaaucguggaccgcaagagauacaccuccacaaaagagguucugaacagcacccucauucaccagucuaucacaggccuguaugaaacgcggaucgaucucggaaagcugggcgaggacuga

SEQ ID NO: 4294 - RNA, 4113 nt, Artificial Sequence
  Cas9 variant
augaagaaacccuacagcaucggccuggacauugggaccaacuccgugggaugggccgucguuacagaugacuauaaggugccugcuaaaaagaugagaguguucggcgauacggaccggucucacaucaaaaagaaucuccuggggacccuucuguuugaugacggaaacacagccgagagccgcagacucaagcggaccgcgcgcagacgguacacacgcagacggaaucgcauucuguaucuucaggaaaucuucaccgaguccaugaacgaaauugaugagagcuuuuuccauagacuggacgauagcuuucucgucccggaagacaaacggggcuccaaguaccccaucuucgcuacacugcaagaggagaaagaauaucacaagcaguuuccuaccaucuaccaucugcgcaaacagcucgccgauucuaaggagaagucugacgugagacugauuuaucuugcccuggcucacaugaucaaauaccgggggcauuuccucuacgaagagacguuugauauuaagaauaacgacauccagaaaauuuucaaugaguuuaucaacauuuaugacaauaccuucgaaggauccagccugucuggccaaaacgcccagguugaggcuaucuuuacagauaagaucuccaaaagcgccaagcgcgaaagagugcuuaaacuguuccccgacgagaagucuaccggccucuucuccgaauuucugaagcugauugucgggaaucaggcggauuucaaaaagcacuuugaccucgaggagaaagccccucugcaguucagcaaggauacauacgacgaagaacuugaaaaccugcucggacaaaucggcgaugacuuugcugaucuguuccuuauugccaaaaagcuguaugacgcuauccuccugucugggauucugaccgugacggaucccuccacaaaggccccucucagcgcguccaugaucgagcgguacgaaaaucaccagaaagaccuggccgcucuuaagcaguuuaucaaaaacaaucugccggagaaguauguugagguguucucugaccagagcaaagauggauacgccggcuauauugacgggaagaccacacaagaggcuuuuuacaaguacaucaaaaaccuccuguccaaguucgagggagccgauuauuuucuugacaaaauugaaagagaggauuuccugcgcaagcagcggaccuuugacaacggcagcaucccccaucagauucaccuccaagaaaugaaugccauccugagacgccagggcgagcauuacccuuuccugaaagagaaccgggaaaagaucgagaagauucucaccuucagaauccccuauuacgucgggccucuggcucgcgauaaucgggacuuuucuuggcuuacaagaaacuccgaugaacccauucgcccguggaauuucgaggaggugguggacaaagcgcggagcgccgaagauuuuauccacagaaugacgaacuaugaccuguaccucccugaggaaaagguccugcccaaacacucucugcuuuaugagaccuucgcuguuuacaaugaacucacaaaggugaaauuuauugccgagggacugcgcgauuaccaguuccuggacagcggccagaagaaacaaaucgugaaccagcucuuuaaggagaagcggaaagucaccgaaaaggacauuauccauuaucugcacaauguggauggguacgacggaaucgagcuuaaaggcauugaaaagcaguucaacgccaaucuguccacauaucaugaucuccugaaaaucaccaaggacaaggaguuuauggaugacccuaaaaacgaagagauucuggagaauaucguucacacgcuuacaauuuucgaagauagagagaugaucaagcagcggcucgcucaauacgacacccuguuugaugaaaaagugaucaaggcccugacccgcagacauuauacaggguggggaaaacucucugcgaagcugauuaacggcauccgggacaagcagagcggcaaaaccauucuugauuaccugaucgacgaugacaagauuaauagaaacuucaugcagcucaucaacgacgaugggcuguccuuuaaagagaucauucagaaggcucaagucgugggaaaaacagacgauguuaaacaggugguccaggaacugcccggcagccccgccaucaagaaagggauucuucagucuaucaagauuguggacgagcucgucaaagugaugggauaugcccuggaguccaucguuaucgaaauggcucgcgagaaucaaacgaccgcccggggcaagaaaaacagccagcagagauacaagcgcauugaagaugcucugaaaaaucucgccccugggcuggacucuaacauccuuaaggagaauccgacagauaacauucaacugaagaaugacagacucuuccuguacuaucugcagaacggcaaagauauguacaccggaaagccccuugacaucaaucagcucuccagcuaugauauugaccacaucauuccucaggcguucaucaaagacgauuccaucgacaaccgggugcugacaucuagcaaggauaaucgcggcaaauccgacaacguccccucucuggaggugguucaaaagagaaaggccuuuuggcagcagcuccuggauagcaaacuuauuuccgaacggaaguucaauaaccugaccaaagcugagcgcgggggacucgacgaaagagauaaggugggcuuuauccggcgccagcuggucgagacgcaacagauuaccaaaaauguggcccagauccuggacgcuagauucaacacagaagugaaggagaagaaccagaaaauucggaccguuaagaucaucacacuuaaaagcaaucuggucucuaacuuucgcaaggaguucgggcucuacaaagugagagaaauuaauaacuaucaccaugcccacgaugcguaccugaaugccguggucgcuaaggccauccucaagaaauauccuaagcuggagcccgaauuuguguacggagacuaccaaaaauaugaucuuaagaaauacauuucccgguucaagccgagcaaggagaucgaaaaagcuaccgagaaguacuuuuucuauucuaaccugcucaacuuuuucaaagaggaaguucuguaugccgacggcacgauuagaaagcgcgagaauaucgaauacuccaaagauacaggggagaucgccugggacaaggaaaaagacuucgcuaccauuaagaaggugcugagcuauccucaggucaauaucgugaaaaagcgggagguucagacaggcggauuuucuaaagagagcauucuucccaagggcaacuccgauaaacugaucccuagaaagaccaaggacauucucugggauaccacaaaauacgggggauucgacagccccgugaucgcguacucuauucugcucaucgccgauaucgaaaagggcaaagcuaagaaacugaagacggucaagacccuuguggggauuacaaucauggagaaagccgccuuugaagagaauccuauuaccuuccuggagaacaagggauaucauaauguucgcaaagaaaacauccucugccugcccaaguacucccuguuugagcuugaaaauggccggagacgccugcucgcuagcgccaaagagcugcaaaaggggaacgaaauugugcucccggucugucugacaacccuucuguaucacuccaagaaccugcacaaacucgacgagccugagcaucuggaauacauccagaagcaccggaaugaguucaaagaucuucugaaccucgugucugaauuuagccagaaguauauccuggcggaggcuaaucucgaaaagauuaaggaccuguacgccgauaacgagcaggccgacaucgagauucuugcuaauuccuucaucaaccugcugacguuuacagcccucggcgcgcccgcugccuucaaauuuuucggaaaggauguggacagaaagcgcuauaccaccgucucugaaauucugaaugccacacuuauccaucaaagcaucaccggccuguacgagacacggauugaucucuccaaacugggggaagaguga

SEQ ID NO: 4295 - RNA, 4113 nt, Artificial Sequence
  Cas9 variant
augaagaaacccuacagcaucggccuggacauugggaccaacuccgugggaugggccgucaucacagaugacuauaagguuccugcuaaaaagaugaaagugcucggcaauacggauaagaacuacauuaagaaaaaucugcuuggggcccuccuguucgacucuggaaacaccgcggaggauagacggcugaagcgcacagcuagacggcgcuauaccagacggcgcaauagacuucuguaccuccaggacaucuuuagcgaugaaaugaacaaaguggacgaguccuucuuucaccggcuggaagauucuuuccuggucagcgaggacaagcgcggcgaucaucacccgauuuuugggaaugugguugacgaagugaaauaucaugagcaauuccccacaaucuaccaccucagaaaguaucuggccgauaccccugagaaggccgaccuucggcuggucuaccucgcucuggcccauaugaucaaauuucgcggacacuuccuuauugacgaucccaagcuggacgugaaaaacacagauucccaggaacucuuuucucaguuccugaccgcuuacgacguuacgcaggaggauagccaccuggccgacgugaagaucaauauuuccgauaucauuaccgaaaagaugaacaagagcagaaaagucgaggcgcuccuguuucauuucccuucucaaaagaaaaauuccuuuuucggcaaccuugugagccugguguucggccuccugcccaauuuuaaaacaaacuucaaucuugccgaggacgcuaagcugcagcucucuaaagauuccuaugacgaagaucuggagaaccugcucgggcagaucggagacgaauacaccgacgucuuuguugccgcucggaagcuguaugauagcauucuucugucuggcauccucacagugaacgaccuguccaccaaagccauccuuagcgcguccauggugcgcagauacgaggaacacaauaaggaucuggccaagcucaaggcuuucgucaaggccaacuuuacgcaugacguguucaaagagguguuuucugaugcuagcaagaauggguaugccggauacauugagggcaaaacaucccaggaagacuucuauaaguacguuaagaaccugaucgggaaagucgauggaagcgccgacuuuauugagaagaucgaucgggaagacuuccugagaaaacaacgcaccuuugauaauggcucuauuccucaccaggugcaccucgcugagaugaaggcgauccugcggagacagggcgaauacuauccguuccuuaaagagcaugccgagaagauccagcaaauucugacauuucgcauccccuacuauguugggccucucgaccggcacggacauuccgauuucgcuugggccagcuucaacucugaagagaaggugacccccuggaauuuugaagagauuaucgacaaaaacaagagcgcccaggcuuucauugaaagaaugaccaaucaggaccuguaccugccuaacgagaaaguccuucccaagcacuccccgcucuaugagaaauacacaguguauaaugaacugacgaagaucaaauacgucaccgagacaggcaccgccaaguuuuucgaugcgaaccugaagcaagaaaucuuugacggacucuucaaaaaggagcgcaaagugacaaagcggaaacugcuuaccuuucuggagaagaauuucgaugaauuuagaauuguugacauccaggggcucgauaaggagacggaaacauucaacgcuucuuacggcauuuaucaggaccugcugaaaaucauuaaggauaaagccuuuauggacgauagcgagaaugccgacauccuugaagauauugugcucacccugacccuguucgaggaccgcgagaugaucaagcagcggcucgcuaaauacgccgaucuguuugacaagaaggucaucgacaaccuugcuagacgccgguauacaggguggggaagacuguccgccaaacuccugaacggcauucgggauaagcgcagcagaaaaaccaucauggacuaccugguggaugacggccggucuaauagaaaccuuaugcaacucauuacagaugacaaucugacguucaaggaugaaaucgcgaaagcccaguauuccgacaacagcgaugaccugcaucagguugugcaggaucucgcugggucuccugccauuaagaagggaauccugcaauccgucaaaaucguggacgagcuugugaagguuaugggcuacgaacccgagcagauugucguggaaauggcucgcgagaaucagaccacagccaaagggcggagaaacagccagcaacgcuauaagagacuggaggaagcgaucaaaaaucucgaccgggaucugaacuacaagauucugaaagagcacccuaccgacaaucaggcccuucagaacgaucgccucuuccuguacuaucugcagaauggaagagacauguacacaggcgaaucccucgauaucaaccggcugucugacuaugauauugaccacaucaucccccaggcuuuuauuaaggauaauagcaucgacaaccgcgugcuugucuccucugccaagaauagagggaaaagcgaugacgugcccuccgaggauguugugaaccggaugcgcccuuucuggaacaagcugcucaauugcggccugauuagccaaagaaaauacucuaaccugaccaagaaagaacuuacgccgaaugacaaggcuggauuuaucaagcggcagcuggucgagacccgccaaauuacaaaacauguggccagaauccucgacgagcacuucaacaaggaauuugaugaggacaaaaagcggaucagaaaaguuaagguggucacccugaaguccaaucucgugagcaacuuccgcaaagaauuugagcuguauaagguucgggagauuaaugauuaccaucacgcccacgacgcuuaucuuaacgcgguggucgccaaagcucugcucaugaaguaccccaaacuggaaccugaguucguguacggcgaauaucccaaguacaauucuuauagagagcgcaagacagccacccagcggauguuuuucuacuccaacaucaugaauauguuuaaaagcaaggugaaacuggccgaugaaagaauuaucgagcgcccuaugauugaggucaacgacgaaacgggggagaucgcuugggauaagacaaaacauauugccaccguuaagaaggugcuuucuuauccccagaucaauaucgugaaaaaggucgaggaacagacaggaggccugaccaacgaaaccauuuacccgcgggggagcuucgacaaacuccugaauagaaagaacacacucgaggcguccaaauauggaggcuucgggagcccuacgguggcuuacuguguucugguggucgccgauucuaagaacgagaauggcaaagugaagaaacuuaaacugggauccgaacuccugggcaucaccauucuggagaagaacgacuuugaaaauaacagccuugauuuccugucccgcaaaggguaccaaggaguucaggagaagaaaaucauuaagcuccccaaguauucucuguuugaguuccaggacggcagccggagaaugcucuccucugugauggccaaugauaacaaacgcggggaccugcagaaggcuaaugaaaugauccuuccugccuaccuggucaaacugcucuaucacgcgaagcauaucaacagcgugggagagcccgcucacaaaaauuacauuaacgaacauugcuccgaguuucaagaccugcuuaauuauauccggcaguucgccgauaaguuuguugacguggauaagaaccugucuaaaauuagaagccucuccaagagcauggccgaauacucugucuccgagaucuguagcucuuucgugaaucugcucacacugaccgcucuuggcgccccugcugacuuuaaauucuuugggacaaccauuccccggaagcgcuauggcuccccgcagagcauccugucugccacgcugauccaccaguccauuacaggacucuacgagaccagaaucgaucugagcaaacuuggcgaagacuga

SEQ ID NO: 4296 - RNA, 4113 nt, Artificial Sequence
  Cas9 variant
augaacaagcccuacagcaucggccuggacauugggaccaauuccgugggauggucuaucauuacagaugacuauaaagucccugccaagaaaaugagaguucucggcaacacggauaaggaguacaucaaaaagaaucugauuggggcucugcuguucgacggaggcaacaccgccgcggaucggcgccucaagagaacagcucggcgcagauauacccggcgcagaaaucggauccuguaccuucaggaaaucuuugccgaggaaaugagcaaaguggacgauuccuucuuucaccgccuggaggacucuuuccucguggaagaggauaagagagggagcaaauauccgauuuuugccacaaugcaagaggaaaaguacuaucaugagaaauuccccaccaucuaccaucugcggaaggaacuggcugacaagaaagagaaggccgaucuccgccugauuuaccuugcucuggcccacaucauuaaauuuagaggacacuuccucaucgaggacgaucgguuugacguccgcaacacagacauucagaagcaguaucaggcguuccuggaaaucuuugauaccacguucgagaauaacgaccuucugucccaaaauguggauguugaagccauccucaccgacaaaauuucuaagagcgcuaaaaaggauagaauccuggcccgguacccuaaccagaaguccacaggcauuuuugcugaguuccugaaacucaucgugggcaaucaggccgacuucaagaaacauuuuaaccuggaagauaagacaccccuucaguucgcgaaagacagcuaugaugaggaccuggagaaucuccuggggcaaauuggagaugaauuugccgaccuuuucucugcugccaagaagcuguacgacuccguccuccugagcggcauccugaccgugaccgaucucucuacgaaagcuccucuguccgccagcaugauccagagauaugacgagcaccgcgaagaucuuaagcagcugaaacaguuuguuaaggccucucuccccgagaaauaccaagaaauuuucgcugacuccagcaaggauggguaugcgggauacaucgagggcaagacaaaccaggaggccuuuuacaaauaucuguccaaacuucugaccaaacaggaagggucugaguaccuccuggaaaagauuaaaaaugaggacuuccugcggaagcaaagaacauuugauaacggaagcaucccucaccaggugcaucucaccgaacugcgcgcuauuauccggagacaguccgaguauuacccguuccuuaaggagaaccuggaccgcaucgaaaagauucucaccuuucggauccccuauuacgucggcccucuggccagagaaaagagcgauuucgccuggaugacacgcaaaacggacgauucuauucggcccuggaauuuugaagaccugguggauaaggagaaauccgcugaggccuucauccacagaaugaccaacaaugaccuuuaucucccugaagagaaggugcugcccaaacauagccugauuuacgaaaaguucacagucuacaacgagcucaccaagguucgcuuucuggcggaaggcuucaaagacuuucaguuccuuaaucggaagcaaaaagagacaaucuuuaacucucuguucaaggagaaaagaaaggugaccgaaaaggauauuaucagcuuucucaauaaaguggacggguaugagggaaucgcuauuaagggcaucgaaaaacaguucaacgccucccugucuacguaccacgaucugaagaaaauucuugggaaggacuuucucgauaauacagacaacgagcugauccuggaagauauuguccagacccucacccuguucgaggaccgggagaugauccgcaagagacuugauaucuauaaagacuuuuucacagaaagccagcugaagaaacucuaccggagacacuauaccggauggggccgccuguccgccaagcugauuaaugggauccggaacaaagagaaucaaaagacaauucuugauuaccucaucgacgauggaagcgcuaacagaaauuuuaugcagcugauuaaggacgccggccugucuuucaaaccgaucaucgacaaggcucgcacgggcucccauagcgauaaccucaaagaagugguuggggagcuggccggaucuccugcgauuaagaaaggcauccuucagucccugaagauuguggacgaacucgucaaagugaugggguaugagcccgagcagaucguuguggaaauggccagagagaaccaaaccacagcuaagggacugagccggcugcgccagagacuuaccacacuccgggaaucccuggccaaucugaagucuaacauucucgaggagaaaaagccuaaauacgucaaggaucagguggaaaaucaccaucugagcgacgaucgccuuuuccuguacuaucuccagaacggcaaagacauguacaccgaugacgagcuggauaucgacaaucugucccaauaugauaucgaccacauuaucccccaggcuuuuauuaaggacgauucuaucgacaacagaguccuugugagcuccgccaagaaucgggggaaaagcgaugacguucccucuguggaaauugucaaggauugcaaaguguucuggaagaaacugcucgacgcgaagcugaugucccagcgcaaguacgauaaccucacgaaagccgagagaggcggacugaccagcgacgauaaggcucgguuuauccaacgccagcuuguugaaacaagacagauuaccaaacauguggcccggauccuggacgagagauucaauaacgagcucgauucuaagggccgccggaucagaaaagucaagauugugacacugaaguccaaucuggugagcaacuuucgcaaagaauuuggguuuuauaagauccgggagguuaauaacuaccaccacgcucaugacgccuaucuuaaugccgucguggcuaaagcgauucugaccaaguacccucagcucgaaccggaguucguguacggagauuaucccaaauacaacucuuauaagacgagaaagagcgccacagaaaaacuguuuuucuacuccaacaucaugaauuucuucaagaccaaagucacacucgcugacggcaccgugguugugaaggacgauauugaggucaacaaugacaccggggagaucgugugggauaaaaagaaacacuucgccacaguucgcaaggugcugagcuauccucaagucaacaucgugaagaaaacggaaauucagaccggaggcuuuucuaaggaguccauccuugcccaugggaauagcgacaaacugauuccccggaagacaaaagauaucuaccucgacccuaagaaguauggcggauucgauucccccauuguugcuuacucugugcuggucguggccgacaucaaaaagggcaaagcgcagaagcugaaaaccgugacagaacuucuggggaucaccauuauggagagaagccgcuuugaaaagaacccguccgcuuuccucgagucuaagggauaccugaauauccgggaugacaaacucaugauucugccuaaguauagccuuuuugagcuggaaaacggcagacggcgccugcucgccuccgccgaugagcugcagaaagggaaugaacuugcucugcccacgcaauucaugaaguuucucuaccuggccucuagauauaacgagcucaaaggaaagccugaggaaaucgagcagaagcaggaguucgucguucagcacgugagcuacuuugacgauauucugcaaaucauuaaugacuucuccaaccgggugauccuugcggacgcuaaucuggagaaaaucaacaagcuguaucaggauaauaaagaaaacauucccgucgacgagcucgccaacaauaucauuaaccuguuuacauucaccagccuuggcgccccugcugccuuuaaguucuucgauaaaaucguggaccgcaagagauacaccucuacaaaagagguucuuaauuccacccucauucaccagagcaucacagggcuguaugaaacgcggaucgaucucggcaagcugggagaggacuga

SEQ ID NO: 4297 - RNA, 4113 nt, Artificial Sequence
  Cas9 variant
auggagaagaacaaagaauacgugaucggccuggacauugggaccggaagcgucggcugguccgccaucucuacagauaauuaucagcucauuagacaaaaggggaaaaaccugaucggaguucggcuuuucaauagcgcugagacggccgaagaacgcagaggcuaccggaccacacgcagacggcugucccgcagacgguggcgcaugucucuccugaacgacauuuuuagacccgaacuuaaugagaucgaugagaacuuccuggcgcggcucaaguauagcuggguguccccucuggaccagaaaaauccgcagcugaacgaacaggggaccaaugcuucucucuacggagauaucgaggccgaccaagccuuucaccgcgcuuaucccacaauuuaccaucugagaaagacccuuauggaagauaaccagaagcacgaccugcgggagguguaucucgccauccaucacauugucaaauaccgcggccauuuccugacaccugauuuugacgcuaauagccagaccaucgauauuaagggccuuuucaaacagcugggggacguguccggaagcaucgagcuccaagccgaucagacgucuaccguuauugcggccuuucaguccauccugcuggacuucacaaagacccccacagaaagcggcagacucgcugggcagcuguuuucugaccaaaacaaagauaagcaggccaagaaacagguggaggaacuuuucaagcugcuccggggaggcaaagggucccuggcugacauguuucuucugaccgaucucgacaaggucgugaaaaaucaacugaaguucgccuuugaugacgcgguugaugagaaccugaaucucaucagcaaccugauuaacgaggagcaguacgagcuucugcucaauauccagaaacugagaggaacgauuauccuuaagcagauucugggcgacgaugaaacagugucugacgccaagguccgcuccuaugaggaacacgcucaccaacucaaagagcugaaggcccaggugcugaccaaagauaacaaggaaaaauucgaggaggcuuaccagcucauccagaagggcgacgccagccggaucgacgggcugaagaaacuuaagacaauuaucaaucaagaacaugaggcccugagacucgauaaauaugaagcugacaagcugcugaaacuuauugagcucgaucagcugcugccugugcagcgcuccaagcggaacggagaaaucccccaccagcuccaugaguucgagcugaagaaaauuaucgaaaagcaaggcagauacuauccuuuucuucgcgagaccuucgaacgggacgggcaggaguuuaauaaaaucggacagcuggucaacuuccgcauuccguacuauguuggcccccucguggauccuagacuggcggggauccagucuggagaccaaaccaaucacuggaugacacagaagaaagccggcaagauuacgcccuggaacuacaccgagcugaucgauauugacaagagcgcugccgaauuuaucaaacggaugacaggcaccgauacauaccuugugggggagccuucccuccacaaggccagccugauuuaucaggacuacaauguccugcaagaacucaacaaucugagauaugauggaaaaccccuuccgguggacgcuaagcaggagaucuacucuaaccugcagguuucccucaaaaaugccaccaagaacaaaaucaauagcuuccugauuucugaaggcuaucugcaggauggggaggagcuuacgggauuugcgggcaaggaacucaagaacaaacugagcuccuuccauuacuuuaagaacaucuucgggccugagcgcaugaauacacugggcaccgacaaccucgagaaaauuaccgagcugcaaacaguguuugaagaccggcacaugcuuaagagacagcugcagaaacucggauuccuggaugacgaugagugcgagaagcuggcuggcaagcauuuuaccggguggggaaaucuuucuaaaaagcuccugaacacacccgccaucauugacccugaaaucaaugagaacaaaaucagccugauugaugcccucuauaagggccagcggaaucuguccuucuacgucaacaauauggacgauaaauaccaauuccgcgacuggaucgaaagcgagaaccagucucaacagguggaaauuucccuugaugagaagaucaagaaucuggcugggagccccgccauuaaaagaggaaucacgcagucuauggcuguuauccaggacauuauccgggccaacaauggcauuucccccaagagaaucuaucucgaguuugcgcgcgaaagccagaacuccuaccaaccuaauucucggauuaaacagaucgagaagaucuaugaucagaacaaaaaggaacugaugaagguguacccggacgucuucaaagaugugcaggggguccugaacaauguggacgagaacaauagccuuuccgagaaggccuuucuguauuucaugcaacucggcaaagacauguacaccggagaagcucuggauuuugacaagcucuauacauacgauauugaccacaucauuccccaggccaugaccaaagauaacucuugggacaauaagguucuggugacagcuaucaaaaacagagaaaagagcaaucagguccuugauaacgccauucaggcgaagaugcauaauuucuggcugcaacucaaaaaggugaaccugcugucccagcgcaaauacgacacccuuaugaagacgaauuuuagcaaaggcgaugaaaagaaguucaucgccagaucucugguugagacccggcagauuaucaaaaacguggcugaacucaucaaguccgaguuugaccacgucgaggccauuccuauccgccaggaacugacaagcgauaugagacaacucauggacuauaaaaagaaucggcuggugaacgacuaccaccaugcucacgaugcccuucugauugccaccgugggggaguucaugcagaaacgcggauuuaugcagggcaugaaucccucucagaacguuuaucauggguacacacaauaugucaagaaguggcucuccauggcuaaaaaggcgagaagcgccgaaaaaccugagcggaucuucccccugcaguuuguggugggaucuaugcgcauggcugucagagacggccagguggauaagguuacccacccggccacgggggaaauuuguuggacagccgacaacgaggcuuaccugcggaaagugcuuggcuauaagaauauccuggucacccgcaaggugaaaaacgccggaaagcucuaccaaagaguuacagugaaaccuaagggcagcggggaggcgcccgucaaucaccagaaauccgauaucaacauuuacggaggcgugaccagcgaacaggcugccgagcugguucucauccggauuaaggccaagaauaacgcuaaaaauauggugaucaagauuccuaccgccaucgcgaaccaggucgcuaauaaaacaacgaccuaugacgccuacgugagaucucugaacauccccaauuaugccgggauuauccuugaucaaauuccucugggacagcugguguucgacgaacgcacauccuucuaccucgcuagcgccgagaucaagcauaacgcucggcagcugugggucaaucagcacauuaacaauguucuuaccaaaaagaacaucaaugaugaagagagagacaacauucugaaccuccugacaaaugagaaaaaccucgaacgcuuuaagcugcuugagcccgaucugaagcgggugaaagccgcgaagcaacagugggccuccugcgacgaucaggaacagaugcaaauccugagaaucauuaucaauaaaaugcaugacgacgcuucuccgcagauuccuggcaagaucgaucccuucaaaaacuaucucgacaagcaggggaagggcuggcgcgaucugcggaccaaaaagggaaugaaacuuagcgacaaugccgaguuuguguaccaaucccccacgggccuguaucacagaaagauuucuaucaacgagcuccugaaacagaagcagcucgaauga

SEQ ID NO: 4298 - RNA, 4113 nt, Artificial Sequence
  Cas9 variant
augaacaagcccuacagcaucggccuggacauugggaccaauuccgugggauggucuaucauuacagaugacuauaaggucccugccaagaaaaugagaguucucggcaacacggauaaggaguacaucaaaaagaaucugauuggggcccuucuguucgacggaggcaacaccgcugcggaucggcgccucaagagaacagcucggcgcagauauacccggcgcagaaaucggauccuguaccuucaggaaaucuuugccgaggaaaugagcaaaguggacgauuccuucuuucaccgccuggaggacucuuuccucguggaagaggauaagagagggagcaaauauccgauuuuugccacaaugcaagaggaaaaguacuaucaugagaaauuccccaccaucuaccaucugcggaaggaacuggcugacaagaaagagaaggccgaucuccgccugauuuaccuugcucuggcccacaucauuaaauuuagaggacacuuccucaucgaggacgaucgguuugacguccgcaacacagacauucagaagcaguaucaggcguuccuggaaaucuuugauaccacguucgagaauaacgaccuucugucccaaaauguggauguugaagccauccucaccgacaaaauuucuaagagcgcuaaaaaggauagaauccuggcccgguacccuaaccagaaguccacaggcauuuuugcugaguuccugaaacucaucgugggcaaucaggccgacuucaagaaacauuuuaaccuggaagauaagacaccccuucaguucgcgaaagacagcuaugaugaggaccuggagaaucuccuggggcaaauuggagaugaauuugccgaccuuuucucugcugccaagaagcuguacgacuccguccuccugagcggcauccugaccgugaccgaucucucuacgaaagcuccucuguccgccagcaugauccagagauaugacgagcaccgcgaagaucuuaagcagcugaaacaguuuguuaaggccucucuccccgagaaauaccaagaaauuuucgcugacuccagcaaggauggguaugcgggauacaucgagggcaagacaaaccaggaggccuuuuacaaauaucuguccaaacuucugaccaaacaggaagggucugaguaccuccuggaaaagauuaaaaaugaggacuuccugcggaagcaaagaacauuugauaacggaagcaucccucaccaggugcaucucaccgaacugcgcgcuauuauccggagacaguccgaguauuacccguuccuuaaggagaaccuggaccgcaucgaaaagauucucaccuuucggauccccuauuacgucggcccucuggccagagaaaagagcgauuucgccuggaugacacgcaaaacggacgauucuauucggcccuggaauuuugaagaccugguggauaaggagaaauccgcugaggccuucauccacagaaugaccaacaaugaccuuuaucucccugaagagaaggugcugcccaaacauagccugauuuacgaaaaguucacagucuacaacgagcucaccaagguucgcuuucuggcggaaggcuucaaagacuuucaguuccuuaaucggaagcaaaaagagacaaucuuuaacucucuguucaaggagaaaagaaaggugaccgaaaaggauauuaucagcuuucucaauaaaguggacggguaugagggaaucgcuauuaagggcaucgaaaaacaguucaacgccucccugucuacguaccacgaucugaagaaaauucuugggaaggacuuucucgauaauacagacaacgagcugauccuggaagauauuguccagacccucacccuguucgaggaccgggagaugauccgcaagagacuugauaucuauaaagacuuuuucacagaaagccagcugaagaaacucuaccggagacacuauaccggauggggccgccuguccgccaagcugauuaaugggauccggaacaaagagaaucaaaagacaauucuugauuaccucaucgacgauggaagcgcuaacagaaauuuuaugcagcugauuaaggacgccggccugucuuucaaaccgaucaucgacaaggcucgcacgggcucccaucucgauaaccugaaagaagugguuggggagcuugccggaagcccugcgauuaagaaaggcauccugcagucucucaagauuguggacgaacuggucaaagugaugggguaugagcccgagcagaucguuguggaaauggccagagagaaccaaaccacagcuaagggacugucccggagccgccagagacuuaccacacuccgggaaucccuggccaaucugaagucuaacauucucgaggagaaaaagccuaaauacgucaaggaucagguggaaaaucaccaucugagcgacgaucgccuuuuccuguacuaucuccagaacggcaaagacauguacaccgaugacgagcuggauaucgacaaucugucccaauaugauaucgaccacauuaucccccaggcuuuuauuaaggacgauucuaucgacaacagaguccuugugagcuccgccaagaaucgggggaaaagcgaugacguucccucucuggaaauugugaaggauugcaaagucuucuggaagaaacuccuggacgcgaagcucaugucccagcgcaaguacgauaaccugacgaaagccgagagaggcggacuuaccagcgacgauaaggcucgguuuauccaacgccagcugguggaaacaagacagauuaccaaacauguugcccggauccucgacgagagauucaauaacgagcuggauucuaagggccgccggaucagaaaagugaagauugucacacugaaguccaaucuugugagcaacuuucgcaaagaguucggguuuuauaagauccgggaggugaauaacuaccaccacgcucaugacgccuaucugaaugccguugucgcuaaagcgauucucaccaaguacccucagcuggaaccggaguucguguacggagauuaucccaaauacaacucuuauaagacgagaaagagcgccacagaaaaacucuuuuucuacuccaacaucaugaacuuuuucaagaccaaagugacacuggcugacggcaccgucgugguuaaggacgauauugaggugaauaaugacaccggggagaucgucugggauaaaaagaaacacuucgccacagugcgcaagguucuuagcuauccucaagugaacaucgucaagaaaacggaagugcagaccggaggcuuuucuaaggaguccauucuggcccaugggaauagcgacaaacucaucccccggaagacaaaagauauuuaccuggacccuaagaaguauggcggauucgauucccccaucguugcuuacucugugcuggucguggccgacauuaaaaagggcaaagcgcagaaacuuaagaccgugacagaacugcucgggaucaccaucauggagagaagccgcuuugaaaagaacccguccgcuuuccuggagucuaagggauaccucaauauucggacggauaaacugaucauucuuccuaaguauagccuguuugagcuggaaaacggcagacggcgccuccuggccuccgccggggagcuucagaaaggaaaugaacuggcucuccccacacaauacaugaaguuccuguaucucgccucuagauacaacgagcugaaaggcaagccugaggaaaucgagcagaagcaggaauuugucguucagcacgugagcuauuucgacgauauucuucaaaucauuaaugacuuuuccaaccgggugauccuggcggaugcuaaucuggagaaaaucaacaagcucuaccaggacaauaaagaaaacauucccgucgacgagcuggccaacaauaucauuaaccuuuucaccuuuaccagccugggggccccugcugccuucaaguuuuucgauaaaaucguggaccgcaagagauauacaucuaccaaagagguucucaauuccacacugauucaccagagcaucacgggccucuacgaaacccggaucgaucugggaaaacuuggcgagggguga

SEQ ID NO: 4299 - RNA, 4113 nt, Artificial Sequence
  Cas9 variant
augaacaagcccuacagcaucggccuggacauugggaccaauuccgugggauggucuaucauuacagaugacuauaaagucccugccaagaaaaugagaguucucggcaacacggauaaggaguacaucaaaaagaaucugauuggggcccuucuguucgacggaggcaacaccgccgcggaucggcgccucaagagaacagcucggcgcagauauacccggcgcagaaaucggauccuguaccuucaggaaaucuuugccgaggaaaugagcaaaguggacgauuccuucuuucaccgccuggaggacucuuuccucguggaagaggauaagagagggagcaaauauccgauuuuugccacacugcaagaggaaaaggacuaccaugagaaauucuccaccaucuaucaucugcggaaggaacucgcugauaagaaagagaaggccgaccugcgccuuauuuacaucgcucuggcccacauuaucaaauuuagaggacacuuccucauugaggaugacucuuuugacguccggaacacagauaucagcaagcaguaccaggacuuccuggaaaucuuuaauaccacguucgagaacaaugaucuucugucccagaacguggacguugaagcgauucucaccgauaaaaucagcaagucugccaaaaaggaccgcauucuggcucaauaucccaaucagaaguccacaggcaucuuugccgaguuccugaaacucauugugggcaaccaggcugauuucaagaaauacuuuaaucuggaagacaagaccccucuucaguucgccaaagauagcuaugacgaggaucuggagaaccuccuggggcaaaucggagacgaauuugcggaccuuuucucugccgcuaagaagcuguacgauuccguccuccugagcggcauccugacagugauugaccucucuaccaaagcuccccuguccgcuagcaugauccagagauaugaugagcaucgggaagaccuuaagcagcugaaacaguuuguuaaggccucccucccugagaaauaccaagaaauuuucgccgauucuagcaaggacggguaugcuggauacaucgagggcaagacgaaucaggaggcguuuuacaaauaucuguccaagcugcugacaaaacaggaagauagcgagaacuuccucgaaaagauuaaaaacgaggacuuucugagaaagcaacgcaccuucgauaaugggucuaucccccaccaggugcaccugacagaacucaaggccaucauucggagacaguccgaguacuauccuuuucugaaagagaaccaggaccgcaucgaaaagauucuuaccuuccggaucccguacuauauuggaccccuggcuagagagaaaagcgauuuugccuggaugacccgcaagacagacgauucuauccggccuuggaauuucgaagaccucgucgacaaagaaaagagcgccgaggcuuucauucauagaaugacgaacaaugauuuuuaccugcccgaagagaaagugcugccuaagcacucccuuaucuaugaaaaguucaccguguacaacgagcucacaaaaguccgcuacaagaaugaacaaggcgagaccuauuucuucgacucuaacaucaaacaggagauuuuugauggcguuuucaaggaacaucggaaagugagcaagaagaaacugcuggacuuucucgccaaggaguacgaagaguucagaaucguggaugucauugggcuggacaaagaaaauaaggcguuuaacgcuucccuuggaacauaucacgaucuggagaaaauccucgacaaggauuuccuggacaaucccgauaacgagagcauucuggaagacaucgugcagacccuuacgcucuuugaggaucgcgaaaugaucaagaaacggcuggagaauuacaaggaccuguucacagaaucucagcucaaaaagcuguauagacggcacuacaccggcugggggcgccuuuccgccaaacugauuaacggaaucagagacaaggagagccaaaagaccauucucgauuaucugaucgacgauggccggucuaauagaaacuuuaugcagcugauuaacgacgaugggcuuuccuucaaaagcaucaucuccaaggcccaggcuggaucucauagcgacaaucucaaagagguugugggcgaacuggccggcuccccggcuauuaagaaagggauccugcagucucucaagauugucgaugagcuggugaaaguuaugggauacgaaccugagcaaaucguggucgagauggcccgcgaaaaccagacaaccaaucagggccggagaaacagccgccagagauacaaacuucuggacgauggggugaagaaucucgcguccgaccugaacggaaauauucugaaggaguaucccacagauaaccaagcccuucagaaugaacgccucuuccuguacuaucugcagaacggccgggacauguacacgggggaggcucucgacaucgaugaccugagccaauaugauaucgaccacauuaucccucaggccuuuauuaaggaugacucuaucgauaauagaguccuuguguccagcgcuaaaaaccggggcaagucugacgauguucccucccuggaaauugugaaagacugcaaggucuucuggaagaaacuccuggaugccaagcugaugagccagcgcaaauacgacaaucuuaccaaggcggagagaggaggccugacaucugaugacaaagcccgguuuauccagcgccaacucguggagaccagacagauuacaaagcauguugcucggauccuggacgaacgcuucaacaaugagcucgauagcaaggggagacggaucagaaaagugaagauugucacccugaaauccaaccuugugagcaacuuucgcaaggaauuuggauuuuauaaaauccgggaggugaauaacuaccaccaugcccacgacgcuuaccugaaugccguugucgccaaggcuauucucacgaaguauccccagcuggaaccugaguucguguacggcgauuauccgaaauacaacucuuauaagaccagaaaauccgcgacagagaagcuguuuuucuacagcaauaucaugaacuuuuucaaaaccaaggugacacuugccgacgggaccgucgugguuaaggaugacauugaagugaauaacgauacgggagagaucgucugggacaaaaagaaacacuucgcuacagugcgcaagguucuguccuauccccagaauaacaucgugaaaaagaccgaaauucaaacaggcggguuuucuaaagagagcauccucgcccauggcaauuccgauaagcugauuccucggaagaccaaagacaucuaccucgaucccaagaaauacggaggcuucgacucuccuauugucgccuauagcgugcugguuguggcugauaucaagaaagggaaggcccagaaacuuaagaccgucacagaacugcucggaaucacgauuauggagagaucccgcuuugagaagaaccccucugcguuccuggaaagcaaaggcuaccugaauauccgggcugacaaacuuauuauccugccgaaguauucccucuuugagcuggaaaacgggagacgccggcuccuggccagcgccggagagcuucagaagggcaaugagcuggcucugccuacccaguucaugaaguuucucuaccuggccucuagauauaacgaauccaaagggaagcccgaggaaauugagaaaaagcaagaguucgugaaccagcacgugagcuacuuugacgauauccuucagcugauuaaugacuucucuaaacgggucauccucgcggaugcuaaccuggagaagaucaauaagcucuaucaagacaacaaagagaauauuuccguugaugaacuggccaacaauaucauuaaccuuuuuacauucaccagccugggcgccccugcugccuuuaaguucuucgacaaaaucguggaucgcaagagauacacaucuaccaaagaggugcuuaauuccacgcucauucaucagagcaucacaggacuguacgaaacccggaucgaccuuggcaagcugggggaggauuga

SEQ ID NO: 4300 - RNA, 4113 nt, Artificial Sequence
  Cas9 variant
augaacaagcccuacagcaucggccuggacauugggaccaauuccgugggauggucuaucauuacagaugacuauaaagucccugccaagaaaaugagaguucucggcaacacggauaaggaguacaucaaaaagaaucugauuggggcccuucuguucgacggaggcaacaccgccgcggaucggcgccucaagagaacagcucggcgcagauauacccggcgcagaaaucggauccuguaccuucaggaaaucuuugccgaggaaaugagcaaaguggacgauuccuucuuucaccgccuggaggacucuuuccucguggaagaggauaagagagggagcaaauauccgauuuuugccacacugcaagaggaaaaggacuaccaugagaaauucuccaccaucuaucaucugcggaaggaacucgcugauaagaaagagcgcgccgaccugagacuuauuuacaucgcucuggcccacauuaucaaguuucggggacacuuccucauugaggaugacucuuuugacguccgcaacacagauaucagcaaacaguaccaggacuuccuggaaaucuuuaauaccacguucgagaacaaugaucuucugucccagaacguggacguugaagcgauucucaccgauaagaucagcaaaucugccaagaaagaccggauucuggcucaauaucccaaucagaaguccacaggcaucuuugccgaguuccugaagcucauugugggcaaccaggcugauuucaaaaaguacuuuaaucuggaagacaaaaccccucuucaguucgccaaggauagcuaugacgaggaucuggagaaccuccuggggcaaaucggagacgaauuugcggaccuuuucucugccgcuaaaaagcuguacgauuccguccuccugagcggcauccugacagugauugaccucucuaccaaggcuccccuguccgcuagcaugauccagagauaugaugagcauagagaagaccuuaaacagcugaagcaguuuguuaaagccucccucccugagaaguaccaagaaauuuucgccgauucuagcaaagacggguaugcuggauacaucgagggcaagacgaaucaggaggcguuuuacaaguaucuguccaaacuucugacaaagcaggaagauagcgagaacuuccucgaaaagauuaagaacgaggacuuucugcgcaaacaacggaccuucgauaaugggucuaucccccaccaggugcaccugacagaacucaaggccaucauuagacgccaguccgaguacuauccuuuucugaaggagaaccaggaccggaucgagaaaauucuuaccuucagaaucccguacuauauuggaccccuggcucgcgaaaagagcgauuuugccuggaugacccggaaaacagacgauucuaucagaccuuggaauuucgaagaccucgucgacaaggagaaaagcgccgaggcuuucauucaucgcaugacgaacaaugauuuuuaccugcccgaagagaaggugcugccuaaacacucccuuaucuaugaaaaguucaccguguacaacgagcucacaaagguccgguacaaaaaugaacaaggcgagaccuauuucuucgacucuaacaucaagcaggagauuuuugauggcguuuucaaagaacauagaaaggugagcaaaaagaagcugcuggacuuucucgccaaagaguacgaagaguuccgcaucguggaugucauugggcuggacaaggaaaauaaagcguuuaacgcuucccuuggaacauaucacgaucuggagaagauccucgacaaagauuuccuggacaaucccgauaacgagagcauucuggaagacaucgugcagacccuuacgcucuuugaggaucgggaaaugaucaagaagagacuggagaauuacaaagaccuguucacagaaucucagcucaagaaacuguaucggcgccacuacaccggcugggggagacuuuccgccaagcugauuaacggaauccgggacaaagagagccaaaagaccauucucgauuaucugaucgacgauggcagaucuaaucgcaacuuuaugcagcugauuaacgacgaugggcuuuccuucaagagcaucaucuccaaagcccaggcuggaucucauagcgacaaucucaaggagguugugggcgaacuggccggcuccccggcuauuaaaaaggggauccugcagucucucaaaauugucgaugagcuggugaagguuaugggauacgaaccugagcaaaucguggucgagauggcccgggaaaaccagacaaccaaucagggcagacgcaacagcagacagcgguacaaacuucuggacgauggggugaagaaucucgcguccgaccugaacggaaauauucugaaggaguaucccacagauaaccaagcccuucagaaugaacgccucuuccuguacuaucugcagaacggcagagacauguacacgggggaggcucucgacaucgaugaccugagccaauaugauaucgaccacauuaucccucaggccuuuauuaaagaugacucuaucgauaaucggguccuuguguccagcgcuaagaaccgcggcaaaucugacgauguucccucccuggaaauugugaaggacugcaaagucuucuggaagaagcuccuggaugccaaacugaugagccagagaaaguacgacaaucuuaccaaagcggagcggggaggccugacaucugaugacaaggcccgcuuuauccagagacaacucguggagacccggcagauuacaaaacauguugcucgcauccuggacgaaagauucaacaaugagcucgauagcaaggggcggagaauccgcaaggugaaaauugucacccugaaguccaaccuugugagcaacuuucggaaagaguucggauuuuauaagaucagagaagugaauaacuaccaccaugcccacgacgcuuaccugaaugccguugucgccaaagcuauucucacgaaguauccccagcuggaaccugaguucguguacggcgauuauccgaaguacaacucuuauaaaacccgcaaguccgcgacagagaaacuguuuuucuacagcaauaucaugaacuuuuucaagaccaaagugacacuugccgacgggaccgucgugguuaaggaugacauugaagugaauaacgauacgggagagaucgucugggacaagaaaaagcacuucgcuacagugcggaaaguucuguccuauccccagaauaacaucgugaagaaaaccgaaauucaaacaggcggguuuucuaaggagagcauccucgcccauggcaauuccgauaaacugauuccuagaaagaccaaggacaucuaccucgaucccaaaaaguacggaggcuucgacucuccuauugucgccuauagcgugcugguuguggcugauaucaaaaaggggaaagcccagaaacuuaagaccgucacagaacugcucggaaucacgauuauggagcgcucccgguuugagaaaaaccccucugcguuccuggaaagcaagggcuaccugaauaucagagcugacaaacuuauuauccugccgaaguauucccucuuugagcuggaaaacgggcgccggagacuccuggccagcgccggagagcuucagaaaggcaaugagcuggcucugccuacccaguucaugaaguuucucuaccuggccucucgguauaacgaauccaaggggaaacccgaggaaauugagaagaaacaagaauuugugaaccagcacgugagcuacuuugacgauauccuucagcugauuaaugacuucucuaagcgcgucauccucgcggaugcuaaccuggagaaaaucaauaagcucuaucaagacaacaaggagaauauuuccguugaugaacuggccaacaauaucauuaaccuuuuuacauucaccagccugggcgccccugcugccuuuaaauucuucgacaagaucguggauagaaaacgguacacaucuaccaaggaggugcucaauuccacgcugauucaucagagcaucacaggacuguacgaaacccgcaucgaccuuggcaaacugggggaggauuga

SEQ ID NO: 4301 - RNA, 4113 nt, Artificial Sequence
  Cas9 variant
augaacaagcccuacagcaucggccuggacauugggaccaauuccgugggauggucuaucauuacagaugacuauaaagucccugccaagaaaaugagaguucucggcaacacggauaaggaguacaucaaaaagaaucugauuggggcucugcuguucgacggaggcaacaccgccagcgaucggcgccucaagagaacagcgcggcgcagauauacccggcgcagaaaucggauccuguaccuucaggaaaucuuugcugaggaaauguccaaaguggacgauucuuucuuucaccgccuggaggacagcuuccucguggaagaugacaagagaggguccaaauauccgauuuuugccacaaugcaagaggagaaggauuaccaugaaaaauuccccaccaucuaucaucugcggaaggagcuggccgacaagaaagaaaaggcugaucuccgccuguuuuaccuugcccuggcucacauuaucaaauucagaggacacuuucucauugaggacgacucuuucgauguccggaacacagacauccagcgccaguaccaggccuuucuggagauuuucgauaccacguuugaaaauaaccaucuucugagccaaaauaucgacguggagggcauccucaccgauaagauuuccaaaagcgcgaagaaagacagaauccuggcccaguauccuaaccagaagucuacaggcauuuucgcugaauuucugaagcucaucguugggaaucaggccgauuuuaaaaagcacuucaaccuggaggacaaaacaccccuucaauuugcuaaggauuccuacgacgaagaucuggagaaucuccugggacagauuggcgacgaguucgccgaccuuuuuagcguggcgaaaaagcuguaugauucuguccuccuguccgggauccugaccgugaccgaccucagcacgaaggccccucugucugcuuccaugauccagcgguacgaugaacacagagaggaccuuaaacagcugaagcaauucguuaaagccagccuccccgaaaaguaucaggagauuuuuacagauuccucuaaagacggauacgcuggcuauaucgaagggaagaccaaccagggagccuucuacaaguaccugagcaaacuucugacaaagcaagagggcuccgaguauuuucucgaaaagauuaagaaugaggauuuccugcgcaaacagcggaccuuugacaacggcagcaucccucaucaggugcaccugaccgaacucaaggccauuaucagacgccagucugaguacuauccguuccugaaggaaaaccuugaucggaucgagaaaauucugacauuuagaauccccuacuaugucgggccucucgcucgcgagaaguccgacuucgcguggaugacgcggaaaaccgaugacagcauuagacccuggaauuucgaggaacugguggauaaggaagccucugcugaggccuuuauccaucgcaugacaaacaaugaccuguaccuuccugaggaaaaagugcuccccaagcacagccugauuuaugagaaauucaccgucuacaacgaacugacaaagguucgguacaagaaugagcaaggagaaaccuauuucuucgacuccaacaucaaacaggagauuuuugauggcguguucaaggagcacagaaaagugucuaagaaaaagcuccuggacuuucuugccaaggaauacgaggaguuccgcaucgucgaugugaucgggcuggacaaagaaaauaaggcuuuuaacgccagccucggaacguaucaugaucugaaaaagauucuggacaaagauuuccuugacaauccggauaacgaauccauccucgaggacauuguucagacacugacccuguuugaggaucgggaaaugaucaagaagagacucgagaauuacaaagaccuguucaccgaaagccagcuuaagaaacuguaucggcgccacuacacaggcugggggagacucucugcgaagcugauuaacggaauccgggauaaagagucccaaaagaccauccuggacuaucuuauugacgauggcaagagcaauagaaacuuuaugcagcucauccaugacgauggccugucuuucaaauccauuaucagcaaggcucaggccgggucccacucugacaaucugaaagaaguggucggagagcucgccggcagcccugcuauuaagaaagggauccugcagucccuuaagaucguggaugagcugguuaaagugaugggauacgaacccgagcaaauugucguggaaauggcccgcgagaaccagacaacgaaccagggccggagaaauucucgccagagauacaagcuccuggacgauggggucaagaaccuggcuagcgaccuuaauggcaacauccucaaagaguauccuaccgauaaucaagcccugcagaacgaacggcuguuccucuacuaucugcagaauggacgcgacauguacacaggcaaggcgcuugauauugacaaccugucccaauaugacaucgaucauauuaucccccaggccuuuaucaaagacgauagcauugacaauagagugcucguuucuuccgcuaagaaccgggggaaaagcgaugacgugcccucucuggagaucgucaaggauugcaagguguucuggaaaaagcugcuugacgccaaacugaugucccagcgcaaguacgauaaucucaccaaagcugaaagaggaggccugacaagcgacgauaaggcccgguuuauucagcgccaacucguugagaccagacagaucacgaagcacguggcgcggauucuggacgaacgcuucaacaaugagcuugauucuaaagggagacggaucagaaaggucaaaauugugacccuuaagagcaaccucguguccaauuuucgcaaagaguucggauuuuauaagauccgggaaguuaacaacuaccaccaugcccacgacgcuuaccugaaugccgucguggcuaaggccauccugacaaaauauccucagcuugagccggaguucguguacggcgacuaucccaaguacaacagcuauaaaaccagaaagucugccacagaaaaacuguuuuucuacuccaauauuaugaacuuuuucaagaccaaggucacgcucgcugaugggacagugguugugaaagacgauaucgaagucaauaacgacaccggcgagauugugugggauaagaaaaagcauuucgcgacaguucgcaaagugcugagcuauccucaggucaauaucgugaagaaaaccgagauucaaaccggaggcuuuuccaaggaaucuauccucgcccacgggaacagcgacaagcugaucccccggaaaacaaaggauauuuaccuugacccuaaaaaguacggaggcuucgauucccccaucguugcuuauucugugcuggucguggccgacauuaaaaaggggaaggcccagaaacucaagacggugaccgagcugcugggaaucacaauuauggaaagaagccgcuuugagaaaaauccguccgcuuuccuugaaucuaagggcuaccugaacauccgggaugacaaacucaugauccugccuaaguauagccucuuugagcuggagaaugggagacgccggcuucuggccuccgcgggcgaacugcagaagggaaacgagcucgcucugcccacccaguucaugaaauuucuuuaccuggccagcagauauaaugaacucaagggcaaaccugaggagauugaacaaaagcaggaguucgucguucagcacgugucuuacuuugaugacauccugcaaauuaucaacgacuucuccaaucgggugauucucgccgaugcuaaccuggagaaaaucaacaaacuuuaucaggacaauaaggaaaacauuagcgucgaugaacuggccaauaacaucaucaaucuguuuacauucaccucucucggggcgcccgcugccuuuaaauucuucgacaagauuguggaucgcaaaagauacacguccacaaaggagguucugaacagcacccuuauccaucagucuauuaccggacuguacgagacacggaucgaccucggcaaacugggggaagauuga

SEQ ID NO: 4302 - RNA, 4113 nt, Artificial Sequence
  Cas9 variant
augaacaagcccuacagcaucggccuggacauugggaccaauuccgugggauggucuaucauuacagaugacuauaaagucccugccaagaaaaugagaguucucggcaacacggauaaggaguacaucaaaaagaaucugauuggggcucugcuguucgacggaggcaacaccgccgcggaucggcgccucaagagaacagcucggcgcagauauacccggcgcagaaaucggauccuguaccuucaggaaaucuuugccgaggaaaugagcaaaguggacgauuccuucuuucaccgccuggaggacucuuuccucguggaagaggauaagagagggagcaaauauccgauuuuugccacaaugcaagaggaaaaguacuaucaugagaaauuccccaccaucuaccaucugcggaaggaacuggcugacaagaaagagaaggccgaucuccgccugauuuaccuugcucuggcccacaucauuaaauuuagaggacacuuccucaucgaggacgaucgguuugacguccgcaacacagacauucagaagcaguaucaggcguuccuggaaaucuuugauaccacguucgagaauaacgaccuucugucccaaaauguggauguugaagccauccucaccgacaaaauuucuaagagcgcuaaaaaggauagaauccuggcccgguacccuaaccagaaguccacaggcauuuuugcugaguuccugaaacucaucgugggcaaucaggccgacuucaagaaacauuuuaaccuggaagauaagacaccccuucaguucgcgaaagacagcuaugaugaggaccuggagaaucuccuggggcaaauuggagaugaauuugccgaccuuuucucugcugccaagaagcuguacgacuccguccuccugagcggcauccugaccgugaccgaucucucuacgaaagcuccucuguccgccagcaugauccagcacuaugacgagcacagagaagaucuuaagcagcugaaacaguuuguuaaggccucucuccccgagaaauaccaagaaauuuucgcugacuccagcaaggauggguaugcgggauacaucgagggcaagacaaaccaggaggccuuuuacaaauaucuguccaaacuucugaccaaacaggaagggucugaguaccuccuggaaaagauuaaaaaugaggacuuccugcgcaagcaacggacauuugauaacggaagcaucccucaucaggugcaccucaccgaacugagagcuauuauccgccggcaguccgaguauuacccguuccuuaaggagaaccuggacagaaucgaaaagauucucaccuuucgcauccccuauuacgucggcccucuggcccgggaaaagagcgauuucgccuggaugacaagaaaaacggacgauucuauucgccccuggaauuuugaagaccugguggauaaggagaaauccgcugaggccuucauccaucggaugaccaacaaugaccuuuaucucccugaagagaaggugcugcccaaacacagccugauuuacgaaaaguucacagucuacaacgagcucaccaagguuagauuucuggcggaaggcuucaaagacuuucaguuccuuaaucgcaagcaaaaagagacaaucuuuaacucucuguucaaggagaaacggaaggugaccgaaaaggauauuaucagcuuucucaauaaaguggacggguaugagggaaucgcuauuaagggcaucgaaaaacaguucaacgccucccugucuacguaccacgaucugaagaaaauucuugggaaggacuuucucgauaauacagacaacgagcugauccuggaagauauuguccagacccucacccuguucgaggacagagagaugauccggaagcgccuugauaucuauaaagacuuuuucacagaaagccagcugaagaaacucuacagacggcauuauaccggauggggcagacuguccgccaagcugauuaaugggauccgcaacaaagagaaucaaaagacaauucuugauuaccucaucgacgauggaagcgcuaaccggaauuuuaugcagcugauuaaggacgccggccugucuuucaaaccgaucaucgacaaggcuagaacgggcucccacagcgauaaccucaaagaagugguuggggagcuggccggaucuccugcgauuaagaaaggcauccuucagucccugaagauuguggacgaacucgucaaagugaugggguaugagcccgagcagaucguuguggaaauggcccgcgagaaccaaaccacagcuaagggacugagcagaucccggcagcgccugaccacacuuagagaaucucucgccaaucuuaagagcaacauucuggaggagaaaaagccuaaauacgucaaggaucagguggaaaaucaucaccucuccgacgaucggcuguuccuuuacuaucugcagaacggcaaagacauguacaccgaugacgagcucgauaucgacaaucugucucaauaugauaucgaccauauuaucccccaggcuuuuauuaaggacgauagcaucgacaaccgcguccugguguccagcgccaagaauagagggaaaucugaugacguucccuccguggaaauugucaaggauugcaaaguguucuggaagaaacuucuggacgcgaagcucaugagccagcggaaguacgauaaccugacgaaagccgagcgcggcggacucaccucugacgauaaggcuagauuuauccaacggcagcugguugaaacacgccagauuaccaaacacguggccagaauccuugacgagcgguucaauaacgagcuggauuccaagggcagacgcauccggaaagucaagauugugacacucaagagcaaucuggugucuaacuuuagaaaagaauuuggguuuuauaagauccgcgagguuaauaacuaccaccaugcucacgacgccuaucugaaugccgucguggcuaaagcgauucuuaccaaguacccucagcuggaaccggaguucguguacggagauuaucccaaauacaacagcuauaagacgcggaaguccgccacagaaaaacucuuuuucuacagcaacaucaugaauuucuucaagaccaaagucacacuggcugacggcaccgugguugugaaggacgauauugaggucaacaaugacaccggggagaucgugugggauaaaaagaaacauuucgccacaguuagaaaggugcucucuuauccucaagucaacaucgugaagaaaacggaaauucagaccggaggcuuuuccaaggagagcauccuggcccacggcaauuccgacaaacuuauuccccgcaagacaaaagauaucuaccuggacccuaagaaguaugggggauucgauucucccauuguugcuuacagcgugcucgucguggccgacaucaaaaagggcaaagcgcagaagcugaaaaccgugacagaacugcuugggaucaccauuauggagcgguccagauuugaaaagaacccgucugcuuuccuggagagcaagggauaccucaauauccgcgaugacaaacugaugauucucccuaaguauucccuguuugagcuugaaaacggccggagacggcugcuggccucugccggggagcuccagaaaggaaaugaacuggcccuucccacgcaauucaugaaguuucuguaccucgcuagccgcuauaacgagcugaaaggcaagccugaggaaaucgagcagaagcaggaguucgucguucagcacguguccuacuuugaugacauucuccaaaucauuaaugauuucagcaacagagugauccuggcggacgcuaaucuugagaaaaucaacaagcuguaucaggacaauaaagaaaacauucccgucgaugagcuggccaacaauaucauuaaccucuuuacauucaccucucugggggccccugcugccuuuaaguucuucgacaaaaucguggaucggaagcgcuacaccuccacaaaagagguucuuaauagcacccugauucaucagucuaucacaggccucuaugaaacgagaaucgaccugggaaagcucggcgaggauuga

SEQ ID NO: 4303 - RNA, 4116 nt, Artificial Sequence
  Cas9 variant
augaaggugaacaauuaccacaucggccuggacauugggaccagcuccaucggaugggucgccauuggcgaggaugggaaaccccucagaaucaagggaaaaacagcuauuggcgcccggcuguuccaggaagggaacccugcggcugaccgcagaauguuucggacgacccgcagacggcuuucucgcagaaaguggcggcugaaacuccuggaggaaaucuucgauccguauaucacacccguugacagcaccuuuuucgcccgccuuaagcaauccaaucugucuccuaaggauagcagaaaagaguuuaagggauccaugcuuuuccccgaccugacagauaugcaguaccauaaagacuauccuaccauuuaccaucugcggcacgcccucaugacacaggaugaaaaguuugacauccgcaugguguaucuggcuauucaccauaucgugaaauacagaggcaacuuccuuaauucuacccccgucgauagcuuuaaggccuccaaggugaacuucguugaccaguuuaaaaagcugaaugagcucuauacggcuauuaacccugaggaauccuuccaaaucaaucuggccaacucugaggauauuggccaccaguuucuugacccguccauccggaaauucgacaagaaaaagcagauccccaaaauugugccugucagcguggaugacaaggcgaccgauaagaucaaugggaaaauugccucugaaaucauuaacgcuauccugggauacaaguccaaacucgacguugugguccagugcacacccguggauagcaagucuugggcccugaaauucgacgaggaggauaucgacgcuaagcugcaaaagauucucccugaaauggaugagaaucagcaguccaucauugccauccugcagaaccuuuacagccaagugacccugaaucagauuguccccaacggcaugucccucucugaaagcaugaucgagaaauauaacgaccaccaugaucaccugaagcucuacaaaaagaucauugaccagcuggcggacccgaaaaagaaggccgcucucaaaaaggccuauucccaauacguuggggaugacggaaaagugaucgaacaggcugauuuuuggagcucugugaagaaaaaucuggacgauuccgaccugagcaagcagauuauggaucucaucgacgccgagaaguucaugccuaaacagcgcacaucucaaaacggcgucauuccccaucagcugcaccagagagagcuugaugaaaucauugagcaccagagcaaguauuacccuuggcuggccgaaaucaaucccaacaaacaugaccuccaccuggcuaaguauaaaaucgaggaacuuguggcguuucggguucccuacuacguggggccuaugauuaccccggaugaccaagccaaguccgcugagacggucuucucuuggauggagagaaaaggaaaggaagccggccagaucacacccuggaauuuugaugagaagguggaccgcaacgccagcgcuaaucgguucauuaaaagaaugaccacaaaggacaccuaucugaucggcgaagauguucucccugacgagucccugcuguacgaaaaauuuaaggugcucaacgagcugaauaugguccgcgugaacgggaaacuucugaaggucgccgauaagcaggcgauuuuccaggaccucuuugagaauuauaaacauaucagcgugaagaaacugcaaaacuacaucaagucuaaaaccggacugcccuccgauccugaaauuagcggccuuucugaccccgaguauuucaauaacucccucgggacauacaaugauuuuaagaagcuguucggaaacaaaguugacgaaccggaucugcaggacgauuuugagaagaucguggaguggagcacggucuucgaagacaaacggauucucagagagaagcugaacgaaaucaccuggcuuuccgaucagcagaaagacgugcuggagucuagccgcuaucaaggcugggggcggcucuccaagaagcugcugacaggaauuguuaaugaccagggcgaaagaaucaucgaugagcuuuggaacaccaauaaaaacuucaugcagauucaaucugacaaugauuuugcuaagcgcauccacgaggccaacgccgaccagaugaaagcuguggaugucgaagacgugcucgccgaugcuuacacaagcccucagaauaagaaagccauuagacaggugguuaaggucguggacgauauccaaaaagcgaugggcgggguggcccccaaguacauuuccaucgaguucacccggagcgaagaccgcaacccucggagaacgaucucucggcagcgccagcuggagaauacacugaaggauaccgcuaaaucccucgccaagagcauuaaccccgaacugcuuucugagcuggacaaugcugccaaauccaagaaaggacucaccgacagacuguaucuguacuuuacacagcuuggcaaggauaucuauaccgggaagccuauuaacaucgacgagauuagcacauacgauaucgaccauauucucccccaagcguucgucaaagaugacucucugaauaaccgggugcugguuagcaaggccaucaauaacggaaaauccgauaacgugccgguccagcucuuuggcgcuaagauggggcacuucuggaaacagcuggccgaagcuggccuuaucagcaagagaaagcugaaaaaucuccagacggacccugauaccauuucuaaguaugccaugcacggauuuauccgccggcaacugguggagacaucccagguuauuaaacugguggccaacauccuuggcgacaaguacagaaaugauaacaccaaaauuaucgaaaucacagcucgcaugaaucaucagaugagagacgaguucggguuuauuaagaaccgggaaaucaaugauuaucaccaugcguucgacgccuaccucaccgcuuuucugggacgcuaccuguaucacagauacauuaagcuccggcccuauuucgucuacggcgacuuuaaaaaguucaaagaggauaaggugacgaugcgcaacuucaauuuucugcacgaccuuaccgaugacacacaagagaaaaucgccgaugccgaaaccggggagguuauuugggacagagaaaacagcauccagcagcugaaggauguguaucauuacaaguucaugcucaucucccacgaggucuauacacugcggggagcuauguuuaaucagaccguguaccccgccucugacgcgggcaaacgcaagcugauuccuaucaaagcugauagaccgauuaacguguacgggggcuauagcggauccgccgacgccuacauggcuaucguccggauucauaauaagaaaggcgauaaguaucgcguugugggggugcccaugagagcccgggacagacuugaugcggcuaaaaaggucucugacgccgacugugaucgcgcccugaaggacgugcucacgccucaacugacaaaaaccaagaaaagccggaagacaggagagaucacccagguuguggaagauuucgagauuguccucggcaaagugauguacagacagcugaugaucgacggggauaagaaguuuaugcuuggauccucuaccuaucaguacaacgcuaaacaacugguucucagcgaccaguccgugaagacacuggccagcaaaggccgccuggauccccuucaggaaucuauggacuauaauaacgucuacacggagauccuggauaaggugaaccaguacuucucccucuaugacaugaauaaauuucggcacaagcugaaccucggguucagcaaguuuauuucuuucccuaaucauaacguuuuugauggcaauaccaaagcuagcagcggaaagagagaaauccuggaggaggugcuuaacggccugcacgccaaucccacauucgggaaccucaaagacauuggaaucaccacaccuuucggccaacugcagcagcccaaugggauucugcuuucugacgaagcgaagauccgcuaccaguccccgaccggacuguuugagcggacggucagccucaaagaucuguga

SEQ ID NO: 4304 - RNA, 4116 nt, Artificial Sequence
  Cas9 variant
auggacaagaaauacagcaucggccuggauauugggaccaacuccgugggaugggccgucaucacagacgauuauaagguucccucuaaaaaguucaaagugcucggcaauacggacagacacagcauuaagaagaaccugaucggggcccuucuguuugauuccggagagaccgccgaagcgacacggcucaaacgcaccgcuagacggcgcuacacaagacggaagaaucgcauuagauaucugcaggagaucuucucuagcgaaauguccaaaguggacgauuccuuuuuccaucggcuugaggagagcuuucuggucgaagaggacaagaaacacgaacgccauccuaucuucggcaacauuguggaugagguugccuaccacgaaaaguauccgaccaucuaccaucucagaaagaaacuggccgacuccacagauaaggcugaccugcggcucauuuaucuggcccuugcucacaugaucaaauuucgcgggcacuuccugauugagggagaucucaaucccgacaacagcgacauggauaagcuguuuauccaacuugugcagaccuacaaucagcuguucgaggaaaacccuauuaaugccucuagagucgacgcgaaagccauccucuccgcucggcugagcaagucucgcagacuggagaaccucaucgcccagcugcccggcgaaaaacggaauggccuuuuugggaaccugauugcucucucccugggacuuacgccuaauuucaagagcaacuuugaucuggccgaggacgcgaagcuccaacugucuaaagauaccuacgacgaugaccuggauaaucuccuggcccagaucggcgaccaguaugcugaucuuuuccuggccgcuaagaaccucuccgacgccauucugcuuagcgacauccugagagugaacuccgaaauuacaaaagcuccccucucugcuagcaugaucaagcgcuacgaugagcaucaccaggaccugacccugcucaaagcgcugguucggcaacagcuuccugagaaguauaaggaaaucuucuuugaucaguccaaaaauggguacgccggauauauugacggcggggcuagccaggaggaguucuacaaguuuaucaaaccgauucuggaaaagauggauggaacagaggaacuccuggccaaacugaacagagaggaccuucuccgcaagcaacggaccuucgauaauggcucuaucccccaucagauucaccugggcgaacugcacgccauccucagacgccaggaggacuuuuauccuuuccugaaggauaaccgggaaaagaucgagaagauucuuacguuuagaauccccuacuacguggggccucuggcucgcggaaauucccgguucgccuggaugacaagaaaaagcgaagagaccauuacacccuggaacuuugaggaagucguggacaagggcgcgucugcucagagcuucaucgagcgcaugaccaauuuugauaaaaaccucccgaaugaaaaggugcugccuaagcauucccugcuuuaugaguacuucaccgucuauaacgagcucacaaaaguuaaguacgugacggaagggaugcggaaacccgaguuucugucuggaaagcaaaaagaagccauuguggaccuccuguucaagaccaauagaaaagucacagugaagcagcugaaggaggauuauuucaaaaagaucgaaugcuuugacagcguugagauuuccggcguggaggaccgguucaacgccagccuugggaccuaccacgaucugcucaaaaucaucaaggacaaagauuuucuggacaaugaagagaacgaagauauucuggaggacaucguccuuacacucacccuguucgaagauaaggagaugauugaggaacgccugaagaaauaugcuaaucucuuugacgauaaggugaugaaacagcugaagagacggcauuacacgggauggggcagacuuucucgcaaacugaucaacggcauucgggacaagcaauccgggaagacaauccucgauuuccugaaaagcgacggauuugccaacagaaauuucaugcagcugaucaacgaugacucucuuaccuuuaaggaggcuauucagaaagcccagguuuccggccaagggcacagccuccaugaacagaucgcgaaucuggccggauccccugcuauuaagaaaggcauccugcagucugugaaggucguggacgagcucgucaaggugauggggcacaaacccgaaaacauuguuaucgagauggcccgcgagaaucagaccacacaaaagggccagaaaaacagcagagaacggaugaagcgcaucgaggaaggaauuaaagagcugggcucccagauccuuaaggagcaccccguggaaaauacccagcugcaaaacgagaaacucuaccuguauuaccugcagaaugggagagauauguaugucgaccaggaacuugauauuaaccggcugucugacuacgauguggaccauaucguuccucagagcuucauuaaggaugacuccaucgauaauaaggugcucacacgcagcgacaaaaacagaggaaagucugauaaugucccguccgaggaaguggugaaaaagaugaaaaacuauuggcggcaacugcucaaugcuaagcugaucacgcagcgcaaguuugacaaccuuaccaaagccgagagaggcgggcugagcgagcucgacaaggcgggauucauuaaacggcagcugguugaaacacgccaaaucaccaagcacgucgcccagauucuggauucuagaaugaacacaaaauacgacgagaaugauaaacuuauccgggaagugaaggugauuacccugaaauccaagcucgucagcgacuuuagaaaagauuuccaguucuauaaggugcgcgagaucaacaauuaccaucacgcucacgacgccuaccugaacgcuguugugggcacggcccucauuaaaaaguaucccaagcuggaaucugaguuugucuacggggauuauaaaguguacgacguucggaagaugaucgccaaaagcgagcaggaaaucggcaaggcuaccgcgaaaagauucuuuuauuccaauauuaugaacuucuuuaagacagagaucacccuugccaauggagaaauucgcaagcggccucugaucgagacaaacgaagagaccggcgagauugugugggauaaagggagagacuucgcuacgguccgcaaggugcucagcaugccccaaguuaauaucgugaaaaagacagaaguccagaccggagcccugacaaacgagucuaucuacgcccggggcuccuuugauaaacugauuagcagaaagcaucgcuucgaauccucuaaauaugggggauuuggcagcccuaccgugaccuacuccgugcuugucguugcuaagucuaaggugcaggacgggaaagugaagaaaaucaagacaggcaaagagcugauuggaaucacgcuccuggauaagcucgucuucgagaagaauccccugaaauuuauugaagacaagggcuacgggaacgugcagaucgacaaaugcaucaaacuuccgaaauauagccuguucgaguucgaaaauggaacccggagaaugcuggccuccguuauggcgaacaauaacucucggggcgaucuccaaaaggcuaacgagauguuucugccugccaaacuugugacacugcucuaccacgcccauaagauugaaagcuccaaggagcuggagcacgaggcuuauauccucgaccauuacaaugaucuguaucagcuucugagcuacauugaacgcuucgccucucuguaugucgacguggaaaagaacaucuccaagguuaaagagcucuuuagcaauauugaaucuuacuccaucagcgagauuuguucuuccgugaucaaccugcuuacccugacagcgagcggggcucccgccgauuucaaguuucucggaaccacgaucccuagaaagcgguacggcucuccccagagcauucugucuagcacacucauccaccaauccauuaccgggcuguaugagacccgcaucgaccuuucucagcugggcggagauuga

SEQ ID NO: 4305 - RNA, 4116 nt, Artificial Sequence
  Cas9 variant
auggacaagaaauacagcaucggccuggauauugggaccaacuccgugggaugggccgucaucacagacgauuauaagguucccucuaaaaaguucaaagugcucggcaauacggacagacacagcauuaagaagaaccugaucggggcccuucuguuugauuccggagagaccgccgaagcgacacggcucaaacgcaccgcuagacggcgcuacacaagacggaagaaucgcauuagauaucugcaggagaucuucucuagcgaaauguccaaaguggacgauagcuuuuuccaucggcuugaggaaucuuuucuggucgaggaggacaagaaacacgaacgccauccuaucuucggcaacauuguggaugagguugccuaccacgaaaaguauccgaccaucuaccaucucagaaagaaacuggccgacuccacagauaaggcugaccugcggcucauuuaucuggcccuugcucacaugaucaaauuucgcgggcacuuccugauugagggagaucucaaucccgacaacagcgacauggauaagcuguuuauccaacuugugcagaccuacaaucagcuguucgaggaaaacccuauuaaugccucuagagucgacgcgaaagccauccucuccgcucggcugagcaagucucgcagacuggagaaccucaucgcccagcugcccggcgaaaaacggaauggccuuuuugggaaccugauugcucucucccugggacuuacgccuaauuucaagagcaacuuugaucuggccgaggacgcgaagcuccaacugucuaaagauaccuacgacgaugaccuggauaaucuccuggcccagaucggcgaccaguaugcugaucuuuuccuggccgcuaagaaccucuccgacgccauucugcuuagcgacauccugagagugaacuccgaaauuacaaaagcuccccucucugcuagcaugaucaagcgcuacgaugagcaucaccaggaccugacccugcucaaagcgcugguucggcaacagcuuccugagaaguauaaggaaaucuucuuugaucaguccaaaaauggguacgccggauauauugacggcggggcuagccaggaggaguucuacaaguuuaucaaaccgauucuggaaaagauggauggaacagaggaacuccuggccaaacugaacagagaggaccuucuccgcaagcaacggaccuucgauaauggcucuaucccccaucagauucaccugggcgaacugcacgccauccucagacgccaggaggacuuuuauccuuuccugaaggauaaccgggaaaagaucgagaagauucuuacguuuagaauccccuacuacguggggccucuggcucgcggaaauucccgguucgccuggaugacaagaaaaagcgaagagaccauuacacccuggaacuuugaggaagucguggacaagggcgcgucugcucaauccuucaucgagcgcaugaccaauuuugauaaaaaccucccgaaugaaaaggugcugccuaagcauucccugcuuuaugaguacuucaccgucuauaacgagcucacaaaaguuaaguacgugacggaagggaugcggaaacccgaguuucugucuggaaagcagaaagaagccauuguggaccuccuguucaagaccaauagaaaagucacagugaagcagcugaaggaggauuauuucaaaaagaucgaaugcuuugacagcguugagauuuccggcguggaggaccgguucaacgccagccuugggaccuaccacgaucugcucaaaaucaucaaggacaaagauuuucuggacaaugaagagaacgaagauauucuggaggacaucguccuuacacucacccuguucgaagauaaggagaugauugaggaacgccugaagacguaugcucaucucuuugacgauaaagugaugaagcagcugaaaagacggcacuacacaggauggggcagacuuucucgcaagcugaucaauggcauucgggacaaacaauccgggaagaccauccucgauuuccuuaagagcgacggauuugccaacagaaacuucauccagcugauucaugaugacucucugaccuuuaaagaggcuauccagaaggcccagguuuccggccaagggcacagccuccacgaacagauugcgaaucuggccggauccccugcuaucaaaaagggcauucugcagucugugaaagucguggacgagcucgucaaggugauggggcauaagcccgaaaacaucguuaucgagauggcccgcgagaaucagacaacccaaaaaggccagaagaacagcagagaacggaugaaacgcauugaggaaggaaucaaggagcugggcucccagauucuuaaagagcaccccguggaaaauacacagcugcaaaacgagaagcucuaccuguauuaccugcagaaugggagagauauguaugucgaccaggaacuugauaucaaccggcugucugacuacgauguggaccauauuguuccucagagcuucaucaaagaugacuccaucgauaauaaggugcucacgcgcagcgacaagaacagaggaaaaucugaugacgucccguccgaggaaguggugaagaaaaugaagaauuauuggcggcaacugcucaacgcuaaacugauuacccagcgcaaguuugacaaucuuacaaaggccgagagaggcgggcugagcgagcucgauaaagcgggauucaucaagcggcagcugguugaaacccgccaaauuacaaaacacgucgcccagauccuggacucuagaaugaacaccaaguacgaugagaaugacaaacuuauucgggaagugaaggugaucacgcugaaguccaaacucgucagcgauuuuagaaaggacuuccaguucuauaaagugcgcgagauuaacaacuaccaccaugcucacgaugccuaccugaaugcuguugugggcaccgcccucaucaagaaauaucccaagcuggaaucugaguuugucuacggggacuauaagguguacgauguucggaaaaugaucgccaagagcgagcaggaaauuggcaaagcuacagcgaagagauucuuuuauuccaacaucaugaauuucuuuaaaaccgagauuacacuugccaacggagaaauccgcaagcggccucugauugagaccaaugaagagacgggcgagaucguguggaacaaggggagagacuucgcuacaguccgcaaagugcucagcaugccccaaguuaauaucgugaagaaaaccgaaguccagacaggagcccugaccaacgagucuauuuacgcccggggcuccuuugauaagcugaucagcagaaaacaucgcuucgaauccucuaaguaugggggauuuggcagcccuaccgugacauacuccgugcuugucguugcuaaaucuaaggugcaggacgggaaggugaaaaagauuaaaacgggcaaggagcugaucggaauuacccuccuggauaaacucgucuucgagaagaauccccugaaguuuaucgaagacaaaggcuacgggaacgugcagaucgacaagugcauuaaacuuccgaaguauagccuguucgaguucgaaaauggaacacggagaaugcuggccuccguuauggcgaacaauaacucucggggcgaucuccaaaaagcuaaugagauguuucugccugccaaacuugugacccugcucuaccacgcccauaagaucgaaagcuccaaagagcuggagcacgaggcuuauauucucgaccacuacaacgaucuguaucagcuucugagcuacaucgaacgcuucgccucucuguaugucgacguggaaaagaacauuuccaaaguuaaggagcucuuuagcaauaucgaaucuuacuccauuagcgagaucuguucuuccgugaucaaccugcuuacacugaccgcgagcggggcucccgccgauuucaaauuucucggaacgacaauuccuagaaagcgguacggcagcccccagagcauccugucuagcacccucauucaucaauccaucaccgggcuguaugagacacgcauugaccuuucucagcugggcggagauuga

SEQ ID NO: 4306 - RNA, 4116 nt, Artificial Sequence
  Cas9 variant
augaacaauaacaauuacagcaucggccuggacauugggaccaacuccgugggaugggccgucaucacagaugacuauaagguucccucuaaaaagaugagagugcucggcaauacggauaaacgguucauuaagaaaaaccugaucggggcccuucuguuugacgagggaaccacagcugaagaucgcagacucaagcggaccgcgcgcagacgguacacacgcagaaagaaucggcugcgcuaucuucaggagauuuucgcugaagagaugagcaaaguggacuccucuuucuuccacagacuggaugacagcuuucucgucccugaagauaaguccggcucuaaauacccgaucuucgccacccuggccgaggagaaggaauaucauaaaaaguuucccacaaucuaccaucugcggaagcaccucgcugacagcaaagagaaggccgaucugcgccuuauuuaucuggcucucgcccacaucaccaaauacagagggcauuuccuguacgaagaggcguuugacauuaagaacaaugauauccaaaagauuuucaacgaguuuaucaauauuuaugacaacacguucgaaggauccagccuuucuggccagaaugcccagguggaggcuaucuuuaccggcaagaucuccaaaagcguuaagcgggaacacgugcugaaacucuucccugacgagaaaucuacagggcuguucuccgaauuucugaagcucauugucggaaaccaggccgauuucaaaaagcacuuugaccuggaggagaaagcuagccuucaauucucuaaggauaccuacgacgaagaucuggagaaucuccugggccagaucggggacgauuuugccgaccuuuuccugguggcgaagaaacucuaugaugccauucugcuguccggaauccucacaguuaccgaccccagcacgaaggcuccucuguccgccucuaugauugaacgcuacgagaaccaucaggaagaucuugcugcccugaaacaguuuaucaagaacaaucuccccgagaaauaugccgagguguucagcgaccaauccaaggacggcuacgcuggguauaucgauggaaagacaacccaggaagcguuuuacaaauacauuaagaaccugcuuagcaaauucgagggcgccgacuauuuucuggauaagaucgaaagagaggacuuccuccggaaacagagaacauuugauaauggcucuauuccucaccagauccaucugcaagaaaugaacgcuauucugcgccggcagggggagcacuacccgcuccugaaggagaauaaggagaaaaucgaaaagauccuuaccuuccgcauucccuauuacgucggaccucuggccagaggcaaccgggacuucgccuggcucaccagaaauuccgaucaggcuauccgccccuggaacuuugaagagauuguggacaaagccagcucugcggagagcuucaucaauaagaugacaaacuaugaucuguaccugccugaagagaaagugcuucccaagcacucccuccuguaugaaacguuugcugucuacaaugagcugaccaaaguuaaguucauugccgaagggcuccgggacuaccaauuuuucgauucuggacagaagaaacagaucgugaaccagcuguuuaaggagaaaagaaaggugacagagaaagacauuauccauuaucuucacaaugucgauggcuacgacgggaucgaacugaagggaauugagaagcaauucaacgccagccucuccaccuaucaugaccugcugaaaaucauuaaggauaaagaauuuauggacaaucacaagaaccaggagauccuugaaaacauugugcauacacucaccaucuucgaggaucgcgagaugaucaaacagcggcuggcucaguacgacagcauuuuugaugaaaagguuaucaaggcccugacgagacgccacuauacaggcuggggcaaacucucugcuaagcugauuaaugggaucugcgacaaaaagaccggaaaaaccauucuugauuaccugaucgacgauggcuauaacaaucggaacuucaugcaacucaucaaugacgaugggcuguccuuuaaggagauuauccagaaggcccagguggucggaaaaacagacgaucugacccaggugguuagagaacuuagcggcucuccggcgauuaagaaagggauccuccaauccauuaagaucguggacgagcuggucaaaaucaugggcuacgccccugaaagcauugugaucgagauggcucgggagaaccagacaacggccaagggaaagaaaaauucccagcagcgcuacaagagaauugaagacgcucugaaaaaccucgcccccggccuggauucuaccaucagcaaggagaauccuacagacaacauucaacuucagaaugaucggcuguuccucuauuaccugcagaacgggaaagacauguauaccggagaagcgcuggauaucaaucaacuuuccucuuacgacauugaucacaucaucccccaggccuucauuaaggacgauagccucgacaacagaguccugacauccagcaaagauaaucgcggcaagucugacaacgugcccucccuggagguugugaagaaacggaaggcuuuuuggcagcagcuccuggacagcaaacuuaucucugagagaaaguucaacaaucugaccaaagccgaacgcgggggacucgaugagagagacaaggucggcuuuauuaagcggcaacugguggaaacgcgccagaucaccaaacauguugcucggauucuggaugccagauucaacacagagguguccgaaaagaaucagaaaauccgcagcgucaagaucauuacccuuaaaucuaaccuggugagcaauuuuagaaaggaguucaagcucuauaaagugcgggagaucaacgacuaccaccaugcccacgaugcuuaucugaaugcgguugucgccaaggcuauucucaaaaaguacccuaaacuggaaccggaguuuguguacggggacuaucagaaguacgaucuuaagcgcuauaucuccaaaagcaaggaccccaaagaaguggagaaggccacagaaaaauacuucuuuuauucuaaccugcucaauuucuuuaaggaggagguccacuacgccgauggcaccauugugaaaagagaaaacaucgaguauuccaaggacacgggagaaaucgcuuggaauaaggagaaagauuucguuacaauuaagaaagugcugagcuacccucaagucaacaucgugaagaaacgggaaguucagaccggcggguucuccaaggagucuauucugcccaagggaaauagcgacaaacuuaucccucgcaagacaaaagauauucugugggacaccaccaaguacggcggguuugacucccccgugaucgccuauucuauucuccugaucgcggauaucgagaaaggaaaggcuaagaaacucaagacagucaaaacgcuggugggcauuaccaucauggaaaaggccgccuucgagaaaaacccgauuacauuucuugaaaauaagggguaccauaacguuagaaaggagaacauccugugucucccuaaauauagccuguucgagcuggaaaauggccggagacgccuucuggcuuccgccaaggagcuccagaaaggaaacgaaauugugcugcccgucuaccucaccacacugcuuuaucacucuaagaaugugcauaaacuggacgagccugaacaccuggaguacauccagaagcaucgguaugaguuuaaagaucuccugaaccuugugagcgaauuuucccaaaaguacguccuggcggaggcuaaucucgaaaagaucaaaagccuguacguugacaacgagcaggccgauauugaaauccucgccaauucuuuuauuaaccugcuuaccuucacggcucugggcgcccccgcugccuuuaaguucuuugggaaagacguggauagaaagcgcuauacaaccguguccgagauccugaaugcgacccucauucaccagagcaucacaggacuguacgagacccggaucgaccuuucuaaacugggcgaagauuga

SEQ ID NO: 4307 - RNA, 4116 nt, Artificial Sequence
  Cas9 variant
augaccgagaagaacuacagcaucggccuggacauugggacaaauuccgugggaugggccgucaucacggaugacuauaaaguucccgcuaagaaaaugaaggugcucggcaacaccgauaaaaaguacauuaagaaaaaucugcuuggggcccuccuguucgacaacggagaaacagcggaggcuaccagacugaagcggacagcccgcagacgguauacccgcagaaagaaucggcuucgcuaccugcaggaaaucuuugccgaggaaauggcuaagguggaugagucuuucuuuuauagacucgacgagagcuuccugacaaccgaugacaaagauuuugaacggcacccuauuuucggcaacaaggccgacgagaucaaguaccaucaagaauuuccgacgaucuaucaucugcgcaaacaccucgcugauucccacgagaaggccgaccugagacuuauuuaccuggcgcucgcccauaugaucaaauuccgggggcacuuucugauugagggagaacuuaaugcugagaacaccgauguccagaagcuguucgaagccuuuguggagguuuacgaccgcacauucgacgauucuaaucucagcgaaaucaccguggacgcuuccucuauucugacagagaaauuuagcaaguccagacggcuggagaaccucaucaaacacuaucccaccgaaaagaagaauacgcuguucggcaaccuugucgcccuggcgcucggccugcagccuaauuucaaaaccagcuuuaaacuuucugaggaugccaaacugcaguucuccaaggacacauacgaagaggaucucgaggaacugauugggaaaaucggagacgaguaugcugaucuguuuacaagcgccaagaaccucuacgacgcuauccugcuuucuggcauucugaccguggccgauaauaccacaaaggcuccccucuccgccagcaugaucaaacgcuauaacgaacaucaaguugaccugaagaaacuuaaggaguucauuaaaaacaaugcgucugauaaguacgacgaaaucuuuaacgacaaggauaaaaauggguaugccggauacauugagaacggcgugaagcaggacgaguucuacaaauaucugaagacgacccucuccaaaaucgaugggagcgacuacuuucuggauaagaucgaaagagaggacuuccugcggaagcagagaacauuugauaauggauccauuccucaccagauccaucuccaagaaaugcacgcuauucugcgccggcagggcgagcacuaugccuuccuuaaagaaaaccaggccaagaucgagaaaauucugaccuuuagaauccccuacuaugucggcccucucgcucgcaaaaauucucgguucgccugggcggaguaccauagcgacgaaaagaucacaccguggaacuuugaugagauuaucgacaaggaaaaauccgcugagaaguucauuaccagaaugacgcugaaugaucuguaucuucccgaagagaaggugcucccuaaacacagccugguguacgagacauacaccgucuauaacgaacugaccaagguuaaauacgugaaugagcaggggaagucuaacuucuuugacgccaauaugaaacaagaaaucuucgagcauguguuuaaggaaaaccgcaaggucacaaaagauaaguuccucaauuaucugaacaaagaguuucccgaguaccggauucaggaccuuaucggacuggacaaggaaaacaaauccuucaaugccagccucggcaccuaucacgaucugaagaagauucuggacaaaucuuuucuugaugacaagacaaacgagacgaucaucgaagauauuauccagacccucacacuguucgaggacagagauaugauucgccaacggcugcagaaauacagcgacaucuuuaccccucagcagcucaagaaacuggaaagacgccauuauacaggguggggacggcuuuccuacaagcugauuaauggcaucagaaacaaggagaaugggaaaucuauccucgauuaccugauugacgauggauaugcuaaccggaauuucaugcaacugaucagcgacgauacccuucccuuuaagcagauuaucaaagacgcccagauuaucggcgacaucgaugacgugacguccguugugcgcgagcucccgggcagcccugcuauuaagaaagggauccugcagucugucaagauuguggaugaacugguuaaagugaugggacacaaccccgacaauaucgucauugagauggccagagaaaaccaaaccacaaaucggggcagaaaccagucccagcagcgccucaagaagcugcaagauagccuuaaagagcuggggucuaauauccucaacgaggaaaagccuuccuacaucgagggaaaaguggaaaauaaccaucugcaggacgaucggcuguuccuuuauuacauucagaacggcaaggacauguauaccggggaugagcucgacaucgaucaccugagcgacuacgacauugaucacaucauuccccaggcguuuaucaaagacgauuccauugacaauagaguccugacaucuagcgccaagaaccgcggcaaguccgaugacgugcccucucucgauaucguucaugacagaaaagcugauuggauccggcuguauaagagcggacuuauuuccaaacgcaaguucgacaaucugaccaaagccgaaagaggcgggcucacggagaacgauaaggcuggauucaucaagcggcaacugguggagacacgccagauuaccaaacacgucgcccagauccuggacagcagauuuaauacagaacgggaugagaacgacaaggugauucgcaauguuaaagugaucacccuuaagucuaaccuggucucccaauucagaaaagacuuuaaguucuacaaggugcgggaaaucaaugauuaccaccaugcgcacgacgccuaucucaacgcugugguuggcaccgcccugcucaaaaaguacccuaaacuggcuccggaguuugucuauggggaauacaagaaauaugauauucgcaaguucaucacaagcucuggagacaaggccacggccaaauacuuuuucuauuccaaucuuaugaacuuuuucaagagagugauucgguacagcaauggcaaaguggucgugagacccguuaucgagugcucuaaggauaccggggagauugcuuggaacaaacagacagacuuugaaaaggugcgccggguccugagcuacccucaggugaauaucguuaaaaagguggagacccagacaggcggauucuccaaggaaagcauccuccccaaaggcaacucugauaagcugauuccuagaaaaaccaagaaauuccgcugggacacgcccaaguaugggggauuugauuccccgaacaucgcguacagcgucuucgugauugccgacguugagaagggcaaagcuaagaaacugaagacagugaaagaacuugucgggaucuccauuauggagcggucuagcuuugaggaaaauccugugguguuccuggagaagaagggauaucaaaacguccaggaagauaaucucaucaaacugcccaaguacucccucuuugaguucgagggcgggagacgccggcugcuugccucugccagcgaacugcagaaaggcaacgagguugugcucuccagacaucugguggaacugcuuuaucacgcucaucgcgucaauucuuuuaacaauagcgagcaccugaaguacguguccgaacacaaaaaggaguucggagagguucucagcuguguggaaaacuuugccaagucuuaugucgacguggagaaaaaucugggcaagauucgggcgguugcugauaaaaucgacaccuucuccaucgaagacauuagcaucucuuuugugaaccuccugacccuuacagcccugggggccccugcugauuucaauuuucugggagagaagauucccagaaaacgguacaccuccacaaaggaaugccucaacgccacgcugauccaucagagcauuaccggccuuuacgagacacgcaucgaccugucuaaacucggggaggaauga

SEQ ID NO: 4308 - RNA, 4116 nt, Artificial Sequence
  Cas9 variant
augaaccugagaaauguggagagcuaccaggucggccucgacaucgggaccggauccguuggcugggccgugcuggaugacaacggggaucuuugccgguucaagggaaaacccacauggggcucucgcguguuuccuacggcugaaaccgccgcggaggcuagaguccaccgggggcaacgcagacgguaugaccgcagacggcagcgcauugaucugcuccagagauucuuugccgacgaaguggccaagguugauccggaguucuuuauccggcugaaucaggcucgccuucaucccgaaaacagagacccugcccacgcugauuaccgguggccccuguucaauggaagcaacuuuacagagaaagacuauuaccgccaauucccuaccauuuaucaucucagagcccaucugcugaaguccgaugagcccgcggacauccggcucguguaccuggcccuucacaauauugucaaacacagaggcaacuuucugcaccaggauaauccuucucucagcgcucgcaacgccaaugugggcgacgcuguugaagcccugugucuugcgcuggacgaguggugcggggcccaugauguggaaugugcuugcgacgaggccgcucucgccgaggcccugggagaugcuucccugcggccgggcgaaaagagagagcgcgcggaagccgcucucggggucgagaaggcccacaaaaagcuggccaaagcugugucuagcgccguggucggauaugcggcugaauuuggccauguuuucuucgccgaguccgaggggagcaaguuugcccuuucuaacgacgaaaaaguggaggcuuacgugugucccgaugaaggacgggaccuguucgaugccaugagagcuguccacuccagcuacgugcucaugggcauccugucugaggcccagggcgaacuucuguccguuugcaaggugggggaguaugagcgcuacaagcgggaccucgaaacacugaaaagccuggucagagcguauggaccugagcgcuacgaugaguucuuuuguggccccuucuaugaagggacccgggacuacgauccuggaaaggcccagggcuauacaaaauacaaucucggggcuucuaagcugucccacgaagacuuucuuaaagaggugcaaaagcugcucaaagacaucggagcccaggcugaugagagauacgccgacauugaacgcgcgaucgaggccggcgcuuuccugcggagacuuaagaccagcgauaacggcacgauucccuaucagcugcaucucgaagagauggacgccaucauugagcggcaggcugccuuuuacccguuccuggcccaagaaaaggauaaacugaagucccucguuucuuuucgcaucccuuauuacguggggccccugacccagaaaaaugcugcgagagacggaaagggcgaggcccgguucgcuuggagcuccagaaaaccugggauggaagaugcccgcgucuaucccuggaacugggaggacgugauugauaaggaccagagcgccgaagauuuuauccggagaaugacaggaaccugcacauaccuuaagggcgagcccguccuggcucgcuguucucucgacuaugagcuguucugcgugcugaacgaacuugccggggcgagauggacccaagauggcgacaaauccuaccgguuugacgcugccgaucgccucggaaucguugaggaccuguucaagaaaagaaagcgggugacguacgaagccgcugagaaauggcuggcccgcacacacggcccugaaagcgggaagucugcgggaggcgcuuaucaugucagcgggggacagggcgaggaugccuuugagucccagcucucuagccacuacgacuucuguaagauucuggggguggaugaacuuuccgacgccgaugaggcuauggccgaagacaucauucuguggaauaccguuuucgaggauagaagcauccucaaacggaagauuaaacuggcuuauggcgaccgccugggagaugcccaggugagaaaacuuugccaaaaacgguacacaggcugggggcgccucucuggagaacugcugagaggccuccgguccgcgaccgacaacgggccgaagaccaucauggauauccugcuugagggagaccccaaucaugccagacgcaugggcgcugccaugaaccugauggagauucuccacgacgaucugcuggaauuucaggcuaagaucgacgagcacaaucgggaaagagcccuugccgucgggggcaugagcguggaugaggugacaggaucuccugcucuccgccggggcauuaaccaggcgcugagaguugucgacgagaucgccgggauugcuggaaaacccccugcccauaucuauguggaagugacgcgcgaugagggcgcccggaauaaggggagacgcaccacaucccgguacagagcucuggaagccgcgcucagcuccaucaaagcucagugcgccgacgucuaugccgagcugaaggaacgggauccccgcgcucuugacgaugagagacugacccucuacuucaugcaauguggaaaaugcauguacucuggcgacgcccuggauauuaacaagcugcagacauaucagguggaccacauccuuccgcagagcuacguuaaagacgauuccuuugagaauaaggugcucguccggccugacaccaaccaacgcaagggggauacgcugcugcucgacgaaagacugauugcgcggaugagaggcuucuggcgcacacuucgggaugcugagcugaucggagaaaagaaguuuaauaaccucaccagaaccucugugagcgacgagcagaugaaaaaguucguuucccgccagcugguggaaacaggccagauggucaaacaagugcagcagcugcuucaagcccgguaucccgagagcgagguucagccugugaaggccggggucucucaucagcugagagugggaugugcucucgccaagucccgcgaaauuaaugauuuucaccacgcucaugacgccuaccuggcgugccaggugggccgguucguccaauauagacacagcgccguuuacucugagcccgugaaaauggcugccguggucaagcaguuuaucaaaaagcaggcugaagauuaucgcagaacccgggagcucccuggguccgacggauucauugugagcucuuuuaugacacccggcuucgauguuaaaacgggcgaaguguuucgcgacgccugggaugccggggcugagaucgacagaauccggcgcuguuucgacuacaaggauugcuucauuagcagaaugccggaggaaacccauggagcguuuugggacgccacaaucuacuccccucgggcugccggcaagacccugagccuuccccugaaaagagggcucgauccccgcaaguauggaucuuacucccgggagcaguucgccuacuuuuucgucuaugaagcugugaaaccuaagaaaaagcaaagaguucuggaguuugccccggugcccguccgcguggcgagcgcucuggccaacgacccugaugcccuugaggacuaugcucgggaacuggccgaggcggaaggccucguuuucgagcggauuagacgcagaaagguguacaaauaucagcagaucauugucggggauucccggcuguacgugacaggacgcgaagaggugagaaaugcccggcagcucgcuuuuucucaagacgagaccaagcugaucugucgcaucgaacagggcgaggaaugcgaggaaggcgagcuucuggaucucuucagaagcaugcagcggaaauaccuggccugugcuccccgccuggccagacuuaugaaggucgcugagauggaagagggguuuauugccgcgacggccuccggaaaacgggaaguucugcucucucugaccagcaucgcugccgcucacagaaacuccauugaccucaagccuaucggccgcaaagggucuagcggacaaaugaagauuacauucuccaaggagcugagcaccaacggcauccuuuuuguggauucuuccgugacagggauguucgaacggagaugccgccugggacuguga

SEQ ID NO: 4309 - RNA, 4116 nt, Artificial Sequence
  Cas9 variant
auggagaacaagaauuacagcaucggccuggacauugggaccaacuccgugggauggucugucaucacagaugacuauaaaguucccagcaagaaaaugaaggugcucggcaauacggauaaaagauucauuaagaagaaccugaucggggcccuucuguuugacgaaggaaccacagcugaggcccggcgccucaaaagaaccgcgcggcgcagauacacacggcgcaagaauagacugcgguaucuucaggaaauuuucgcugaggaaauguccaaaguggauucuagcuuuuuccaccgccuggacgauuccuuucucaucccugaggacaagagaggcucuaaauacccgaucuucgccacccuggccgaggaaaaggaguaucauaagcaauuucccacaauuuaccaucugcggaaacagcucgcugauagcaaggaaaagaccgaccugcgccuuaucuaucuggcccucgcucacaugauuaaguacagagggcacuuccuguacgaggauacguuugacaucaaaaacaaugauauucagaagaucuucuccgaguuuauuagcaucuaugacaacaccuucgaaggaucuucccuuagcggccagaaugcccaagucgaggcgaucuuuacagacaaaauuucuaaguccgccaagcgggaacgcgugcugaaacucuucccugaugaaaagagcaccggccuguucucugaauuucugaaacucaucguugggaaccaggcugacuucaagaaacauuuugaucugggagagaaggcuccccuucaguucuccaaggacacauacgaugaggaccuggaaaaucuccugggccagauuggggaugacuuugccgaucuuuuccugguggccaaaaagcucuaugacgcgauccugcugagcgggauucucaccgucacggauccuuccacaaaagcuccccugucugccagcaugaucgagagauacgaaaaccaccaaaaggaccuugccgugcugaaacaguuuaucaagaauaaccucccugagaaguaugacgaaguuuucuccgaucagagcaaagacggcuacgcuggguauauugauggaaagaccacacaggaggccuuuuacaaauacaucaagaaucugcuuucuaaauucgagggcaccgacuauuuucuggaaaagauugagcgggaagauuuccucagaaagcaacgcaccuuugacaacggcuccaucccgcaccagauucaucugcaggagaugaacgccauccugcggagacaaggggaacacuaccccuuccucaaagauaauaaggagaaaaucgagaagauucugacauuccgcaucccuuauuacgugggaccccuugcucggggcaacagagacuuugcguggcugacgcgcaauagcgaugaagccauucggccuuggaacuucgaggaaaucgucgacaaggcuucuagcgccgaggauuuuauuaauaagaugaccaacuaugaccucuaccugcccgaggaaaaagugcugccgaagcauucccuucucuaugagacauucgccguguacaaugaacugaccaaggucaaauuuaucgcugaggggcugagagauuaccaguuccucgacucuggacagaagaaacagauuguuacacaacuguuuaaggaaaaacgcaaggugaccgagaaggacaucauccaguuccuucacaacguggauggcuaugacgggauugagcugaaaggaaucgaaaagcaguuuaaugccagccucuccacguaccacgaucugcugaaaauuaucaaggacaaagaguucauggaugacagcaagaacgaagagauucuugaaaauaucguccauacacucaccaucuuugaggaucgggagaugauuaagcagagacuggcgcaauaugacucucuguucgaugaaaaagugaucaaggcucucauucgccggcacuacaccggcuggggcaaacuguccgccaaacuuaucgacgggauuugcgauaaacagacaggaaacaccauccuggacuaucucaucgaugacggcaagaauaacagaaauuuuaugcagcugauuaacgacgaugggcugagcuucaaggagaucacacagaaagcccaaguugugggaaagacggacgaugucaaacaggugguucaggaacuuccuggcucucccgcuauuaagaaagggauccuccaguccauuaagaucguggacgagcuggucaaagugaugggccauaccccugaaagcaucgucauugagauggcccgggagaaccaaacaaccgcucgcggaaagaaaaauucccagcagagauacaaacggaucgaagaugcccugaagaaccucgcgucuggccuggacagcaauauucuuaaagagcaccccacaaacaauauccaacugcagaacgauagacucuuccuguauuaccugcagaaugggcgcgacauguacaccggaaagccccuugauauuaaccagcucuccucuuaugacaucgaucauauugugccucaagccuuuaucaaagacgacagccuggauaaucggguucugacgucccucaaggacaacagaggcaagagcgauaaugugccgucuaucgaagucgugcagaaacgcaaggcuuucuggcagcagcugcuugacuccaaacugauuagcgagagaaaguuuaacaaucucaccaaagccgagcggggaggacuggaugaacgcgacaagguuggcuucaucaagagacaacugguggagacacggcagauuaccaaacacgucgcucagauccuugaugcccgcuuuaacaaggaagugaaugagaaagacaagaaaaacagaacagugaagauuaucacccugaagucuaaccucguuuccaauuuccggaaagaauuucgccuguacaaggucagagagaucaacgauuaucaccaugcgcacgacgccuaccucaaugcugugguggccaaagcuauucugaagaaauaucccaaacuugagccugaguucgucuacggggauuaucagaaguacgaccugaaacgguacaucagccgcucuagaaaccccaaggagguggaaaaagccacggagaaguacuuuuucuauagcaaucuccugaacuuuuucaaagaagagguucauuaugccgauggcacaauugugaagcgggagaauaucgaauacuccaaagacaccggagagauugcuuggaacaaggaaaaggacuucgcgacaaucaaaaagguccugagcuauccucaagugaauaucguuaaaaagagagaggugcagaccggcggguuuucuaaagaauccauucuucccaagggaaacagcgauaagcugaucccgcgcaaaaccaaggacauucucugggagacaacgaaauacggcggguucgauuccccugucaucgccuauucuauucugcucaucgcugacauugagaagggaaaagccaagaagcugaaaaccgugaagacacuuguuggcaucaccaucauggaaaaagccgcuuuugaggaaaaucccauuacauuccuggagaacaagggguaccacaaugugcggaaagagaacauccucugucugccuaaguacagccuguuugaacuugagaauggcagacgccggcugcucgccuccgcgaaggaacugcagaaaggaaacgagauuguccuccccguguaucugaccacgcuucuguaccacucuaagaacgugcauaaacuggaugaaccugagcaccucgaguauauccaaaagcauagaaaugaguucaaagaccugcuuaaccuggucagcgaauuuucccagaaguacguucucgcugaugccaaucuggaaaagauucagaaccucuaugccgacaaugagcaggcugauaucgaaauccuggccaacucuuucauuaaucuucugacauuuaccgcgcugggcgcucccgccgccuucaaguuuuucgggaaggacaucgaucgcaaacgguacaccacagugagcgagauucucaacgcuacccugauccaccaauccauuacaggacuuuaugagacgagaaucgaccugagcaagcucggcgaagauuga

SEQ ID NO: 4310 - RNA, 4116 nt, Artificial Sequence
  Cas9 variant
auggacaagaaauacagcaucggccuggauauugggaccaacuccgugggaugggccgucaucacagacgauuauaagguucccucuaaaaaguucaaagugcucggcaauacggacagacacagcauuaagaagaaccugaucggggcccuucuguuugauuccggagagaccgccgaagcgacacggcucaaacgcaccgcuagacggcgcuacacaagacggaagaaucgcauuagauaucugcaggagaucuucucuagcgaaauguccaaaguggacgauagcuuuuuccaucggcuugaggaaucuuuucuggucgaggaggacaagaaacacgaacgccauccuaucuucggcaacauuguggaugagguugccuaccacgaaaaguauccgaccaucuaccaucucagaaagaaacuggccgacuccacagauaaggcugaccugcggcucauuuaucuggcccuugcucacaugaucaaauuucgcgggcacuuccugauugagggagaucucaaucccgacaacagcgacauggauaagcuguuuauccaacuugugcagaccuacaaucagcuguucgaggaaaacccuauuaaugccucuagagucgacgcgaaagccauccucuccgcucggcugagcaagucucgcagacuggagaaccucaucgcccagcugcccggcgaaaaacggaauggccuuuuugggaaccugauugcucucucccugggacuuacgccuaauuucaagagcaacuuugaucuggccgaggacgcgaagcuccaacugucuaaagauaccuacgacgaugaccuggauaaucuccuggcccagaucggcgaccaguaugcugaucuuuuccuggccgcuaagaaccucuccgacgccauucugcuuagcgacauccugagagugaacuccgaaauuacaaaagcuccccucucugcuagcaugaucaagcgcuacgaugagcaucaccaggaccugacccugcucaaagcgcugguucggcaacagcuuccugagaaguauaaggaaaucuucuuugaucaguccaaaaauggguacgccggauauauugacggcggggcuagccaggaggaguucuacaaguuuaucaaaccgauucuggaaaagauggauggaacagaggaacuccuggccaaacugaacagagaggaccuucuccgcaagcaacggaccuucgauaauggcucuaucccccaucagauucaccugggcgaacugcacgccauccucagacgccaggaggacuuuuauccuuuccugaaggauaaccgggaaaagaucgagaagauucuuacguuuagaauccccuacuacguggggccucuggcucgcggaaauucccgguucgccuggaugacaagaaaaagcgaagagaccauuacacccuggaacuuugaggaagucguggacaagggcgcgucugcucagagcuucaucgagcgcaugaccaauuuugauaaaaaccucccgaaugaaaaggugcugccuaagcauucccugcuuuaugaguacuucaccgucuauaacgagcucacaaaaguuaaguacgugacggaagggaugcggaaacccgaguuucugucuggaaagcaaaaagaagccauuguggaccuccuguucaagaccaauagaaaagucacagugaagcagcugaaggaggauuauuucaaaaagaucgaaugcuuugacagcguugagauuuccggcguggaggaccgguucaacgccagccuugggaccuaccacgaucugcucaaaaucaucaaggacaaagauuuucuggacaaugaagagaacgaagauauucuggaggacaucguccuuacacucacccuguucgaagauaaggagaugauugaggaacgccugaagaaauaugcuaaucucuuugacgauaaggugaugaaacagcugaagagacggcauuacacgggauggggcagacuuucucgcaaacugaucaacggcauucgggacaagcaauccgggaagacaauccucgauuuccugaaaagcgacggauuugccaacagaaauuucaugcagcugaucaacgaugacucucuuaccuuuaaggaggcuauucagaaagcccagguuuccggccaagggcacagccuccaugaacagaucgcgaaucuggccggauccccugcuauuaagaaaggcauccugcagucugugaaggucguggacgagcucgucaaggugauggggcacaaacccgaaaacauuguuaucgagauggcccgcgagaaucagaccacacaaaagggccagaaaaacagcagagaacggaugaagcgcaucgaggaaggaauuaaagagcugggcucccagauccuuaaggagcaccccguggaaaauacccagcugcaaaacgagaaacucuaccuguauuaccugcagaaugggagagauauguaugucgaccaggaacuugauauuaaccggcugucugacuacgauguggaccauaucguuccucagagcuucauuaaggaugacuccaucgauaauaagauccucacacgcagcgacaaaaacagaggaaagucugauaaugugccguccgaggaagucgugaaaaagaugaaaaacuauuggcggcaacugcucaaugcuaagcugauuacgcagcgcaaguuugacaaccuuaccaaagccgagagaggcgggcugagcgagcucgacaaggcgggauucaucaaacggcagcugguggaaacacgccaaauuaccaagcacguugcccagauccuggauucuagaaugaacacaaaauacgacgagaaugauaaacuuauucgggaagucaaggugaucacccugaaauccaagcucgugagcgacuuuagaaaagauuuccaguucuauaagguccgcgagauuaacaauuaccaucacgcucacgacgccuaccugaacgcugugguuggcacggcccucaucaaaaaguauaccaagcuggaaucugaguuuguguacggggauuauaaagucuacgacgugcggaagaugaucgccaaaagcgagcaggaaauuggcaaggcuacagcgaaaagauucuuuuauuccaauaucaugaacuucuuuaagaccgagauuacacuugccaauggagaaauccgcaagcggccccugauugagaccaacgaagagacgggcgagaucguuugggauaaagggagagacuucgcuacagugcgcaagguccucagcaugccucaagugaauaucguuaaaaagaccgaagugcagacaggagcccugaccaacgagucuauuuacgcccggggcuccuuugauaaacugaucagcagaaagcaucgcuucgaauccucuaaauaugggggauuuggcagccccaccgucacauacuccgugcuuguggucgcuaagucuaagguucaggacgggaaagugaagaaaauuaagacgggcaaagagcugaucggaaugacccuccuggauaagcucguguucgagaagaauccucugaaauuuauugaagacaagggcuacgggaacguccagaucgacaaaugcaucaaacuucccaaauauagccuguucgaguucgaaaauggaacacggagaaugcuggccuccgugauggcgaacaauaacucucggggcgaucuccaaaaggcuaacgagauguuucugccggccaaacuuguuacccugcucuaccacgcccauaagauugaaagcuccaaggagcuggagcacgaggcuuauauccucgaccauuacaaugaucuguaucagcuucugagcuacauugaacgcuucgccucucuguauguggacgucgaaaagaacaucuccaaggugaaagagcucuuuagcaauauugaaucuuacuccaucagcgagauuuguucuuccguuaucaaccugcuuacacugaccgcgagcggggcuccugccgauuucaaguuucucggaacgacaauccccagaaagcgguacggcuccccucagagcauucugucuagcacccucauccaccaauccauuaccgggcuguaugagacacgcaucgaccuuucucagcugggcggagauuga

SEQ ID NO: 4311 - RNA, 4116 nt, Artificial Sequence
  Cas9 variant
auggacaagaaauacagcaucggccuggauauugggaccaacuccgugggaugggccgucaucacagacgauuauaagguucccucuaaaaaguucaaagugcucggcaauacggacagacacagcauuaagaagaaccugaucggggcccuucuguuugauuccggagagaccgccgaagcgacacggcucaaacgcaccgcuagacggcgcuacacaagacggaagaaucgcauuagauaucugcaggagaucuucucuagcgaaauguccaaaguggacgauagcuuuuuccaucggcuugaggaaucuuuucuggucgaggaggacaagaaacacgaacgccauccuaucuucggcaacauuguggaugagguugccuaccacgaaaaguauccgaccaucuaccaucucagaaagaaacuggccgacuccacagauaaggcugaccugcggcucauuuaucuggcccuugcucacaugaucaaauuucgcgggcacuuccugauugagggagaucucaaucccgacaacagcgacguggauaagcuguuuauccaacuuguccagaccuacaaucagcuguucgaggaaaacccuauuaaugccucuagaguggacgcgaaagccauccucuccgcucggcugagcaagucucgcagacuggagaaccucaucgcccagcugcccggcgaaaaacggaauggccuuuuugggaaccugauugcucucucccugggacuuacgccuaauuucaagagcaacuuugaucuggccgaggacgcgaagcuccaacugucuaaagauaccuacgacgaugaccuggauaaucuccuggcccagaucggcgaccaguaugcugaucuuuuccuggccgcuaagaaccucuccgacgccauucugcuuagcgacauccugagaguuaacuccgaaauuacaaaagcuccccucucugcuagcaugaucaagcgcuacgaugagcaucaccaggaccugacccugcucaaagcgcuggugcggcaacagcuuccugagaaguauaaggaaaucuucuuugaucaguccaaaaauggguacgccggauauauugacggcggggcuagccaggaggaguucuacaaguuuaucaaaccgauucuggaaaagauggauggaacagaggaacuccuggccaaacugaacagagaggaccuucuccgcaagcaacggaccuucgauaauggcucuaucccccaucagauucaccugggcgaacugcacgccauccucagacgccaggaggacuuuuauccuuuccugaaggauaaccgggaaaagaucgagaagauucuuacguuuagaauccccuacuacgucgggccucuggcucgcggaaauucccgguucgccuggaugacaagaaaaagcgaagagaccauuacacccuggaacuuugaggaagugguggacaagggcgcgucugcucaauccuucaucgagcgcaugaccaauuuugauaaaaaccucccgaaugaaaagguccugccuaagcauucccugcuuuaugaguacuucaccguuuauaacgagcucacaaaagugaaguacgugacggaagggaugcggaaacccgccuuucugucuggagagcagaagaaagccauugucgaccuccuguucaagaccaauagaaaagugacaguuaagcagcugaaggaagauuauuucaaaaagaucgagugcuuugacagcguggaaauuuccggcgucgaggaccgguucaacgcuagccuugggaccuaccacgaucugcucaaaaucaucaaggacaaagauuuucuggacaaugaggaaaacgaggauauucuggaagacaucgugcuuacacucacccuguucgaggauaaggaaaugauugaggagcgccugaagacguaugcccaucucuuugacgauaaaguuaugaagcagcugaaaagacggcacuacacaggauggggcagacuuucucgcaagcugaucaauggcauucgggacaaacaauccgggaagaccauccucgauuuccuuaagagcgacggauuugcuaacagaaacuucauccagcugauucaugaugacucucugaccuuuaaagaagccauccagaaggcccagguguccggccaagggcacagccuccacgagcagauugcgaaucuggcuggauccccugccaucaaaaagggcauucugcagucugucaaaguggucgacgaacucgugaagguuauggggcauaagcccgagaacaucgugaucgaaauggcucgcgagaaucagacaacccaaaaaggccagaagaacagcagagagcggaugaaacgcauugaagagggaaucaaggaacugggcucccagauucuuaaagagcaccccgucgagaauacacagcugcaaaacgaaaagcucuaccuguauuaccugcagaaugggagagauauguauguggaccaggagcuugauaucaaccggcugucugacuacgauguugaccauauugugccucagagcuucaucaaagaugacuccaucgauaauaagguccucacgcgcagcgacaagaacagaggaaaaucugauaaugugccguccgaagaggugguuaagaaaaugaagaacuauuggcggcaacugcucaaugccaaacugauuacccagcgcaaguuugacaaccuuacaaaggcggaaagaggcgggcugagcgagcucgacaaagccggauucaucaagcggcagcuggucgagacccgccaaauuacaaaacacguggcucagauccuggauucuagaaugaauaccaaguacgacgaaaacgauaaacuuauucgggaggugaaggucaucacgcugaaguccaaacucgugagcgacuuuagaaaggauuuccaguucuauaaaguucgcgaaauuaacaauuaccaccaugcccacgacgcuuaccugaacgccguggucggcaccgcccucaucaagaaauaucccaagcuggagucugaauuuguguacggggauuauaagguuuacgacgugcggaaaaugaucgcuaagagcgagcaggagauuggcaaagcgacagccaagagauucuuuuauuccaauaucaugaacuucuuuaaaaccgaaauuacacuugcuaauggagagauccgcaagcggccucugauugaaaccaacgaggaaacgggcgagaucgucugggauaaggggagagacuucgccacagugcgcaaaguucucagcaugccccaagugaauaucgucaagaaaaccgaggugcagacaggagcccugaccaacgaaucuauuuacgcucggggcuccuuugauaagcugaucagcagaaaacaucgcuucgaguccucuaaguaugggggauuuggcagcccuaccgugacauacuccguccuuguuguggccaaaucuaaggugcaggacgggaaggucaaaaagauuaaaacgggcaaggaacugaucggaauuacccuccuggauaaacucguguucgagaagaauccccugaaguuuaucgaggacaaaggcuacgggaacguucagaucgacaagugcauuaaacuuccgaaguauagccuguucgaguucgaaaauggaacacggagaaugcuggcguccgugauggcuaacaauaacucucggggcgaucuccaaaaagccaaugaaauguuucugccugccaaacuugucacccugcucuaccacgcucauaagaucgagagcuccaaagaacuggagcacgaggccuauauucucgaccacuacaacgaucuguaucagcuucugagcuacaucgaacgcuucgcgucucuguauguggacguugagaagaacauuuccaaagugaaggaacucuuuagcaauaucgagucuuacuccauuagcgaaaucuguucuuccgucaucaaccugcuuacacugaccgcuagcggggcccccgccgauuucaaauuucucggaacgacaauuccuagaaagcgguacggcagcccccagagcauccugucuagcacccucauucaucaauccaucaccgggcuguaugagacacgcauugaccuuucucagcugggcggagauuga

SEQ ID NO: 4312 - RNA, 4116 nt, Artificial Sequence
  Cas9 variant
auggagaacaagaauuacagcaucggccuggacauugggaccaacuccgugggauggucugucaucacagaugacuauaaaguucccagcaagaaaaugaaggugcucggcaauacggauaaacacuucauuaagaagaaccugaucggggcccuucuguuugacgaaggaaccacagcugaggccagacggcucaaacgcaccgcgagacggcgcuacacaagacggaagaaucgccugagauaucuucaggaaauuuucuccgaggaaaucggcaaaguggauucuagcuuuuuccaucggcuggacgauuccuuucucaucccugaggacaagcgcgggucuaaauacccgauuuucgcuacccuggccgaggaaaagaaguaucacaaacaauuucccacaaucuaccaucugagaaagcagcucgccgauagcaaagagaagaccgaccugcggcuuauuuaucuggcucucgcccacaugaucaaauaccgcggacauuuccuguacgaagaggcuuuugauauuaagaacaaugacauccagaaaauuuucaacgaguuuaucuccaucuauaauaacacguucgaaggcaauagccuuucuggccagaacguccaaguggaggccauuuuuaccgauaagaucuccaagagcgcgaaaagagaacggguucugaagcucuuuccugacgagaaaucuacagggcuguucuccgaauuucugaagcucauugugggaaaucaggccgacuucaaaaagcacuuugaucuggaggagaaggcuccccuucaguucagccgcgacaccuacgaugaagaccuggagaaccuccugggccagaucggggaugacuuugccgaucuuuuccuggucgcuaaaaagcucuaugacgccauucugcugucuggaauccucacagugaccaauccuuccacgaaagcgccccugagcgccuccaugaucgaaagauacgagaaccaccaaaaggaucuugcuucucugaaacaguuuauuaagaacaaucucccugaaaaguaugacgagguuuucagcgaucaguccgaggacggcuacgccggguauaucgacggaaaaacaacccaggaaacauuuuacaaguacauuaaaaaccugcuuagcaaguucgagggcgcugauuauuuucuggacaaaaucgaacgggaggauuuccucagaaagcaacgcaccuuugacaauggcucuauuccgcaucagauccaucugcaggaaaugaacgccauccugcggagacaaggggagcacuaccccuuccucaaggagaauaaagaaaagauugagaaaauccugaccuuccgcauuccuuauuacgugggaccccuugcccggggcaacagagauuuugcuuggcugacacgcaauuccgaccaggcgauccggccuuggaacuucgaagagauugucgauaaggccagcucugcugaggacuuuaucaauaaaaugacgaacuaugaucucuaccugcccgaagagaaggugcugccgaaacacagccuucucuaugaaaccuucgccguguacaaugagcugacaaaggucaaguuuauugccgaagggcugagagacuaccaguuccucgauuccggacagaaaaagcaaaucguuacccagcuguuuaaagagaagcgcaaagugacagagaaggacaucauucaguuccuucacaacguggauggcuaugacgggaucgaacugaagggaauugagaaacaguuuaaugcuucucucagcaccuaccaugaccugcugaagaucauuaaagauaaggccuucauggacgaugcgaaaaacgaagcuauccuugagaauaucguccacacgcucacaauuuuugaagaccgggagaugaucaagcaaagacuggcccaguaugauucccuguucgacgagaaggugauuaaagcccucacccgccggcauuacaccggcuggggcaagcugagcgcuaaacuuaucaacgggauuucugauaagcagacaggaaacaccauccuggacuaucucaucgaugacggcgaaauuaauagaaacuuuaugcagcugaucaaugaugacgggcuguccuucaaagagauuauccaaaaggcccagguugugggaaagacaaacgaugucaaacaggugguucaggaacuuccuggcagccccgcuauuaagaaagggauccuccaaucuaucaagauuguggacgagcuggucaaagugaugggccacgccccugaauccaucgucauugagauggcgcgggagaaucagacgaccgcccgcggaaagaaaaacagccagcaaagauacaagcggaucgaagacucccugaagauucucgcuucuggccugaauagcaaaauccuuaaggagcaucccacagauaacauucagcugcagaaugacagacucuuccuguauuaccugcagaacgggaaagauauguacaccggagaagcccuugacaucaaucaacucuccucuugcgauaucgaccacauuaucccccaggcuuuuauuaaggaugacagccuggauaaccgcgugcugacauccagcaaagacaaucggggcaagucugauaacguuccuucccucgagguggucgacaagaugaaaguguucuggcagcagcugcuugacagcaagcugaucucuuauagaaaauuuaauaaccucaccaaggccgagcgcgggggacugaacgaacuggauaaaguuggcuucauuaagagacaacuuguggagacgcggcagaucaccaagcacgucgcgcagauccuggacgcccgcuuuaauaaagaagugacagagaaggauaaaaagaacagaaccgugaaaauuaucacacucaaguccaaucugguuagcaacuuccggaaggaauuugagcucuacaaaguccgcgagauuaaugacuaucaucacgcucaugaugccuaccugaacgcugugguggccaaggccauccuuaaaaaguauccgaaacuggaacccgaguucgucuacggggacuaucagaaguacgaucucaagagauacauuucucggagcaaagacccuaaggaaaucgagaaagcuaccgaaaaguauuucuucuacuccaaucugcugaacuuuuucaaagaggaggugcacuaugcggauggcacgaucguuaagcgcgaaaauauugaguacagcaaagacacaggagaaaucgccuggaacaaggagaaggauuucgcuaccauuaaaaaggugcuuucucugccccaagucaauaucgugaaaaagagagaaguucagacaggcggguuuuccaaagagagcauucucccuaagggaaacuccgacaagcugaucccccggaaaaccaaggauauucucugggacaccacaaaauauggcggguucgacucuccggugaucgccuacagcauccugcuuauugccgauaucgagaagggaaaagcuaagaagcugaaaacggucaagacccucgugggcauuacaaucauggaaaaagacgccuuugagaagaauccuauugcguuccuggaaaacaaaggguaucacaauguuuguaaggagaacauccugugccuucccaaguacucccuguuugagcucgaaaacggccgcagacggcugcucgcuucugccaaagagcugcagaaguguaaugaaaucgugcuuccugucuaccugaccacacugcucuaucauagcaaaaacgugcacaagcuggaugagcccggacaucuugaauacauucaaaaacacagaaaugaguucaaggaccugcucaaccugguguccgaguuuucucagaaauauguccucgccgaugcuaaucuggaaaagaucaagaaccuuuacgccgacaaugagcaggcggauauugaaauccuggcuaacagcuucauuaaucugcucaccuuuacggcccugggcgccccugcugccuucaaauuuuucgggaaggacguugaucgcaaacgguauacaaccguguccgagauccuuaacgcuacccugauccaucagagcauuacaggacucuacgaaaccagaaucgaccugucuaagcucggcgaggauuga

SEQ ID NO: 4313 - RNA, 4116 nt, Artificial Sequence
  Cas9 variant
augaaggugaacaauuaccacaucggccuggacauugggaccagcuccaucggaugggucgccauuggcgaggaugggaaaccccucagaaucaagggaaaaacagcuauuggcgcccggcuguuccaggaagggaacccugcggcugaccgcagaauguuucggacgacccgcagacggcuuucucgcagaaaguggcggcugaaacuccuggaggaaaucuucgauccguauaucacacccguugacagcaccuuuuucgcccgccuuaagcaauccaaucugucuccuaaggauagcagaaaagaguuuaagggauccaugcuuuuccccgaccugacagauaugcaguaccauaaagacuauccuaccauuuaccaucugcggcacgcccucaugacacaggaugaaaaguuugacauccgcaugguguaucuggcuauucaccauaucgugaaauacagaggcaacuuccuuaauucuacccccgucgauagcuuuaaggccuccaaggugaacuucguugaccaguuuaaaaagcugaaugagcucuauacggcuauuaacccugaggaauccuuccaaaucaaucuggccaacucugaggauauuggccaccaguuucuugacccguccauccggaaauucgacaagaaaaagcagauccccaaaauugugccugucagcguggaugacaaggcgaccgauaagaucaaugggaaaauugccucugaaaucauuaacgcuauccugggauacaaguccaaacucgacguugugguccagugcacacccguggauagcaagucuugggcccugaaauucgacgaggaggauaucgacgcuaagcugcaaaagauucucccugaaauggaugagaaucagcaguccaucauugccauccugcagaaccuuuacagccaagugacccugaaucagauuguccccaacggcaugucccucucugaaagcaugaucgagaaauauaacgaccaccaugaucaccugaagcucuacaaaaagaucauugaccagcuggcggacccgaaaaagaaggccgcucucaaaaaggccuauucccaauacguuggggaugacggaaaagugaucgaacaggcugauuuuuggagcucugugaagaaaaaucuggacgauuccgaccugagcaagcagauuauggaucucaucgacgccgagaaguucaugccuaaacagcgcacaucucaaaacggcgucauuccccaucagcugcaccagagagagcuugaugaaaucauugagcaccagagcaaguauuacccuuggcuggccgaaaucaaucccaacaaacaugaccuccaccuggcuaaguauaaaaucgaggaacuuguggcguuucggguucccuacuacguggggccuaugauuaccccggaugaccaagccaaguccgcugagacggucuucucuuggauggagagaaaaggaaaggaagccggccagaucacacccuggaauuuugaugagaagguggaccgcaacgccagcgcuaaucgguucauuaaaagaaugaccacaaaggacaccuaucugaucggcgaagauguucucccugacgagucccugcuguacgaaaaauuuaaggugcucaacgagcugaauaugguccgcgugaacgggaaacuucugaaggucgccgauaagcaggcgauuuuccaggaccucuuugagaauuauaaacauaucagcgugaagaaacugcaaaacuacaucaagucuaaaaccggacugcccuccgauccugaaauuagcggccuuucugaccccgaguauuucaauaacucccucgggacauacaaugauuuuaagaagcuguucggaaacaaaguugacgaaccggaucugcaggacgauuuugagaagaucguggaguggagcacggucuucgaagacaaacggauucucagagagaagcugaacgaaaucaccuggcuuuccgaucagcagaaagacgugcuggagucuagccgcuaucaaggcugggggcggcucuccaagaagcugcugacaggaauuguuaaugaccagggcgaaagaaucaucgaugagcuuuggaacaccaauaaaaacuucaugcagauucaaucugacaaugauuuugcuaagcgcauccacgaggccaacgccgaccagaugaaagcuguggaugucgaagacgugcucgccgaugcuuacacaagcccucagaauaagaaagccauuagacaggugguuaaggucguggacgauauccaaaaagcgaugggcgggguggcccccaaguacauuuccaucgaguucacccggagcgaagaccgcaacccucggagaacgaucucucggcagcgccagcuggagaauacacugaaggauaccgcuaaaucccucgccaagagcauuaaccccgaacugcuuucugagcuggacaaugcugccaaauccaagaaaggacucaucgacagacuguaucuguacuuuacccagcuuggcaaggauauuuauacagggaagccuaucaacauugacgagaucagcaccuacgauauugaccauauccucccccaagcguucgucaaagaugacucucugaauaaccgggugcugguuagcaaggccaucaauaacggaaaauccgauaacgugccgguccagcucuuuggcgcuaagauggggcacuucuggaaacagcuggccgaagcuggccuuauuagcaagagaaagcugaaaaaucuccagacagacccugauacgaucucuaaguaugccaugcacggauuuauucgccggcaacugguggagaccucccagguuaucaaacugguggccaacauucuuggcgacaaguacagaaaugaugacacaaaaaucaucgaaauuaccgcucgcaugaaccaucagaugagagaugaguucggguuuaucaagaaucgggaaauuaacgacuaucaccaugcguucgacgccuaccucacagcuuuucugggacgcuaccuguaucacagauacaucaagcuccggcccuauuucgucuacggcgauuuuaaaaaguucaaagaggacaaggugaccaugcgcaauuucaacuuucugcacgaucuuacggacgauacccaagagaaaauugccgacgccgaaacaggggagguuaucugggauagagaaaauagcauccagcagcugaaggacguguaucauuacaaguucaugcucauuucccacgaggucuauacccugcggggagcuauguuuaaccagacaguguaccccgccucugaugcgggcaaacgcaagcugaucccuauuaaagcugacagaccgaucaauguguacgggggcuauagcggauccgccgaugccuacauggcuauuguccggauccauaacaagaaaggcgacaaguaucgcguugugggggugcccaugagagcccgggauagacuugacgcggcuaaaaaggucucugacgccgauuacgaccgcgcccugaaggaugugcucaccccucaacugacgaaaacaaagaaaagccggaagaccggagagauuacacagguuguggaagacuucgagaucguccucggcaaagugauguauagacagcugaugaucgauggggacaagaaguuuaugcuuggauccucuaccuaccaguauaaugcuaaacaacugguucucagcgaucaguccgugaagacccuggccagcaaaggccgccuggacccccuucaggaaucuauggauuacaacaaugucuacacagagauucuggacaaggugaaccaguauuucucccucuacgauaugaacaaauuucggcacaagcugaaucucggguucagcaaguuuaucucuuucccuaaccauaauguuuuugacggcaacacgaaagcuagcagcggaaagagagaaauucuggaggaggugcuuaauggccugcacgccaaccccaccuucgggaaucucaaagacaucggaauuacaaccccuuucggccaacugcagcagcccaacgggauccugcuuucugaugaagcgaagauccgcuaucaguccccgacaggacuguuugagcggaccgucagccucaaagaccuguga

SEQ ID NO: 4314 - RNA, 4116 nt, Artificial Sequence
  Cas9 variant
augaaggugaacaauuaccacaucggccuggacauugggaccagcuccaucggaugggucgccauuggcaaagaugggaagccccucagaguuaaaggaaagacagcuaucggcgcccggcuguuccaggaggggaacccugcggcugaccgcagaauguuucggacgacccgcagacggcuuucucgcagaaaauggcggcugaagcuccuggaagagauuuucgauccguauaucacacccguggacagcaccuuuuucgcccgccuuaagcaauccaaucugucuccuaaagauagcagaaaggaauuuaaaggauccaugcuguuccccgaccugacagauaugcaguaccauaagaacuauccuaccaucuaccaccuccggcaugcccucaugacacaggacaaaaaguuugauauucgcaugguguaucuggcuauccaccauauugucaaguacagaggcaauuuccuuaacucuacccccguggacagcuuuaaagccuccaagguugauuucguggaccaguuuaaaaagcugaaugagcucuaugcugccaucaacccugaagagagcuucaaaauuaaucuggcgaacucugaggauaucggccaccaauuucuugacccguccauucggaaguucgacaaaaagaagcagauccccaaaaucgucccugugaugaugaaugauaagguuacggaccgccugaacgggaaaauugccagcgaaaucauucacgcuauccucggauacaaggccaaacuggaugugguccugcagugcacccccguggacucuaagccuugggcucucaaguucgaugacgaggauauugacgccaaacuggaaaagauccuucccgagauggaugagaaucagcaauccaucguggcgauucugcagaaccucuacagccaggucacacugaaucagaucguuccgaacggcaugucucuuuccgaaagcaugauugagaaauauaacgaccaucacgaucaucugaagcucuacaaaaagcugaucgaccaacuggccgacccuaagaaaaaggcugugcucaaaaaggccuauucccaguacgugggggaugacggaaaagucauugaacaggcugaguuuuggucuagcgugaagaagaaucuggaugacuccgaacuuagcaaacaaaucauggaucugaucgacgccgagaaguucaugcccaaacagagaaccucucagaacggcguuauuccucaccagcuccaccaacgggagcuggaugaaaucauugagcaucaguccaaguauuaccccuggcuuguggaaaucaaucccaacaaacacgaccugcaucucgccaaguauaaaauugagcagcuggucgcuuuuagagugccuuacuacguugggccgaugaucacacccaaggaucaggcggaaagcgccgagaccguguucucuuggauggagcgcaagggaacggaaacaggccaaauuaccccuuggaauuuugacgagaaagucgaucggaaggcuagcgccaacagauucaucaaacgcaugacaaccaaggacaccuaucugaucggcgaagaugugcuccccgacgagucccugcuuuacgaaaaauuuaagguccugaaugagcucaacauggugcggguuaaugggaagcugcugaaaguggccgacaagcaggcuauuuuccaggaucuuuuugagaacuauaaacacgucucugugaagaaacuccagaauuacaucaaggccaagacaggacugccuagcgaccccgaaauuuccggccugagcgauccggagcauuucaacaauucucucgggacguauaacgacuuuaaaaagcuguucggauccaaaguugaugaaccugaccuucaagaugacuuugagaagaucguggaguggagcaccgucuucgaagauaaaaagauucugagagagaagcucaaugaaaucacauggcugucugaccagcagaaagaugugcuggaguccagccgcuaccagggcugggggcggcuuuccaagaaacuccugaccggaaucgugaacgaccaaggcgaaagaauuaucgauaagcuguggaacacaaauaaaaacuucaugcagauucagucugacgacgauuuugcgaagcgcauccacgaggcuaaugccgaccaaaugcaggccguugaugucgaggacgugcucgcugaugccuauaccagcccccagaacaaaaaggcuauuagacagguggucaaggugguugacgauauccaaaaagccaugggcgggguggcgccuaaguacaucuccauugaguucacgcggucugaagaccgcaauccccggagaacaaucagccggcagcgccagcuggaaaacacccuuaaagauaccgccaagucccuggcuaaaagcauuaauccugagcuccugucugaacuggacaacgccgcuaaguccaagaaaggacuuacagauagacucuaccuguauuuuacccagcugggcaaggacaucuacacaggggagcccauuaauaucgacgagcucaacaaauaugauaucgaccacauucugccgcaagccuucaucaaggauaauagccuugacaaccggguccuggugcucacggcgguuaauaacggaaaaucugauaaugugccucugagaauguuuggcgccaagauggggcauuucuggaagcagcuggcugaagccggccuuauuuccaaacgcaagcucaaaaaccugcagaccgaccccgauacaaucagcaaguacgcuaugcacggauuuauucggagacagcuggucgagaccucucaagugaucaaacucguugccaacauucugggcgacaaguaucgcaaugaugacacaaagaucaucgaaauuaccgccagaaugaaccaucagaugcgggaugaguucggguuuaucaaaaaucgcgaaauuaacgacuaccaccacgcuuucgaugcguaucuuacggccuuucugggaagauaccucuaccaucgguauaucaagcugcgccccuacuucguguauggcgacuuuaaaaaguucagagaggacaaagucaccaugcggaauuucaacuuucugcacgaucuuacagacgauacccaggagaagauugcugacgccgaaacaggggaggugaucugggaucgcgaaaauagcauccaacagcugaaggacguguaccauuauaaauucaugcucauuucccacgaggucuacacccugagaggagccauguuuaaccagacgguuuauccugcuagcgaugccggcaagcggaaacucaucccggugaaggcggaccgccccgugaaugucuacgggggcuacucuggauccgcugaugccuauauggccauugugagaauccauaacaaaaagggcgacaaauaccggguugugggggucccuaugagagcucuggaucgccuugacgccgcgaagaaugugagcgaugcugacuucgaccgggcccugaaggauguucucgcuccccagcugacaaaaaccaagaaauccagaaagacaggagagauuacccaagugaucgaagacuuugagaucguccugggcaaagugauguaucgccagcuuaugauugauggggacaagaaguucaugcugggaucuagcaccuaccaguauaacgccaaacagcucguucuguccgaucaaucugugaagacacucgccagcaaaggccggcuggacccucuucaggaauccauggauuacaauaacgucuauacggagauccuggacaaggugaaucaguacuuuucucucuacgauaugaacaaauucagacacaagcugaaccugggguuuagcaaguucauuuccuuucccaaucacaacgugcuugacggcaauaccaaagucagcucuggaaagcgcgaaauccugcaggagauucucaacggccugcaugcuaauccuacauucgggaaccucaaagauguuggaaucaccacacccuucggccaacugcagcagccgaaugggauucuucuguccgacgagaccaagauccgguaucagagcccuacgggacuguuugaaagaacagugucucucaaagaccuguga

SEQ ID NO: 4315 - RNA, 4116 nt, Artificial Sequence
  Cas9 variant
auggacaagaaauacagcaucggccuggauauugggaccaacuccgugggaugggccgucaucacagacgauuauaagguucccucuaaaaaguucaaagugcucggcaauacggacagacacagcauuaagaagaaccugaucggggcgcuucuguuugauuccggagagaccgccgaagcgacacggcucaaacgcaccgcuagacggcgcuacacaagacggaagaaucgcauuugcuaucugcaggagaucuucucuaacgaaauggccaaaguggacgauagcuuuuuccauagacuugaggaauccuuucuggucgaggaggacaagaaacacgaacggcauccuaucuucggcaauauuguggaugagguugccuaccacgaaaaguauccgaccaucuaccaucuccgcaagaaacuggcugacucuacagauaaggccgaccugagacucauuuaucuggcucuugcccacaugaucaaauuucgggggcacuuccugauugagggagaucucaaccccgacaauagcgacguggauaagcuguuuauccaacuuguccagaccuacaaccagcuguucgaggaaaauccuauuaacgcgucccgcguggacgccaaagcuauccucagcgccagacugucuaagucccggcgccuggagaaucucaucgcucagcugcccggcgaaaagaagaacggccuuuuugggaaucugauugcccucagccugggacuuacgccuaacuucaagucuaauuuugaucuggcggaggacgccaaacuccaacuguccaaggauaccuacgacgaugaccuggauaaccuccuggcucagaucggcgaccaguaugccgaucuuuuccuggcugccaaaaaccucagcgacgccacacugcuuucugacauucugagaguuaauuccgaaaucaccaaggcuccccucagcgcguccaugauuaaacgguacgaugagcaucaccaggaccugacacugcucaaggcccuggugagacaacagcuuccugagaaguauaaagaaaucuucuuugaucagucuaagaacggguacgcuggauauaucgacggcggggccagccaggaggaauuuuacaaauucauuaagccgauccuggagaaaauggauggaaccgaggaacuccuggccaagcugaaucgcgaggaccuucuccggaagcaaagaacguucgauaacggcuccauuccccaucagauccaccugggcgaacugcacgcuauucuccgccggcaggaggacuuuuauccuuuccugaaagauaauagagaaaagaucgagaaaauccuuacauuucgcauucccuacuacgucgggccucuggcccggggaaacagcagauucgcguggaugacccgcaagucugaagagacaaucacccccuggaauuuugaggaagugguggacaaaggcgcuuccgcccaauccuucauugagcggaugaccaacuuugauaagaaucucccgaacgaaaagguccugccuaaacauucucugcuuuaugaguacuucacaguuuauaaugagcucacgaaggugaaauacgugaccgaagggaugagaaagcccgccuuucugagcggagagcagaaaaaggcuaucgucgaccuucucuucaaaacaaaccgcaaggugaccguuaagcagcugaaagaagauuauuucaagaaaauugaguguuuugacuccguggaaaucucuggcgucgaggaccgguucaaugccagccuugggacauaccacgaucugcucaagauuaucaaagacaaggauuuucuggacaacgaggaaaaugaggauauccuggaagacauugugcuuacccucacgcuguucgaggauaaggaaaugaucgaggagagacugaaaacauaugcucaucucuuugacgauaagguuaugaaacagcugaagcggcgccacuacaccggauggggcagacuuucccggaaacugauuaacggcaucagagacaagcaaagcgggaagaccauucucgauuuccugaaaucugacggauuugccaaccgcaauuucauccagcugauccaugaugacucccuuacauuuaaggaagcgauucagaaagcccaggugagcggccaagggcacucucuccacgagcagaucgcuaaccuggccggauccccugcuauuaagaaaggcauccugcagagcgucaagguggucgacgaacucgugaagguuauggggcauaaacccgagaauauugugaucgaaauggcccgggagaaccagaccacacaaaagggccagaaaaauuccagagagcgcaugaagagaaucgaagagggaauuaaagaacugggcucucagauccuuaaggagcaccccgucgagaacacgcagcugcaaaaugaaaaacucuaccuguauuaccugcagaacgggcgggauauguauguggaccaggagcuugauauuaaucgccugagcgacuacgauguugaccauaucgugccucaauccuucauuaaggaugacucuaucgauaacaagguccucaccagaagcgacaaaaaucggggaaaguccgaugacgugccgagcgaagaggugguuaaaaagaugaaaaacuauuggcgccagcugcucaaugcgaagcugaucacacagagaaaguuugacaaccuuaccaaagccgaacggggcgggcugucugagcucgauaaggcuggauucauuaaacgccagcuggucgagacaagacaaaucaccaagcacguggcccagauucuggacucccggaugaauacgaaauacgaugaaaacgacaagcugauccgcgaggugaaggucauuacccugaaaagcaagcucgugucugauuuuagaaaagacuuccaguucuauaagguucgggaaaucaacaauuaccaccaugcucacgaugccuaccugaacgccguggucggcacagcucucauuaaaaaguaucccaagcuggaguccgaauuuguguacggggacuauaaaguuuacgaugugagaaagaugaucgcgaaaagcgagcaggagaucggcaaggccaccgcuaaacgcuucuuuuauucuaauauuaugaacuucuuuaagacagaaaucacccuugccaauggagagauucggaagagaccucugaucgaaacgaacgaggaaacaggcgagauugucugggacaaagggcgcgauuucgccaccgugcggaagguucucagcaugccccaagugaauaucgucaaaaagacagaggugcagaccggagcucugaccaacgaauccaucuacgccagaggcagcuuugacaaacugauuucucgcaagcaucgguucgaguccagcaaauaugggggauuuggcuccccuacagugacguacucuguccuuguuguggcuaagagcaaggugcaggaugggaaagucaagaaaaucaagaccggcaaagaacugauuggaaucacacuccuggacaagcucguguucgagaagaauccccugaaauuuauugaggacaagggcuacgggaacguucagaucgauaaaugcaucaaacuuccgaaauauucccuguucgaguucgaaaauggaaccagacgcaugcuggcuucugugauggccaacaauaacagccggggcgaccuccaaaaggccaaugaaauguuucugccugcuaaacuugucacacugcucuaccacgcccauaagauugaguccucuaaggaacuggagcacgaggcguauauccucgaucacuacaacgaccuguaucagcuucugagcuacauugaaagauucgcuucccuguauguggauguugagaaaaacaucagcaaggugaaagaacucuuuucuaauauugaguccuacagcaucucugaaauuuguuccagcgucaucaaccugcuuacccugacggccucuggggcccccgcugacuucaaguuucucggaacaaccaucccucggaagcgcuacggcagcccccagagcauucuguccagcacccucauccaucaaucuauuacagggcuguaugagaccagaaucgaucuuagccagcugggcuccgacuga

SEQ ID NO: 4316 - RNA, 4119 nt, Artificial Sequence
  Cas9 variant
augaacaaugaguacuucgugggcuuugacaucgggaccaacagcgucggagccgcuguuacagaugaaaaguaucacgugcugaaauucaagggcaaugccauguggacguccgcgguguuugagucugcucagcaaagcgccgacagacggcucaaccgcaccgccagacggcgccuggauagaucccagcagcggcgcgaccuucugcaggaacucauugcucccgccaucacaccugucgauccgagauucuuugaccggauucgcgagucugcucugugggccgaagauaaaaccacagggagcagauucaccuacuuuuccgacgagggauauacagauaagcaauaccauaaagaguaucccaccauccaccaucuuauuugcucucugaugaaugacccugcgccccacgauccucggcucguguacaucgccuguagcuauaugcugacgcaucgcggccacuuccugaacgaagcugacaaggagaagaucgaugacguucucgacauuagacggguguuuaaugaacugugcuccugguucaccagcuacgggaucgagguccccuuuucuuguuucccugaggaauuuggaaacgugcuuacagccaaucgcggcguucaggauagaacccgggcuuucuacgaccuccuguucgccggcaaaaagccgaaacccuccgaggaugaccagguggauauugacguccugaucaaacuuauuagcgggggaaaaaucgaacugucuaagcucuuucugaacgaggaauauuccgagcuggagaauaacaagauucagcucagcgaugcgggcuucgacgaaaaagagccugaacugagaucugagcuuggggaugacuuuggacugguggccgcugccaagaauaucuacgauuggucccuccugacaggcgugcuuggggaaugcaaaagcaucuccgaggcuaaggucaaaaccuaugagaagcacucugaagaccuggccgcccuccgccggguugugagaaaauaccaucccgacaaguauaaggagauuuucaaaaaguacguggucggaaacuauacgagcuacuccggcaaugugaaaagcgcuggcaagaucucugaaacaaaacugaagcgcuguaaccaagcggaguuuugcgauuaccugaaguccaaacucaaggacguuaaaccugcccccggggaugacgaaugugagcgggugcugaaggagauuagcaaacacaccuucugcccgagacaggucacaaccgauaaccgcgugaucccuuaucagcuuuacuauaccgaacugaagaagguucucgagaaugcuaaacgguacauuccccagcugaacgugacagacgaauauggaucugccgccgauaagauccuuagccugaugacguuuagaaucccuuacuaugucggcccccucgugaaaaagaaugacuccucuaacgcuuggauuguccgcagaggggagggaagaauccugcccuggaauuucgaugagcugguggacaaagauaagugugaagacgaguuuauucgccggaugaccugcaaguguacauacaucgccggcaaaaacguucucccuaagaauagccugcuuuacugcaaauucauggugcugaacgaaauuaauaacaucaagaucaauggggagagaauuuccgucggagauaaacaaaagaucuauaccgaacucuuugagaaaaagcggaaggugacaguucgcgacauuagaaaccugcugaccagcgagggccggcuuaaagcgggcgacacguucgggggaaucgauauuacagugaagucuucccucaaaccgcagcaugaccugaagagacugauggcugccggcgucaucaccgaagccgaugcugaggaaauuaucgagcgcauuaccugcacaaccgacgugagccggcucagaacauggcuggggaaauuuggacuuucugccgcugaugccaaguacguguccggccugaaguauagcgacuucgggcgccucuccagagaguuccugacggaaguuaaugaugucgaccccgcgaccggcgaggugaucaacccuaauaucauuacaaugaugugggaaaacaacaucaaucugauggagcuucucucucagaaauacagcuaucggucccaaauugaaucuaugaaccgcgaguacuaugccgcuaauccccugacccuggaugaaagaaugagcgagauguacaucccuuccgccgugcggcgccccgucaagagaacaaucgagaugaugaaagaauacaugcacauuaugcggaagccgccuaaacgcaucuuuauugagauggcuagagaacucaccgaccuggauaacaagggaaagcggacgagcucucgcagaaauacccuucuggaguucuuuaaaaaguguccccaggacacaaccgagcuccgggcccagcuggaaaagaaguccgaugacgagcugagaagcgaaaaacuuuaucucuacuucgcgcagcugggcaagugcauguauucuggggaguccaucgacauugaacgccugggaagcaagcucuacgauguggaccacaucuuuccucaagcccggguuaaagaugacucuaucgagaacaaggugcugguccuuagcgaucugaauggcgcuaaauccgacagauaucccauuaacgccgauauccgcaauaagaugcauagcuucugggacaaacuccacucuauugggcugaucggagagaagaaauacgaacggcugacaagauccaccggcuuuacggaugacgagcuugcuggguucauuagccgccagcucguggaaacacggcaguccaccaaggccguugccgcucugcuggcggaggaauuuccugagucugagaucguguaugucaaggccggccucgcuagccaguucagacaugaauuuggacugcuuaaaugucgcgagaucaacgaucugcaccaugccaaggacgccuaccucaauauugugaugggcaacaucuaccacguuaaauucacaaaggaccccaugaauuuugugaaagaauaucggagaaaggagcaagucuucgaucugaagauucaguccaugcugacccacgacgcuauccggaacggggaaaccgccuggauuggagauggcacauggcuugagacggugaaaaagcagauggagaaaaauaacauccgcuacgugagauauucuuuccggcgcaagggggcgcuguuuaaccucaugccggaacggaaaaauccuagccugcucccccggaagaacggaaagaauaugguccugcccgcugagaaauacggcggguauaacaauaccgccgccuccuucuuuucucuuguuaaguaccauagcgcuaaaggcuccggaguggugauuaucccugucgaacugauccacgcccauagauaugagcacgacagcucuuucgcggaggaauacgcucuccgcgugcuggccgauauuguuucccugaagaaaggcgacgugcuucagagcgucgaguuuccgcuggggucucggauccucaaggugaacacacugcucgauauugacggauucagagccaauaucaccggcaaggauuccgggggaaaauaccugggcauuagcucugcuuccagccuuaucaucucccaaguugacacaaccuauauuaagcgcgugaucagcauuaacgaacggaucucugccugcgagaaaaauaagcagagcuacacgauuagacccgaauuugaugucaucacauccgagcgcaacaucgagauuuauaauaugcugugugagaaaaucucuagccggccuuucugcauuaaguuugcuaacaccuccgacaccuucgugucugggagagaaaaguuuaucgcccucagccugaaugaacagguuaaaacacugaccaacaugcuuuccguguucaagacaggccgcgcgucuggaugugaucugacgaauauuggcgggagcaaaaacaccgccaucgucaagcucaacgcugugcuguccaaucucaaagacuucaagagcgugagaauuaucgaccagucucccacaggacuguacgagaaagucuccccuaaccuucugagccuguga

SEQ ID NO: 4317 - RNA, 4119 nt, Artificial Sequence
  Cas9 variant
augaccaagaaaaacuacagcaucggccuggacauugggacaaauuccgugggaugggccgucaucacggaugacuauaagauucccgcuaaaaagaugaaaguucucggcaacaccgauaaggaguacaucaagaaaaaucugcuuggggcccuccuguucgacucuggagaaacagcggaggcuaccagacugaagcggacagcccgcagacgguauacccgcagaaagaaccggcuucgcuaccugcaggaaauuuuugccgaggaaaucgcuaaggccgauaauagcuucuuucaaagacucgacgaguccuuccugacagaugacgauaaagacuuugauucucacccuaucuucggcaacaaggcugaggaagacgccuaucaucagaaguuuagcaccauuuaccaucugcggaaauaucucgcggauuccccggagaagucugaccugcgccuuguguaccuggcccucgcucacaugaucaaauacagagggcacuuccugauugaaggagagcuuaaggccgagaauacggacgugcagaaacuguuuaccgauuucgucgaaguguaugaccggacauuugaugacagccaucucuccgagguuaccguggaugcuagcucuauccugacagaaaagauuuccaaaagccgcagacuggagaaccucaucgaaucuuaccccaaggagaagaaaaauacccuguucggcaaccuuauugcccugucccucggccugcagccuaauuuuaagacgaacuucaaacuuagcgaggacgcgaagcugcaauucucuaaagauacauaugaagaggaccucgaagagguccuggaaaagaucggggaugacuacgccgaucuguuuaccuccgcuaagaaucucuaugacgccauccugcuuagcggcauucugacaguggacgauuccucuaccaaagcuccccucagcgccuccaugaucaagcgguacgccgagcaccacgaggaccuggaaaaacuuaaggcuuucauuaaaaccaacaagccuaaucuguaucaugauaucuuuaaggacgagacacagaacggauacgcgggguacauugaaaacggaguuaaacaggaugaguucuauaaguaccucaaaacgauccugagcaagaccgacggcucugaauauuuucuggauaaaaucgagcgcgaggacuuccucagaaagcagcggacauuugauaauggguccauuccccaccaaauccaucugcaggaaaugcacgccauucuuagacgccagggagacuacuauccuuuccugaaggagaaccaggaucggaucgaaaagauucucaccuuuagaaucccguacuaugugggcccccuggcucgcaagaauagccgguucgccugggccgaguaccacucugacgagaaaaucacaccuuggaacuuuaauaaggucauugauaaagaaaagagcgcugagaaauucaucaccagaaugacgcugaacgaccuuuaccuccccgaagagaaggugcugccuaagcauucccacguguaugaaacauuugccgucuacaaugagcugaccaaaauuaaguauguuaacgagcaaggcaaagaagcguucuucgacucuaauaugaagcaggagaucuuugaucauguguucaaagaaaaccgcaaggugaccaaggagaaacuccugaauuaccuugacaaggaauuucccgaguaucggauucaggaucugaucgggcucgacaaagagaacaagagcuucaaugcuucccugggaacauaccacgaucugaaaaagauucuugacaagagcuuucucgaugacaaagucaacgaagaggugaucgaagauaucauuaagacccugacacuguucgaggacagagaaaugauccaacagcgccuccauaaauauucugauaucuuuuccacgcagcagcugaagaaacuugagcggagacacuacaccggcugggggcgccugagcuacaagcucauuaauggcauucggaacaaggagaacaauaaaacaauccuggaauaucugaucgacgauggauacgccaacagaaauuucaugcaacuuauuaacgacgacacccucccguuuaagcagaucauuaaagaugcccagaucauugggaauaucgacgauaucgcugccguugugcacgagcugccuggaucucccgcuauuaagaaaggcauccugcaguccauuaagaucgucgacgaacucgugaaaguuaugggccauaacccugauaauauugugaucgagauggcccgggagaaccaaacaaccaaucgcgggagaagccagucccagcagcggcugaagaaacuucaagacucucugaaagaacucggaagcaacauccugaauaagaaaaagcccuccuaugucgaggauaaaguggaaaacguccaucugcaggacgauagacuuuuccucuacuauauucagaauggcaaggacaucuacacgggggaggaacuggauauugaccgccugucugacuaugauaucgaccacauuaucccccaggcguuuauuaaggaugacagcaucgauaaccgggugcucaccuccagcgccaaaaauagaggaaagucugacgauguuccuaaccuggacaucgugcgcgcuagaaaagccgauuggguccggcuuuacaaguccggccugauuagcaaacgcaaguucgacaaccucacaaagucugagagagggggccugaccgaggcugauaaagccggauuuaucaagcggcaacugguggaaacacgccagauuaccaaacacguugcgcagauccuugacgccagauucaauacggagcacgaugaagacgacaaggugauucggaacgucaaagugaucacacugaaguccaaucucaucagccaauuccgcaaggauuuuaaauucuacaaggugagagagauuaacgacuaucaucacgcucaugaugccuaccugaaugcuguugucggcaccgcccuccugcggaaauauccgaaacuugcccccgaauuuguguacggggaguauaaaaaguacgacgugcgcaagcugaucacaucuagcuccgauaaagcuaccgcgaaguauuucuuuuacagcaaccucaugaauuucuuuaaaagagucgugcgguacucuaacggaagaguuauugugcgcccugucaucgaguauuccaaggacaccggcgaaauuguguggaauaaagagacagauuuccggacgaucugcaagguucugagcuacccccaggugaacaucgucaaaaagguggaaucccagaccgggggauuuucuaaggagagcauucugccuaaaggcgacuccgauaaacuuauccccagaaaaacaaagaaaguuuauugggacaccaagaaguacgggggcuucgauucuccgauuaucgccuauagcguguuugucguggcugacguggaaaaaggaaaggccaaaaagcugaaaaaggucaaggagcucguuggcauuuccaucauggagcgcccuucuuucgaaaagaaucccauuguguuccuggagaagaaaggguaccggaacgugcaggaagauacacucaucaagcugccuaaauauagccuuuuugaguucgagggaggcagacgccggcugcucgccuccgcuagcgaacugcaaaaggggaaugaggucgugcugucugacagacuuguugaacugcucuaccacgcccaucgcgugaacuccuuuaauagcaccgagcaccugaaguacgucucugaacacaaaaaggaguucggagaggugcucuccuguguugaaaacuuugcgaacagcuauguggacgucgagaaaaaucuggauaagauccgggcugugauuaacaaaaucgacacguucucuauugaagagaucuccaccagcuuuguuaaucuucugacacugaccgcccucggcgcccccgcugauuucaacuuucuggggaagaaaauuccuagaaagcgguacacauccaccaaggaaugccuuaaugccacacugauccaucagagcaucacgggccucuaugagacccgcauugaccugucuaaacucggagaggauaaguga

SEQ ID NO: 4318 - RNA, 4119 nt, Artificial Sequence
  Cas9 variant
augaccaagaaaaacuacagcaucggccuggacauugggacaaauuccgugggaugggccgucaucacggaugacuauaagguucccgcuaaaaagaugaaagugcucggcaacaccgauaagaaguacauuaaaaagaaucugcuuggggcccuucucuucgacucuggagagacagcggaagcuaccagacugaaacggacagcccgcagacgguauacccgcagaaagaaccggcuucgcuaccugcaggagaucuuugccaaugaaauugcuaaaguggaugagagcuucuuucaaagacucgacgaauccuuccugacagaugacgauaagaccuuugacucucacccuaucuucggcaacaaggccgaggaggaugcuuaucaucagaaauuuccgacgaucuaccaucugcggaagcaccucgccgacagcuccgaaaaagcggaucugcgccuugucuaucuggcccucgcucacaugauuaaguucagagggcauuuucugaucgagggagaacuuaaugccgagaacaccgacgugcagaaaauuuucgcugacuuuguuggcguguacaaucggacauucgaugacucucaccugagcgagaucaccgucgauguggccuccauucucacagaaaagaucagcaaaucucgcagacuggagaaccugauuaaguacuaucccaccgaaaagaaaaauacgcucuuuggcaaccugaucgcgcuugcccuggggcuccagccuaauuucaagacaaacuucaaacuguccgaggacgcuaaacuucaauuuagcaaagauaccuacgaagaggaccuggaggaacuccugggaaagaucggcgaugacuaugccgaucuguucacaucugcuaagaaucucuacgacgccauucugcuuuccgggauccugaccguugaugacaacagcaccaaagcuccccucucugcuuccaugauuaagcgguauguggagcaccaugaagaccuggagaaacuuaaggaauuuaucaaagcgaacaagagcgagcuguaccacgauauuuucaaggacaaaaauaagaacggauaugccggcuacaucgagaauggggucaaacaggaugaauuuuacaaguaucucaaaaacauccuguccaagauuaagaucgacggaucugauuacuuccuggacaaaauugagcgcgaagauuuucucagaaagcagcggacauucgacaauggcagcaucccucaucagauucaucugcaagagaugcacgcuauccuuagacgccagggcgauuauuaccccuuucugaaagaaaagcaggaccggaucgagaaaauucucacguucagaaucccuuauuacguggggccgcuggugcgcaaggauucccgguuugccugggccgaguauagaagcgacgaaaagauuacccccuggaacuucgauaaggucaucgacaaggagaaaucugcugaaaaguuuauuacacgcaugacccugaaugaccuuuaccucccugaggagaaaguucugcccaagcacucccacguguacgaaacauaugccguguacaacgagcugaccaaaaucaaguaugucaaugaacagggaaaggagagcuucuucgauucuaacaugaaacaagaaauuuuugaccauguguucaaggagaaucggaaaguuacgaaggagaaacuccugaacuaccuuaauaaggaauuuccugaguauagaaucaaggaucugaucggccucgacaaagaaaacaagagcuucaaugcgucccuggggacauaccacgaucugaaaaagauucuugacaaagccuuucucgaugacaaggugaacgaggaagucaucgaggauauuaucaagacccugacccuguucgaggacaaagauaugauucaugaacgccuccagaaguauucugacaucuuuacagccaaccagcugaaaaagcuggagcggagacacuacaccggauggggccgccugagcuacaaacucaucaaugggauucggaacaaggaaaauaacaaaacaauccuggauuaucugauugacgacggauccgccaauagaaacuucaugcaacuuaucaaugaugacacgcuccccuuuaagcagauuauccaaaagagccaggugguuggcgauguggacgauaucgaggcugucgugcacgaccugccgggcucuccugccauuaaaaaggggauccugcaguccgucaaaauuguggaugaacucguuaaggugaugggaggcaaccccgacaauaucgucauugagauggcucgggagaaccagaccacaaaucgcgggagaagccagucucagcaacggcugaaaaagcugcagaacucccuuaaggaacucggaagcaauauccugaacgaggaaaaaccuuccuacaucgaggauaagguggaaaauucucaucugcagaacgaccagcuuuuccucuauuacauucaaaacggcaaagauauguauaccggggacgaacuggacaucgaucaccugagcgacuacgauauugaccauaucauuccccaggccuuuaucaaggaugacuccauugauaauagaguucucacaucuagcgcgaaaaaccgcggcaaguccgacgaugugcccagccuggacaucguccgggccagaaaggcugagugggugcgccuuuauaaaucuggacugaucuccaagagaaaauucgauaaucucaccaaggccgaacggggcgggcugacggaggcugacaaagccggauuuauuaagcgccagcugguggaaaccagacagaucacaaagcacguugcgcaaauucuugaugcccgguucaacaccgagcacgacgagaaugacaaagucauccgcgaugugaaggugauuacacugaaaagcaaccucgucucucaguucagaaaggacuuugaguucuacaaagugcgggagaucaaugauuaccaucacgcucaugacgccuaucugaacgcuguugugggcaccgcccuccugaagaaguacccuaaacuugccuccgaauuugucuauggggaguacaagaaauaugauauccgcaaguucauuacgaauagcucugacaaagcuacagcgaaguacuuuuucuauagcaaccugaugaacuuuuucaaaaccaaggugaaguacgccgauggaacaguuuuugaaagaccgaucauugagaccaaugcugacggcgagaucgccuggaauaaacagauugauuucgaaaaggugcggaaaguccucuccuacccccaagugaacaucguuaagaaaguggagacccagacagggggcuuuagcaaggaaucuauccugccuaagggagacuccgauaaacugauuccccgcaagacgaaaaaggucuauugggacaccaaaaaguacggcggguucgauagcccuacaguggccuauuccguguucgucguugcugacguggagaagggaaaagccaagaaacuuaagaccgugaaagaacuggucggcaucucuauuauggagcggagcuuuuucgaggaaaaucccguggaguuucucgaaaacaagggguaccacaacaucagagaggacaagcugauuaaacucccgaaguauucccuguucgaguuugaaggaggcagacgccggcuucuggcgucugcuagcgagcuccagaaagggaaugaaaugguucugccuggcuaccugguggagcuucuguaucaugcccacagagccgauaacuucaauuccacagaauaccucaacuacgucucugagcacaagaaagaguuugaaaaggugcugagcugcguugaggacuucgcuaaucucuauguggaugucgagaaaaaccuguccaagauccgcgccguggcggacagcauggauaauuuuucuauugaagaaaucuccaacagcuucaucaaucuucugacccugacggcucucggagcccccgccgacuuuaacuuccugggcgagaagauuccucggaaaagauacacaucuaccaaggagugucuuaaugcuacccugauccaucaguccauuacagggcucuaugaaacccgcaucgaucugagcaaacucggagaggaauga

SEQ ID NO: 4319 - RNA, 4119 nt, Artificial Sequence
  Cas9 variant
augaacagcgacaagagagaggauuacuaugugggccuggacauggggaccggaucccucggcggggccgucacagauacgcaguaccaucugcuuaaaguuaagggaaaagacuucugguuugugcgggaauaugagaccgcuaagucucaacuggaucgcagaacacaccggaucgccaaacgcagacuccagcggcacaaggcgcgcauuggccugaucagaagcuacuucgcugaagacauucuuaagcaugauccccuguuuuauauccggcaggacaauuccaaauacuaucacgaggauaaggacgugcgccucaccacaaaagauucuauuuucgccgacccuggguacggagauaaggaauaccuggacgacaaagaguauccgaccaucuuucaucugagacaggcccuccugcgggaucaaaucaaggacgaggaacgcuacagcagauuccuuuaucuggcuauuaucaacauguuugagcaccggggccacuuccuccugaauacagaauccucugaucuuaacgccgacaugauuaaggaugucggcgagcuggugaugaaugcuaucugcgggguuagcgaguacggauccgugaccuauaaagaaauuaucgagauucucgaagacaagaacaucagccgcacggccaaaaaggaucagaucgcgucuaaaauugacaucaagaaauccgagaaggcccagauggaaagaauuaagugucugugcggcauggaggcugaugcccgggucauguuugagaucgaagcugacgagaaaauuaagaucgccuuccagcaagcggccuuugaagaugagaaagaagagaucgaggcugugauuggggaagacagauaccugaucauugagaauaugaagcagcucuaugacuacagccagcugcagucuguucuuaacggauucgauuaccuguccgacgcccgcgugcaaauguaugaaaaacauaaggaggaucuccaucugcuuaagaaagucuaccggaagaaucuggacagagaaaucuaugaucgcauguuucggagcggcgaggaggggucuuacugugcuuauuccaacagcaccaauuccguggacucucucgccgaagccaaaaaguacagacgcaacaugaaaaagcggagccagaaggaucuguaugacagaauuaaaaaggaucugaaagaggugcacgacgcugaugcggacgccauccgcaaggaaauggagcucgagcgguuccugcccaaacagaucacaggagcuaauggcauuaucccuaaccaaguccacagaaaggaacuuaagaaaauucuggagaaugccgaacaccaucucgauuuccugaaggagaaagacgaauccggcuacaccguuagcgagcgcauccuuaugcuguuuucuuccaacauucccuacuauguggggccugugggaagcggcucuaagacagggugggccaaaauccaggagagcggacagguccuccccuggaacauggaacagaagauugacaucgagcaaaccuccgaacgguucaucacgaaucugauuagagagugcacauaccugucuggcgaaaaagugcucccuaagcagagccugcuuuaugaguccuacuguguucugaacgagaucaauaaccuccggauucacgggaagcgcaucgugccggaacugaaacaggauauuuauaaggaggucuuucagggauucagacugggcaaaaaggugaccaaaaagaauaucugcacauaccuuaucaaccggggccucauuaccgaagagagcgaaguuucugggaucgacaaggagauuaaugcuuaucugcccuccuacggaaaaauguacggcguguuuggggagagacugcgcgaagaggccguccaagaaaucgcggagaagauuaucuauuacggaaccaucuauggcgaugcuaaaagcauguuccggaagaaacucaaccaguacgugucugacggguggaugacagaguaucaggccaagagaauuuccggcuacaaguuuaaagauugggcccgccugagcagauccaugcuuugucugucuggaugcgacaagagcacgggcgagaaaaucucccucauucgggcuaugugggaauauaaucugaacuucauggaacugaucuaccgcgaggauuuuaccuuccagaaggaacuugaggagagacggaaagcccucgggaagacacugcaagaauuucaguucgaggaccuggaugaauacuauuacucugcuccugucaagcgcaugauuuggcaggccgugcaggcgcucaaagagaucacccaaaucaugggacauaaucccaagagaauuuuuaucgaaaugacacggaccgaggaggaaaaaggcgagcaggggcgcaagaacagcagagaaaaacggcugcuuaagauguaugaguccauucgcgacgaaagaaauugggccgcugagaucaaaaacgccaaugcuagcggaaagcugaacucuaagaaacucuaccuguauuaccugcagaugggccgggauguuuauacgggggagccuauugacaucgaagaucuuuucgacgacuccagauacgauauugaccacaucuacccccgcagccucacaaacgauaauaacaucgagaauaaccuggugcuggucucuaagaccauuaaucaaaacgaaaagaaaaaugacuauccggugccugagaaaauccggagaaacaagaagguucgcaaucucuggcauacccugcacaaaaugggcuucaugaacgaugagaaguacaaucggcuuacauccaccgaaagacugagcgaggaccagcucgccggauuuauugcgcgccagcugguggaaacagcccagggcgcuaaagggaucgccgagcugaugaaggcuaugcuucccggaacggauauugucuaugccaaagcccggaacgugucugacuucagaaaggaauacaagaugcucaaaagccgccuggugaaugauuaucaccaugcucaagacgcguaccugaacaucguugucggcaauguguauuuuaugaaguucacccggaacccuaugaacuuugugaaaacagaggccagacgggaugggcgcaauuacgacuacaaccucuauaagauguacuccaaagacaucauuagaaauggagagaaggcuuggaucgccaccagcgaacagggccccgggacaauucggcuggucaaggagaccaugggccgcaacacgcccaucauuaccagacaggccuucgaacagcggggagagcuuuuuaaucugcaaccugugggcaaauauucugcuaagaaagauaacuacguuccgcucaagaucaaugacgagaaaaugcaggauguguccaaguaugggggauacacaagccugaaccccuccuauuucaucuuuauugaacacggcccugagaagaaaagaaagaaauguuucgaagucauccauucuuacuacgccgcgcagauuaagaccgagaaagaccugaucgauuuucuucugcagaagggguauaaaaauccccgcgugauuaacgcucggaucaagaagaaugcccucauuaaauacaacggauauuuccuguacaucaucggcauggacgccagaaagaauauugaauuuagcaacgcuacagccaugugccucaaaaauaaguauauccaauacguuuguaaacuggagaagaugaacaaggcgauucuucuguccgaaaaacagaagaccaaccuccacugggaugagaaaaucacgugcgagucuaaucuggaacuguaucgcgagcuuacagaaaagcaucugcacagcauuuaccagcggcacccuagauccaucgggaaaugccucgcugacggcgagggagccuucaagcugcucgauaucgaggaacaagugaagauuaucugugacauuguccaguacaccucuuuccagcgcggcguguuuagccugaaaguucuugggggacccaaggaggugggccggaucagaauuuccgggaacaugacagaagccaaagagugcaagcuggucaauuauagcaucaccggaauguacaaaaccgaaauggaucuccugaagaaguga

SEQ ID NO: 4320 - RNA, 4122 nt, Artificial Sequence
  Cas9 variant
auggagaagaccuacagcaucggccuggacauugggacaaacuccgugggauggucugucaucacggaugacuauaaaguucccgccaagaaaaugaaggugcucggcaauaccgauaaaaaguacauuaagaaaaaccugcuuggggcucugcuuuucgacagcggagaaacagccgaggugaccagacugaagcggacagcgcgcagacgguauacccgcagaaagaaucggcuucgcuaccugcaggaaaucuuugcuaaggagauggccaaagucgaugaauccuucuuucaaagacucgaggagucuuuccugacagacgaugacaagaccuuugauagccacccuauuuucggcaacaaggccgaagaggacgcuuaucaucaggaauuuccgacgaucuaccaucugcggaaacaccucgccgauuccucugagaaggcugaccugcgccuuguguaucuggcccucgcgcacaugaucaaauucagagggcauuuucugauugagggagaacuuaaugccgagaacaccgauauccagaagcuguucaaugacuuuguugaaacauacgacaaaauugcugaugagagccaccucuccgaaguggacgccagcucuauccugaccaacaagauuuccaaaagccggcgccuggagaaucucaucaagcaguaccccacagagaagaaaaacacccuguucggcaaucuugucgcucuggugcucggccugcaaccuaacuuuaagacgaauuucaaacuuucugaagaugccaagcugcaguucuccaaagacacauaugaugaggaccucgaggaacugcuggggaagauuggagaugacuacgcggaucucuuuaccgccgcuaagaaccuguaugacgccauccuucugagcggcauccucacaguugaugacaauucuaccaaagcuccccuguccgccagcaugauuaagagauacgaggaacaccaugaggaccuugaaaaacugaagaaauucaucaaggugaacaacuuugauaaguaucacgagauuuucaaagacaaguccaaaaauggguacgccggauauaucgaaaacggcgucaagcaggauauuuucuacaaacaucucaagucuaucaucagcgagaagaaugggggacaguacuuccuggacaaaauugaacgggaggauuuucugcgcaagcaaagaaccuucgacaacggcuccaucccucaccagauucaccuccaggagaugcgggcuauccugagacgccagggcgaauauuaccccuuucuuaaagagaaucaagcgaagauugaaaagauccugacauuccggaucccuuauuacguggggccgcucgccagaaaggauagccgcuuugcuugggccaacuaucauucugacgagcccauuacgccuuggaauuucgaugagguggucgacaaagaaaaguccgccgagaaguuuaucacccggaugacacugaacgaucuguaccuucccgaagagaaaguucucccuaagcacagccauguguaugaaaccuucacaguguacaaugagcugaccaaaauuaaguacgucaacgagcagggagaaucuuucuuuuucgacgcuaauaugaaacaggagaucuuugaucacguguucaaggaaaacagaaagguuacgaaagccaagcugcucagcuaucugaauaacgaguuugaagaguuccgcauuaaugaccuuaucggccuggacaaagauuccaagucuuuuaacgcgagccucgggacauaccaugaccugaaaaagauucuggauaaguccuuccuugacgauaaaaccaacgagcaaaucaucgaagacauugugcucacccugacacuguuugaggaucgggacaugauccacgaaagacuccagaaguauagcgauuucuuuaccucucagcagcugaaaaagcucgagcgccggcacuacacaggauggggcagacuguccuauaaacucauuaaugggauccgcaacaaggaaaauaacaagacgauucuggacuuccugaucgaugacggacaugcuaaucggaacuuuaugcaacuuaucaaugaugagagccucucuuucaaaaccauuauccaggaggcccaggucgugggcgacguugacgauauugaagccgugguccacgaccugcccggcuccccggcuaucaagaaagggauucugcagagcgugaagaucgucgaugagcucgugaaaguuaugggagacaacccugauaauaucgugauugaaauggccagagagaaccaaacaaccaaucgggagcgcucccagucucagcagagacugaagaaacuucaaaacagccugaaggaacucggcuccaauauccugaacgaggaaaagcccucuuacauugaggacaaagucgaaaauagccaucugcagaacgaucagcuuuuccucuauuacauccagaacgggaaggacauguacacaggagaugagcuggacauugaucaccuguccgacuaugacaucgaucacaucauuccucaggcuuuuaucaaagacaauagcauugauaaccgggugcucaccucuuccgccaagaauagaggcaaaagcgacgauguucccucucuggacaucgugcgcgcgcggaaggccgagugggucagacuuuacaaguccgggcugauuagcaaacgcaaguucgauaaccucacgaaagcugaaagaggcggacugaccgaggccgacaaggcuggcuuuaucaaacggcaacugguggaaacacgccagauuaccaagcauguggcccaaauccuugaugcgagauucaauacaaagcgggacgagaacgauaaaguuauccgcgacgucaaggugauuacccugaaaucuaaucucgugagccaguuuagaaaggaauuuaaauuuuauaagguccgggagaucaacgauuaccaccaugcccacgacgcuuaucugaaugccgugguugggacggcucuccugaagaaauaccccaaacuuacaccugaguucguguauggagaauacaaaaaguacgacguccgcaaacugauugccaaguccagcgaugacuauucugagaugggcaaggccaccgcuaaauacuuuuucuauuccaaccucaugaacuuuuucaagacagaagugaaauacgcggaugggagaguuuucgagcggccggacaucgaaaccaaugccgauggagagguggucuggaauaagcagaaagacuuugauauugugcgcaagguucugagcuauccccaggugaacaucgucaaaaagguggaggaacaaaccgugggccagaaugggggccuguucgacaacaacauccuugcuaagccugagaaagaugacaagaaaaagcuguuucccauuaaaaagucccucucuacaacgagcuacggaggcuaugccagagccaccaucgcuuacuccauucugaucgucucugaguucgggaagaauaaagaacucaagcugcuuggacugccucuccuggauaaaguuaaguacgagaaaaaccccauugccuaucugaauagcaucggcaucauuaacgugaaguccaucuuuaaacuuccgaaauacugccuguucgaauuucaggagaagaauacaaacuaucggagauacauggugucuaaucaggaacucaaacgcgcgaaccaacuguuccucaccuguaaggagacagaacuggucuauaaauacauuaagagcgacaaugauaacacccaucuuguggggaaugagaagacgauccuguccauuuggaacaaacugguuaucuuuauggagcggacaaagcucauugacaaaaagcuguucgcuagccuuaaacagcugaaggacgaaguggaucucaucaauauccuggacaugaccgccaaaucucucgauuuuaccaagauuuccgccggacagaagaaaaucacaauuagcgacucucugucccuuccuaucaagagauggcaguucagcucugaugagaaaaugcugaagcaacugaaaaccgcuacacucauucaccaguccgucacgggccuguaugaaacccgcaucgaccuuagcaagcugggggaggaauga

SEQ ID NO: 4321 - RNA, 4122 nt, Artificial Sequence
  Cas9 variant
auggagaagaccuacagcaucggccuggacauugggacaaacuccgugggauggucugucaucacggaugacuauaaaguucccgccaagaaaaugaaggugcucggcaauaccgauaaaaaguacauuaagaaaaaccugcuuggggcucuccuguucgacagcggagaaacagccgaggugaccagacugaagcggacagcgcgcagacgguauacccgccggaaaaauagacuucgcuaccugcaggaaaucuuugcuaaggagauggccaaagucgaugaauccuucuuucaaagacucgaggagucuuuccugacagacgaugacaagaccuuugauagccacccuauuuucggcaacaaggccgaagaggacgcuuaucaucaggaauuuccgacgaucuaccaucugcggaaacaccucgccgauuccucugagaaggcugaccugcgccuuguguaucuggcccucgcgcacaugaucaaauucagagggcauuuucugauugagggagaacuuaaugccgagaacaccgauauccagaagcuguucaaugacuuuguugaaacauacgacaaaauugcugaugagagccaccucuccgaaguggacgccagcucuauccugaccaacaagauuuccaaaagccggcgccuggagaaucucaucaagcaguaccccacagagaagaaaaacacccuguucggcaaucuugucgcucuggugcucggccugcaaccuaacuuuaagacgaauuucaaacuuucugaagaugccaagcugcaguucuccaaagacacauaugaugaggaccucgaagaacugcuggggaagauuggagaugacuacgcggaucucuuuaccgccgcuaagaaccuguaugacgccauccuucugagcggcauccucacaguugaugacaauucuaccaaagcuccccuguccgccagcaugauuaagagauacgaagaacaccaugaggaccuugaaaaacugaagaaauucaucaaggugaacaacuuugauaaguaucacgagauuuucaaagacaaguccaaaaauggguacgccggauauaucgaaaacggcgucaagcaggauauuuucuacaaacaucucaagucuaucaucagcgagaagaaugggggacaguacuuccuggacaaaauugaacgggaggauuuucugcgcaagcaaagaaccuucgacaacggcuccaucccucaccagauucaccuccaggagaugcgggcuauccugagacgccagggcgaauauuaccccuuucuuaaagagaaucaaagcaagauugagaaaauccugacauuccggaucccuuauuacguggggccgcucgcgagaaagaacucucgcuuugccugggcuaaauaucauuccgaugagcccauuacgccuuggaauuucgacgagguggucgauaaggaaaagagcgccgagaaauuuaucacccggaugacacugaacgaccuguaccuucccgaagagaagguucucccuaaacacucucauguguaugaaaccuacgccguguacaaugagcugacaaagauuaaauaugucaacgagcagggaaaggagagcuucuucgauuccaauaugaagcaggagaucuuugaccacguguucaaagaaaacagaaagguuaccaaagagaagcugcucaauuaccugaacaaagaauuucccgaguaucgcauuaaggaucuuaucggccuggacaaggagaauaaaucuuucaacgcuagccucgggacguaccaugaccugaagaaaauucuggauaaguccuuucuugacgauaaagugaacgaagaggucaucgaagacaucauuaagacacucacccuguucgaggauaaggacaugauccacgaacggcugcaaaaauauagcgauauuuuuaccgccaaucagcucaagaaacuggagagacgccacuacacaggauggggccggcuuucuuauaagcugaucaacgggauuagaaauaaagagaacaauaagaccauccucgacuaccugaucgaugacggauccgcgaaccgcaauuucaugcagcugauuaacgaugacacacuuccguuuaaacagaucauucaaaagagccaggugguuggcgauguggacgacaucgaagcugucgugcaugaucucccuggcucucccgccauuaagaaagggauccugcaguccgucaagaucguggacgagcugguuaaagugaugggaggcaauccugauaacauugucaucgaaauggcccgggagaaucagacgaccaacagagggcggagccaaucccagcagcgccucaagaaacugcagucuagccuuaaggagcugggauccaauauuaucaacgaagagaagcccucuuacauugaagacaaaguggagaauagccaccuccaaaacgaucagcuguuccuguauuacauccagaacggcaaggacauguauacaggggaugaacuugacaucgaucaucucuccgacuacgauauugaccacaucauuccccaggcuuuuaucaaagacgauagcauugacaauagaguucugaccucuuccgccaagaaccggggcaaaagcgaugacgugccuucucuggauaucgucagagcucgcaaggccgagugggugcggcucuauaaguccggacugauuagcaaaagaaaguucgacaaucuuacaaaagcggagcgcggcgggcugaccgaagccgauaaggcuggauuuaucaaaagacaacucguggagacgcggcagaucaccaagcacguugcccagauucuggacgcucgcuucaacacagaacaugaugagaaugacaaggucaucagagaugugaaagugauuacccugaagucuaaccuugucagccaauuccggaaagacuuugaauuuuacaaggugcgcgagaucaaugauuaucaccaugcccacgacgcguaccugaacgccguugugggcacagcucuccugaaaaaguacccgaagcucgcccccgaguuugucuauggggaauacaaaaaguaugacgugagaaaacugauugcuaaguccagcgaugaccauucugagaugggaaaagccaccgccaaguacuucuuuuauuccaaucuuaugaacuucuuuaaaacgaagguuaaguacgcugauggcagcguguaugaacggccuaucaucgagacaaaugcggacggggaagucguguggaacaaacagaaggauuucgagauuauccgcaaaguucuguccuacccccaggugaauauugucaagaaaguggaggaacagaccgugggccaaaacggaggccucuuugacaauaacauccuggccaagccugagaaggaugacaaaaagaaacuguuccccauuaagaaaucucuuagcacaaccuccuacgggggauaugcuagagccaccaucgccuacucuauccugauugucagcgaauuuggcaagaacaaggagcucaaacugcucgggcugccgcuucuggauaagguuaaauaugagaagaauccuaucgcuuaccucaacuccauuggaaucauuaaugugaaaucuaucuucaagcugcccaaguauugccuguucgaauuucaggagaaaaacacaaauuaccggcgcuauauggugagcaaccaggaacuuaagagagccaaucagcuguuccucacguguaaagagaccgaacuggucuacaaguacauuaaauccgacaacgauaauacacaccucgugggcaacgagaagaccauccugagcaucuggaauaaacuuguuauuuuuauggagcggacaaagcugaucgacaagaaacuguucgcgucucucaagcaacugaaagaugaagugaaccuuauuaauauccuggacauugcuuccaagagcaucgacuuuaccaaaaucucugccgggcagaagaagauuguccucaacgauucccugagccucccuaucaaaagauggcaguucaagucugacgagaaaaugcugaagcagcuuaaugaugccacgcugauucaccaauccaucacaggccuguaugaaacccgcauugaccucagcaaacugggagaggaauga

SEQ ID NO: 4322 - RNA, 4122 nt, Artificial Sequence
  Cas9 variant
augaaccugagacgggcccgcgacuacagcaucggccucgaucuggggaccggauccgugggcugggcugucacagacgccgaggggaaucuuuauucuuucaagggaagacccgcgaugggcagccggacguuuccuaacgcugaaccggccuccguugcccgcauucccagagggcagcggcgcagauacgagcggcgcagacaacggaucaaacugcuccagcaguucuuuaugucugauauggaacgcguggacccugauuucuuuaccagacugaaucagagcacacuucuggcugaggacaaggaugaacggauugccuccugcgcuuggcccaucuucaacucuagcgacuuuaccgagaaagauuauuacaagaaauucccuacaauuuaucaccuccgcgccuuucugugugaguccgacgaaaagggagaucugagacucguguaccuggcgcuucauaauaucgucaagcaccggggcaacuuccuguaucaagacaaucccgcccucagcgcuucugaugccuccguggacgaggcuguuagacagcugguggacgcccuugcggaauggugccagaacaaagagaucgagcugagcugugaugccggccgcauuaucgaagucuuuggggacgcuucucuccggagaaccgauaagcgcgaccagcugaaaggacugcucggccugccugccgaucuugcuaagacaauggggaaagagcuggccuccgccgugcucggauacgcugcgaauuucagcaagauuuuucugaucucugacgccgaacauaaguucucccuuggcaacgaugagaaaguugaagaguucgagaccauuugcccgaaugaauguacgagccuguuuuccgcucuccggaccgccuacucugccuaucugcugagcgggauccucagagacgcuaacggaaagacacuguccuucugcaaaaagaaagaguacgaucgcuaucacgacgaucuugcccugcucaaggcgcuggugcgggaauacgcucccgagagcuaucaaucuuucuucggcggcgaaagacuugucgugaaugggcgcaugaccaaacgguacgacccuacaaaggccaagggauauaccaaauacgaccuggugcauuccgccggcagcuacgaugagcucgcuaaggacgucaaaaagcugcuggggucucucgccgcugaugacagcagauaucagcgcaugaugcaggccuuugaugaggaacgguuccugagacggcuuaaaacguccgacaacggaucuauucccuaccagcugcaccucgaggaacugcgcgcgaucaucgccagacaaggcgaguuuuauccuuuccugaaggaagagagcaagaaaauugagucccuuguuagcuuucggauccccuacuauguggggccgcucacaaccaagaaugcugccguggauguccacggaaacaaaagauucgcuuggucugaacgcaagccuggcauggaguccgccaaagugcggcccuggaacugggacgauguuauugacagaggcaagagcgcggaaaauuuuaucgugcgcaugacagggaccuguaccuaccugcagaacgagaagguccugccuaaaugcucucuccuguaugaggaauuuugugugcuuaaugagcugaacggagcccauugguccgcugauggcgaccacgaaugccccuuugauacaagcgacagacgggggauuguucaggaccucuucuguggaaagcgcagaguguccuacaaacaagucgaggauuggcugcggcagcauggcucucgcagagcccgggugagcgggggccagggagcuuccggcuucgaaucuaagaugagcuccuacaucuuuuucagcaaagacguccugcacguggaucgcaucgaccccgccgauuuuccuaugauugaggagaucauucuuuggaauacgcuuuucgaagacagagauauccugaaggagcggauugaagaggccuauggggaccgccugaacgcugaacagaucaagaccaucugcaaaaagagauuuacaggauggggccggcucucuagacgccugcuuaccgggauuaaagcgcaaacagaucagggagaccuguccaucauggauauucuccgggagggcgacccgaauaacgaucacagagggaaggccaugguuuucaugggcauccugcauagcgaggaccugggauuucagaaaaagauugaccagaucaaucaagaaaaagugucugcuggcaaggucucccuugaggaucuccccgggagcccugcccugcgccggucuauuaaccaggccaugagagugguugacgaaaucgugagcaucgcuaagugucccccuucccacauuuaccuggaggucacccgcgaugaagacggagcccggaaaggcagacgcagcacgcggagauaugaugcgaucaaggcugcccucgagaaauucaaggaggaaucucccacaugguuugaccaggauguguucggggaguuucggcgcuccagagccgaagaccuggaugagcggcuuagccuguacuucaugcagggaggcaaaucccucuauucugcuaccccgcugaagcuggagcuucuccauaccaaucaauaccagguggaccacauuaucccucagagcuauauuaaggaugacuccuuugaaaacaaagcccugguucuggcgggggagaaucagcgcaagucugacgcucuccugaucgauagcuccaucagaacagccauggcccccuacuggcgggcucuccaucaagccggccugaugggagacaaaaaguucaacucucucaugugcagcuccauuagcgauaaaagaguccgcggcuucaucgcucggcagcugguggaaaccucucagauugugaagcuggccgggaugaugcuucaauccaauuacccugaggcggacguccagcccgugaaggccagccugggacacgaucucagaguucaggcuggcuuuaucaaaugccgcgaagugaacgacuuccaccaugcccacgaugcucugauugccugugaggucgggcgguauaucaaccagugccauccuggaaucuacgacaaucccauuggcuaugccagagcugugcgcgagcucguucggaagcaaaacgaagagaugagaaaauacgggcgccugccgggcucugcgggauuuaucgugggcggguucaugagaacacacgucgauguggacacgggagaaguugugugggaugccgaggaggaacuuucccggauucgcgcuuaucuggacuacagcaaugucuuugugaccagaaugucugaggaaacauccggcgcccucuggaacgccaccaucuauagcccucacuacgggaagacagcucccacccugcauauuaaacagggacuggaugugcagcgguacggcggcuauuccagcgccacguucgcguacuuuacccuuuaugucgcugagaaggggaagaaacgcaaggccgaacugcucggaauccccaucucuguugccagaaaaauugagggcgaaccuagcaagcuggacgcuuucguggcccaggacgcggaggcuaaaaagcucaaacacccgcugaucauucgggccagaauccuuaaguacgcccgcuuugagauggaagggaaucaauucuauuuugcugcccaggaugcuguguacuccgcccggcagcugguccucaagggagaccuguauucuguggcggccaaggcuugugauaaacaucugaacgacagcugcauuuccaaugaggaucuuaucagacuguacgacgaacucguucacaaaggcgaucugcucuguaacaaguucgggaaugugacagacguccugcgcgccggacgggagagauacgcuggccuuucuauuagcgagaaacggcagcuggugugcaacguucuggccuauuaccgcuccgccaccgcuagaguggauaucucucucgucggcgggcccaagcaugcgggaaaucugggcaucgccuucgugcuuaacaauccugaagcuauuguuuuuguggaccaaagcgucacagggauguucgagaagcggacccgcguggaacuguga

SEQ ID NO: 4323 - RNA, 4122 nt, Artificial Sequence
  Cas9 variant
augaagaaaauccugggccucgaccuggggaccaacagcauuggaugggcccuugugaaugaggcugauaacgaaagagagaaguccucuaucauuaaaaucggcguccggguuaauccccugacaguggacgaacagcaaaacuucgagaaggggaaaagcauuacgaccaaugccgaucgcacacucaagagauccaugcggcgcaaccugcagagauuuaaacuucggaaagaaaaucugaucgagauccucaagaaacagaaguucauuaacgacgagaccauccugucugaaaauggaaacaaaagcacauuugagaccuacaaucugcgcgcgaaguccgcuacagaagagauuacccucgagcaguucgccagagugcugcuuaugaucaacaagaaacggggcuauaagucuagccgcaaagccaagucccaagaugaagggcagcugauugacggaauggagaucgcuaaaaagcucuacaaugauaaccugacgccuggccaguuugucuuccagauucuuaaagaaggcaagaaguauaucccggacuuuuacagaagcgaucugcaagccgaguucgacaaaaucuggucuuuucagaagcaguucaaucccgauauucucaccgaagaguuuaacaaacagaucauugggaagggaaaagugaacacaaccaagaucuuccuggcuaaguauggcauuuacacaaucgacaauaaaggggccgauaagaaaucccaagcguauaacuggcggguugaggcccugaccaaucagcucacgaaggaggaacuggcuuuugugaucagcgaccuuaacggaauuaucucuaauuccagcggcuaccuggggucuauuuccgaccgcagcaaagaacucuacuucaacaagcagacagucggacaauaucugaucgcccagcuuaaggagaauccucacacccagcugaaaaaccagguguucuacagacaagauuaucucgacgaauuuaauacaauuugggagacccaggcuaaguuccauaaagagcugaccaacgaacugaaggaggaaauccgggauaucauuaucuuuuaccagcgcaaacucaagucccagaagggccugauuucuuucugcgaguuugaaagcaaacaaaucgagauuaauaucgacggcaagaaaaagcugaaaacaguuggguccaaggugugucccaaaagcucuccucuuuuccaggucuuuaagauuuggcagauccucaacaauauccaggugauugagaaguccacgggaaaaagcaaguuccuggaacaagaugagaaagaaauccuuuuuaaggagcugaacuucaaagacaagauuucuaagaccgaugcccucaaaauccuguauaagaauuacaaagagcuggacuuuaacuucaaggaaaacauugagggcaauagaacacaggcgaccuuucucaaagccuuccagagcaucaucgaacuguccgggcacgaggugucugauuucagcaagauuaagacagacgaaauccuugagauugucacccccaucuuugagggauucggcuuuaacacgaaucugcuccaguucaacuccaaucugaaagggaaggauuuugaaaaacaagcuguuuaucagcuguggcaucuucucuacagcuucgagggagacaacucuaauacaggcaacgaaaagcugauucagaaaaucuccgagcuguacggcuuugaacgggaguaugccaucauuaucgcuaauauuagcuuccaaccugacuacgggucucucuccaccaaggccaucagaaagauucugccgcaccuuaaagagggaaucgaauuuagccuggccugcgaguaugcuggcuaccgccauuccaagaacucucucaccaaagaagagaagaauaaaaagauccugaaagauaagauugacauccugcccaagaacagccuucggaauccugugguggaaaagauucucaaccagaugaucaaugucgugaacgcgacaauugagaccuaugggaagcccgaugagaucagaauugaacuggcccgcgagcugaaaaaguccgcuaaagaacgggaggaccucacaaacgccaucaauaagucuacgcuggaucacgagaaguacaaagcccuucugcagaaggaguucggacucagcaacguuuccagaaaugacaucauucgcuauaaacuguaccuggaacuugaacacaacggcuuucauacccucuacagcaauacauauaucgagccuaacaagcuguucucuaaagaauuugauauugagcacaucauuccccagucccggcuguucgacgauagcuucucuaauaagaccaucgaguccagaagcgcuaacaucgaaaaggggaaugagacagccuuugacuacgugucuaacaaaaauggcgaagucggacucaaggauuaucugaaaaacauugaggaccuuuucaauaacggcaagaucagcaaaaccaaguacaauaagcugaaaaugaagggggaugaaauuccguccgacuuuaucgcgcgcgaccuccgggauacgcaauauauuagcaaaaaggcuaaaucuauccuggaggaccuggugaaggauguuguguccaccggaggcagcaucacagacagacuucgcgaggauuggcagcucauugacaucaugaaggaacugaacugggauaaauacgacaagcuggggcucaccgaggucauugaaaacaaugauggacauaaaaucaaccggauuaaggacuggacaaaaagaaaugaucaccggcaccaugccauggacgcccugaccaucgcuuucacgaagcgcuccuauauucaguaccuuaacaaucugaacgccagaucugauaaaagcggcuccaucuacgggaucgagcagaaggaacucuaucgggacaagaauaacaaacugagauuuaagccucccauuccucuggacgauuuccgcgcugaggccaaaaagcaacuugagaauacacuggugucuaucaaagcgaagaacaaggucgccaccauuaauaucaacaauaccaaaaagcagggcggagaaaacaaaaagaaacagcucacaccccggggccagcugcaccucgagaccauuuacgggagcauccaacaguaugugacaaaggaagagaagguuggagcuaauuuuaacaaagagcugaucgaaaagguggccaauaaaaaguguagagaggcccuucugaaacgccucauugaguucgacaacgaucccaagaaggcuuuuacgcggaaaaacucccugaauaagaacccucuguacaucgacaccauuaaaacauauaaggucccggaaaaagugaagaccguuacaaccgaaacgaucuacacaauuagaaaagauaucaaucccgaccuuaagaucgauaagguggucgacaaaaagauuaaaaacauccuggagcuccgccugaaggaguucaauggcgaugcgaaaaaggccuuuucuaaccucgacgaaaagccuauuuggcugaauaaagagaaggggaucagcauuaaaagagugaccaucaccggaauuuccaacgcuaucgcccuucaugauaagaaagacaaggaaggcaauuucauccuggacaaccaggggaagaaacaagcuguggauuucguuaauacaggcaacaaucaccaugucgccauuuauaaggacgagaaaggaaaccuccaggaaaaugugaucaccuuuuacgaggccguggagcgggucaaccagggcauucccaucauugauaagacauacaaacagaacgaaggguggcaauuccuguuuagcaugaagcagaaugaguauuucguguuuccuaacgaaaagacgggauucaauucuaacgagaucgaccugcuuaaucccgaaaacuaccaccugaucuccccgaaucucuuucgcguucagaaaauugcuaccaaggauuauuucuuuagacaccaucuggagacaaacguggagaauaucaccacaaccaaagaccucacguggaagcggcugggcauuaacgggaucauuaauauccuuaaaguccgcaucaaccacauuggacagaucgugagcguuggcgaauacuga

SEQ ID NO: 4324 - RNA, 4122 nt, Artificial Sequence
  Cas9 variant
augaccaagaaaaacuacagcaucggccuggacauugggacaaauuccgugggaugggccgucaucacggaugacuauaagguucccgcuaaaaagaugaaagugcucggcaacaccgauaagaaguacauuaaaaagaaucugcuuggggcccuccuguucgacucuggagagacagcggaagcuaccagacugaaacggacagcccgcagacgguauacccgcagaaagaaccggcuucgcuaccugcaggagaucuuugccgaagagaugacaaaaguggaugaaucuuucuuucaaagacucgacgaguccuuccugcggugggaugacgauaauaagaagcugggccgcuauccuauuuuugggaacaaagcugacgucgugaaguaccaccaggaguucccgaccaucuaucaucucagaaaacaccuggccgauucuagcgaaaaggcugaccuucggcugguuuaccucgcccuggcgcauaugaucaaauuucgcggacacuuccuuauugagggcgaacugaaugccgagaacacggaugugcagaagaucuuugcugacuucgucggcguguacgacagaaccuuugaugacucccaucucucugagauuacaguugaugccgcuagcauccugaccgaaaagauuuccaagagccggcgccuggagaaucucaucaaguauuaccccacagaaaagaagaacacccuguucgggaaucuuauugcccuggcgcucggacugcagccuaacuuuaaaaugaauuucaaacuuucugaggacgccaaacugcaauucuccaaggauagcuaugaagaggaccucggcgagcugcuggggaagaucggagaugacuacgcugaucucuuuacgucugccaaaaaccuguaugacgcuauccuucuguccggcauucucaucguggaugacaauagcacaaaggcuccccugucugccuccaugauuaaaagauacgucgaacaccaggaggaccuugaaaagcugaaagaguucaucaaggccaacaagagcgaacucuaucacgauauuuuuaaagacaagaacaaaaauggguacgcgggauacaucgagaacggcgugaagcaggaugaguucuauaaauaccugaagaauacccuguccaagaucgccggcucugacuauuuucucgauaaaauugaacgggaggacuuccugagaaagcagcgcacauuugauaacgggagcaucccucaucaaauucaccuucaggaaaugcaugcuauccugcggagacagggagacuacuaucccuuccucaaagagaaucaggaucgcauugaaaagauccugaccuuucggaucccuuacuaugugggcccgcuggccagaaaagacucccgcuucagcugggccgaguaccacucugaugagaagauuacccccuggaacuuugacaaagucaucgauaaggaaaaguccgcugagaaauucauuacacggaugacgcuuaaugaccucuaccugccugaagagaagguucugcccaaacacagccauguguaugagaccuacgccguguauaacgaacucacaaagaucaaauacgucaaugagcaagggaaggacagcuuuuucgauagcaacaugaagcaggaaauuuucgaccacguguuuaaagagaauagaaagguuaccaaagaaaagcugcuuaacuaucugaauaaagaguucccugaguaccgcaucaaggaucucauuggacuggacaaggaaaacaaauccuuuaaugcgucucugggcacauaucaugaucuuaagaaaauccucgacaaggcuuuccuggaugacaaagugaacgaggaagucaucgaggauauuaucaagacccugacgcucuuugaagacaaggauaugauucacgagcggcugcagaaauacagcgacaucuucacagccgaucaacuuaagaaacuggagagacgccauuacaccggguggggacggcucuccuauaagcugauuaacggcaucagaaauaaagaaaacaauaagaccauccuggacuaccuuauugacgauggcagcgccaaccggaauuuuaugcagcucaucaacgacgauacacugcccuucaaacagauuauccagaagucucaagugguuggggacguggaugacauugaggcugucgugcacgaucugccgggauccccugccaucaagaaaggcauccuccagagcgucaagauuguggacgaacugguuaaagugaugggggauaaucccgacaacaucgucauugagauggcucgcgaaaaucagaccacaaacagaggacggucucagucccaacagagacuuaagaaacugcagaauagccucaaggagcugggcuccaacauccugaaugaggaaaagccuucuuauauugaggauaaaguggaaaacagccaccuucagaaugaccaacucuuucuguacuauauccagaacgggaaggacauguacacgggcgaugagcuggacaucgaucaucucuccgacuaugauauugaccacaucauuccccaggccuucaucaaagaugacucuauugauaaccgcguucugaccagcuccgcgaagaaucggggaaaaagcgacgaugugcccucucuugacaucgucagagcccgcaaggcugagugggugagacuguacaaguccggccucauuagcaaacggaaguuugauaaccugacaaaagccgaacgcgggggacugaccgaggcugacaaggccggcuucaucaaaagacagcuuguggaaacacggcaaaucaccaagcauguugcgcagauucuggacgcccgcuuuaauacggagucugaugaaaacgacaaggucaucagagaugugaaagugauuacccucaaguccaaucuggucagccaguuccggaaagacuucgaguuuuacaaggugcgcgagaucaacgauuaucaccacgcucaugacgccuaccucaaugcuguuguggggacagcccugcuuaaaaaguauccuaagcuggccucugaguucgucuacggagaauauaaaaaguacgauauuagaaaauuuaucaccaacagcuccgacaaggcuacagcgaaauauuucuuuuacagcaaucucaugaacuucuuuaagcgggugauccgcuacucuaauggcaaaguuauugugagaccggucguggaauauuccaaggauaccgaggacaucgccugggauaagaaaagcaacuuccggacgauuugcaagguucuguccuacccccaagugaauaucgucaaaaagguggaaacacagaccgggggcuuuucuaaagagagcauucugccuaagggagacuccgauaaacuuauccccagaaaaacaaagaaggcuuauugggacaccaagaaauacggcggguucgacucuccuaccguggccuauagcgucuuuguuguggccgauguggagaagggaaaggcuaaaaagcugaaaacagucaaggaacucgugggcaucuccauuauggagcgcucuuucuucgaagagaaccccguugaauuucuggagaauaaaggguaccacaacauccgggaggacaagcucauuaagcugccgaaauauagccuuuucgaauuugagggaggcaagagacgccugcucgccuccgcgagcgaacugcagaaagggaacgagauggugaucccuggccaucuggucaaacuucuguaccacgcucagcggauuaauucuuucaacuccacgaaauaccucgauuaugugagcgcccauaagaaagaguuugaaaagguucugucuuguguggaggacuucgccaaucucuacgucgauguggaaaagaaccuguccaaaaucagagcuguugccgacagcauggauaauuuuucuauugaggaaaucuccaacagcuucaucaaucuucugacccugacagcgcucggagcucccgccgacuuuaacuuccugggcgagaagauuccucgcaaacgguauaccuccacaaaggagugccuuaaugccacccugauccaccaaagcauuacggggcucuacgaaacaagaaucgaucugucuaaaauuggagaggaauga

SEQ ID NO: 4325 - RNA, 4122 nt, Artificial Sequence
  Cas9 variant
auggagaacaagaauuacagcaucggccuggacauugggaccaacuccgugggaugggccgucaucacagaugacuauaaaguucccucuaagaaaaugaaggugcucggcaauacggauaaaagauucauuaagaagaaccugaucggggcccuucuguuugacgaaggaaccacagccgaggcgcggcgccucaaaagaaccgcucggcgcagauacacacggcgcaagaauagacugcgguaucuucaggaaauuuucgccgaggaaaugagcaaaguggauuccucuuucuuccaccgccuggacgauagcuuucucaucccugaggacaagaaaggcuccaaguacccgaucuucgccacccugauugaggaaaaggaguaucauaaacaauuucccacaaucuaccaccugagaaagcagcucgcugauucuaaagaaaagaccgaccugcggcuuauuuaucuggcccucgcucauaugaucaaauaccgcgggcacuuccuguacgaggauacguuugacauuaagaacaaugauauccagaaaauuuucaacgaguuuaucagcaucuauaauaacaccuucgaaggaaauucccuuagcggccagaacguccaaguggaggccauuuuuacagacaagaucucuaaguccgcgaaaagagaacggguucugaaacucuucccugacgagaaaagcaccggccuguucucugaauuucugaagcucauuguggggaaucaggccgauuucaaaaagcauuuugaccuggaggagaaggcuccccuucaguucucccgcgauacauacgacgaagaucuggagaaccuccugggacagaucggcgacgauuuugccgaccuuuucgucgcugccaaaaagcuguaugaugcgauucuccugagcgggauccugaccgugacggacccuucuacaaaagcuccccucuccgcuagcaugaucgaaagauacgagaaucaccaaaaggaucuggccacccuuaaacaguuuauuaagacaaaccugccugaaaaguaugacgagguuuucuccgaccagucuaaagauggauacgcuggcuauaucgacgggaagaccacccaggagagcuuuuacaaauacauuaagaaccuccuguccaaauucgaaggagccgauuauuuucuugagaagaucgaacgggaggacuuccugagaaagcaacgcacauuugauaauggcagcauuccgcaccagauccaucuccaggaaaugaacgccauccugcggagacaaggcgagcacuaccccuuccugaaagagaauaaggagaaaauugaaaagauccucacguuccgcauuccuuauuacguggggccccuggcucggggaaacagagacuuugcguggcuuacccgcaauucugaucaggccauccggccuuggaacuucgaagagauugucgacaaggcuuccagcgccgagucuuuuaucaauaagaugacaaacuaugaucuguaccuccccgaagagaaagugcugccgaagcauagccugcuuuaugaaaccuucgccguguacaaugagcucacaaaggucaaauuuauugcugaaggccugagagacuaccaguuccuggauucccgccagaagaaagacaucuuuuauacccucuucaaggccgaggauaaacggaagguuacggagaaggacaucauucaauaccugcacacaguggacggguaugauggaaucgaacuuaaaggcauugagaagcaguuuaacgcgucucugagcaccuaccacgaccuccugaaaaucauuaaggauaaagaauuuauggacgauccuaauaacgaggaaauccuggagaauaucgugcauacccuuacaauuuuugaggacagagaaaugaucaagcagcgccucgcucaguaugauucccuguucgacgagaaggucauuaaagcccugacccggagacacuacacaggguggggaaagcucagcucuaaacugaucaacggcauucgggauaagcaaacgggcaaaaccauccuugacuaucugauggaugacggguacaauaaccgcaacuuuaugcagcucaucaaugaugacgaacuguccuucaaggagauuaucaagaaagcccaggugguuggaaagacagacgaugugaaacaggucgugcaagaacugcccggcagcccugcuauuaagaaagggauccuucagucuauuaagcucguugacgagcuggugaaagucaugggacaugagcccgaauccaucgugaucgagauggccagagaaaaccagaccacagcucggggcaagaagaauagccagcaaagauacaaacgcauugaggauucccugaagauccucgccucugggcugaacgcgaaaauucuuaaggagcaccccaccgacaauauccagcugcagaacgauagacucuuccuguauuaccugcaaaauggccgggacauguauacgggaaaaccucuugauauuaaccagcucagcuccuacgacaucgaucauauugucccgcaggccuuuaucaaggacgauucucuggacaaucgcgugcugaccagccucaaggacaacagaggcaaauccgauaauguucccagccuggaaguggucgagaagaugaaaacauucuggcagcaacuucuggacucuaagcucaucuccuaucggaaauuuaacaaucugaccaaggcugaacgcgggggacuggaugagagagacaaggugggcuucauuaaacggcagcuuguugaaacacgccagaucaccaagcacguggcccagauucuggaugcuagauacaacacggaggucaaugagaaagacaagaaaaaccggacagugaagaucauuacccucaagagcaaccuggugucuaauuuucgcaaagaguucagacucuauaagauccgggaaaucaacgauuaccaccaugcccacgacgcguaccugaaugccguugucgcuaaagccauucuuaagaaauauccuaagcuggaacccgaguuuguguacggggauuaucaaaaguacgaccucaaacgcuauaucuccagaagcaaggauccuaaagaaauugagaaggcuacagagaaauacuucuuuuauucuaaccugcugaauuucuuuaaggaagaggugcauuacgccgacggaaccaucgucaaacgggaaaacauugaguacagcaaggauaccggcgaaaucgccuggaauaaggagaaagacuucgcuacaaucaagaaagugcuuucccugccccagguuaacauugugaagaaaagagagguccagaccgggggcuucagcaaggaaucuauccucccgaagggaaauuccgacaaacugauuccucgcaagacgaaagauauccucugggacacaaccaaguauggcggguuugauagccccgugauugcguacuccauccugcuuauugccgacaucgagaaaggaaaggcuaagcggcugaaaacaguuaagacccucgugggcaucacgauuauggaaaaagccacauucgagaagucuccuaucgccuuucuggagaacaaaggguaucacaaugucagaaaggaaaacauucugugccuucccaaguacagccuguucgagcucaaaaauggacgccggagaaugcuggcuuccgccaaggaacuccagaaaggcaacgagaucgugcugccuguucaccuuaccacccugcuguaucaugcgaagaauauucaccgccucgaugaacccgagcaucuggaguacauccaaaaacaccggaacgaauuuaaggggcuucugaaccucgugucugaguucagccagaaauauguccuggcugacgccaaucucgaaaagaucaagaaccuguacgccgauaaugagcaggcugacauugaaauccuugccaacuccuuuauuaaucugcugacauucaccgcgcucggcgcuccggccgccuuuaaauucuuuggaaaggauguggacagaaaacgcuacacaacggugucugagauccugaacgcuacccuuauucaucaaagcaucacaggccuguaugagacccggaucgaucucuccaagcugggggaagacuga

SEQ ID NO: 4326 - RNA, 4125 nt, Artificial Sequence
  Cas9 variant
auggagaccaaguucacauacuaucugggccucgacauggggacggauagccugggaugggccgugaccgacuccucuuaccacauccuuagagcuaaaggcaaggaucuguggggaguccggcucuuucccagcgccgaaacauccguugagcgcagaaccuaucgggugaaccgcagacggcgccagagagaaguggcgcggauuggggcucugaaagagcuuuucgccgacgaaaucgagaaggucgauccuggcuuuuucgugcgccuggacgagucuaaauuucauauggaagauagaagcgagaauaacaagcaaaaguacgggcucuuugccgacaaacuguuuuccgaugcuggauauuacaagaaauauccgacaauuuuccaucugcggaaggaacuccuggagucugaggaaccccacgacguucgccuuguguaccuggcccuccugaauauguuuaaacacagaggccauuuccuuaacagcucccugcagaucgagggcgaaaauagcaacauugcugagucuuaccagauguuugucgauacccucacagacgaagaucuggacuucccugaacagguguccggggagcggcugcaagagaucuuucgcagcucugacuccagaaagaagaaaguugagaaucuccuggccgaaaugaaccuuagcaagaaacagaagcgggagauccaguucgugaaucugauuugcggacucaaaggcaagcugucugaacuuuuccccgauaaagaguaugacgaggaacagaagaagaucgcguuuuccuuccaagauagcgacuacgaggauaaagaaaacaccauucaggagcugcucgacgaauccgagaugaauaugaucuaugccgucaaggcugugcacgauucuggggugcugagcggaauuaugaacggcgagagauaccuguccgucgcccgcguugcuagcuaugaaaaacacaagaaagaccuccagauccugaaggauauucuuaagaaauacgacacgaaggaguauuuugaaauguuccggaaugagucugccaaauccgagagcuacucugcguacguggggagcgugaaguaucauggaaccuuuagacgcggccuguccggcgggaaacaggaagaucucuacaagcacaucaagaaaguccugggaaaguucccucaagacgacgagggcgugacauauauccuugaagagauugaaaccgagucuuuucugcccaaacagcucacagccagcaacgggguuaucccuaaucaggugcaugcucgggagaugcuggccauucugaagcacgcugaacucuaccugccguuccuucaagagaaagaugacaccggacuguccgucagcgaaaagauccucaagcuguuuauguuccagauucccuauuacgugggcccucuggggcaggaguauaaagauaagaaaggauacaacguuugggccgaaagaaaggccucuggcaaaaucuaccccuggaacuuugaggacaagaucgaugugaaaaaguccgcugagaaguucauuggccgcaugguccggagauguacguaucuuagcggggaacaggcgcucccuaaacaaucucugcuguacgagaaguuucaggugcucaaugaacugaacaaucuucgcauccggggagagaaaauucccgucucccugaagcaggaaaucuaucacgaccucuucggcgaugggaaaaaggugagcaugacaagacugaccaacuaccugcuucagaauggaguuauuuccggcgaggagaaggacucuugcaucagcgggaucgauggcggauuccauaacucccucucuagcgugggcaaauuuaagggggucuucggagacacagugcacaccgaugaacaucgcaaaaugauugaggacaucauuuucuggggcaccguuuucggggauggaaagaaacugcugaaggaaaagguggaggaggucuauggcaaucaacucacagaagcccagaaaaagcggaucuuuggguucaaauuuuccagcuggggcagacugucuaaggcuuuccuuacgauggagggagccuccaaagacgacggcgaaauuaaggggcugauccaggccaugugggauaccaacuguaaucucauggagcugcugagcgaccgguuuacauacaaggauaaacuuaacgaaauggugaccacagcugagaagccgcucugcgaguggaaaauugaagaccuggaugagauguaucugucugccccugugaagcgcaugguuuggcagaccaucagagucguggacgaagugcaacagaucauuggaugucccccuaaacggaucuucgucgagaugacgagauccgauggcgaaaaggggaaacgcacagugagccggcagaagaagcucguugaccuguacaaagcgcuuggaaaggagggcaaaaccuggucugaggaacugagcgauacccccgagucccaguuuagaauuaagaaacucuaccuguauuaccugcaaauggggaagugcauguauacaggcgaagcuaucgagcuugaacagcucaugaaugacaaccuguacgauauugaccacaucuauccccgccauuucaucaaggaugacaauauuagcaacaaucuggugcucgucaaaaaggagaaaaacgcccacaagucugacuccuuuccuaucgagccggaaauuagaaacaaaaugaugcccuucuggaagucccugcggaagaaaggauuccuuaccgaggaaaaguacaaucgccugacaagaauguccgccuuuacggaugaggagaaagcugccuucaucggccggcagcucguggaaaccucucaagggacaaaggcuauuacccagaucuuugagcaggccuucgcgaacagcgaaaucguuuuuagcaaagccucuguggucagcgcuuuccgccagaaguuugacuguuauaaggugagaugcguuaauaacuaccaccaugcccacgaugcuuaccugaauauuguggccggaaacacauaucgggucaaauucaccuccaauccucugaacuuuaucaaggaggcgaaaaagaaucccaacucucgcgaaaauagauacaacauggacaaaauuuucgagugggaugugacgcggaauggcgagaccgccuggguggcucaaacaaaggaacauccugggaccauccagcuugucaagaaauaucugaacaagaauagcccccucauuacaaaaaugguuuacgagaagcacggaggcaucacccagaaagccacgaucugguccgcuaagaaagccgaaagcgggaacacagacgccuauauuccggugaagaugaacgauccucgccuggcugacgugaccaaguacggcggagucacaaccaucgcgguggccggcuauacccuccuggaguacaaagcugggggaaagacaguuagaucucuugaagcccugcccauuuaccucggcggguccaaaaagcugacggaggagcagaugguggaauauuuuagcaauguccugcaacaggagaacaaagaaaaggugguuucugaugugaucauucggaagaaaaugaucccuuccggaagccuuauuaaguacaauggcuucuauuacuaucuggccggcaaaaccggggacagaaucauccucauuucugcuguccagcugugucuccccauggauacaaugcuguacaucaagaaaauugagaaggccugcuccaccggaaacuucgaagagaaggacaaaaauggcaaacaggugcuuagcaagcaacagaacgaguuuguuuaugaacugaucauucagaaguaccaacaguccaucuucaaaaagaaggugggggcgaucggagacacaauuaucgagaaacgcgaaaaguuugcugagauuagccucgaggaacaguguaaaguccugaugcagaucuuccugaauuuucaaucuggcauugggguggagcuuaagaucaucgaaggaggcaaaaagagcggcgugaccuaccugaacaaaaaggucaugaauguucaggagcucaagcugauugaucaguccgugacggggguguucucucgggaaaucgaccuccugacaauuuga

SEQ ID NO: 4327 - RNA, 4125 nt, Artificial Sequence
  Cas9 variant
augaagaaaagauacagcuauuccaucggccuggacauugggaccaacucugugggaugggccgucaucaaugaggauuacaagguucccgcuaaaaagaugacaguguucggcaacacggaccggaaaaccauuaagaagaaucuccuggggacagugcuuuuugauagcggagaaaccgcccaggcgcgcagacugaaacggacaaaccgcagacgguauacccgcagacgguaccgccucugccaacugcagaauaucuucgcuacagagauggucaagguggacgauaccuuuuuccagagacuuuccgaaucuuucuuuuauuaccaggacaaagccuuugauaagcacccuauuuucggcaacagcaaagaggaacgggccuaucauaagacguacccgaccaucuaccaucugcgcaaggaccucgcugauagagaccaaaaagccgaucugcggcugaucuaucucgcucugucccacauuaucaaguuucgcgggcacuuccuuauugagggaaaacuuaauucugagaacacagacguucagaagcucuuuaucgcccuggugaccgucuacaaucuucuguucgaagaggaacccauugcgggcgagacaugugaugccaaagcucuccugaccgccaagacgagcaaauccaagagacuggagagccucaucucugaauuuccuggccagaagaaaaacgggcuguucggaaaucuucuggcucucgcccugggccuucggcccaacuucaaguccaauuuugggcugagcgaggacgcgaaacuccagauuacaaaggacaccuaugaagaggaacuggauaaccugcucgccgagaucggagaccauuacgcugaucuguuccuugccgcuaaaaaucugucugacgccauccuccuguccgauauucuuacacugagcgacgagaacaccagagccccucucucugcuuccaugaucaagcgcuaugaagaacaccaagaagaucuggcgcugcucaagaaacuggugaaggagcagaugcccgaaaaauacugggagauuuuuagcaacgccaagaaaaauggcuaugcuggguacaucgagggaaagguuucccaggaagacuucuaccgguauauuaagccuauccuuucuagacugaaaggcggcgaugaguuucucgccaagaucgaccgcgaugacuuccugcggaaacagagaaccuuugacaacgggagcauuccgcaccaaauccaucugaaggaacuucacgccauucuccgccggcaggagaaauacuaucccuuccuggcugaacagaaggagaagaucgagcaacugcucugcuuucgcauuccuuacuaugugggaccccuggccaaaggcggaaauuccagcuucgcguggcuuaagagacggucugaugaaccuaucacacccuggaacuuuaaagacgucguggaugaggaggcuuccgcccaggccuucaucgagggaaugacgaauuacgacaccuaucugccggaggaaaaggugcucccuaaacauagcccccuguacgagauguuuacagucuacaacgaacugaccaagguuaaauauauugcugagaauaugacaaagccucuuuaccucucugccgaacagaaggaggcuaucauugaucaccuguucaaacagaccagaaaggugacggugaaagaccugaaggagaaauauuucagccaaaucgaaggccucgagaacgucgaugugacagggguugaaggagccuuuaaugcgucccugggcaccuacaacgaccuucugaagauuaucaaggauaaagccuuccucgacgaugaggcuaaugccgaaauucuggaggagaucgugcugauccuuacccucuuucaggacgaaaagcugauugagaaacgccuggcuaaguaugccaaccucuucgaaaaaucuguccugaagaagcugcggaaaagacacuaccggggcugggggcgccugagcagacagcucaucgauggaaugaaggacaaagcguccggcaagacaauucuggacuuucugaaagccgaugacuucgcuaaucggaacuuuauccagcuuauuaaugauagcucucucgacuucgagaagcugaucgaugacgcccaaaagaaagcuaucaagagagaaucccugaccgaggccguggccaaccucgcugggagccccgcgauuaaaaagggaauccugcagucucuuaaaguuguggaugagauugucaaggugaugggccauaaccccgacaauaucgucauugaaaugucccgcgagaaccagacaacggcccaggggcugaaaaaugcucggcaaagacucaagaagaucaaagaagugcacaagaaaaccggcagccgcauccuggaggauaacuccgagagaauuacaaaucugacccuucaggacaaccggcuguaucucuaccugcuccaggauggaaaggacauguacacaggccaggaucuggacaucaauaaccuuucucaauaugacauugaucauaucauuccucagagcuuuaucaaagacaauuccaucgauaaccugguucucaccacgcagaaggccaaucgcgggaagucugacaacgugccgagcauugaagucgugagagauaugaaagaccggguuuggcgcagacaacuggccaauggagcuaucucccggcagaaguucgaucaccugaccaaagccgagcgcggcgggcuugcggacagcgauaaggcuagauuucugcggcgccagcucguggaaacaagacagauuaccaaacaugucgcccaacugcucgacucucgguucaacuccaagagcaaucagaacaagaaacuggccagaaacgugaagaucauuacacuuaaaucuaagaucguguccgauuuucgcaaagacuucggacuguacaagcuccgggagguuaauaacuaucaccacgcucaugacgccuaccugaaugcggucgugggcaccgcucugcuuaagaaauaucccaagcuggaagccgaguucguguacggggauuauaaacacuuugaccucgucaagcugauuagcaaaucugauccuagccucggcaaggccacggcuaagguguucuuuuacuccaacaucaugaauuucuuuaaagaggaacugagccuugccgacggaacacugaugaagagacccguuaucgagaccaacacagaaaccggcgagguggucugggauaaagugaaggacuucaaaaccauucgcaagguucugucuuacccucaggugaauaucgucaaaaagacagaaauucaguccggggcuuuuagcaaggaguccgugcucucuaaaggaaacagcgauaagcugaucgagcggaaaaagggcugggaccccaaaaaguaugggggauucgauuccccgaauacggccuacucuauuuuuguuguggcgaaggucgccaaaagaaaggcucaaaaacuuaagaccgugaaagaaaucgugggcaucacaauuauggagcaggccgaauaugagaaggacaacaucgcuuuccuggaaaagaaaggguaccaggauauucaggagaagcuccugaucaaacucccuaaguauagccuguuugagcuugaaaauggccgccggagacugcuggccuccgccaacgaguuccaaaaaggaaaugaacucgcucugucuggcaaguacaugaaguuccuuuaucuggcgagccgcuacgacaaacucuccagcaagauugagucugagcagcagaaaaagcuguuugucgaacaacaucuccacuacuucgaugagauccuggacaucguugugaaacacgccaccuguuauauuaaggcugaaaacaaucuuaaaaagaucauuucccuguacaagaaaaaggaggccuauagcaucaacgaacaggcccugaacaugcucaaucuguuuauuuucacaucucuuggggcucccuccaccuuuguguucuuugacgagacgaucgaucggaaaagauacacaaccagcucugacguccugaacgggauucucauccagcaguccaucaccggccuguaugagacacggauugaucucagccgcuucgggggagacuga

SEQ ID NO: 4328 - RNA, 4125 nt, Artificial Sequence
  Cas9 variant
augaagaaacagaaguucagcgacuacuaucugggcuuugauaucgggaccaacuccgugggauggugcgucacagaccucgauuacaauguucugagauucaacaaaaaggacauguggggcucucggcuuuuugaugaggccaaaacggcugccgaacgcagagugcaacggaauagccgcagacggcugaagcgcagaaaguggcggcucaaccugcuugaggaaauuuucuccgacgagaucaugaaaauugauucuaacuuuuuccgcagacugaaggaaagcucccucuggcuggaggacaaaaauucuaaggagaaauuuacccuguucaaugaugacaacuauaaggauuacgacuuuuauaagcaguaccccacaaucuuccaccuccgggaugaacugauuaaaaauccugagaagaaagacauccgccuuaucuaucuggcgcuccauagcauuuuuaaguccagagggcacuuccuguuugaaggacagaaccuuaaagagaucaagaauuucgagacccuguacaacaaucucauuagcuuccuggaagacaacggcaucaauaaaucuauugauaaggacaacaucgagaagcuggaaaagauuaucugugauuccgggaagggacucaaagacaaggagaaagaauuuaagggcaucuucaacagcgauaagcagcugguggcuauuuuuaaacuuucugucggcuccagcgugucucugaaugaccucuucgauacagacgaguacaagaaagaggaaguugagaaggaaaagaucuccuuucgggagcaaauuuaugaagaugacaagccgaucuacuauagcauucugggggagaagaucgagcuucuggauaucgccaaauccuucuacgacuuuauggugcucaacaauauucugucugacagcaacuauaucuccgaagccaaggucaaacuguacgaggaacauaagaaagaucucaagaaucugaaguauauuauccgcaaauacaacaaggagaauuacgacaaacuuuucaaggauaaaaacgaaaauaacuaucccgcuuacauuggacugaauaaggagaaagacaagaaggaggugguugaaaagagcagacucaagaucgaugaccugaucaaagugauuaagggcuaucuuccuaaacccgagcggaucgaagagaaggauaagaccauuuuuaacgagauccugaauaaaauugaacucaagacaauccugccuaaacagagaauuucugacaacgggacccugcccuaccagauccacgaggucgaacucgagaagauccuggaaaaucaguccaaauauuacgauuuccuuaacuaugaggagaacggagugagcacgaaggacaagcugcucaaaaccuuuaaguuccgcauuccuuacuacgugggcccgcuuaauucuuaucauaaagauaaagggggaaacagcuggaucguccggaaagaagagggcaagauucugcccuggaauuuugaacaaaagguugacaucgagaaauccgccgaagaguucauuaagagaaugacaaacaaaugcaccuaccugaauggcgaggaugugaucccuaaggacucuuuccucuauagcgaauacaucauucugaacgagcugaauaaagugcaggucaacgacgaauuucucaaugaggaaaacaagcgcaaaaucauugaugagcuguucaaggagaauaagaaaguguccgaaaagaaauuuaaggaguaucuucugguuaaccagaucgcuaaucggacaguggaacucaaagggauuaaggacagcuucaacucuaauuacgucuccuauaucaaguuuaaagauaucuucggagagaagcugaaccuggacauuuacaaagagaucagcgaaaagucuauucuuuggaaaugucucuacggcgaugacaagaagaucuuugagaaaaagauuaaaaacgaauauggggauauccugaauaaggacgagaucaaaaagauuaacuccuucaaguuuaauaccuggggaagacugagcgaaaaacuccugacgggcaucgaguucauuaaccuugagacaggggaaugcuacuccucugugauggaggcccugcgccggaccaauuauaaccucauggaacugcugagcuccaaguuuacacuucaggagucuaucgauaaugaaaacaaagagaugaaugagguuagcuacagagaccucauugaagaguccuaugugagccccucucugaagcgcgcgauccugcaaacccucaaaauuuacgaagagaucaagaagaucaccggacgggucccuaaaaagguguucauugaaauggccagaggcggcgaugaguccaugaaaaacaagaaaauccccgcucgccaggagcagcugaagaaacuuuaugacagcugugggaaugauauugccaacuuuucuaucgacauuaaggaaaugaaaaauucccugagcucuuacgacaacaauagccuccggcagaaaaagcuguaccuguauuaccuucaauucggaaaaugcauguauacaggcagagagaucgaucucgaccggcugcugcagaacaacgauacguacgacaucgaucacauuuauccgcgcuccaaggucaucaaagacgauagcuucgacaaucucgugcugguucuuaagaacgaaaaugcugagaagucuaacgaguacccugugaaaaaggaaauucaggagaaaaugaaguccuuuuggagauuccugaaagaaaagaauuuuaucagcgaugagaaguauaaacggcucaccgggaaggacgauuucgaacugagaggauuuauggcccgccaacuggucaacgugcggcagacaaccaaagagguuggcaagauucuucagcagaucgagcccgaaaucaaaauuguguacuccaaggcggagaucgccucuagcuucagagaaauguuugacuucauuaagguccgcgagcugaaugacacacaccaugcuaaagaugccuaccucaacaucguggcugggaauguguauaacaccaaguuuacggaaaaaccuuacagauaucugcaagagauuaaggagaauuacgacguuaaaaagaucuauaacuacgauauuaaaaaugccugggacaaggaaaacucccucgagaucgucaagaaaaauauggaaaagaacacagugaauaucacccgguucauuaaagaggaaaagggcgagcuguuuaaccuuaaccccaucaaaaagggagagaccucuaaugaaauuaucagcauuaagcccaaacuguaugauggcaaggacaacaaacucaaugagaaguacggguacuauacaucccugaaagccgcuuacuucaucuauguggaacacgagaagaagaacaaaaaggucaaaaccuucgagcgcaucacaagaauugauucuacgcugaucaagaaugagaaaaaccuuauuaaguaccuggugagccagaagaaacuccugaauccuaagaucauuaaaaagaucuauaaagaacagacccucaucauugacuccuacccguauacauuuaccggaguugauagcaacaagaaaguggaacugaagaauaagaaacagcuuuaccuggagaagaaauacgaacaaauccucaagaacgcgcugaaauucgucgaggacaaucagggcgagacagaagagaacuauaaguuuauuuaccugaagaaacggaauaacaaugaaaagaacgagaccaucgaugccgugaaagaacgcuauaacauugaguucaaugagauguacgacaaguuucuugaaaaacugucuuccaaggauuauaagaacuacaucaauaacaaacucuauacgaauuuccugaacagcaaggagaaauuuaagaaacucaagcugugggaaaagucucuuauucugagagaguuccugaaaaucuuuaauaagaacaccuacgggaaauacgaaaucaaggacucccagacaaaagagaaacucuucagcuuucccgaggacaccggacggauucgccugggccagucuucccuugggaauaacaaggaacugcucgaggaaagcguuacaggccuguucgugaaaaagaucaaacucuga

SEQ ID NO: 4329 - RNA, 4128 nt, Artificial Sequence
  Cas9 variant
augagcaacaagcccuacuccaucggccuggacauugggaccaauucugugggaugggccgucaucacagaugacuauaaaguuccuagcaagaaaaugaaggugcucggcaacacggauaaacacuucauuaagaagaaucugaucggggcccuucuguuugacgagggaaccacagcugaagauagacggcucaaacgcaccgcgagacggcgcuacacaagacggaagaaccgccugagauaucuucaggagauuuucuuugaagagauguccaaacuggacucuggcuucuuucaucggcucgaugacuucuuucugaucccggaagauaagcgcgggagcaaauaccccaucuucgcuacccuggccgaggagaaggaauaucacaagcaauuuccuacaauuuaccaucucagaaaacagcuggccgacuccaaggagaaagcugaucuucggcugaucuaucucacccuggcccacaugauuaaguaccgcggacauuuccuuuacgaagagucuuuugacaucaaaaauaacgauauucagaagaucuucaaugaguuuauuagcaucuaugacaacacguucgaaggcuccagccugucuggccagaaugcucaaaucgaggccauuuucaccgacaaaaucuccaagagcgcgaagagagaacgggugcucaaacuguuucccgaugagaagucuacagggcuguucuccgaauuucucaaacugauugucggaaaccaggccgacuucaagaaacacuuugagcuugaggaaaaggcuccucugcaguuccccaaggauaccuacgacgaggaucucgaaaaugugcugggccagaucggggacgauuuugccgaccuuuucguugcugccaaaaagcuguaugaugcgauucuccugagcggaauccugacagugaccgacccuucuacgaaagccccgcucuccgcuagcaugaucgagcgcuacgaaaaccaccaaaaggaucuggccgcucuuaaacaguuuauuaagacaaaucugcccgagaaguaugucgagguguucuccgaccagucuaaagacggcuacgccggguauaucgauggaaagaccacacaggaagccuuuuacaaauacauuaagaaccuccugagcaaauucgagggcaccgacuauuuucuugauaagaucgaaagagaggacuuccugcggaagcaaagaaccuucgauaauggcuccauuccucaucagauccaccuccaggaaaugaacgcuauccugcgccggcaaggggagcauuaccccuuucugaaagagaacaaggagaaaauugaaaagauccucacauuccgcauuccuuauuacguuggaccccuggcgagaggcaaucgggacuuugccuggcuuacgagaaacagcgaucaggcuauccgcccguggaauuucgagaaaauuguggacaaggccucuuccgccgaagauuuuaucaacaaaaugaccaauuaugaccuguaccucccugaggaaaagguccugcccaagcacagccugcuuuaugagacauucgcuguguacaacgaacucaccaaagugaaguuuauugccgaggggcugcgggauuaccaguuccuggacucuggacagaaaaagcaaaucgucaaucagcucuuuaaagaaaagagaaagguuaccaaaaaggauaucauucacuaucugcauacaguggacggcuacgacgggaucgagcuuaaaggaauugagaagcaguucaacgcgagccuguccacguaucacgaucuccugaaaaucauuaaggacaagaaauuuauggaugacucuaagaaugaagcuauccuggagaacaucgugcauacacuuaccauuuucgaagaucgcgagaugaucaaacagcggcucgcccaauacgacagccuguuugaugaaaaggucauuaaagcccugaccagacgccacuauacaggcuggggcaagcucuccgcuaagcugaucaaugggauuugcgacaaacagaccggaaacacaauccuugauuaccugaucgacgauggcgagauuaaucggaacuucaugcagcucaucaaugacgaugggcugagcuucaagaaaauuauccagaagucucaagugguuggagagacggacgacgugaaacaggucgugagagaacugccuggcucccccgccauuaagaaagggauccuucagagcaucaagauuguugaugagcucgugaaggucauggaccaugcucccgaaucuaucgugauugagauggcccgggaaaaccagaccacagcgcgcggcaaaaagaacucccaacagagauauaaacggaucgaggauagccugaagaaucuggccuccggacucgacucuaacauucugaaagagaauccuaccgauaacauccagcuuaagaaugacagacuguuucucuacuaccugcaaaacggcaaggauauguauacaggggaagcucuggacauuaaucagcuuagcuccuacgauaucgaccacaucauuccgcaggccuucaucaaagaugacucucucgacaaccgcguccugaccagcuccaaggauaaucggggaaaaagcgacaacgugcccucucuggagguugugcagaagagaaaggcuuuuuggcaacagcuccuggauuccaaacuuauuagcgaacgcaaguucaauaaccugacgaaagccgagagaggcgggcucaaugagcgggacaaggucggauuuaucaaacgccagcugguggaaaccagacagauuacaaagcacguugcgcaaauccuggaugcccgguauaacaccgaggugaaugaaaaagacaagaagaaccgcacagucaaaaucauuacccuuaagucuaaccugguguccaauuucagaaaagaguuucggcucuacaaggugcgcgaaaucaacgauuaucaucacgcucaugacgccuaccugaaugcuguugucgccaaagccauucucaagaaguauccuaaacuggagcccgaguucguguacggcgaauaccagaaguaugaucuuaaaagauacaucagccggucucgcaacccuaaggagguggaaaaagcuacggagaaguacuuuuucuauagcaaucugcucaacuuuuucaaagaagagguccacuaugcggacgggacaauugugaagagagagaauaucgaauacuccaaggauaccggcgagaucgccuggaacacagaaaaagacuucgcuaccauuaagaaaauccugagcuauccccagguuaauauugugaagaaaaccgaggaacagacagucggacaaaacggcgggcuguuugauaauaacaucgugucuaaggagaagguuguggacgccuccaaacuuauuccgaucaagagcggacuguccccuaaaaaguacggcggguacgcccggcccacgauugcuuauucuguccucgugaccuacaaacagaauaacaagaucaagaauacaaugguuggaaucccugugcugaccaaacucgaguucgaaagagaccccaaccuguaucuucgcaaccugggcauuaauaacgucagccacgugaucaagcucgugaaauacacaguccuggaguuuaagcauaaauaugggaccuaccggagauucauuguuuccaaucaggaacugaagcgcgccaaccaaaucuuugugacgacaaagcagaugaaacuuauuucucaguauaccacccuggauaagaaugagcacgacagccuccugaaaaacaaucagcaacucauccaguccaucuggaaccaguuccuggaguuuaugcuugcgacagaucuggugaauaagaaacaguacgacgaacugauucucaccaacaaucaaacaaucgaggaaugucggaacauuaugaauagagucaucacgacccugucuuucacaaacauuaaugcuggccagaagaaaaucaucuuugaugacacccuuagccugccuauuaagcgcuggcaguucacagauuccgacaagauggugaaaaagaucauugagagcacccucauccaucagucuauuacgggacuguacgaaacccggaucgaucucuccaaacugggcgaggacuga

SEQ ID NO: 4330 - RNA, 4128 nt, Artificial Sequence
  Cas9 variant
augaaggaguaccacaucggccuggacauugggaccagcuccaucggaugggccgugacagauucucaguucaaacucaugagaauuaagggcaaaacggcuaucgggguccggcuguuugaagagggaaagaccgccgcggaacgcagaacauuccggaccacacgcagacggcuuaaacgcagaaaguggcggcugcauuaucucgacgagauuuuugcuccccaucugcaagaaguugaugagaacuuccuucgcagacugaagcagagcaauauccacccugaggacccggccaaaaaccaggccuuuaucggcaagcuccuguuccccgaucugcucaaaaagaaugaacggggguacccuacccugauuaaaaugcgcgacgagcuucccguggaacagagagcucacuauccugugacaaacaucuacaagcugcgggaggccaugauuaaugaggaucgccaauuugaccucagagaagucuaucuggcugugcaucacaucguuaaguaccggggacacuuccuuaacaaugccuccguggauaaauuuaaggucggcagaauugacuucgauaaaucuuuuaacgugcugaaugaggcguaugaagaacuccagaacggcgaagggagcuucaccaucgagcccuccaagguugagaaaauuggacagcugcugcucgacacgaagaugcgcaaacuggaucggcagaaggccguggcuaaacuucuggaagucaagguggccgacaaggaggaaaccaaaagaaauaagcaaaucgcuacagccaugucuaaacucgugcugggcuacaaggcggacuuugccaccgucgcuaugguuaacgggaaugaguggaagaucgaucuuagcuccgaaacaagcgaggacgagauugaaaaauuccgcgaggaacugucugaugcccagaacgacauccucaccgagauuacgucccuguucagccagaucaugcugaaugaaauugugccuaacggaaugucuaucuccgagagcaugauggaucgguacuggacacaugagagacagcucgcugaagugaaggaguaucuggccacccaaccggccucugcucgcaaagaauuugaccaggucuacaacaaguauaucggccaggcgcccaaagagaagggguucgaucuugagaagggacugaaaaagauucucuccaaaaaggaaaauuggaaagagaucgacgaacugcuuaaggccggcgauuuucugccuaagcaacggauuagcgcuaacggcgugaucccccaccagaugcaucagcaggagcucgacagaauuaucgaaaaacaagccaaguacuauccuuggcuggccacagagaaucccgcuaccggggagcgcgaucggcaccaggccaaauacgaacuggaccagcucguuuccuucagaaucccguauuacgugggaccucuggucacccccgaggugcagaaggcgacaucuggcgcuaaauuugccugggccaagcgcaaagaagacggggagauuacgccuuggaaccuuugggauaagaucgaccgggcugaaagcgccgaggcuuucauuaagagaaugaccguuaaagauacauaccugcucaaugaggacgugcugcccgccaacucccugcuuuaucaaaaguacaauguccucaacgaacugaauaacgugcgggucaauggacgcagacugagcgugggcaucaaacaggauauuuauaccgagcucuuuaagaaaaagaagacaguuaaagcgucugacguggccucccuggucauggcuaagaccagaggggugaacaaacccagcguugaaggacuuucugauccuaagaaauucaauagcaaccuggccacguaccucgaccugaaguccaucgugggcgauaaggucgacgauaauagauaucagauggaccuggagaacauuaucgaauggcgcucuguguuugaggauggcgagaucuucgcugacaaacuuacagaaguggaguggcucaccgacgaacagcggagcgcccugguuaagaaaagauacaagggguggggacgccuguccaaaaagcuccugaccggcauugucgaugagaacgggcaaagaaucauugaccuuauguggaauacagaucagaacuuuaugcagaucgugaaucagccgguguucaaggagcaaauugaccagcugaaccagaaagcgaucaccaaugauggaaugacacuccgggaacgcgucgagagcgugcuggacgaugccuauacgucuccccaaaacaagaaagcuaucuggcagguugugagagucguggaagacauuguuaaggccgugggcaaugcuccuaaauccaucagcauugaguuugcccggaacgaagggaauaagggcgagaucacccgcucuagacggacacagcugcagaaacuuuucgaggaucaagcccacgaacucgucaaggacaccucccugacagaggaacuggagaaggugcccgaucucagcgaccgcuacuacuucuauuuuacccagggaggcaaagauauguacacgggggacccuauuaacuucgacgaaaucuccaccaaguaugauaucgaccauauucugccccagucuuuuguuaaagaugacagccuugauaauagagugcugacaucccggaaggagaacaauaaaaagucugaccaggucccggcuaagcucuacgcggccaaaaugaagccuuauuggaaccaacugcugaaacagggacuuaucacccagcgcaaguucgagaaucucacaauggauguggaccagaccauuaaauacagaagccugggcuuugugaagcggcaacuggucgaaacgagacagguuaucaagcucacagcuaacauucugggguccauguaucaggaggccggaaccgauaucaucgaaacacgcgccggccuuaccaaacaacugcgggaggaguucgaccuccccaaggugagagaggugaacgauuaccaccaugcugucgacgccuaccugaccacauuugcggggcaguaucugaaucgccgguacccuaaacuucggagcuucuuuguguauggcgaguacaugaaguucaaacacggaucugaccugaagcuccgcaacuuuaauuucuuucaugaacugauggagggcgauaagucccaggggaaaguuguggaccagcaaacgggagaacucauuaccacacgggaugaggucgcugacuauuucgauugggugcaggaccugaaacuuaugcugguuaccaaggagcucaagagaagcaacggcaaacuguucgaugccacaauccagaaugccaacuacaccaagcugaaugaacgcaagaaaguguuugucccccuuaagaaagagcuggacaagacgcucuaugggucuuacuccggcauucagagcucuuacaugacaaucgugaaaaaguucgauaaaaagggaagcaccuaugcuguucaacggauuccugugauguacuccaagcugcucgaacuggagaaagaacagagcaaacuuaacagacugguccagucuaucgugaccuccgacccccaggccccgaauaacuuugaggugcucaugccuugcguccugagcgggcaacugguuauugauaauggccggaaguucacacuuaccuccuaucgcuaccaguguucuacagcgcagcuguuucuccccaagaaagaccugaaguauauccagaacaauuucaaggagcucaaaaagacgcccgauaaacaagacaagaucuuugaaaccauuuacgacgauauccugaaacagguggacaaguauuucagccuuuacgauauuaacaaguuuagauccaaacugcacgacggaaaggauaaauuccuggcucucgagaauuuuggcgaaaaggagucuaaagacaaggugaucacaaagauucugcgggggcuucacgccaacgccgaacgcaccagccugaaagagaucggacucuccacaccucugggccaguuccaaucuggggagggaggcaucacccucagcgauaacacgaagauuaucuaccaguccccgaccgggcuguucgaaagacaugucuaucuuaaagaccuguga

SEQ ID NO: 4331 - RNA, 4128 nt, Artificial Sequence
  Cas9 variant
augagaaagaaccaggagcccuacaauaucggccuggacauugggaccagcuccaucggauggucuauuaugaacgauaauuucgaccucaugcgggugaaaggcaagaaagggaucggaguccgccuguauaacgaaggccaaagcgccgcugagagacggaugcaccgcacagccagacggcgcuacgggagacggaaguggcgccuuagacugcucgaagauuucuucgacgagcauauggcggaaguugaugacacguuuuucgcucggcugaaagauuccaauauuucuccuaaggacgauaagaaauaucgcaagagccuucuguuuccgaaauccaagggagugaccuaccaggacgauggcgaguucuauaaaaaguaccccacaauguaucaccucagauacgcccugaugaccgagcaucggaaguuugaccugcgcgaaaucuaccucgccuuccaccauauggugaaauauagaggcaacuuucuguacgauacaucugucgacagcuucgaggcuaagaaucuugacaucaaagggaaguuugaugaaauuaacgaccugcucuccagcuauaccgauuucuacguggacaauucuaacgccgcucugguugaguccauccuucuggagaaaaauacaacccggaaggauaaaagcaagaagauugccaaacuccugcacguggaagacaaggagaaaggaaagaacaaaaaggcgaaggaucuggccacgcagaucucuaaugcuguccucggccugaaaugcaacuuucaccuuauuuucgaacugcagcaaaaguauuccuucgaccucuguagcgagaaaaccgaagagaauaucgccaagcugucugaggugcuugaugaaaaccagaaaaugcugcucaugauucugaaggagguucaggaccaggugaugcugaacgcuuuugucccuuccgggaugagccucuccgaagccaugaugcaaaaguacgaugacuauggagagcagcugaaaaucuaccaugaacuugagcacucugugagcgacgauuccgcggccaagcugagaggcgcuuaccgcgacuauaaugauaacaucauuaaacggaucgacggggauaauaagaaagacacauucuacaagagagugaagaacauucucaccaaaaucagcaaggaguaugucgaucaggacguucuggaaucuugcggaaaacuuaagaaacugauugaugagaauaagcucuuuauccgccagcggacagccgcuaacggcgugcugccccaucaacugcaccagaucgaaaugagaaaaauuaucgacaaucagaaggaguacuauccuuggcucgccgaacccaacccuaaugagaagcgccggguguacuccaaauauaaggucgaggaacugauugccuucagaaucccguacuacgugggcccccuuguugauccuaacaaugcugacaaaaacaaggaggcgcgcuuuagcuggauggugcggaaaaaggauggggaaauuacccccuggaauuucuaugacaaggucgacugggccgagucugcuaacaauuuuaucgagagaaugaaaagcaaggauacguaccugcucggagaagacgugguuccuaaagaguccaugcuguaucaaaaguacgaagugcugaacgagcuuaacaaucuccgcaucaacgauucuggccugagcgacuccuucgaagaugucaaacugaagcaggccauuuauaaugaccucuuuaagaaacagaagaucgugaaaauuacagaucugcagaacuaccuuguccaaaaucacaaguaucuggugaaacccaagaucagcgggcucgccgacgagaaccgguuccugucuucccugagcaccuacucugaucuuaagacaauuuuuggagacaaaguugaugacagaaccuacuucaaugauuuugagaagaugguggaauauuccaccgucuucgaggacggccaugacuacaaccagaaacucgaugaauauacauggcugacgaaggaggaaaaauacaagaucgggaaaaagcgguaucgcggauggggcaagcugagcaaaaagcuccugaccggccuuagagacaaaaauaaccacacaauuauggauaaucugugggagaccaaccggaauuucaugcagauccagacagcugacgaguuuuccaagcaaaucgccgaagagaacgaaagacaucucaaagggucugugagcgaugcgauuaaugacauguacaccuccccggcuaacaagaaggccauccgccagguucugcggguggucgaugacauucagaaagccaugggauaugcuccuucuagcaucucccuggaguucgccagagaagauggccccagcgugcgcacggugucuagagcuaaccggaugaaguccauuuacgagaaauacgccagcgagguuucugaagaggucaugaaggaccuugauggggugaucaaagacaagaagggacucaaugaccgccuguaucuguacuuugaacagcaaggcaaagauauguauuccgggcacccucucgacuucgauaaggugaucagcggccaggaguacgacauugaucauauccugccccaggcggucauuaaagacgauucucuugacaacagagugcugacaaccaaggcccucaauaacgauguuaaaagcaagggagugcccugucggauguuuaauggcaugcacuccuucuggaagaaccuguaugacaaaggguuuaucagccgcagaaaguucaauaaccugaccacaaauccugagaacauugauaaauacaagaugaaaggauuugucaaucggcagcuuguggaaacccgccaaaucaucaagcucguugcuaacgugcugaaugacaaguaucagaacgaugacgucgacauuaucgaggugagagccgaacugacacacgauguucggaaacauuucaaguuuuacaaaaaucgcaacgugaacgacuaccaccaugcuuucgaugccuaucucacgucuuuuauuggccacuaccuguucaagaaauauccgaaucuuagaccccuguucgacuacaacgauuuuaugaaggucuccgacaauguguucaaacagcuccgggggaacaauuuucugggagaguuccugaacaagaccggcgauaucauuagcacagacgggaauuuugugcuuaacaaggaagagaugaucaauaaacugaacaaggcguaugccuucaaaaagauccucgucaccaaagagguuggccaaagaacaggagcuauguuuaaugaaacccgcuacccugcccccaacucccggaaggcugcccugaaguauagacgcaugccuaaacccgauucucucauuagcgugaaggacuacaaaaauacggauaucuacggcggguauuccggaaagaacgacgccuacauggugauugucgauaugggcaaacaguauauggugguuggggugccgguccgguacaccgagaagcuggacaaacuuagaaucaaacacucugaacuguaucgcgacgagcuccggaaggugcugagcagagauaaaacacugcuugacuccaagggaaauguuaaacgcuucgauauugugcuggaccggguccucuacggccagcugaucgaagaugggaacgagcucuuuacccugggcucuagcaaguauaagagaaauuuccggcagcuuuuucuggacaaacaaugcauugagauccucgauuccagcgcuacaccucagcccaccgacgaagaacugaucuggguguacgaucagauucuggacaagguugauaaauacuucgaacuuuaugacaucaaccgccagagagagacgcugcggaagggacgcgcggccuucuguucucucccuaacauuuccaugaaaaaggacgaugugacaaagaagaagauccugaaugaaauucucgucgcucugcaugccaacgagagcgagucuaauugcgagaaaaucggcaagaaaguguuugggagacuucaagugcccggaggcaucaagcuguccaaagaggccaagcugauuuaccagagcccuaccgggcucuuugaacgggucguuuaucugaaggaccuuuga

SEQ ID NO: 4332 - RNA, 4128 nt, Artificial Sequence
  Cas9 variant
auggagaacaagaaauacagcaucggccuggacauugggaccuccucuaucggauucgccguggucgaugaaaauaacagaguuaugcgggugaagggcaaaaaugcuauuggggugcgccucuuuagcgagggacagcccgccgcggacagacgguccuuccgcacaacgagacggcgccugucuagacggcgcuggagacuucggcugcuccgcgaaaucuuugagccuuauauuaacccggucgaugaggcuuucuuuaugagacugaaggagagcaaucuuucccccaaagacgccaacaagcacuacucuggcgauauccuguucaauaaccaaaccgaccaggauuuuuaugagaaguacccuacaaucuaucaucuccggcacgcccugaugaccgaacaucgcaaauucgacgugagagagauuuaccuggcuauccaccauauuguuaaguuucgggggcacuuccucaaugccgcuagcgccuccaacuuuacagugggaaaacugaaucuugaaggcaaguucgaugcgcugaacgagaucuaucagagaguccucaccgacgaucccuuugcccugcgcacagacaaucuugaucacauuaaagagauccugauugacaacaagcggagccaggcugacagacaacgcacccucacgggcgauguguaccagucuuccgaagagaaggaaaucgagaaacggaauaaggccaucgcuaccgaaauucugaaagccgcgguugggaacaaggccaaacugaacgugaucacaaaugucgagguggacaaggaggcugccaaagauuggagccucaccuucgacucugaaacaauugaugacgagcuggcuaagguggauggacagaugaccgacgauggcagagaaaucauugagauccuucgcucccuguacagcgggaucacgcucgccgccauugucccugaaaaccauacacugucucaguccaugguugagaaguauaauagccacaaagcucaucuuaagcugcucaaagaccugaucaacaauaugaccgauacaaagaaagcgaagaaccugcgggccgcuuacgacggauauauugacggcgugaaggggaaagugcucaccagagaugacuucuacaagcaaauccagggaaaucuggaugacuccgccgaggcccagaaaauucaggaugucauggaccaagaugaauuuaugcccaagcagcgcaccaaagcuaacggcucuaucccucaccagcuucaacagcaggagcuggaccagaucguggaaaaucaaaaggaguauuacccguggcucgccgaagagaaccccaaugagacacggagaggcguugcgaaguauaaacuggaugaacuugugacguuccgcgucccuuacuacguggggcccaugauuaccgcugaggaccaggaaaagcagagcggagccuccuuugccuggaugaaacggaaggagccuggcaacaucacacccuggaauuucgaucagaaaguugacagaauggcuagcgccaaccaauuuauuaagcggaugaccacaaccgauacguaucugcucggggaggacgugcugccggcucagucucugcucuaccagcgcuucgaaguccugaaugagcuuaacaagaucagaauugaccggaaaccuaucuccauugaacugaagcagcaaaucuuuaacgaucucuucaaaaaguuuaaaaaugugacaaucaagcaccuccaggaguaucuggucgccaccggaggcuacgacaaaagaccccgcauugaugggcuugcggacgaaaagcgguucaacagcggacucucugccuaucaugaucugcacggcauccugggcgcugaggugguugacgccaaugauaagcaggacgaucucgagaaaauuaucgaauggagcaccauuuuugaggacaagaaaaucuacagagcuaagcuggaugaacuuacauggcugaccgacucccagaaagagaagcucgccacaaagcgcuaucaaggguggggaagacugucuaaaaagcugcuuagcggccuccggaacuccgaucaucgcagcauccuggacauucuguggaucacgaaugaaaacuucaugcagauucaggcggacccugauuuugccgagcucgugaaaaaugcuaaccaagggaugcugggaaagaauaacucucaggacgucaucaaugaucuuuacaccagcccccagaacaaaaaggccauuagacagauccugcucgugguucacgacauccaaaaugcuaugcauggccaggcccccgccaagauucacguggaguucgcucgcggggaagaacggaacccuagacgguccauccagcgccagcaccaaauugaagcggccuacgauaaagucacaucugaccugcugguggaugcuggcgugagacaggagcuuaaggacgccaucaaugauaaacgggacuucaaggaucgccucuuucuguauuucaugcagggaggcagagacauuuacaacggggaaccgaucaacaucgaccggcuguccagcuaugauauugaccauauccucccccaggccuuuguuaaagaugacucccugaauaacagaguccuuaccgaugcugagggaaaucgccggaagucugacgccgugccuagcgagcuguucggcgcgaagaugagauccacaugggaacucaugcgcgagcaagggcugauuucuaaagcuaaguaccggaaccugaccaugaaucccgaaaacaucaaugcccacacggagaacggauuuauuaauagacagcuuguggagacccgccaggucaucaaacucgccgugaacauucuggcugaugaauauacagaggacacccaaaucguuagcgugaaggccgaucugucccaucagaugcgggaagacuucgagcuccugaaaaauagagaugucaacgacuaccaccacgcguuugaugcuuaucuugccgccuucaucggcaauuaccugcucgaacgcuacccuaagcugcagagcuauuuuguguacggggacuucaaaaaguuuucucagaaggacacaaaaaugcggagauucaacuuuauuuaugaucugaagcauuccgaccaaaucgcugauaaaaauggcaagaaaauuuggcacaagaccaacgaccuugauuacauccggcaucuguucgccuauaagaaaauucucaucagccacgagguuucugagcgcagaggagcucuguacaaccagacgguguauaaggccuccgacgauaaagcgagcggccaggggucuaagaaacucauccccauuaaggccaauaagccgacagaaaucuacggaggcuacaccgggaaaacacuggcuuauauggccauugucaaggugaucaaaggaaagaaaauugcuuacaagguugugggcgucccuaccagcgcccuugugcagcuggccgggaucgagcauggcucccaagaggaacucaaccggcuguaugacgugcugaagccccaguucacccagcuuaaaaagaauaacaaaacaggagaaaucagcgagacggucucuaaguuugagauuguuaucccucgcgugaaauaccagcaacugguggaagaugacgauaagcuguucaugauuggcuccgacaccuaucccuacaaugcucagcagcugguccucagcgagggggcgcugaaggugaucaacaauguuuauagaaaaggagaaaacuccgauaagcaggagucuuacaaacuugacgacguguacgaugaaauuaucauugccaugaagaaauauuuuccucuguacgacaaucggggcuucagagagaaggucgcugaggggaaaagcacauuugaaaaccuccccaucuccaaugaguucaagaacggaaagcugaccaaaaucggcaagaaagaagugauuaaucgcaugcugcaagggcuucacgccaacgccacaaugaccgaucugaagauccucggcauuaaaucuccguuuggauucaugcagcagccuacgggcaucgcucugagcgagaaugcccaacucauuuaucagucccccacagaccuguuugagcggagaguucagcuuaacaagaucaaguga

SEQ ID NO: 4333 - RNA, 4128 nt, Artificial Sequence
  Cas9 variant
augaagaaaauccugggccucgaccuggggaccacaagcauuggaugggcccuuguguacgaguccgaaaacacggaugagaagucuagcaucgucagacugggcguucgggugaauccccucuccguggacgaaaaagggaacuucgagaagggaaaagcuauuaccacaaaugccgaucgccagcaaacccacggcgcgagaaucaaccugcagcgguauaagcugcgcagagaaaaucugaaggacugccuccagaaacagggguggauuggaacagaggcucugugugaggaaggcaagaccucuacauuugagaccuacaugcugcgggccaaagccgcugaagaggagaucagccuccaugaacugugccgcguccuuuucaugaugaacaagaaaagaggcuauaaguccaaucggaaggccaacaauaaagaggaugggaagcuguuugacggaaugacgguggcuaaaaagcucuacgaggaacaccugaccccugccgaauauucuuuccaacuucugagcuccggcaaaaaguuuaaacaggaguacuaucgcagcgaucucaaggaggaauuugacagaaucuggaacgagcagcagaaguacuacccggaaauucugacagaugacuuuaaacaacagcugcaggggaagucuaaaggaaauaccuccaagaucuuccucggcaaauaugggauuuacagcgcggaucugaagggacuugaccggaagcugcagccccucaaauggcgcguugaggcccugaagcaacagguggauaaagaaguccuugcuuuugugaucucugaccugaacggccagauugccuccacaagcggccuccugggggcuaucucugacagauccaaggagcuguauuucaauaaacaaaccguuggacaguaccucuggacgagccugaaggagacaccucauguguccauuaagaacaaacccuuuuaucggcaggauuaccuugacgaauuugagaagaucugggaaacccaggccacauaucacaaagagcugaccccugaacucaagcaagagauccgcgauauuaucauuuucuaccagagaccccugaaaucuaagaagggccuuaucagcgucugugagcuggaacagcggaaagugaaggugaccauugacgggaaagagaaggaaaucuccaucggaccuaaagucgcgcccaagagcucuccgauguuccaggaguucagaauuuggcaaaaucucaacaacauccugcugauugauaaaggcaauaacuccauccauccucucuacgaggaagagaagaaucugcuuuaugaggaacugagcguuaaggaaaaacucucuaaggccgaggcucugaaagugcugaacaagaauagcaaacagugggaccuuaacuacaaggagauugaagggaaucgcacacaggccgugcucuaugauugcuacaaccggaucaucgucaugacgggacacgaggaauauaauuuuaagaaacugaaggcuuccgagauuagaucuuacgugaaaaccacauucaccggccugggcuuuaacacagacauccucgaguucgauagcucccugaccgggcacgaacuugagaagcagcccauguaucaacuguggcaucuccuguacagcuacgaaucugacaauucccgcacgggaaacgaugcccugcuucggaaacucgagacagccuuuggcuucccuaaggaauaugcugcgguucugagcgacguggucuuugaggacucuuacgggaaucuguccgugaaggccaugagaaaaauucucccccaucugcaggcuggacuuaacuauagccaggccugugaagaggccggcuacaagcacucccgccggucucugaccaaaaaugagcucgaucagaaggaauauaaagagaagcuggaacugcuuccgaagaacagccuccacaacccuguuguggagaaaauccugaaucaaaugauuaacgucaucaaugcugugauugacgaguacgggaagcccgaugaaaucagaaucgagcuggcccgcgaacucaaaauuggcgcggcugagcgggaaaacaugaccagauccaucaaucagggaaacgccgagaauaagcgcauucgggagauccuggaaaaagaguucgcccuuucuuauauuagcagaaacgacaucaucaaguacaaacuguacgaggaacucaaguccaauggcuuuaagacacuguauagcgauaccuacauuucuaaagacaagcuguucuccaaagauuuugacaucgaacacauuaucccuaaggcucggcuuuucgaugacagccucucuaacaaaacaauugaggcccgcgaugucaauaucgcuaaguccaacaagacggccuuugacuucaucagcgagaaauaugaucagcaagggauugaagcguacaagaaaaagcuggacauccugcuccaggacggaucuauuagcaaagccaaguauaauagacugcuuaugaaggaggcugauauccccuccggcuucauugaccgggaucugagagacacccaguacaucgccaaaaaggcuuaugaaauccucagcgaucuggugcgcaacguuacacccaccacaggggccgugaccucucggcugagagaggacuggcagcuugucgaugugaugaaagaacugaauuuugagaaguaccaaaaacucggacugguugaggugauugaagaccgcgauggcagaaagaucaagcggauuaaagacuggacgaagcgcaacgaucauagacaccaugcgauggacgcccucaccaucgcuuucacaaaaccuuccuacauucaguaucugaacaaucuuaacgcccggagcgauaaaaauuccucuaucuacgggauugagaacaaggaacugcaccgcgaggacaauaagcucagauuuaacgcuccgcugcccaucaaugaguuccgggccgaagcccgcagacaucuuaagagcauccuugucuccgugaaagcuaagaacaaagugaugacccagaauguuaacgucauuaagacaaaacacggcgugaucaagaaagugcagcugaccccucggggagagcuccacaaugcgacguuuuauggcacaaagaagcgccccauuaucaaaauggucaaggugggggccgcucuggacgaaguuaccauuaaaaaggugucuagcuccuucaucagagaggcccuccuggaucggcuucaugaauacaacggagacgccaaaaaggcuuuuacaggcagaaauucuaucgauaagaacccuauuuauaucgacgaggagcacaaaaagaccguccccgcccuggugaaaaccauugaaugggagauguaccauccgacacgcaagcucaucagcccugaucugaaaauugacaagguuaucgauaaggggauccgggaaauucugaaaacgagacuugcgaaguucaauggagacgcucaaaaagccuuuuccaaccuggaugagaaccccaucuauaaggacgaagccaaaaagauuacccucaagcgcgugagccuggagggcgucucuuccgugaucccucuccacacacugaaagaucgggaggggaaacuuguugugggcaaggacggaaagcccguccugggcgacuacgugcagaccagcaauaaccaccauauugcuuucuacauggaugaaaaugggaaccugcaggacaauguggucucuuucuucgaggccgcggaaagaaaaucccagggaguuccugugaucgauaagaacuauaaucacgacaaaggcuggaacuuucucuucacaaugaagcaaaaugaguacuucguguuucccaacgaagucaccggguucaauccgagcgagguggaucugauggacgaggcuaacuauucuauuaucuccccuaaucuuuaccgcguucagaagaugagcaaagccuccggacgggauuauugguuuagacaucaccuggaagccaugcucaacgacgaucccaagcugcgcaauagcauguucaaacggaucacgucucucaaggcucuggagggcauugugaaagucagaaucaacugcauugggaagaucguggccguuggcgaauacgacuga

SEQ ID NO: 4334 - RNA, 4128 nt, Artificial Sequence
  Cas9 variant
augagcaacaaguccuacucuaucggccuggacauugggaccaauagcgugggaugggccgucaucacagaugacuauaaaguucccuccaagaaaaugaaggugcucggcaacacggauaaacacuucauuaagaagaaucugaucggggcccuucuguuugacgagggaaccacagcugaagauagacggcucaaacgcaccgcgagacggcgcuacacaagacggaagaaccgccugagauaucuucaggagauuuucucucaagaaaucagcaaaguggacuccagcuuuuuccaucggcuggaugacuuuuuccucgucccugaggauaagcgcggcagcaaauacccgaucuuugcuacccugguggaagagaaggaguaucacaagaaauuccccacaauuuaccaucugagaaagcaccucgccgacuccaaagaaaagaccgaucugcggcuuaucuaucuggcccucgcucauaugauuaaauaccgcgggcacuuucuguacgaggaaucuuucgacaucaagaauaacgauauucagaaaaucuuuucugaguucauuuccaucuaugacaauacguuugagggaaagagccuuucuggccagaacgcccagguugaagcuaucuucaccgacaagauuuccaaaagcacaaagagagagcgggugcugaaacucuucccugaugaaaagucuaccggccuguuuuccgaguuccugaaacucaucgucgggaaucaagccgacuuuaagaagcacuucgaucuggaagagaaagcgccccuucaguuuagcaaggacacauacgaugaggaccuggaaaaccuccugggacagauuggcgaugacuucgccgaucuuuuucugguggcuaaaaagcucuaugacgccauccugcuguccgggauucucaccguuaaagaucugucuacgaaggcuccucuuagcgccuccaugaucgagcgcuacgaaaaucaucagaaggaccuggcggcccucaaacaauucauccagaacaaucugcaggagaaguaugacgaaguguuuagcgaucagucuaaagacggauacgcuggcuauauugaugggaagacaacccaagaggccuucuacaaauacaucaagaaccuucuguccaaguuugagggagcugacuauuuccucgauaaaauugaaagagaggacuuucugaagaaacagcggacauucgauaauggcagcaucccccaccagauucaucugcaagaaaugaacgccaucaucagacgccagggcgagcacuacccuuuccuccaggaaaacaaggagaaaauugagaagauccugaccuuucggauuccguauuacgucgggccccuugccagaggaaauggcgacuucgcuuggcugacccgcaacucugaucaggcgauccggccuuggaauuuugaagagauuguggaccaagccagcuccgcugaagauuucaucaacaaaaugacaaauuaugaccucuaccugcccgaggagaaggugcugccuaagcacucucuucucuaugaaacguuugccgucuacaacgagcugaccaaaguuaaguucauugccgaagggcugacaagauaccaguuucucgauaaaaagcagaaaaaggacaucuucgacaccuuuuucaaggcugagaauaaacgcaaggugacagaaaaagauaucauucauuaucugcacaacguggacggauacgauggcaucgagcuuaaggggauugagaaacaguuuaaugccagccuguccaccuaucaugaccuccugaagaucauuaaggauaaagcguucauggacgauagcaagaacgaagagauccuggaaaauaucauucacacgcuuacaaucuuugaggaccgggaaaugauuaaacaaagacucgcucaguacgauucucuguucgacgagaaggucaucaaagcccugacccgccggcauuauaccggauggggcaagcucuccgccaagcugauuaacggcaucagagauaaaaagagcgggaaaacaauccuugacuaccugauugaugacggagagaucaaucgcaacuucaugcagcucauucacgacgauggccugucuuuuaaggaaaucauucagaaagcucaaguguucgggaagaccaaugacguuaaacaggugguccaggagcugcccggauccccggccaucaagaagggcauccuucagagcauuaaaaucguggaugaacucguuaaggugauggggcacgcuccugaguccauugucaucgaaauggcccgggagaaccaaacaacggcgagaggcaaaaagaacucucagcagcgguauaaacgcauugaggacagccugaagaaucuggccuccggacucgauucuaacauccugaaggaaaaucccaccgacaacauucaacuucagaaugauagacuguuucucuacuaccugcagaacggccgggacauguauacagggaaaccucuggagaucaaucagcuuagcaacuacgauaucgaccauauuaucccccaggcuuucauuaaggaugacucccucgacaauagagugcugaccagcucuaaagauaaccgcggaaaguccgacaauguccccagccuggaagugguugagaaaaugaaggccuuuuggcaacagcuccuggauucuaagcugaucuccgagcggaaauucaacaaucugacaaaggcugaaagagagcgcggcgggcucaacgaacuggacaaagugggauuuauuaagagacagcuggucgagacccggcaaaucacgaaacacguggcccaguuccuugaugcgcgcuuuaauaaggaaguuaccgagaaggacaaaaagaacagaaacgugaaaaucauuacacuuaagagcaaucucgucucuaacuuccggaaagaguuuggccuguauaaggugcgcgaaaucaaugauuaccaucacgcccacgacgcuuaucucaacgccgugcuggcuaaggccauucuuaaaaaguacccuaaacuggagccggaguucguuuauggggauuaccagaaguacgaccuccagagauauaucagcaaaucccgggaacccaaggaagucgagaaagccacccaaaaguacuucuuuuauagcaaucugcugaacuucuuuaaggaggaagugcauuacgcugauggcacaauugugaaacgcgagaauaucgaauauucuaaggacaccggagagaucgcguggaacaaagaaaaggauuucgccacggucaaaaaggugcuuucccugccucagguuaauauugugaagaaaacagagguccagaccggcggguuuagcaaggaguccauccuccccaaaggaaacucugacaagcugauuccuagaaaaacaaaggaaauccucugggacaccaccaaguacggcggguucgauagccccgugauugcuuauuccauccugcuuauugccgacaucgagaaaggaaaggccaaaaagcugaaaacaguuaagacgcucgugggcaucaccauuauggaaaaggcuacauuugagaaaaauccgaucaccuuccuggagaacaagggguaccacaauguccggaaagaaaacauucugugccuuccuaaguacucucuguuugagcucgaaagcggccgcagacggaugcuggccuccgcgaaagagcuccaaaagggaaaugaaaucgugcugcccguuuaucuuacaacccugcuguaccauucuaaaaacgugcacaagcucgaugagccugagcaucuggaauauauucagaagcacagauacgaguucaaagaccuucugaaccucgucagcgaauuuucccagaaguaugugcuggcugaugccaaucucgagaaaaucaagaaccuguacgccgacaaugaacaggcugauaucgagauucuugccaacagcuucaucaaucugcugacguuuacagcgcucggcgcucccgccgccuucaaauuccuggggaaggacguggaucgcaagcgguauaccaccgucucugagauucuuaacgcuacacugauccaccaauccauuaccggacucuacgaaacaagaaucgaccugagcaaacucggcgaggauuga

SEQ ID NO: 4335 - RNA, 4128 nt, Artificial Sequence
  Cas9 variant
auggagaagaaauacagcaucggccuggacauugggaccaacuccgugggaugggccgucaucacagaugacuauaagguucccucuaaaaaguucaaagugcucggcaauacgaacagaaagagcauuaagaaaaaucugaugggggcccuucuguuugauuccggagaaaccgcugaggcgacacggcucaagcgcaccgcuagacggcgcuacacaagacggaaaaaccgcaucagauaucugcaggaaauuuucgccaaugagauggccaagcuggacgauagcuuuuuccaacggcuggaagagucuuuucucguggaggaagacaaaaagaacgagcgccacccuaucuucggcaaucuggcugaugaagucgccuaccauagaaacuauccgaccaucuaccaucugcggaagaaacucgcugacucccccgagaaggccgaucugcgccuuauuuaucuggcgcucgcccacaucauuaaauuuagagggcacuuccugaucgagggaaaacuuaaugcugaaaacucugacguggccaaacuguuuuaccagcucauucagacauacaaucagcuguucgaggaaagcccucuggaugagaucgaaguugacgcuaagggcauucucuccgcccggcugagcaaaucuaagcgccuugagaagcugaucgcgguguuucccaacgagaaaaagaauggccucuucgggaacaucauugcccuggcucuuggacugaccccuaauuuuaaauccaacuucgaucucacggaagacgccaagcugcaacugagcaaagacaccuaugaugacgaucucgacgagcugcuuggccagaucggggaucaguacgcugaccuguucucugccgccaagaaccucuccgaugcuauucugcuuagcgacauccugagaucuaauuccgaagucacaaaggcgccccucagcgccuccauggugaaacgguaugaugagcaucaccaggaccuggcucugcucaagacccugguuagacaacaguuuccugaaaaauacgccgagauuuucaaggaugacacaaagaacggauaugccggcuacguggggaucggaaucaagcaccgcaagcggaccacgaaacuugcuacacaggaggaauuuuauaaguucauuaaaccgauccuggagaagauggacggcgccgaggaacuccuggcgaaacugaauagagaugaccuucuccgcaagcagcggaccuuugauaacggcucuauuccccaucaaauccaccugaaggaacugcaugcuauucucagacgccaggaggaguucuacccuuuucugaaagaaaaucgggagaagaucgaaaagauccuuacauuccgcauucccuacuaugucgggccucuggccagaggaaacagccgguuugccuggcucaccagaaaguccgaggaggcuaucacccccuggaauuucgaagaggugguggacaaaggcgccagcgcucagucuuuuauugaacgcaugacaaacuucgaugagcaacugccgaauaagaaaguccugccuaagcacucccuucucuacgaauauuuuacgguuuacaacgagcugaccaaggugaaauaugugacagagcggaugagaaagcccgaguuccugagcggggaacagaaaaaggccaucgucgaccuccuguucaaaaccaaucggaaggugacaguuaagcagcuuaaagaagauuacuuuaagaaaauugagugcuucgacucuguggaaaucauuggagucgaggaucgcuuuaacgcgagccugggcaccuaucacgaccuccugaagaucaucaaagauaaggacuuccuggauaaugaggaaaacgaggacauucuugaagacaucgugcucacgcugacacuguuugaggauagagaaaugauugaggagcggcucaagaccuacgcccaucuguucgacgauaaaguuaugaagcagcuuaaaagacgccacuacaccggguggggacggcuguccagaaagaugaucaauggcauucgcgacaaacaaucuggcaagacaauccucgauuuucuuaagagcgacggguucuccaacagaaacuuuaugcagcugauccaugaugacagccuuaccuucaaagaagagauugaaaaggcucaggugucuggacagggcgauucccuccacgagcaaaucgccgaccuggcugggagcccugccauuaaaaagggaauccugcagacagucaaaauuguggaugagcucgucaaggugaugggccauaaacccgaaaauaucguuaucgagauggcgcgggaaaaccagacgaccacaaaggggcugcagcaaucucgcgagagaaagaaacggauugaagagggcaucaaggagcuugaaucccagauucugaaagagaaucccguggaaaacacccagcuccagaaugagaagcuguaucuguacuaucuucaaaacggacgcgacauguacgucgaucaggaacuggacaucaauagacucagcgacuaugauguggaccacauuguuccucaguccuuuaucaaagaugacucuaucgauaacaaggugcugacacggagcgucgagaaucgcggcaaguccgacaacgugccgucugaggaagugguuaaaaagaugaaaaauuacuggagacaacuccugaacgccaaacuuauuacccagcggaaauucgauaaucugacgaaggcugagcgcgggggacucagcgaagccgacaaggcuggcuuuaucaaaagacagcuggucgagacccggcagauuacaaagcacguggccagaauccuggauucccgcaugaacaccaaacgggacaagaaugauaaacccauuagagaagugaaggucaucacacuuaagagcaaacuggugucugacuuccgcaaggacuuccaacucuauaaaguucgggauauuaacaacuaccaucacgcccaugacgcuuaccugaaugcgguggucgggaccgcccucaucaagaaauauccuaagcuggaguccgaguuuguguacggagauuauaagguuuacgacgugagaaaaaugaucgcuaagagcgaacaggagauuggcaaagccacggccaagcgcuucuuuuauucuaacaucaugaauuucuuuaaaacagaagucaaacuugcuaacggggagauucggaagagaccccugaucgagaccaauggcgaaacaggagaggugguuuggaacaaggaaaaggauuucgccaccgugcgcaaaguccucgcgaugccucaggugaauauugugaagaaaaccgagguccagacaggcggguuuuccaaggaaagcauccugucuaaacgggagagcgcuaagcugauccccagaaagaaaggaugggacacgcggaaguacggcggguucggauccccgaccguugccuauagcauucuugugguggccaaagucgagaagggcaaagcuaagaagcugaaaucugugaagguucucguggggaucacaauuauggaaaaaggcuccuacgagaaggauccuaucggauuucuggaagccaaaggcuacaaggacauuaagaaagagcucaucuucaagcugcccaaauauagccuuuuugaacuggagaacgggcgcagacggaugcuggcguccgcuaccgagcuccaaaaggccaaugaacugguccuuccucagcaccuggugcgccuccuguacuauacacagaacaucucugccaccacgggaagcaauaaccucggcuacauugagcagcacagagaagaguucaaagaaaucuucgagaagauuaucgauuuuuccgagaaauauauucugaagaauaagguuaacucuaaucuuaaaagcuccuucgacgaacaauuugcugugucugauagcauccugcuguccaacagcuucgucucucuccugaaguacacauccuuuggggccagcggaggcuucaccuuucuugaccuggaugugaaacaggggcggcucagauaucagaccguuacagaggugcuggacgcuacccucauuuaccaaucuaucacaggccuguacgaaacgcgcaccgaccuuucccagcugggaggcgauuga

SEQ ID NO: 4336 - RNA, 4128 nt, Artificial Sequence
  Cas9 variant
augaagaaaauccugggccucgaccuggggaccacaagcauuggaugggcccuugugaacgaguccgaaaauaaggaugagcagucuagcaucgucagacugggcguucgggugauuccccucacgguggacgaaaaagggaacuucgagaagggaaaagcuaucaccacaaaugccgaucgccaacagguccacgcggcuagaauuaaccugcagcgguacaaacuucgcagagaaaaucugcgggacugccuccagaagcaaggcuggaucggguccgagccuaugugugaggauggaaaaucuagcaccuuugaaacauauaagcugcgcgccaaagccgcuguggaggaaguuucccugcaugaguucgccagagugcucuuuaugcugaacaagaaacggggcuacaagucuaaucgcaaggcuaacgacaaagaggaaggcaaacuuuucgaugggaugaccaucgccaaaaagcuguaugaggaacaccucacaccggcggaguacagccugcagcuucugaauaccggaagaaaauuuacgcccgaauauuaccgguccgaccucauugaggaguucgaaaagaucuggaacgagcagcagaaauauuacccugaaauucugaccgaugaguuuaagcaacagcuggaaggcaaggccaaaagcaauacaucuaagcucuuucuggggaaauacggaaucuauuccgcugacaccaagggccuugaucgcagacugcagccccucaaauggcgggucgaggccaugaagcagcaaguggacaaggauguucuggcuuuugugauuagcgaccuuaaagggcagaucgccaacacaucuggacugcucggcgcgauuuccgaccgcagcaaggagcuguacuucucuaaacagaccaucggccaauaucugugggccucccuccaggaaaauccucauaucagcauuaagaaccagcccuuuuacagacaggauuaucuggacgaguucgaaaagaucugggagacgcaagcuacauaccacaaggaacuuaccuccgagcugaagcaggagauucgggauaucauuaucuuuuaucagagaccucucaaaucuaagaaaaaucugaucgccgucugcgaacuugagcagcgcaaggugaaagugacagucgacgggaaggaaaaggagauuaccaucggaccgaaaauugcucccaagagcuccccuauguuccaagaguuccggaucuggcagaaccugaacaauauucuccugcuggaucaugaaaccaacagcaaaagaccccucuacgaggaggaacgcaaucugcuuuacgaggaacugucuguuaaggagaaacucuccaagacagaagcccugaaagugcugggcaaaaagagcaagcagugggaccuuaacuauaaggagcucgaagggaaucggacgcaggccgugcuguacgauuguuauaacagaaucaucgucaugucuggacacgaggaaugcaauuuuaaaaagcugaaagcuagcgacauucgccacuacgugaagaugaucuucaagaaccucgcguuuaauaccgauauucuguguuucgacuccucucuuaaaggccaugagcuggagcggcaaccuaugugccagcucuggcaucugcuguauagcuacgaaggggauaacuccagaacaggaaaugacgcccuucuccgcaagcuggagaccagcuuuggcuuccccaaagaauaugcugccguucuggccgacgugaucuuugaggauucuuacggcaaccucuccgucaaggcuaugcggaauauucugccgcaccuucaggccgggaaagacuacagccaggcgugugaagaggcuggauauaagcacucuagacgcucccugacaaaggaggaacucaaccaaaaaguguacaaggagaaacuggaacugcuuccuaagaauagccuccacaaccccguuguggagaaaauccugaaccagauggucaaugugauuaacgccgucaucgaggaauauggcaagccugaugagauccggauugaacuggccagagaccucaagaucggggcugccgagcgggaaaauaugacccgcuccauuaaccagggaaaugcugagaacaaaagaauccgggagauucuggaaaaggaguucgcccuuucuuaccugagcagaaaugauaucaucaaauauaagcucuacgaggaacugaaauccaacggcuuuaagacgcuguauucugacacauacauuagcaaagauaaacuuuucuccaaggacuuugauaucgaacauauuauccccaaggcgcgccucuucgacgauagccugucuaauaagaccauugaggcccgggacgugaacaucgcuaaauccaauaagaccgccuuugauuucauccuggagagauacggggaacaaggcguuaaaacauauaagaccaagcuccugcgccuucuggaggacggagcuauuagcaacaaaaaguacaauaaccuccugaaaacagaagccgacauccccucuggcuucauugauagagaccugcggaauacgcaguauaucgcgaagaaagccuacgagauucuuuccgaacuggugaagaucgucaccccuacaaccgggagcgugacaaaccgccucagagaggauuggcagcugguugacgugaugaaggagcucaacuuugaaaaauaucagaagcugggacuugcugaugucaucgaggaccgggauggccgcaaagugaagagaauuaaagacuggaccaagcggaaugaucaccgccaucacgccauggacgcucugacgaucgccuucaccaagccgucuuacauucaauaucucaacaaucugaacgccagaagcgauaaauccagcucuaucuacgggauugaagugaaggagcugcaucgggaggaaggaaaauuucgcuucaaugcuccccuuccuaucaacgaguuuagagcggaagccaagcggcaccugaaauccguucucgucagcauuaaggcuaagaaaaaggugaugacacagaaugugaacaaaaucaagaccaaacacggcaucauuaagaaaguccagcugacacccagaggggagcuccauaaugccaccuacuauggcacgaagaagcgcccucuggugcggaugguuaaagugggagccgcucuugacgaagccacaaucaagagagucugcucccccgcgauucgcgcugcccugcucaaacggcugaacgccuacaauggcgaugcuaaggaggccuucaccgggagaaacucuaucgacaaaaauccgauuuaucuggacaucgagcagacaaaacuugugccuguucuggugaagaccaucgaauggggaauguaccaccccauucgcaagcggaucaccccugaucucaagauugacaaagucaucgauaagggcauuagagagaaacugaaggcgcgccucgcugaauuuaacggggacgcccaaaaggccuucagcaaucuggaugagaaccccaucuauauggacgaagcuaaacggaucacacuuaagagaguguccauugagggaguucugucugccaucccucugcauacgcucaaagauaaggcuggcaaacccgugauugggagcgacggcaagccggucuuuggagauuacgugcagaccuccaacaaucaccacaucgccuucuauauugacgauaagggcaaccugcaggacaauccugugucuuucuucgaggcggccgaacggaaaagccaggggguccccguuaucgaccgcagauacaacugugauaagggauggcauuuuguguucacaaugaaacaaaaugaguacuucguguuucccaacgaagcuaccggcuucauuccuuccgaggucgaccuucuggaugaagccaauuauugcaucaucagcccgaaccucuaccgggugcagaagcugucuaaggcuuccgggcgcgacuauugguuuagacaccaucucgagacaaugcugaaugaugaccuucggcugaagaacagcaccuucaaacgcauucagucucugaagggacucgaggauaucguuaaggugagaauuaauuccaucggcaaaauugucgccguggggaaguacgacuga

SEQ ID NO: 4337 - RNA, 4128 nt, Artificial Sequence
  Cas9 variant
auggagaccaaguucacauacuaucugggccucgacauggggacggauagccugggaugggccgugaccgacuccucuuaccacauccuuagagcuaaaggcaaggaucuguggggaguccggcucuuucccgccgcggaaacaagcguugaccgcagaaccuaucgggugaaccgcagacggcgccagagagagguggcucggauuggggcccugaaagaacuuuucgccgaugagaucgaaaaggucgacccuggcuuuuucgugcgccuggaugaguccaaauuucauauggaggacagaucugaaaauaacaagcaaaaguacggacucuucgcugauaaacuguuuagcgacgccgaguauuacaagaaauauccgacaauuuuccaucugcggaaggaacuccuggaguccgaggaaccccacgauguucgccuuguguaccuggcucuccugaauauguuuaaacacagagggcauuuccuuaacucuagccugcagaucgagggcgaaaauuccaacauugccgagagcuaccagauguuugucgacacccucaaggaugaagaacuggacuucccugaacaggugucuggcgaacggcugcaagagaucuuucgcuccagcgacucuagaaagaaaaagguugaaaaucuccuggcggagaugaaccuuuccaaaaagcagaaacgggaaauccaguucgugaaucugauuugcgggcucaagggaaaacugagcgagcuuuuccccgauaaggaguaugacgaagaacagaagaaaaucgccuuuucuuuccaagauuccgacuacgaagauaaggagaacacaauucaggaacugcucgacgagagcgagaugaauaugaucuaugcugucaaagccgugcacgauuccggcgugcugucugggauuaugaacggagaaagauaccugagcgucgcucgcguugccuccuaugagaagcacaaaaaggaccuccagauccugaaggauauucuuaaaaaguacgacaccaaagaauauuuugagauguuccggaaugagagcgaaaagucugagaacuacuccgcguacgugggcagcgugaaauaucaugggacguuuagacgcggacugucuggcggcaagcaggaagaucucuacaagcacaucaaaaagguccuggggaaauucccucaagacgacgagggagugaccuauguucuugaagagaucgagacagagagcuuucugcccaagcagcucaccgccuccaauggcgugauuccuaaccagguccaugcucgggagaugcuggccauccugaaacacgcugaacucuaccugccguuccuucaagagaaggaugacacagggcugucugugagcgaaaagauucucaaacuguuuauguuccagauccccuauuacguuggaccucugggccaggaguauaaggauaaaaagggguacaacgugugggccgagagaaaagaacccggaaagauuuacccuuggaauuuugaggaaaagaucgacgucaagaaguccgccgagaaauucaucggccgcauggugcggagauguaccuaucuuagcggcgaacaggcucuccccaagcaaucucugcuguacgagaaauuucagguccucaacgagcugaauaaccuucgcauuagaggggaaaagaucccggugucccugaaacaggagauuuaucacgaucucuucggagacggcaagaagguuagcaugacgcggcugacaaauuaccugcuucagaacggggugaucucuuccgaagagaaagauagcugcauuuccggaaucgacggcggguuccauaauucucucagcuccgucggcaaguuuaaaggaguguucggcgauaccguucacacagacgagcaucgcaagaugaucgaagauauuaucuuuugggggaccguguucggagacggcaaaaagcugcugaaggagaaagucgaagagguguaugggaaccaacucaccgaagcgcagaagaaacggauuuuuggauucaaguuuucuggcugggggagacugagcaaagccuuccuuacaauggagggcgcuuccaaggauaauggagagaucaagggccugauucaggccaugugggacacgaacuguaaucucauggaacugcugagcgagcgguuuaccuacaaagacaaacuuaacgaaauggugacaaccgccgagaaaccucucugcgaauggaagaucgaggaucuggacgagauguaucugucugcucccguuaaacgcauggucuggcagacaauuagagugguggaugaaguccaacagaucaugggguguccucccaagcggaucuucguggagaugaccagauccgacggagaaaaaggcaagcgcacgguuagccggcagaagaaacucguggaucuguacaaggcccuugggaaagagggaaagauuuggucugaggagcugaauaacacacccgagggccaguuuagaaucaaaaagcucuaccuguauuaccugcaaauggggaagugcauguauaccggcgaauccauugagcuugaaccucucaugaaugacaaccaccuguacgauaucgaccauauuuauccgcgccacuucaucaaagaugacaacaucagcaauaaccugguccucgugaagaaagagagaaaugcgcacaagucugauagcuuucccauugagccugaaauccggaacaaaaugaugcccuucuggaagucccugcgcaagaaaggauuccuuaccgaggaaaaguacaauagacugacacggaugagcgcuuuuaccgacgaggaaaaagccgccuucauuucucgccagcucguugagacaucccagggcacgaaggcuaucacccaaauuuuuaaacaggccuucgcugauagcgagaucguguuuuccaaggccucugucgugagcgcguucagacagaaguuugacuguuauaaaguucggugcgugaacgacuaccaucacgcccaugaugcuuaccugaauaucgucgccgggaacacauaucgcgugaaguucaccuccaauccucugaacuuuauuaaagaagcuaagaaaaaucccaacucuagagagaaucgguacaacauggacaagacauucgaaugggaugugacccgcaauggagagacggccugggucgcgcagagcaacgaaaacccgggcaccauccaacuuguuaagaaauaucugaauaagaacuccccucucauuacaaaaaugguguacgagaagcacgggggaaucacccagaaagccacaauuuggucugcuaagaaagccgagagcggcaauaccgacgcuuauauccccgugaagaugaacgauccuagacuggccgacgucacgaaguacgggggcgugacaaccaucgccguugcuggauauacacuccuggaauacaaagcgggcgggaagaccgugcggucccuugaggcccugcccauuuaccucggaggcagcaaaaaucugaccgaggagcagauggucgaauauuuuucuaacauccugcagcaagagaauaaggagaaagugguuuccgaugugauuaucagaaagaagaugauuccuagcgggucucuuaucaaauacaacggauucuauuacuaucuggcuggcaagacaggcaaucgcauuguccucaucuccgccgugcagcugugucuccccauggacacgaugcuguacaucaaaaagauugaaaaagccugcagcaccgggaacuucgaggaaaaggauaagaauggaaaacagguucuuucuaagcagcaaaacgaguuuguguaugagcugaucauugaaaaauaccagcaguccaucuucaagaaaaaggucggcgcuauuggggacacaaucaucgagaagcgggaaaaauuugccgagauuagccucgaggaacaauguaaggugcugaugcagaucuuccugaauuuucaguccggaauuggcguggaucuuaccagcgucgacgggucuaacaaaagcggaguuacauaccugaauaagaaaaucaugaacgcgcaggagcucaagcugauugaccaauccgugaccggcguguucucuagagaaaucgaucuccugacgaucuga

SEQ ID NO: 4338 - RNA, 4128 nt, Artificial Sequence
  Cas9 variant
augagcaacaaguccuacucuaucggccuggacauugggaccaauagcgugggaugggccgucaucacagaugacuauaaaguucccuccaagaaaaugaaggugcucggcaacacggauaaacacuucauuaagaagaaucugaucggggcccuucuguuugacgagggaaccacagcugaagauagacggcucaaacgcaccgcgagacggcgcuacacaagacggaagaaccgccugagauaucuucaggagauuuucucugaagagaugagcaaaguggacuccagcuuuuuccaucggcuggaugacucuuuucucgucccugaagauaagcgcggcuccaaauacccgaucuucgcuacccuggccgaggagaaggaauaucacaagaaauuucccacaaucuaccaucugagaaagcaccucgccgacagcaaagagaagaccgaucugcggcuuauuuaucuggcucucgcccauaugaucaaauaccgcgggcacuuccuguacgaagagucuuuugacauuaagaauaacgauauccaaaagauuuucuccgaguuuaucagcauuuaugacaauacguucgaagagucuucccuuaucggacagaacgcucagguggaagccaucuuuaccgacaagauuagcaagucugcgaaaagagagcggguucugaaacucuucccugaucagaaauccacaggccuguucagcgaauuucugaagcucauccugggcaaucaagccgacuucaaaaagcacuuugaucuugaggagaaggcuccccugcaguucuccaaagacaccuacgaugaagaccucgagaaccugcuugggcagauucgcgaugacuuugccgaucuguuccucguggcuaagaaacuguaugacgccauccugcucucuggcauucugacagucaaggaucuuagcaccaaagcgccucuguccgccagcaugaucgaacauuacgagaaucaccagaaggaccucgcugcccugaagcaauuuauccagaacaaucuucaggaaaaauaugacgagguguucucugaucaguccaaggacggauacgcuggguauauuaacggaaaaacgacacaagaggccuuuuacaaguacaucaaaaaucugcucagcaaguucgaaggcgccgauuauuuucuggacaagauugagagagaagauuuccugcggaaacagagaaccuuugacaacgggucuaucccccaucagauucaccuccaagagaugaacgcuauccugcaccgccagggagaacauuacccuuuccuuaaggagaauaaagagaagaucgagaaaauucugaucuuccggauuccguauuacguuggcccccucgcgagaggcaaccgcgauuuugccuggcugacacggaauagcgacgaagcuaucagaccuuggaacuucgaagagauuguggauaaggccuccucugccgaggacuuuaucaauaaaaugaccaacuaugaucuguaccuucccgaagagaagguccucccuaagcacagccugcuguaugaaaccuucgcuguguacaaugagcucacaaaagugaaguuuauugccgaagggcugacgcgcuaccaguuccuugacaaaaagcagaaaaaggauaucuuuuauaccuucuuuaaggcggaggacaaacggaaggucacagagaaagacaucauucauuaccugcacaccguugauggauaugacggcaucgaacucgaggggauugaaaagcaauucaacgcuucccugagcacauaccaugaucugcuuaaaaucauuaaggacaaggaguuuauggaugacgauaaaaaugaagccauccucgagaacaucgugcacacccugacgauuuucgaggacagagaaaugaucaagcagcgccuggcccaguauaauucucucuuugaugagaaagugauuaaggcucugacacggagacacuacaccggauggggcaaacuuuccgccaagcugaucaacgggauucgcgacaagaaaagcggaaagaccauccucgauuaucugaucgacgauggcgaaauuaaucggaacuucaugcagcugauccaugacgacggccuuucuuucaaagagauuauccaaaaggcucaggucuuugggaaaacaaaugaugugaagcagguugugcacgaacuccccggauccccggccauuaaaaagggcauccugcagagcaucaagauugucgacgagcuggugaaaguuauggggcaugcgccugaguccaucgugauugaaauggccagagagaaccaaaccacagcucggggaaagaaaaacucucagcagcgcuacaagagaaucgaagauagccucaaaaaucuggccuccggccuugacucuaacauucugaaggagaaucccacggauaacguccagcuccaaaaugaccggcuguuccuguacuaucuucagaacgggagagauauguacaccggcaagccucucgagaucaaucagcugagcaacuaugacauugaucacaucaucccccaggcuuuuauuaaagacgauucccuggacaaucgcgugcucacaagcucuaaggacaaccggggaaaauccgauaauguccccagccuggaagugguugagaagaugaaagccuucuggcaacagcuucuggacucuaagcucaucuccgaaagaaaguuuaacaaucugaccaaagcggagcgcgaaagaggcgggcugaacgagcuugauaaggugggauucauuaaacggcagcuggucgagacacgccaaaucaccaagcacguggcccagauucucgacacgagauuuaauaaagaaguuaccgagaaggauaagaaaaaccggaacgugaagaucaucacacugaaaagcaaucucgucucuaacuuccgcaaggaauuuggccuguacaaagugagagagauuaaugacuaucaucacgcucaugaugccuaccuuaacgcugugguugccaaggccauccugaagaaauauccuaagcucgaaccggaguucgucuacggggaguaccagaaauaugaccugaagcgguacauuagccgcuccaaagaucccaaggacaucgaaaaagcuaccgagaaguacuuuuucuauagcaaucugcuuaacuucuuuaaggaagaggugcaguaugcggauggaacaauugccaaaagagaaaauaucgaguacucuaaggacaccggcgagaucgcuuggaacaaagaaaaggauuucgccacggugaaaaagguccugucccucccucaagugaauauuguuaagaaacgggaggugcagacagggggcuuuagcaaggaauccauccugcccaaaggaaacucugacaagcucauuccucgcaaaaccaaggacauccugugggagacaaccaaguauggcggguucgauagccccgucauugccuacuccauccuucugauugcugacaucgagaaaggaaagucuaaagaacucaagaccgugaaaacacugguuggcaucacgauuauggagaaggccaccuuugaagagaauccgaucacauuccuggaaaacaagggguaccacaaugugagaaaagagaacauucuuugccugccuaaguauagccucuuugagcuggaaaauggacggagacgccuccuggcguccgcuaaagagcuucagaagggcaacgaaaucguccugcccguguaccugaccacacuccuguaucauucuaaaaaccuucacaagcuggaugagccugggcaccucgaauacauucagaaacaucggaaugaguucaaggaccugcucaaccugguuagcgaguuuucccaaaaguauauccuugccgaugccaaucuggagaaaauccagaaccuguacgcugacaaugaacaggccgauauugaaauccucgcgaacagcuucauuaaucugcuuaccuuuacgacacugggcgcucccgccgccuucaaguuuuucggaaaagacaucgauagaaagcgcuauaccaccgugucugagauucucaacgcuacacugauccaccaauccaucaccggccucuacgaaacacggauugaccugagcaaacuuggggaggauuga

SEQ ID NO: 4339 - RNA, 4128 nt, Artificial Sequence
  Cas9 variant
auggaaaagagcuacuccaucggccuggacauugggaccaacucugugggaugggccgucaucacagaugacuauaaaguucccgcuaagaaaaugaaggugcucggcaauacggauaaaaaguacauuaagaaaaaccugcuuggggcccuccuguucgacagcggagaaaccgcggaggugacaagacugaagcggaccgcucgcagacgguauacacgcagaaagaaucggcuucgcuaccugcaggaaaucuuugccaaggagaugaccaaagucgaugaauccuucuuucaaagacucgaggagucuuuccugacagacgaugacaagaccuuugauagccacccuauuuucggcaacaaggccgaagaggacgcuuaucaucagaaauuuccgacgaucuaccaucugcggaaguaucucgccgauucccaggaaaaagcugaccugcgccuuguguaccuggcccucgcgcacaugaucaaguacagagggcacuuccugauugagggagagcuuaaugccgaaaacaccgauguucagaaacuguuuaauguguucgucgagacauaugacaagaucguggacgaaucucaucucagcgagauugaaguugaugcuuccagcauccugaccgagaaagugucuaagucccggcgccuggagaaccucauuaagcaauaccccacagaaaagaagaauacccuguuuggcaaccuuaucgcccuggcucucggccugcagccuaauuucaaaacgaacuuuaaacuuagcgaggacgccaaacugcaguucucuaaggauacauaugaagaggaccucgaggagcugcuggggaaggucggagaugacuacgcggaucucuucauuuccgccaaaaaucuguaugacgcuauccuucugagcggcauccucaccguggaugacaacucuacaaaggcgccccuguccgcuagcaugauuaaaagauacguggagcaccacgaagaucuugagaagcugaaagaauuuaucaagauuaauaagcucaaacuguaucaugacaucuucaaggacaaaaccaagaacggguacgccggauacauugauaacggcgucaaacaggacgaguuuuauaaguaccugaagaccauccucacaaaaaucgaugacuccgauuauuuccuggacaagauugaacgggaugacuuucuucgcaaacaaagaacguucgauaaugggucuaucccucaccagauucaucugcaggagaugcacagcauccuccggagacagggagacuacuaucccuuucugaaggagaaccaagccaaaauugaaaagauccugaccuuccgcaucccuuacuauguuggcccgcuugcucggaaagauuccagauuugcgugggccaauuaccacagcgacgagcccauuacaccuuggaacuucgaugaagugguggacaaggagaagucugcugagaaauuuaucacccgcaugacacucaaugaccuguaccugcccgaagagaagguccucccuaaacauucccacguguaugaaaccuucacgguuuacaacgagcugacaaagauuaaauaugugaaugaacagggcgagagcuuuuucuucgaugccaacaugaagcaggagaucuuugaccaugucuucaaggaaaaucggaaagugaccaaggccaaacuucugucuuaccucaacaaugaguuugaagaguucagaauuaacgaucugaucgggcuggacaaggauagcaaauccuuuaaugcuucucuuggaaccuaucacgaccucaagaagauucuggauaagagcuuccuggacgauaagacaaacggccaaaucaucgaagacauuguucucacccugacacuuuuugaggaucgcgacaugauccaugagcggcugcagaaauacuccgauuucuuuacgagccagcagcucaagaaacuggaaagacgccacuauaccggguggggacggcugucuuacaaacuuauuaauggcaucagaaacaaggagaacaauaaaacaauucucgacuuccugaucgacgaugggcacgccaaccgcaauuuuaugcaacugaucaacgacgaaucccucagcuucaagaccauuauccaggaggcccagguggucggagauguggacgauauugaagcugucgugcaugaccugcccggcucuccggccaucaaaaagggcauucuucaguccguuaaaaucguggaugagcuggucaaggugaugggggacaauccugauaacaucguuauugagauggcccgggaaaaucaaacaaccggauacggcagaaacaaaagcaaucagcggcucaagcgccugcaggacucccugaaggaguuugggucugauauccuuagcaaaaagaaacccuccuauguggacucuaaggucgaaaacagccaccuccagaaugacagacuguuccuguacuauauucaaaacggaaaagauauguacacgggcgaggagcucgacaucgaucggcuguccgacuaugauauugaccauaucaucccucaggcuuucauuaaggauaauagcaucgacaacaaggugcuuaccucuuccgccaaaaauagaggcaagagcgaugacgugcccucuauugaaaucguucgcaaccggagauccuacugguauaaacuguacaagagcgggcucauuucuaaacgcaaguuugauaaccugacaaaggcugagagaggaggccugaccgaagccgacaaagcgggguucaucaagcggcagcuugucgagacacgccagauuaccaaacacguggcccaaauccuggaugcuagauuuaauacgaagcgggacgaaaacgacaaagugauccgcgaugucaaggugauuacacucaagagcaaucugguuucccaguucagaaaagaguuuaaguucuacaaagugcgggagaucaacgacuaucaccaugcccacgaugcuuaccucaaugccgucgugggaaccgcgcugcuuaagaaauaucccaagcugacaccugaauuuguuuacggcgaguauaagaaauacgacgugcgcaagcucauugccaaaagcucugaugacuauuccgaaauggggaaggcuaccgccaaauacuucuuuuacagcaaccugaugaauuucuuuaagaccgaggucaaauaugcugauggaagaguguucgaacggccggacaucgagacaaacgccgauggcgagguuguguggaauaagcagaaggacuucgauauuguccgcaaagugcuguccuacccccaagugaacaucgucaagaaaguugaagcccagacagggggcuuuucuaaggagagcauccuuuccaaaggagacucugauaagcugauuccuagaaagaccaaaaagguguauuggaauacgaaaaaguacggcggguucgacagccccaccguggcuuauuccguccucgugguugcggacaucgaaaaaggaaaggccaagaaacugaagacagugaaagagcucgucggcauuucuaucauggaacggagcuuuuucgaggagaacccuguguccuuucuggaaaagaaaggguaccauaauguucaggaggauaaacuuauuaagcugcccaaauauagccucuucgaauuugagggaggcagacgccggcugcuggcuucugccaccgagcuucagaaggggaacgaagugaugcugccggcccaccucgucgagcugcucuaccaugcucacagaaucgacuccuucaauagcacggaacaccugaaauacgugucugagcauaagaaagaauuugagaagguucuuuccugcguggagaacuucagcaaccuguaugucgauguggagaaaaaucugucuaaggugcgcgccgcggcugaauccaugacaaacuuuagccucgaagagaucuccgccagcuucauuaaucugcuuacccugaccgcccucggcgcuccugccgacuuuaacuuccugggagaaaagaucccccggaaaagauacacaucuaccaaggagugucucagcgcgacacugauucaccaauccgucacgggccuuuaugagacccgcaucgaucugucuaaacugggggaagaguga

SEQ ID NO: 4340 - RNA, 4128 nt, Artificial Sequence
  Cas9 variant
augaccaagaucaaagacgauuacauugugggccuggacaucgggacagauagcugcggaugggucgccaugaacuccaauaacgacauucucaagcugcagggcaaaacggcuaucgggucuagacuuuucgagggaggcaagagcgccgcggaacggcgccuguuuagaaccacacaccggcgcauuaaaagacggcgcuggagacucaagcugcuugaggaguucuuugaucccuauauggcugagguugacccuuacuucuuugcccggcugaaggaauccgggcucucuccgcuggauaaacgcaagaccgugagcuccaucguguuccccacaucugccgaggacaaaaaguuuuaugaugacuacccuaccaucuaucaucugagauacaaacucaugacagaggaugaaaaguucgaccugcgggaggucuaucuugcuauucaccauaucauuaaguaccgcggaaauuuucuguacaacaccagcgugaaagauuucaaggccuccaaaaucgacguuaagagcucuauugaaaaacucaaugagcuguaugagaaccuuggccuggaccucaauguggaauuuaacaucuccaauacggcugagauugaaaagguccugaaagauaagcaaaucuucaagagagacaaagugaagaaaaucgccgagcuguuugcgauuaagaccgauaacaaagaacagagcaagcggaucaaggacauuucuaaacagguugccaaugcugugcucggcuacaagacacgcuucgauaccaucgcccugaaagagauuuccaaggacgagcuuagcgauuggaacuucaaacugucugacaucgaugcugacuccaaguuugaagcccucauggggaaucuggaugagaacgaacaggcgauccuucugacaauuaaggaacucuucaaugaagucacccugaacggaaucguggaggacggcaacacgcugagcgaguccaugauuaauaaauauaacgaccacagagaugaccucaagcugcuuaaagaagugaucgagaaucauauugaucggaagaaagccaaggaacuggcucucgccuacgaccuguaugucaacaauagacacgggcaacuucugcaggcuaagaaaaagcucggaaaaaucaagccccgcucuaaagaggauuuuuacaagguugugaacaaaaaucuggacgauagccgggccuccaaggaaaucaagaaaaagauugagcuggacagcuucaugccuaaacagagaacaaacgccaauggcgugauccccuaucagcuccaacagcuggagcuugauaagauuaucgaaaaccagucuaaauacuacccuuuucugaaggagauuaauccggucuccagccaccucaaggaagcucccuauaaacuggacgagcugauccgcuuccgggugccuuacuauguugggccccuuauuucuccuaacgagagcaccaaggauauccagaccaaaaagaaucaaaacuuugcguggaugaucagaaaagaagagggacgcauuacacccuggaauuucgaccagaagguggaucggaucgaauccgccaacaaguuuauuaaaagaaugaccacaaaggacacguaccucuucggcgaggacguccugccggcuaacucucugcucuaucagaaauuuaccgugcugaaugaacuuaacaauauccgcauuaacggcaagcggaucagcguugaucugaaacaagagaucuacgagaaucucuucaagaagcauacaaccgugacagucaaaaagcuggaaaacuaucugaaagagaaucacaaccuugugaaggucgaaauuaaagggcucgccgacgagaagaaauuuaauuccggacugaccacguacaacagauucaagaaucugaacaucuucgauaaucagauugacgaucucaaguaccgcaacgacuuugagaaaaucauugaguggagcacaaucuucgaggauaagucuaucuauaaagaaaagcugcgguccauugacuggcuuaaugagaaacagaucaacgcccugagcaacauuagacuccagggcugggggcggcugucuaagaagcugcuugcucaacuccaugaucacaauggacagaccaucauugaacagcugugggacucccagaacaauuuuaugcaaaucgugacccaggccgauuucaaagacgcgaucgcuaaggccaaccagaaucugcucguugccacaagcguggaggauauucugaacaaugcuuacaccuccccugccaacaaaaaggcuauccgccaggucauuaaagugguugacgacaucgugaaggccgcgucuggcaagguccccaaacaaauugccaucgaauuuacaagagaugcugacgagaauccuaagcggagccagacgagaggguccaaacuucagaagguguauaaagaucugucuaccgagcucgccagcaagacaauugcugaggaacugaacgaagccaucaaggacaaaaagcuggugcaggauaaauacuaucuuuacuucaugcaacucggacgcgacgcguauaccggcgagcccaucaauauugaugagauccagaaguacgacauugaucacauccugccccaguccuuuauuaaagacgaugcccuggacaaccggguucucgucagcagagcugugaauaacggcaagucugacaaugugccugucaagcuguucgggaacgaaauggccgcuaaccuuggaaugacaauccgcaaaaugugggaggaauggaagaauaucggccugauuuccaaaaccaaguacaacaaucuccugacggauccggaccauaucaacaaauauaagagcgccggguuuauuagacggcaacugguggagaccucucagaucauuaaacuuguuuccacaauccugcagagccgcuaccccaauaccgaaaucauuacagugaaggccaaguauaaccacuaccucagagagaaauucgaucuguauaagucucgggaggucaaugacuaccaucacgcuaucgaugcguaucucagcgccauuuguggaaaccugcuuuaccagaauuacccuaaccugcgccccuuuuucguguauggccaauacaaaaaguuuuccagcgacccugauaaagaaaaggcuaucuucaauaagaccagaaaauucucuuuuauuucccagcuccugaagaacaaaagcgaaaauuccaaggaaaucgccaaaaagcugaagcgggccuaucaguucaaauacaugcuuguuucucgcgagacggaaacaagagaccaggagauguuuaagaugaccguguauccccgguucagccaugauacagucaaagcuccgcgcaaccugauuccuaagaaaauggggaugucccccgacaucuacggcggauauaccaauaacucugaugccuacauggugaucguuagaauugacaagaagaaaggcaccgaguacaagauccucgggauuccuacacgggaacuggugaaucucaaaaaggcggagaaagaagaucacuauaagagcuaccugaaagagauccuuacgccccgcauucuguauaacaagaacggaaagagagacaaaaagaucaccuccuuugaaaucgucaaaucuaagauuccuuacaaacaagugauccaggacggcgauaagaaguucaugcucgggagcuccacauauguguacaaugcuaaacagcugacccugagcacagagucuaugaaggccauuaccaacaauuuugacaaagauuccgacgagaacgaugcccuuaucaaggcuuaugacgaaauucuggauaaagucgacaaguaccucccccuguucgauaucaauaaguuucgggagaaacuccacagcggaagagaaaaguucaucaaacugucucuugaggacaagaaagauacgauucugaagguucuggagggccuccaugacaacgccgugaugacaaagaucccgaccauugggcuguccaccccucuuggcuuuaugcaguuccccaauggagugauccugagcgaaaacgcgaaacucauuuaccaaucucccacaggccuguucaagaaauccgucaagaucagcgaucucuga

SEQ ID NO: 4341 - RNA, 4131 nt, Artificial Sequence
  Cas9 variant
augagcaacuucgacaaucacaaggauuccaucugcaaacauaagggccugaaaaaggggaacuacuauauuggacucgacaucggcaccaauucuguggggugggccgcuacaaacgagcaguacgaacugcuuaaauuuaagagccacaagauguggggauccagacuguucgccgaggcgcaaacggcugucgauacccggaugaaacgcucugccagacggcgccuccagagacggaaguuucgccugauucuucuggaaagccucuucuccaaagagaucaaugccguugacgaaacauuuuucaugagacugcaugagucuaacuaucacguggaggauaagaccaaucuggugaaauacacacucuuuauugacaagaacuauaccgaugucgacuacuauaaggaguuccccacaaucuaccaucugcggcaccaccuuaugaccgagggcacgaaagauauccgccugcucuuucuggcuauucaucacauccuuaaguacagagggaauuuccuguaugggaaaaaggaauuuagcguggacggcgagauguacuccguucuccggagcacccuggaggaacugggcuucgggucuuauguggaggaugaaaacguccuccaguccauugccaaucuggugcuugaccgcggaaucgcuagaagcgagaaaguuaagcagauugaaccucugaucgcccaaggcaaaaagcucucuuccguggagaagaaccggcugaaagcgugggccuaccuuauuauggggcugaaggcuaaucucgucaaccuguuuacagaugaggacguggaagugguccugccggaggaaaaagaguucaagagcaucaaucuccaugaaggaaucuaugaggacguucgcgaugccuacgaggacgcuuggggcgauagauucgccauuguggaccaguguaaagugcugcacgauaucauugucaucucuuccauuaucaagcccgggcagagccuuuccgaagcgaagaucgagucuuauaaccagcacaaagaagaccuggugcuccuuaagagcguucuuaaagaggauaagaaacuguacgacgauauguuuguggucgacauugauaagggaaccaacuacgugaaguauaucaaacaaggcguuaauggcaacacauccaccacgcaggaagccuucuacaaguaugugcggaaagucgugagcguccucccugagacagagaauaccagaugcauugugcagaagcuggaagaggggacauuucugccccuccagcgcaucucuaaaaacggaguugugccuuaccaacugcauaaggaggaacuuguccggauucuggagaaggcuaaacucaauuuccccuuucugaacgaaguggaggacggccugaccguugccgacaagaucaucuccauucuugaguucaaaaucccuuauuacguggggccgcucaaucccacccacagcauugaaaacggaggcuuugcuugggucgugagaaaggaagccggacaggugcugccuuggaauuucgagcagaaaguugauguccaagccucugcugugaaguuuaucgagaaccugacaaauaaauguacguaucucauugaccaggaugugcugcccaaguacagccuucuguacgcggaguucucccuccugaacgaacugaauaacauccgcgucaaugacaagccucuucccgccgaugugaaacaggcuuuuauucgggaccauuucaucucucuccaggauagcaagaccgccaccaaaaagguuguggccaaauaucuggucgacaacaacuacgugucccaaccgccuaucauuacaggaauggaucagcagaucgcuacaaagcugaccagccacagagacaugacgcgcauucucggcgaacauuuugauuaugccauggcggaggacaucauucgguacaucacaaucuucggcgaaucuaaggauaugcugagacagguucuuaaaaauuauuacggggaccgccugaccaccgagcaaauuaagaaacucggaaagcugacauauaccggcugggggcggcuguccaaaaaguuccuuagcgacaucuggggaaugaagaaaaacgaugacgaugcugaggccggcacaauuaucgaacacaugagagaggggcaggaaaaucucaugcagcugcugucuuccagcuacuccuuuauugacgugguccaggaguacgugacgaacguucucggcgccaaggagaaaaccgcuuucgaaaugcuggaggaucuuucucugagccccauggugaagcgcuccgucuggcaaacacuccggauccuggacgaaaucgugucuauuagaaaagagcugccuaagaagaucuuuguggaagucgcccggaccaauaaagcugauaagaaacgcacacagagcagaaaggcccuucucgaggagcuguaugaacagauuaaagacgaggauguucacgugcugcagcaagaacucgaguccaaggaagacagcgcgcugaacucuaaaaagcuguaccuguauuucacccagaugggacggugcauguacuccggcagacgcaucgauauucaugagcucuuuacggacaccuaugauaucgaccacaucuacccccggagccugacaaaggacgauucuuggcauaauauugugcuggucgagaaacagcuuaacgccgaaaagaccgacagauuccccauccuguccgcuauucaaagcaaacagaagggguuuuggaaacuccugugggaucgcggauucaucucugagaagaaguaugacagacucgugcggacaaccgaucugacggacgaggaacuuaaucaguuuauuaaccgccagaucguuagcacaaaucaauccgugaaagccgucaccacacugcuccaccagcuguacccugaaaccgaggugguuuucagcaaggcugagaacauuucugauuuuagacgggacuacggcuucgugaaaguccgcuccaucaaucaccaucaccaugccaaggaugcguaucugaacaucgugguugggaauguguaccacgaaaaauuuaccaagaacuuccuuagcuucgccaagcagaaaggaacacauagaacguauaaccugaccaagauguuugaguacgaaauuaaacucacagaggaauccaagaaagucaucugggacccgaauauucacauggauaucgugaagaagaugaugaaaucuaacgacgugcgggucacccagcgcgcuguuccccaaaagggcgggcugagcgacgagacaauuuauaaaaagggcaucgccaaaagaggaguguaccucccucugaaguccucugaugagcgggugcgcgacgucgaaaaguauggcgggagaaccagcaucacgauuuccgaguacaucauucuuaauauccgggauacaucugaccaggauagaauugaaaucuucagccugccccucuacaucgcuggcaaaaaggacauucacaaagccaucgaggaggccuaucuguccaccuguaagaaaccugcuagcgugguugauauucagauccuguaccgcggacuuuauauugggucuaaggugaacaucaauggauuuaccuacuauaugggcgggaaaacaggcuccaacgucagcguggacucugcgguugauguggucauggacauuaccuccagcguguacaucaagcugcucgaaaaggucgccaucaaaaagauugaaaauucuaaaacauuccggaucgaaaacauuaagacguccuauaaucauaaagaggugaccguuagcaaggaacagaacaucgcucuguaccaagagcuccugaagaaacuugauacaccccuguuuuccaagaugaaaggaaauaagcuggaggaguucagaaccgugggcuuugacacauucauugcccucagccuggaagaucaggccucuguccuucuggaagugcucaacguucugaccaauuuuaaaacgaagcgcgacaucaccaagaucgggaugacaagcucccggucuacccucggaauuaacaucagcaauacagagcaguucuccgugauuaccacaucuaucaccggccuguacgaacaagagauuaaaaucaaguga

SEQ ID NO: 4342 - RNA, 4131 nt, Artificial Sequence
  Cas9 variant
augaccacaaagaacagagagaaaaauaacaaguuccacaaagccagcccccuguacacgcucggccuggacaucgggaccacauccgugggauuuaccgcuauugaugaagcccagcggccuaugcgcgcgaagggcaaaacagucaucgggguuagacuuuuccaagagggacagucugcugugggccggaagaauuuucgcaccacaagacggcgccugaagagacggcgcagacggcucaaccugcuuaaacaguucuuuagcgccccgcugcgcaagauugaccccaccuucuuuaaaagacucaaggccuccucucugagcccugcugauaaacggcgcuaucuggcccccgggcuguucccuaauggaggcgacaucaaguuuuaccagaaguaucccacgauuuaccaucugagacuugcucugaugaccgaaaaacggccuuucgaucucagagagguguaucuggccauccaccauaucgucaaguaccgcggcaacuuucuuaauccgcugcccguguccgcguuccgggggagaaaccaacgcuuugaagaccaguucucugagcucaaucagcuguauaaaagccuggagggagaauccccuuuccaguuugaugagaagauuuucagcgaacucgacaaacaacugcuuguuaacgauggccggaagaucgacagacagaaacagcuggccaagcgcguguuuauuaagacaaaugagaaacggaucgauucucaccaucagaagauugcuuccgccuucagcaaagcugucuuuggguacaaguucagacccgacgugcuccugaacucugauccuaaugaguccaucgacgaauuuauuaaauucggagacgaggauuuugacgauaaacuuguuauccugcgcgaaagccucaacgccacccaaaaggagauccuggcggugacacagcggauuuacucucagaucauucugaaugaaaucguccccuccagagagacccucagcgaggccauggugucccgcuaucaaaaacaccacucugaccugcagcuucugacggaggcuugcaagaaaaugacaaaggccaaagcugcccggauucaggccgcuuacaccgauuauaucggcaagggggacggacauaagcucgugcacgaucaguucgucgcgcugaucaaaaagaaccuugacccgagcgaagaaggcagagaucuggccgagcggcucgcucaagacgauuuuaugccucugcagcgcacaccccugaacagaguuauuccucaucagcuccagcaagaggaacuggaccggaucauugagaaucagggcgaauacuaucccuuccuuaaaacccugaaccccaauagaucccgcgccgggguggccaacuaccagcucgacgagcuggugagcuuucggaucccuuauuacgucggaccgcugauuaccgcuacagaucagcuucacacgucuggcgccaaguucgcguggaugaccagacgcgcugccggggaaaucacacccuggaauuucgaccaaaaaguggauagacucgccuccgcuaaccaguuuauccggcagaauaugccuaaggacaaccaucugcuggaggccgauguucuccccgcuaauagccugaccuaccagcgcuaucuugugcuggacgaacucaacgccgucaaggugaaucacaaaucucugacaguuagccaaaagcagagaauuuucaacgaucuguuuaaacggcagcgcaccgugacgguccuuaaucuccaaaacuaccugaaguccaucgagaaacugccuacacuccccgugauuaccggagucucugacagcgagagauucaagaccacacuguccaccuaucuugauuuuaaaaauaucuucggcgggaagguggacgauagcucucagaaggaaaaauuugagaagauuauccuguacgcgacaauuuucgaagaccacgccguuuauaaagcuaagcucgaucagaucgacuggcugggacagcaacagaaaacggaccugcuuuccaagaacuaccagggcuggggccagcucagcgagaagcugcugcucgggcugaaaaaccaagccggacagucuauccuugaugagcuguggcagaccaauaagcgguuucgcgaaauuaugaacgaggcucauuucgccaaacagaucauggcguccaaugccgcucuccugagaaagaaaggccuggacgaugugcuuagcacagccuuucucuccccgcaaaacaagaaggcuauucggcagaccgucgaagugguugacgauaucgugaaagccauuggguguccuccccagaagaucucucugcacuucagcaaagccccugcugacgcgauccgccaugagagagauaaugccaacauuauccugcggacauauagaaaucuccccgcuaagauggucgacgaucaacugaaagccgaacuucaggccaccgcugagaagcaccaggugcuguccgacaagcucuaccuguacuuuacgcagcugggacgcgaucuuuauaccggcgagaugcugaaaaugucugaacucgagaacgacaugauugaucacaucaugccucaaacauucgccuacgacgacagcgugaauaaccggguucuggucucccagaaucauagcucucagcucgggaagaccuccggcgaaaagagcgaugcgaagaugauuagauucuggcaagugcugcgcgacaacaaacuuaucucugagcagaaguaucagaaucugacacucgauuccgaccaccugagcaaaucuacccgggaacagcugcuuaacagauaccugguggagaagaaucccaucacgcagugggucgcuagcgugcucacagagaaguauggagauaacggcacccgcguucugacaauuaacccgcggaugguguaccaaaugagacgccaguuuaaucucgucaaccugccugaagugaaugacuaugaucaugggcuugacgccuaccuggccgcuuucaucggaaacuacguugaucggagauauccccggcuccgcuccuacuuuguguauggcgacuucucuagcuccaaagagauugucuuuagacugaaucgguucaacuuucuguucgaucuugggcaggccgaacccaaugagcugaccgacugggaaaccggagagaugaucugggacaaggcggcugccaacagcgugcuccgcgauguuuaccaguauaaauuuaugcugauuucccaagccguguacucuagacagggcgcuauguucaaucagacaaucuauccugccagccaagcugccgggcggcagcucaucccggucaagaaaaacagagcgacgaagcuguacggcggauacuccggcaauguggacgccuaucuugcuauugugcgccucgggggacccaagucugaucaguaccgggucguuggcaucccuaccagaaugguggggcgccugcagagcgccaugaaacaaggagcugacacauaugccaacacccuccacaagauucugcagccccaguuuacaaaacggaagaaaaauagacagaccggcuacuaugaggaaacgacagagccuuucgccgugauccuugauaaggucuacuaucgccaacugauuaucgacgggcagcagaaguucaugcucggcuccucuaccuaccaguuuaacgcuaaacaacuggugcucagcucccgggcgagacagauucugagcggagaggaacgccuuaccgaugagaauggcucucaggaccugaucgauguuuacgacgaaauccugacaaagauugauagauauuucgagcucuacgaccaacggcacuuucgccagucccugcaugaugggagaaaacaguucaucagccuucccauucacaacguguaucgggccaaccgccugaucgaacauggaaaguacgagacccucucucagauucugaauggccuccacgcuaacacaaugaugacgaaucugagauaucuugggaucuccagcccuuuuggaaaauuccaaucucccaacggcaucaagcuguccaaggacgccguccugguguaccagagcccguccgggcucuuugaacggagaguucgccugcgggaccuuuga

SEQ ID NO: 4343 - RNA, 4131 nt, Artificial Sequence
  Cas9 variant
augaacaauaagcccuacagcaucggccuggacauugggaccaacuccgugggaugggccgucaucacagaugacuauaaaguuccuucuaagaaaaugaaggugcucggcaauacggauaaacacuucauuaagaagaaccugcuuggggcucugcucuuugacgagggaaccacagccgaagauagacggcugaaacgcaccgcgagacggcgcuacacaagacggaagaaucgccuuagauaucugcaggagaucuucaccgaagagaugagcaaaguggacauuuccuuuuuccaucggcucgaugacucuuuucuggucccggaagauaagcgcggcagcaaauaccccaucuucgcuacacuggaggaggaaaaggaguaucacaagaacuuuccuaccaucuaccaucucagaaaacaccuggccgacuccaaggaaaaagccgauuuccggcuuauuuaucuggcucucgcccauaucauuaaguaccgcgggcacuuucuguacgaggagucuuucgacaucaaaaauaacgauauucaaaagaucuuuaaugaguucauuagcaucuaugacaacacguuugaaggauccagccuuaauggccagaacgcucagguggaagccaucuucaccgacaaaauuucuaaguccgcgaagagagagcggguucugaaacucuuccccgaugaaaagagcacaggccuguuuucugaguuccugaaacucaucguggggaaucaggccgacuuuaagaaacacuucgaucuggaggaaaaggcuccucuucaauuuuccaaggacaccuacgaugaggaccuggaaaaccuccugguccagauuggagaugacuucgccgaucuuuuucugguggcuaaaaagcucuaugacgccauccugcugagcggcauucucacaguuaccgaucccucuacgaaagcgccucuguccgccagcaugaucgaccgcuacgagaaucaucagaaggaccuugcugcccugaaacaguucaucaagacaaaccucccggaaaaguaugaugagguguuuuccgaccaaucuaaagauggguacgcuggauauauugacggcaagaccacacaggaggccuucuacaaauacaucaagaaccugcuuagcaaacuggaaggggccgauuauuuucucgacaagauugagagagaagauuuccugcggaagcagagaaccuuugacaauggauccaucccccaccagauucaucugcaagagaugaacgcuaucauccgccggcagggcgaacacuacccuuuccuccaggagaauaaagagaagauugagaaaauccugaccuuccgcauucccuauuacgucggcccucuugcgagagggaaccgggauuuugccuggcugacaagaaauagcgaccaagcuauccgccccuggaacuucgaagaaauuguggauaaggcccggucugccgaggacuuuaucaauaaaaugacgaacuaugaucucuaccugccggaggaaaaggugcugccuaaacacucccuucucuaugagaccuucgcugucuacaaugaacugacaaagguuaaguuuauugccgagggacugagagacuaccaguuccucgacagcggccagaaacagcaaaucgugacccagcuguuuaaggaaaaacgcaaggugacagagaaagauaucauucaguaucuucauaacgucgacucuuacgaugggaucgagcugaagggaauugaaaagcaguucaaugcgagccucuccaccuaucacgaccugcugaaaaucauuaaggauaaagaguuuauggacgauucuaagaacgaagcuauccuugagaauaucgugcauacgcucacaauuuucgaagaccgggagaugaucaaacaaagacuggcccacuacgccagcauuuuugaugagaagguuaucaaggcucugacccgccggcauuauaccggcugggggaaacucuccgccaagcugauuaacggaaucuacgacaaacagagcaagaaaacaauccuugauuaucugauugacgauggcgaaaucaauagaaacuucaugcagcucauuaacgacgacggccugucuuuuaaggagaucauucagaaggcucaaguggucgggaaaaccaaugaugugaagcagguugugcaggaacugcccggauccccugccaucaaaaagggcauccuucagagcauuaaacucgucgacgagcuggugaaggucauggggcacgcgcccgaaucuaucgugauugagauggcccgggagaaccaaacaacggcucgcggaaagaaaaauucccagcagagauacaagcggaucgaagaugcccugaaaaaccucgcucacggccuggacagcaauauucuuaaggagcaucccaccgauaacauccaacugcagaaugacagacucuuccuguacuaucugcagaacgggaaagauauguacacaggcaagucccuugacauuaaucagcucucuagcugcgauaucgaccacaucauuccucaagccuucaucaaagaugacucccuggacaaccgcguucugaccucuagcaaggauaaucggggaaaguccgacaacgugccgagccucgaaauuguccagaaaagaaaggcguuuuggcagcagcugcuugauucuaaacugaucuccgagcgcaaguucaauaaccucacaaaagccgagagaggcgggcuggacgaacgggauaaggugggauuuauuaagcgccaacugguugagaccagacagaucacgaaacauguggcucagauccuugacgcccgguucaauaccgaagucacagagaaggauaaaaaggaccgcagcgugaaaauuaucacccugaagucuaaccucguguccaacuuuagaaaggaguuccggcuguauaaaguucgcgaaauuaaugauuaccaccacgcucaugaccccuaucucaacgccgucguggccaaggcuauccugaaaaaguacccuaaacuugagcccgaauuuguguauggcgauuaccagaaguacgaccugaagagauauauuagccggacaaaagauccuaaggaggucgaaaaagcgaccgagaaguacuucuuuuauucuaaucuccugaacuucuuuaaagaagaggugcacuacgccgacgggacgaucguuaagcgcgagaauaucgaauauagcaaagacacaggagagauugcuuggaacaaggaaaaggauuucgccaccaucaaaaaggugcugucccuuccccaagucaauauugugaaaaagacagaggaacagaccguuggccagaacgggggccuguucgacaauaacaucgugagcaaaaagaaggucguggaugccucuaaacucaccccgauuaaguccggacugagcccugagaaauacggcggguaugcuagacccacaaucgccuacuccguucucgugauugcggacaucgagaagggaaaagcuaagaagcugaaacggaucaaggaaauggucggcauuacggugcaagauaaaaagaaauuugaggccaauccuaucgccuaccuugaagaguguggguauaagaacauuaaucccaaccugaucauuaagcucccuaaauacucucuguucgaguuuaauaacggacagagacgccugcuugcuagcuccaucgaacugcagaagggcaacgagcucaucgugcccuaucauuucaccgcccugcucuaccacgcgcagcggauuaauaaaaucucugaaccgauucauaagcaauaugucgagacacaccagagcgaauuuaaagagcugcuuaccgcuaucauuucccugucuaagaaauacauccagaagccuaacguugagagccugcuccagcaagccuucgaccaguccgauaaggacaucuaucagcugagcgaaucuuuuauuucccuucugaaacucaucagcuucggggcccccggcacauuuaaguuccugggaguggagauuucucaguccaaugugagauaccaaagcgucucuuccugcuuuaacgcuacccucauccaccagagcauuacgggccuguacgaaacacgcaucgaucuuuccaaacugggggaggacuga

SEQ ID NO: 4344 - RNA, 4131 nt, Artificial Sequence
  Cas9 variant
auggacaagaaauacggcaucgggcuggauauuggaaccagcuccaucggcuggacaguggucgacaaguaugggcacauuaucagaguuaaaggacagacgggcauuggggugcgccucuuccgggagggacaaaccgccgcugaaagacggacauuucgcaccacaagacggcgccugucuagacggcgcuggagacuucggcugcuccgcgagaucuucgaugaacccaucagcgccauugacgagaacuuuuucgcgagacagaaggcuuccucucuggccccuggcgaugcccgguaccagcaggcuuuucaacuuuucaaugaccgcaccgaucaggccuuuuauugcaaauacccgacaaucuaucaucugagacaggcucucaugaccgaaagccggcaguucgacauuagagagaucuaccuggcccugcaccaaauuaucaaguaucgcggccauuuucuccuugggggagcggccaaggauuuccaguccgacaaacuugaucuggaggcuuacuuuacgaccauuaacgcccagcucgcuggcaucuacucugacgggagcgugcagcugcccacacuugauuggaaucaagccugucaggaacugaccgacacaucccggacccagagcgacagaaagaacuggcucgucaaagagcugaagucuuauggagauucccaacugaaaccuaucuacacgcagauugcgaaugccauccucggcuucaagacagaccuggcuaagauuauggggaucaacgaucccgaaaaagcccuuagcuuuaaucuggacgcucucgaugaccaccgcgaugacguggccgagcugcuuaccgaugagcagauuccucugguuaaccuccuggccaagcugcauacagcucucgaacuggcggccauccuucccgacggacagacccugucuggcaaaaugguggagaucuaugaaacccaccggaagcaacucaaaacauacaaggcuuucauuagacagcugccugaucgccagcagcggcuugcccugaaacaagccuaugaccacuacaucgaccagggccucaauagagaggcuuucuauuccgaagucaaggccauucuggagaagcagaaaccgcugacggcgaccgggcaggcuaugaagaaagccauggaucaaaacgccuuucuccugaagcagcgcacaaaaaccaauaucgcuauucccuaccaggugcagcaacaggagauggaccagaucaucgccaaccaaagcaaguacuauccuuggcuugcuacacccaauccuguuaagucucggagagugauugcccccuacaaacuggaugaacucgucugcuuccgcgugaacuauuacgugggaccgcugguccaguccaagccuggcgaggcgaccaaagaagccaaguuugcuuggaugacgcggaaagacccccagagcacaguugccaucaccccuuggaauuucgaucagcaaguggacagacaggcuuccgccaacgcguuuauucagcggaugaagaccacagauaccuaucugcuuggggaggacgugauccccaagaacucucuccuguaccagaaauaugaaguccugaaugagcucaacaaugugcgcguuaacggagauuggcuggacccccaaagaaagcaguaccuuuucaaaaagcuguuuauggaucagccucagagcguggucacagugaaagcccuccaaaagacgcugguugugauuggcgcuuguccgacccugcccacagucgaggggcuugccaauccuaagcgguuccucucccagcugaccacauaccaugacuuuugcaaacugcuccccgaugacauccagagagcugaccgccaagccgauauugaaaagaucaucaacuggagcaccauuuucgaggacacggccaucuuuaaagaaaagcugcgggauauuaaauggcuuucugcugaccagaucagacgccuguccagcagaccucgguaucgcggauggggcagauucucugcgaagcuccuguguggccugcacgaucggcaggggaauaccgugauggacgagcuuuggcagacaagccgcaacuuuaugcaaauuaucagacaguccgauuuccagaccgccaucgcugccgucaaucagcaagaccucggacggcaggaucugcagcgcgugauugacgaucuguacacaucuccccagaacaaaaaggccaucagacaaguucucgcuguggucaccgacauucagaaggccaugcauggcaaagcgccgagcuggcuguucguggaaguugcuaagggggcccagaaaaauccucagcggacgcaaucccgccagagcaagcuggccgaggcuuauagagagucugcccgggaacugguggaugaggcggucaaagaacagcuccugacacugcccgacgacagacaaaccuuuuccgaucgccuugugcucuacuuccagcagaacggacgggacaucuauacaggcgagccucuggauuuugagagacugagcaauuaccacauugaccacaucaucccccaggcugugguuaaggaugacucucucgauaaccgcguccugaccuccaaucaagccaaccuugaaaagggggcccaugugccuaccauuuuccgggacaaacaggagcccguguggcaggaacuguauagagucggccucaucagccaccgcaagcugcggaaccugcuuacaacgccggaugaccuggaugacagaggacgcgcuaccggcuuuauugcccggcagcucguggagacaagacaaguuaucaaacuggugauggaaguccucucccaguacuacgacaccacagagaccgagcugauuucuaucaaggcugggcuuagccaucaguuccggcaggaacugaaucucccuaaacugcgcgcccugaacgauuaucaccaugcgcaagacgccuaccuugcugccagaaucggaacguaucugcuccagcgguaccccaaucugaagcgcuuuuucguguauggcgauuuuaagaaaacacacuucgaccuccagagacgguuuaacuucauugggggaaugaucuccagagagaagcaacccuacaaucugauuaaaaacccuguuacccaccaggugaucugggaugaagagauggaaauuggcgacugccagaagaaaaauccggagcagcccaagcaugaugcuaccgucaagaugaugaaccuuacaaaaaucaugaaucugaagcacauucucgugacccaugagguuuaugaaaaccacggggcccuguuuaaucaaacaaucuacccugccucucaggcucacaaaaagaaacugaucccccagaagacggagaaaccuauugaacuuuacggcggacauagcuccgagcaggcgggcuauauggccaucauucgccugcucgggaagcggcccggauacaaggugaugagagucccugugcgcuaugugagccaacugcagcaccaggacgucgcugaacagaaaaagcuccuguacaaaaucuucguuucugagcuuaccucccggaacaaggugaaacccuucgagguggucgugccgcauguuugucugaaucaaccuguggaagauaugauuaagggccaguggcacagauuugcccugcgcacaaacggguauuaccagaaucagcaacagcucauccugagccuugucgcccagcggacccuggcuggauauaagcccaaagacgaugagcucauggccguguaccaugaaaucugcaagcaaguuaaauacuauuucccucuguacaagaugaacaaauuucagucuagacucuucgcggcugaggagcugcuucagaagcgcuccacagugaacagcuuuucuauuaccaucggcaagaaugggaaagaaaacaagacgcugaaucugggcaaaagagagcuccugcuucggcugcucggaggccugcacgccaacgccacccgcgucgaccucaaggauauuggguguacaggacaguucggccaacuucaggugaaaaaugggaucaagcugaccgaacaggcuguucugauucacgagagccccacaggacuguuucauagacgggugcgccucaacgaccuguga

SEQ ID NO: 4345 - RNA, 4134 nt, Artificial Sequence
  Cas9 variant
augaccaagaaaaacuacagcaucggccuggacauugggacaaauuccgugggaugggccgucaucacggaugacuauaagguucccgcuaaaaagaugaaagugcucggcaacaccgauaagaaguacauuaaaaagaaucugcuuggggcccuucucuucgacucuggagagacagcggaagcuaccagacugaaacggacagcccgcagacgguauacccgcagaaagaaccggcuucgcuaccugcaggagaucuuugccgaagagaugacaaaaguggaugagagcuucuuuuauagacucgacgaguccuuccugaccacggaugagaaggacuuugaacggcacccuauuuucggcaauaaggcugaugagaucaaauaccaucaagaauuuccgaccaucuaucaucugcgcaagcaccucgccgacucuagcgagaaagcugaucugagacuugucuaccuggcccucgcgcacaugauuaaguuccgggggcauuuucugaucgagggagaacuuaacgccgagaauacagacgugcagaaaauuuucgcugauuuuguuggcguguacgaccgcaccuucgacgauucccaccugucugaaaucacagucgacgccgcuagcauucucaccgagaagaucuccaaaagcagacggcuggaaaaccugauuaaguauuaccccacggagaagaaaaauacacucuuuggcaaccugaucgcccuugcgcuggggcuccagccuaauuucaagaugaacuucaaacugucugaggaugccaagcugcaguuuuccaaagacagcuauaaugaagaucuggaggaacuccugggaaagaucggcgacgauuacgcugaccuguucaccucugccaagaaccucuaugaugcuauucugcuuuccgggauccugacaguggacgauaauagcaccaaagcgccccucucugccuccaugauuaagcgcuacgcugagcaccaugaagaccuggagaaacuuaaggaguuuaucaaagcgaacaagagcgaacuguaucacgacauuuucaaggaugagaccaaaaacggauacgccggcuacaucgaaaaugggguuaagcaagacgaguuuuauaaauaccucaagaacacacuguccaaaaucgcuggaucugauuauuuccuggacaagauugaaagagaggauuuucuccggaagcagagaacguucgacaauggcagcaucccucaucagauucaucugcaggagaugcacgccauccuucgccggcaaggcgauuacuaucccuuucugaaagaaaaccaggacagaauugagaagauccucaccuuccgcaucccuuacuauguggggccgcuggcccggaaagauuccagauuuagcugggcugaauaccacucugacgagaagauuacacccuggaauuucgauaaagucaucgacaaggagaaauccgccgaaaaguuuauuacccgcaugacacugaacgaucuuuaccucccugaggaaaaggugcugcccaaacacagccauguguaugagaccuacgcggucuauaaugaacugacgaagaucaaauacguuaacgagcagggaaaggacucuuucuucgacagcaauaugaaacaggagauuuuugaucacguguucaaggaaaaccggaaggugacaaaagagaagcuccugaauuaucuuaacaaagaauuuccugaguacagaaucaaggaccugauuggccucgauaaagaaaauaaguccuucaacgcuucucuggggaccuaucaugaccugaagaaaauccuugauaaggccuuucucgacgauaaagucaaugaggaggugaucgaagacauuaucaagacccugacacuguucgaggauaaagacaugauucacgaacgccuccaaaaguacagcgauaucuuuaccgccgaccagcugaagaaacuugagcggagacacuacacaggauggggccgccuguccuauaagcucauuaacgggauccggaacaaagaaaauaacaagacgauccuggauuaccugauugacgacggaagcgcuaauagaaacuucaugcagcuuaucaaugaugacacccuccccuuuaaacaaauuauccagaagucucagguugugggcgaugucgacgauauugaggccgugguucaugaccugccgggcuccccugcuaucaaaaaggggauccugcagagcgugaagauugucgaugagcucgugaaagucaugggagacaaccccgauaauaucgugauugaaauggcccgggagaaccaaacaaccaaucgcggcagaucucagucccagcagcggcugaagaaacuucaaaacagccugaaggaacucggguccaauauccugaacgaggagaaaccuucuuauauugaagacaagguugagaauagccaucugcagaacgaucagcuuuuccucuacuauauccagaauggaaaggacauguacacaggcgacgaacuggauaucgaccaccuguccgauuaugacauugaucacaucauuccccaagcguuuaucaaagacgauucuauugacaacagagugcucaccagcuccgccaagaaccgcgggaaaagcgaugacguccccucucuggauaucgugcgggcuagaaaggccgaguggguucgccuuuacaaauccggccugauuagcaagagaaaguucgacaaucucacgaaagcugaacggggaggccugaccgaggccgauaaggcgggguuuaucaaacgccagcugguggagacaagacagaucaccaagcacgucgcccagauucuugacgcucgguucaacacagaaucugacgagaaugauaaagugauccgcgacgugaagguuauuacccugaaguccaaccucgucagccaauucagaaaagauuuugaguucuacaaggugcgggaaaucaaugacuaucaucacgcccaugaugcuuaccugaacgccguggucggaacggcccuccugaaaaaguauccuaaacuugcuucugaauuuguguacggcgaguauaagaaguacgacguucacaaacugauugccaagagcuccgaugaccauagcgagauggggaaagccacagcuaaguauuucuuuuacucuaaucucaugaacuucuuuaaacgcgugaucagauacuccaauggaaaggucaucgugcggccgguuguggaauauagcaaagauaccgaggacauugccugggauaagaaguccaacuuccgcacaaucugcaaaguccugucuuacccccaggugaauauuguuaagaaaguggaaacccagaccggcggguuuagcaaggaguccauccugccuaaaggcgacucugauaaacuuauucccagaaagacaaagaaggccuauugggacacgaaaaaguacggaggcuucgacagcccuaccgucgcuuauuccguguuuguggucgccgauguugaaaaagggaaggcgaagaaacugaagacagugaaagagcucgugggaaucucuaucauggagcggagcuucuucgaagagaaccccgucgaauuucuggagaauaagggcuaccacaacauuagagaggacaaacucaucaagcugccgaaguauucccuuuucgaauuugaagggggaaaacgccggcugcucgcuagcgccucugaacugcaaaagggcaaugagauggugauuccugggcaccugguuaaacuucuguaccaugcccagagaaucaacuccuucaacagcaccaaguaccucgauuaugugucugcucacaaaaaggaauuugagaaaguccuguccuguguggaggacuucgccaaucucuacguugauguggaaaagaaccugagcaagauucgcgcggucgcugacucuauggauaauuuuuccaucgaggaaauuagcaacuccuucaucaaucuucugacacugaccgcccucggcgcccccgcugacuuuaacuuccugggagagaaaaucccucggaagagauauacgagcacaaaagaaugccuuaaugccacccugauucaucagucuaucaccggccucuacgagacacgcauugaucugagcaagaucggggaggaauga

SEQ ID NO: 4346 - RNA, 4134 nt, Artificial Sequence
  Cas9 variant
augaagaaacccuacagcaucggccuggacauugggaccaacuccgugggaugggccgucaucacagaugacuauaagguuccuucuaaaaagaugaaagugcucggcaauacggauaagcacuucauuaagaaaaaccugaucggggcccuucuguuugacgagggaaccacagccgaagauagacggcucaagcgcaccagcagacggcgcuacacaagacggaaaaaucgccugagauaucuucaggagauuuucuccgaagagaucucuaagcuggacagcuccuuuuuccaucggcucgaugacucuuuucuggugccggaagauaaacgcggcagcaaguaccccaucuucgcgacccuggaggaggaaaaggaguaucacaaaaaguuuccuacaauuuaccaucucagaaaacaccuggcugacuccaaggagaaaaccgaucuucggcugaucuaucucgcccuggcccauaugauuaaguaccgcgggcacuuccuuuacgaagagagcuuugacaucaaaaacaaugauauucaaaagaucuucaacgaauuuauuucuaucuaugacaauacguucgagggauccagccugucuggccagaacgcucaggucgaagccaucuuuaccgacaagauuuccaaaagcacaaagagagagcgggugcucaaacuguucucugaugaaaaguccaccggccuguucagcgaguuucucaaacugaucguugggaaucaggcugacuucaagaagcacuuugaucuugaggaaaaagcuccccugcaauucuccaaggacacauacgaugaggaccucgaaaaccugcuuggacagauuggcgauggguuugcggaccuguuccucguggccaaaaagcuguaugaugcuauccugcucucugggauucugaccgucacggacccuagcacaaaagcuccccuuuccgcuagcaugaucgagcgcuacgaaaaucaucaggaggaucuggccgcgcucaagcaguuuaucaagaacaaucugucugagaaauaugccgaaguguucuccgaccaaagcaaggacggcuacgcuggguuuauugauggaaaaaccacacaggaggccuucuauaaguacaucaaaaaccuucugucuaagcucgaaggcgcugacuacuuucugaauaagauugagagagaagauuuccugcggaaacagagaaccuuugacaacggcagcaucccucaccagauucaucuccaagagaugaacgccauccugcgccggcagggggagcacuaucuuuuccugaaggaaaauagagagaaaaucgaaaagauucucgccuuccgcaucccguacuauguuggaccccuggcucggggcaacagagauuuugcguggcugacccgcaauuccgaccaggccauucggccuuggaacuucgaggagguggucgauaaagccucuagcgccgaagacuuuaucaauaagaugacaaacuacgaucuuuaucuccccgaggaaaaagugcugccuaagcacucccugcucuacgagacguucgccguguauaaugaacugaccaaggucaaauuuauugcugaggggcuuagagacuaccaauuccuggauagcggacagaagaaacagaucguuaaccagcucuuuaaggacaaacgcaaggugacagagaaggauauuauccauuaccugcacaauguggacggcuaugacgggaucgaacugaaaggaauugagaagcaauucaacgccucucuuuccaccuaccaugaucuccugaaaaucauuaaggacaaagaauuuauggauaaucccaagaacggcgagauccuggaaaauauuauccacacacucaccaucuucgaggaccgggagaugauuaagcagagacuggcgcaguaugauacgcuuuuugacgaaaaagucaucaaggcucugacacgccggcauuacaccggcugggggaaacucagcgccaagcugauuaacggaaucagagauaaacagaccggcaagacaauucuggaguaucuuaucgacgauggggacugcaaucggaacuucaugcaacucaucaacgaugacggacugucuuuuaaggaaauuauccagaaagcccaggugguuggcaagaccgaugacgugaaacaggucgugcaagagauuccgggguccccugcuaucaagaaaggcauucugcagagcaucaagaucguugacgaacucgugaaagucaugggacacaaucccgaguccauugugaucgagauggcccgcgaaaaccagacaacggcuaagggcaagaaaaauucucagcaaagauacaagcggauugaggaugcccugaaaaaccuugcgccugggcuggacagcaauauccucaaggaaaaccccaccgauaauauucagcugcagaacgacagacuguuccuuuauuaccuccaaaauggaaaagauauguacacaggcaaggccaucgacauuaaccagcuguccaauuaugauaucgaccacaucauuccccaggcuuucaucaaggaugacucucuggauaaccgcguccucaccagcuccaaagacaaucggggaaagagcgacaacgugccuucuauugagguugugcagaaaagaaaggccuuuuggcaacagcugcuugauuccaaacugaucagcgagcgcaaguucaauaaccucacaaaggcuaaaagaggaggccuggacgaacgggauaaggucggguuuauuaaacgccagcugguggagaccagacagaucacgaagcauguugcccaacuucuggacacccgguucaacacagaagugaaugaggaaaaccagaaaauccgcaccgucaagauuaucacacucaagucuaaucugguguccaacuuuagaaaagaguucggccucuacaaggugcgggagauuaaugauuaucaccaugcgcacgacgccuaccugaacgcuguugucgccaaagcuauccuuaagaaauauccgaagcuggaacccgaguuuguguacggagauuaucagaaguacgaccucaaacgcuacauucuuaagagcaaagccucuaauaccaucgauaaggccacggaaaaauauuucuuuuacagcaaccugcugaauuucuuuaaggagaaagugagauaugcugacggcacaaucaagaagcgggaaaacauugaguacuccaaugauaccggggagaucgcguggaacaaagaaaaggacuucgccacaauuaaaaagguccugagccucccucaggugaauaucguuaaaaagaccgaggaacaaaccgugggacagaacggcgggcuguucgauaauaacauugucucuaagaaaaaggugguugacgcuuccaaacucauccccauuaagagcucccugucuccugagaaauauggaggcuacgcccgccccacaaucgccuauagcgugcuugucaucgcugacauugaaaaggggaagggcaaagccaagaaacugaagagaaucaaagagauugugggaaucacgauucaggauaagaagaaauuugaguccaacccgguuaccuaccucgaagaguguggcuacaagaauaucaacucuaaucugaucauuaaacugccuaaguauagccuuuucgaauuuaacgacgggcaacggagacugcucgcguccucuaucgagcugcagaaaggaaaugagcucauucugcccuaccaccuuacagcucugcuguaucaugcccagcgcaucaacaagauuagcgaaccuauccacaaacaguacguggaggcccaucaaaaugaguucaaggaacuccugaccacaaucauuucccuuagcaagaaauauauccagaagcccaacgucgaacugcuccugcagcaggcuuuugaucaagccgacaaagauauuuaccagcucucugaguccuucaucagccugcuuaagcugaccucuuuuggcgcgccuggggcuuucaaauuucugggaguggagauuucccagagcucugugcgguauaagcccaauucccaguuccucgacacgacacugauccaccaaagcauuaccggccuuuacgaaaccagaaucgaucuguccaagcucggggaggacuga

SEQ ID NO: 4347 - RNA, 4134 nt, Artificial Sequence
  Cas9 variant
augaacaauaagcccuacagcaucggccuggacauugggaccaacuccgugggauggucugucaucacagaugacuauaaaguuccuagcaagaaaaugaaggugcucggcaauacggauaaaagauucauuaagaagaaccugaucggggcccuucuguuugacgagggaaccacagcugaagcccggcgccucaaaagaaccgcgcggcgcagauacacacggcgcaagaauagacugcgguaucuucaggagauuuucgcugaagagauguccaaaguggauucuagcuuuuuccaccgccuggacgauuccuuucucaucccggaagacaagagaggcucuaaauaccccaucuucgccacccuggucgaggagaaggaauaucauaagcaauuuccuacaauuuaccaucugcggaaacagcucgccgauagcaaggagaaagcugaccugcgccuuaucuaucuggugcucgcccacaugauuaaguacagagggcacuuccuguacgaagaggcuuuugauaucaaaaacaaugacauucagaagaucuucaacgaguuuauuuccaucuaugauaauaccuucgaaggaagcucucuuuccggccagaacgcccaaguugagacgaucuuuaccgacaaaauuagcaagucugcgaagcgggaacgcgugcugaaacucuuccccgacgagaaguccacaggccuguucagcgaauuucugaaacucaucgucgggaaucaggccgauuucaagaaacauuuugaccuggaggagaaggcuccucuucaguucucuaaggauaccuacgacgaagaucuggagaaccuccuggaacagauuggagacgauuuugccgaccuuuucguggcugccaaaaagcuguaugaugcgauccuccuguccggcauucugacaguuaccgaccccagcacgaaagccccucucuccgcuucuaugaucgagagauacgaaaaucaccaaaaggaucuggccgugcuuaaacaguuuaucaagacaaaccugccggagaaguaugucgagguguucagcgaccaguccaaagacggguacgcuggauauauugauggcaagaccacacaggaagccuuuuacaaauacaucaagaaucuccugagcaaauucgacggggccgauuauuuucuugacaagauugagcgggaaguguuccugagaaagcaacgcaccuuugauaacggaucuaucccccaccagauucaucuccaggagaugaacaccauccugcggagacaaggcgaacacuacccuuuccugaaagagaauaaggagaaaaucgaaaagauucucacauuccgcauccccuaucaugucggcccucuggcucgggggaacagagacuuugcguggcuuacgcgcaauuccgaucaggccauucggcccuggaacuucgaggaaaucguugacaaagcuagcucugccgaggauuuuauuaauaagaugaccaacuacgaccuguaucucccggaggaaaaagugcugccuaagcacagccugcuuuacgagacauucgccguguauaaugaacucaccaaggucaaauuuaucgcugagggaaugagagauuaccaguuccuggacuccggccagaagaaaaagauuaucaaccaacuguuuaaaaagaagcgcaaagugacagaagaugacaucauugacugccuccagaagaucgauaauuacgacgggauugagcugaaaggaaucgagaagcaguucaacgccucucuuagcaccuaucacgauauucugaaaaucauccgggacaaggaauuuauggaugaccccaagaauggcgauauucucgagaacguuauccauacgcugacaauuuucgaagacagagagaugaucaaacagcgccuggcgcaauacaauuccauuuuugaugaaaaggugaucaaagcucuuagccggaagcacuauaccggguggggaaaacucucugccaagcugaucgacggcauuagagauaagcagaccggcaaaacaauccuggacuaccucauggaugacgggaaguccaaccggaauuucaugcagcugauuaaagacgaugagcuuagcuuuaccgagaucauucagaaggcccaagucgugggagacacagauaaccugcgccagguugugcagaaccucccuggcucucccgcuaucaaaaaggggauccugcaguccauuaaaaucgucgacgaacuggugaaggucaugggacaugcccccgagagcauugugaucgaaauggcuagagagaaucaaacgaccgcccggggcaagaaaaacucccagcagagauauaagcgcauugaagauucucuuaaaaaucucgcgagcgggcuggacuccaacauccugaaggagaauccuacagauaacauucaacuccagaaugaccggcuguuccuuuacuaucugcagaacggcaaagauauguacaccggagaggcccucaauaucaaccagcugucuagcuacgacaucgaucacauuaucccgcaggcuuucauuaaggacgacucccuggauaauagaguucuuacaagcucuaaggacaaccgcggcaaauccgauaaugugcccagccucgaagucguggagaagaugaaagccuuuuggcaacagcugcuggacucuaagcucaucuccgaaagaaaauauaacaaucugaccaaggcugagcgggagcgcgggggacuuaacgaacuggauaagguuggcuucauuaaaagacagcucguggagacgcggcaaaucaccaagcaugucgcccagauccuggacgcgcgcuuuaacaaagaagugacagagaagaauaaaaagaacagaaaugugaagauuaucacccugaaaagcaacaugguuucuaauuuccggaaggaauuugggcuuuacaaaguccgcgagauuaacgauuaucaccacgcccaugacgcuuaccugaaugccgugguggcuaaggccauccucaaaaaguauccuaagcuggagcccgaauuugucuacggagauuaucagaaauacgaccucaagagauacauuagccgguccaaagauccuaaggagguggaaaaagccacagagaaguauuucuucuacagcaaccugcuuaacuuuuucaaagaagagguucacuaugcugacggcaccaucgugaagcgcgagaauaucgaauacucuaaggauacgggggagauugcguggaauaaagaaaaggacuuugccacaaucaaaaagguccugucccucccccaggugaacauuguuaaaaagaccgaggaacaaacagugggccagaauggaggccuguucgacaacaauaucgucagcaagaaaaaggugguugaugcuuccaaacugauuccgaucaagucugggcuuagcccugagaaauauggaggcuacgccagacccaccauugccuauuccgugcuggucaccuacaagcagaacaacaagaucaaaaauacaaugguggggaucccugugcucacgaagcuggaguucgaacgggaccccaaccucuaccugagaaaucuuggaauuaacaaugucucucauguuaucaaacuggugaaguauaccgugcucgaguuuaaacacaaguacggcacauaucgccgguucauugucagcaaccaagaacugaagagagcuaaucagaucuuugugaccacaaaacagaugaagcugauuucccaguacaccacgcuugauaaaaacgagcacgacucucugcucaagaauaaccaacagcugauccagagcaucuggaaucaguuccucgaguuuaugcuggccacagaucuuguuaacaaaaagcaauaugacgaacugauucugaccaauaaccagaccaucgaggaaugucgcaauauuaugaaccgggugaucacaacccucuccuucacaaauauuaacgcggggcagaaaaagaucaucuuugaugacacgcugagccuuccuauuaagagauggcaguucaccgauucugacaaaauggucaagaaaaucauugaguccacacugauccaucaaagcauuaccggccucuacgaaacacgcaucgaucugucuaagcucggagaggacuga

SEQ ID NO: 4348 - RNA, 4134 nt, Artificial Sequence
  Cas9 variant
auggagagcaaccacgacggcgaacaggugaaguacacccuggggcucgauaucggaacauccucuauuggcuaugccgcuaucgacaaacaucaaaagcccauuagagccaaagggaagcacgucaucggaguucggcuguuccaggagggccagacggcggcugaucgcagagccuuucggaccacacgcagacggcuuaaacgcagaaaguggcggcugaaucuccugaaccgccuuuucgacccuuaccugagcgaaguggauccgaauuuucuccccagacugcggcaguccaaccugucuccuaaggacgauaauaaacauuucaacgggagcacccucuuucccgacaagacagaugccgcuuucuaucgccaauacccuaccauguaucaccugagauacgcccuuaugacagagaaacggaaguuugacauucgcgaaguguaucuggcuauccaucacaucgucaaauacagaggaaauuuccucaacuccgccaccguggauucuuuuaagacgagcaauauugacuucaccucccaguuugaucggcugaacgagcuuuacagacagguuauccuggacgagcccuuccagauuaauauggaccaaguggaugaaaugacaaacaagcuccuggacaaugaugcgcugaaacucgacacccagaagcaggucgccaaacugcuuccugugaucuauaacgauaagccgauugacaaacaguacacacgcaucgcuaccgaguuuagcaaggccauucugggcuauaaaacgaagcucgauguuauccugaaucuugacacacaaaacgcuaaggauugggugauccggcuggacgaugaagacauugacgauaaacuccccgcccuggucgagaaccuggacgagucuagacaggaaaucgugaccauuauccgcgaucucuacgcgcagauuacacugaaugccaucgugccuaagggcaaaucccuuagcgagucuauggucgacaaguauaacgaucacaaagaccaucuggaucuccugauggggcuuauccacgaacugggagacgauuccgcuaagggcauuaagcuccgggaggccuacacccaauauguugggaaaagcgacgauaagacccugaaucaggacgauuucuacgcugccaucaaaaagaaccuggacgaagacucuaaaagaucccccaagauucagcgccucaucgagcaggccagcuucaugccuaagcaacggacauccgcuaauggagugauuccccaucagcugcaccagcuugagcuggauagaaucaucgaaaaccagggccgcuacuauccguuucucaaaaagccuaaucccaacacgcacaaaccuaaugggggaaaguacaaacuggacgagcugguggcguuccggauucccuauuacgucggcccccuuaucaccaagagagaucaagaaaagacaucuggcgccgacuuugcuuggaugauucgcaaaccugggcaggagggagaaaucaccccguggaacuucgaucagaagguggaccggauggccagcgccaauagauuuauucggcgcaugacaaccaaagauuccuaucucguugcugaggacgugcugcccgaugccagccugaucuacgagaaguucaaagcgcucaacgaacugaauaugcuuaaggucaacgacucuagacuguccccuagccagaaacaagaucucuuuaauaaccuguucaagaagcagaaaacgauucggacaaagaaacugcagaccuauaucagaaccaacugggagcuucccucugugaugaucagcggccucgcugacccugauaaguuuaauuccucucugagcacauacauugacuuccgcgacaucuuuggggaaaaaguugaugaccccaaccggcaggccgauuacgaggaaauuaucgagugguccaccguguucgaggacagaaagauuuaucaagccaagcugaaucagcucgauuggcugacagaaccgcagcgcaaagcccuucugacgaagagauacaccggauggggccggcucagcaaaaagcugcugacagggcuuaaagaccaaaacggagauucuauccucgaccagcuguggaagaccaaugauaacuuuaugcagauccagucccgcgacgaguucgcuaagcaaauucaugaugaaaaugcuaaacaguuccacgaggccaacaaugucgacgacauccuggaugacgcguuuacaagcccucagaacaagaaagccauuagacagguggauaaggucgugcaagacguugugaaagcugucggcuaugcccccgauaagaucgcuauugaguucacccggucucucgaaaauaacccucagcgcacgguguccagacagcggcagcugcaagccgcguacaagaauaucccccgcgagaucaugaaaagcggccuuauggccgaacugggguccguugcugacucuaagaaagugcucagcgauaagcuguaucuguacuuuacccagaugggaaaagacauguaugaggauaagacaauuaacaucgacaaucuuccuaacuacgauauugaccauauccucccccaggccuucauuaaagaugacuccaucgacaacagaguccugaucucuaaggaagagaaugcucgcaagagcaaccgggugccgcugaaauuuuucggcgccaagagaaugggguuuuggaaagaucuccugaauaacggacuuauuuccaaucggaaguuccaaaaccugaccacagacccugagaaaaucagcaaguacucugccaagggcuuuauucacagacagcucguggaaaccucccagguuauccgccuggucgcuaauauucuggggaacgaguauagccaggcgggcacgacaaucauugaagugucugccaaaaugaaucggcaacuuagagaggauuuccaucugaucaagaaccgcaaugugaacgacuaccaccacgcuauggaugccuaucucaccgccuacgucggagacuaucuguaccuccgguaucccaaacugagacccuacuuuguguacggcgauuucaagaaagcugaagaccaggaucuuaauauccgcaacuuuaauuuccugcaugaccucaaggauaacgagucccuggacaagauuguugauagcgagacaggggaaaucgugugggagaaacacggaucugucaagcagcugaaaaagguguaucauuacaaauucaugcuuguuagccaggaaguguauacccggcaagacgcccuguuuaaccagaccauuuacccugcguccgacgcugauaagagaaagcucaucccgauuaaaaauagcaagcccgucgacguguauggcggguacucuggaaacaucgaugccuauauggccaucguucgcgugcacggcaaaaaggaggacaauuacaaagucguggggauuccuaugcgggcugugacaaagcugaagaaagccgaaaaggagggccacgauuccuaccucaacgcgguccaugagguucugaaaccccaguucacgaagaaaaagaaaaauagaaagaccggagaaaucacagagaccguggacgaauuugaugugcuucugggcaaggucuauuaccggcagcucauuguggacgggaacaaaaaguucaugcugggaagcuccucuuaucaauacaaugcuaaacagcugguucuuagcgauaaggccaugcaagugcuguccaaaaacggcaaggucaagucucaggacgagaaucagaaccucaucgauguguaugacgagauucuggaaaaaguugaccaguacuuugagcucuaugaucagcgccacuacagagaaagccugcauaaggggcggggaaucuucgugaaucuuccucuguccaaccaauacgacggcucuaaacugacaagcuaugggaaguacgagaccaucgaugccauucucaauggccugcacgcuaacgccacgauguccaaucuucgcuaucugggaaucagcucucccuuuggcaaaaugcaggcuuccaacgggcucacaauugacccugauagcaucauuugcuaccagucucccaccggacuguucgaaagacagaucaagcucuccgaccuguga

SEQ ID NO: 4349 - RNA, 4134 nt, Artificial Sequence
  Cas9 variant
augaacaagcccuacagcaucggccuggacauugggaccaauuccgugggauggucuaucauuacagaugacuauaaagucccugccaagaaaaugagaguucucggcaacacggauaaggaguacaucaaaaagaaucugauuggggcccuucuguucgacggaggcaacaccgcugcggaucggcgccucaagagaacagcucggcgcagauauacccggcgcagaaaucggauccuguaccuucaggaaaucuuugccgaggaaaugagcaaaguggacgauuccuucuuucaccgccuggaggacucuuuccucguggaagaggauaagagagggagcaaauauccgauuuuugccacaaugcaagaggaaaaguacuaucaugagaaauuccccaccaucuaccaucugcggaaggaacuggcugacaagaaagagaaggccgaucuccgccuggucuaccuugcucuggcccacauuaucaaauuuagaggacacuuccucauugaggacgaucgguuugacgugcgcaacacagacauccagaagcaguaucaggcguuccuggaaauuuuugauaccacguucgagaauaaccaucuucugucccaaaauguugacguggaagccauccucaccgauaaaaucucuaagagcgcuaaaaaggaccggauucuggcccaguacccuaaccagaaguccacaggcaucuuugcugaguuccugaaacucauugucggcaaucaggccgauuucaagaaacacuuuaaccuggaagacaagacaccccuucaauucgcgaaagauagcuaugacgaggaucuggagaaucuccuggggcagaucggagacgaauuugccgaucuuuucucuguggcuaagaagcuguacgacuccguucuccugagcggcauucugaccgugaccgaccucucuacgaaagccccucuguccgcuagcaugauccagagauaugaugagcaccaugaagaccuuaagcaccugaaacaguuugucaaggccucucuccccgagaacuacagagaaguguucgccgauuccagcaaagacggguaugcuggauacaucgagggcaagacaaaucaagaggcguuuuacaaguaucugcuuaaacugcucaccaagcaggaaggguccgaguacuuccuggagaaaauuaagaacgaagauuuucugcgcaaacagcggacauucgacaacggaucuaucccucaucaagugcaccucaccgaacugagagccauuauccgccggcagagcgaguauuacccguuucuuaaggagaaucaggauagaauugaaaagauccugaccuuccgcauccccuauuacgucggcccucucgcucgggagaaauccgacuuugccuggaugacaagaaagacggaugacagcauucgccccuggaacuucgaagaucugguugacaaagagaagucugccgaggcuuucauccaccggaugaccaauaacgaucuguaucuuccugaagagaaagugcuccccaagcauucccugauuuacgaaaaauuuacaguguacaaugagcugaccaaggucagauuccucgccgaaggcuuuaaggacuuccaguuucugaaccgcaaacaaaaggagacaaucuucaauagccuuuuuaaagagaagcggaaagugaccgaaaaggacauuaucucuuuccugaacaagguugauggguaugagggaauugcgaucaaaggcaucgaaaagcaguuuaaugcuagccucuccacguaccacgaccugaaaaagauucuggggaaagauuuccuugacaacacagauaaugagcucauccuggaagacauugugcagacccugacccucuuugaggauagagagaugaucaagaagugccuggacauuuauaaagauuucuuuacagaaucucagcuuaagaaacuguaccggcgccauuauaccggauggggcagacucagcgccaagcugaucaacgggauccggaauaaagagaaccaaaagacaauucuggacuaccuuaucgaugacggauccgccaauagaaacuucaugcagcucauuaacgaugacgaccugagcuucaagccgaucauugauaaagcucgcacgggcucucacuccgacaaucugaaggaagucgugggcgagcucgccgggagcccugcuaucaaaaagggaauccugcagucucuuaaaauuguugaugaacuggugaaggucaugggcuaugagcccgagcagaucguggucgaaauggcccgggagaaccaaaccacagcgaaagggcucuccagaagccgccagagacugaccacacugcgggaaucccuugccaaucucaagucuaacauucuggaggagaagaaaccuaaguacgugaaagaccagguugaaaaucaucaccugagcgaugaccgccucuuucuguacuaucuucagaacggaagagauauguacaccaagaaagcucuggacaucgauaaucucucccaauaugacauugaucacaucaucccccaggccuucauuaaggacgacucuaucgauaaccgggugcuggucagcuccgcuaagaaucgcggcaaaagcgacgaugugcccucuauugagaucguuaaggccagaaaaauguuuuggaagaaccugcuugacgcgaaacugaugucccagcggaaguacgauaaucucacgaaggccgaacgcgggggccugaccagcgacgauaaagcuagauucauucaacggcagcucguggagacacgccagaucaccaagcaugucgcccggauucuggacgaaagauuuaacaaugagguggauaacggcaaaaagaucuguaaagugaagaucguuacacuuaagucuaaucuggucuccaacuucagaaaagaguuuggauucuauaagauucgcgaagugaacgacuaccaccaugcucacgaugccuaucucaaugccguggucgcuaaagcgauccugaccaaguacccucagcuggagccggaauuuguguacgggauguaucggcaaaagaaacuuagcaagauuguucacgaggacaaagaagagaaguacucugaggccacgagaaaaauguucuuuuauagcaaccugaugaauauguucaagcgcgugguccggcucgcugauggauccaucgugguuagacccgugauugaaacaggccgcuacaugcggaaaaccgccugggacaagaaaaagcauuucgccacagucagaaaggugcugagcuauccucagaacaauaucguuaaaaagaccgagauccagaccgggggauuuucuaaagaauccauucucgcucacggcaacagcgacaagcugaucccccgcaaaacaaaggauauuuaccuugacccuaagaaauaugggggcuucgauucccccaucguggccuacucuguccuggugguggcggacauuaagaaaggaaaggcucagaaacucaagacggucaccgagcugcugggcaucacaaucauggaacggagcagauuugagaagaauccguccgccuuccuugagucuaaaggguaccugaacauucgggaugacaagcucaugauccugccuaaauauagccucuuugaacuggagaauggacgcagacggcuucuggccuccgcuggcgaacugcaaaaggggaacgagcucgcccugcccacccaguucaugaaauuucuuuaccuggcgucucgcuauaaugagagcaagggaaagccugaagagauugaaaagaaacaggaguucguuaaccagcauguguccuacuuugaugacauccuccaacugauuaaugauuucagcaaaagagugauccucgcugacgccaaccuggaaaagauuaauaaacuuuaucaggauaacaaggagaacauccccgucgacgagcuggccaauaacaucauuaaucuguuuacauucaccucucucggcgcuccugccgcuuuuaaauucuucgauaagaucguggaccggaagagauacacguccacaaaagaaguucugaacagcacccuuauucaccagucuaucaccgggcuguaugagacacgcauugaccucggcaagcugggagaagauuga

SEQ ID NO: 4350 - RNA, 4134 nt, Artificial Sequence
  Cas9 variant
auggagaagaccuacagcaucggccuggacauugggacaaacuccgugggaugggccgucaucacggaugacuauaaaguucccgcuaagaaaaugaaggugcucggcaauaccgauaaaaaguacauuaagaaaaaccugcuuggggcccuccuguucgacucuggagaaacagcggaggcuaccagacugaagcgggccgcccgcagacgguauacacgcagaaagaaucggcuucgcuaccugcaggaaaucuuugcuaaggagauggccaaaguggaugaaucuuucuuucaaagacucgaggaguccuuccugaccgacgaugacaagacauuugauucucacccuauuuucggcaacaaggcugaagaggacaccuaucaucaggaauuuccgacgaucuaccaucugcggaaacaccucgccgauagccccgagaaggucgaccugcgccuuguguaucuggcgcucgcccacaugaucaaauucagagggcauuuucugauugagggacagcuuaaugcugaaaacaccgauguucagaagaucuucgccgacuuugugggcgucuacgaccggacauucgaugacucccaccugucugagauuaccguggaugcugccagcauccucacagagaaaauuuccaagagccgcagacuggagaaucugaucaaacaauacccuaccgaaaagaagaacacgcucuuuggcaaucugguugcgcuugcccuggggcuccagcccaacuucaaaacaaauuucaagcugucugaggacgcuaaacuucaguuuuccaaggauaccuaugacgaggaucuggaggagcuccugggaaaaauuggcgacgauuacgccgaccuguucacagcugccaagaaccucuaugaugccauccugcuuagcgggauccugaccguggacgacaauucuaccaaggcuccucucuccgcgagcaugauuaaacgguacgaggaacaccaugaagaucuggagaaacuuaaaacauuuaucaaggucaacaauuucgacaaauaucacgagauuuuuaaggauaagucuaaaaacggauacgccggcuauaucgaaaacggggugaagcaggacauuuucuacaaacaucugaaguccaucaucagcgagaaaaauggaggccaauacuuucucgauaagauugaacgcgaggacuuccugagaaagcagcggacguuugauaacggcuccauccccuaucagauucaucugcaggaaaugagaaccauccuccgccggcaaggggaguacuauccuuuccugaaagagaaucaggcuaagauugagaaaauccuuacauuuagaaucccguacuaugugggaccccuggcccgcaagaacucucgguucgccugggcuaaauaccacagcgacgaaccuauuacccccuggaauuuugaugaagucguugacaaggagaaauccgccgagaaguucaucacaagaaugacccucaacgaucuguaucugccugaagagaaggugcuucccaaacacagcuacguguacgaaacguucgcggucuauaaugagcucacaaagauuaaauacgugaacgaacagggcaagagcuuuuucuuugacgcuaauaugaaacaagagaucuucgaucacguuuuuaaggagaaccgcaaggugaccaaagccaagcugcuguccuaucucaauaacgaguucgaagaauuucggauuaaugaccugaucgggcuugacaaagauagcaagucuuucaacgccagccugggaaccuaccaugaccucaaaaagauucuggauaaguccuuucuggacgauaaaacaaaugagcagaucaucgaagacauuguccuuacccucacacuguucgaggauagagacaugauccacgagcgccugcagaaguauucugauauuuuuacgagccagcaacucaaaaagcuggaacggagacauuacaccggcugggggcgccuuuccuauaaacugaucaacggcauucggaacaaggagaauaacaagacaauccucgacuuccugaucgaugacggagaugcuaauagaaacuuuaugcagcugauuaaugacgacagccuuucuuucaaaaccacaauccaggaagcccaggugguuggcgauguggacgauauugaggcugucgugcacgaccucccgggguccccugccaucaagaaaggcauucugcaaagcgucaagaucguggaugaacugguuaaagugaugggacacaacccccagaauaucgucauugagauggcgcgggagaaccagaucaccggguacggacgcaauagaucuaaccagcggcucaagagacugcaagacucccuuaaagaguucggcagcgauauucuguccaagaagaaaccuucuuacguggacagcaagguugaaaauucccaucuccagaacgaucgccuguuucuguauuacauccagaaugggaaagacauguauacgggcgaggaacuugauauugaccaccucucugacuacgauaucgaccauaucauuccccaggccuucaucaaggauaacagcauugacaaucgggugcugaccuccagcgcuaaaaacagaggaaagucugaugacguccccuccaucgaaauugugcgcaacagaaagagcuauugguacaaacuguauaagucuggccucaucuccaaacggaaguuugauaaucugacaaaagccgaacgcgggggacuuaccgagacagacaaggcuggcuucauuaagagacaacugguggaaacccggcagaucacgaaacacguugcccagauccucgaugcgcgcuuuaacacaaagugcgacgagaaugauaaagucauuagagacgugaaggugaucacccugaaaagcucucuggucagccaauuccggaaggaauuuaaguucuacaaagugcgcgagauuaacgauuaccaccaugcccacgacgcuuaucuuaaugccguuguggggacagcucugcucaagaaauacccuaagcuggccccggaguuugucuauggagaauacaaaaaguaugacgugagaaagcucguugccaaauccagcgauaaccauucugagcugggcaaggcuaccgcgaaauacuucuuuuauuccaaucuuaugaacuucuucaagaccgaagugaaauacgccgacgggcgggucuuugagcgccccgauaucgaaacaaaugcugacggcgaggugguuuggaacaagcagagagauuucaauauugugcggaaaguccugagcuacccucaggugaacaucgugaagaaggucgagguucagacgggaggcuuuuccaaagaaucuauccuccccaagggggacagcgauaaacugauuccuagaaagaccaaaaagcugcaaugggagacacagaaguauggaggcuucgacucccccaccguggccuacucugugcuugucguggccgauguugaaaaagggaagacacgcaaacugaagaccgugaaagagcucgucggaaucagcauuauggaacgguccucuuuugaggagaauccggugagcuuccuggaaaagaagggcuaucacaacguucaggaggacaaacucaucaagcugccuaaauacucccuuuuugaguucgaagggggcagacgccggcugcucgcuagcgccacggaacugcagaagggaaaugaagugguccugccccaauauauggugaaccuucuguaccauucucagcacguuaacaauucccacaaaccugagcaucucaacuaugugaagcagcacaaggaugaauuuaaagacauuuucaaucugaucaucagcauugcgagaaucaacauucucaagcccaaagucguggauaaucugaucaacgaguuuacagaauacggccaggaggacauuucuucccuuagcgagucuuucaucaaucugcugaaguuuauuuccuucggggcuccuggagccuucaaauuucucaagcuggacgugaaacaaagcaaccuucgcuacaaguccaccaccgaagcccugagcgcuacacucauccaucagucugucaccggccuguaugagacacggaucgaucucagcaagcugggggaagaguga

SEQ ID NO: 4351 - RNA, 4137 nt, Artificial Sequence
  Cas9 variant
augaagaccuucgccgaggaauacgugauggacaaaagcaagcccuauggcaucgggcuggauauuggaacaaacuccgucggcuuuguugcuacggacgccgaggggcaccucaucagacugaaaggaaagaccgugauuggcgcguaccuuuucaaugcugggaucucugccgccgaacggcgcggauuuagaacaacccggcgcagacugagccgggugaaauggcgccucggccugcuuagagagauuuucgaaacacauuuucaggaguccaugggcgagaacgaagauaaugacuucuuucugcgguucaaguauucuaacaucagcccuaaggauccgcaauuuuccaccgcuaaaggacucuucaaugaccgcacagauaaggaguuuuacgaccaguaucccaccaucuaccaccugagacgggcccugaugacggaagaucaucaguucgacauucgcgagaucuauauugcuaugcaccauaucgucaaauacagagggcacuuucucaaggagggccgggccaaagauuucaaggugggggaccugcgccuucuggauaacuucaagaugaugaaugaacagauugaggaaaucaacccucucuggcaacugaaacuucccaccgacgacgcgucuauuaagagcaucacagccauccugcucgauaauacccagucccagaacgacagacagaaagcuguuacaaaggugauucuggccacccuggucaaagcuagcgauaaggacaucaaugccgcgcggaaaagauuugugggagagcucucuaaggccaugguuggccugaagacgaaacuuugggugcuggcugaugucucccaaaacggggacugggaaauuaaguacgagaauuaugccgauuucgcugagacaaucggaagcggcgaaucugacaccauucagucccucuuuaacgagaucaaugaucuguacggcgugaucacacuugccgggauuaucccuaaagaagccgagagcuucucugacggaauggugcgcaaguaugaacaccaucggaaaaaccuggagcuccugaaggucuacugcgcugagcaguccgauggcaagagagggcgccagauucggcaaaccuaugacaaauacaucgacggaguugauagcaagcaguuuacccaggaagacuucuauaaagcgcuguccaaguuuacagccaaagaugaggcuacgucugaaaacgccaagcucauugcccaagagaucgcugugggcaccuucaugcccaagcugagaacaaaagccaaugggaccaucccucaccagcuucaucagaaggaacuggacgcgauuaucgagaaccagaaaaaguacuacccguggcucggagaggugaaucccgucgaaagccaccgccgggcucugccuuauaaacuugaugagcugguguccuuucgcauucccuacuauguuggcccuauggugacacccaccaagggcgacccggaaaagagcaaauucgccuggauggucagaaaggagccugggacgaucacacccuggaacuuugaucaaaaaguggaccggucugccuccggagaggcuuucauucagagaaugaagaccaccgauacauuucucaucggcgaagacguucugccucagcagagccugcucuaccaaaaauucgaggugcugaaugaacuuaacaagauuaugaucaaugggaaacccaucugucgcgagcagaagcagcggcuguucaagcagcucuuuaugcaauauaaaaccgucacagugaagaaaguccagcagaaccugauugccaauggagaagagucugagaacgugcccaucacgggccugagcgauccucuuagauucaauuccucuuuuagcaccuacauugacuauaaggauauccucgggacagcugccguuaacgacaaugcgaaacaguccgacauugaacaaaucaucgccuggagcaccauuuucgaggaugcugccaucuuucgggaaaagcugaacgacauuacauggcugaaugaugaccagcgcaacaagcucucucacaaaagauaccggggcuggggaagacauucccgcaagcugcuugcuggccugcgggauggggagggacagaccaucauugaaagacucuggaacacgaaugacaacuucaugcaaauccagaaugauagcgagaucgcccgccagauuaccgaggcgaacucuuccaaaauggccacagcugaaggcaccgacgagaucauugauggguuuuacacaagcccggaaaauaagaaagcccugagagaggugaugaaggucgugaaggacauccagcgggcucaccauggacaagcccccgccuggguuuauauugaauccccucgcgagacccccagaccuggccagcggacggugucucgcgagcagcagcugacagaucuuuacgaaggggcugcgaaagagaucgucgacgaugccgugcucaacgaacugaaggacaaaguuaagagcaaagagaauuucaccgacaagcuggugcucuauuuucugcaaaacggccacgauaucuacgcuaaugacuccauuaacaucgauaaucuuaacgccuaugacauugaucauguccugccccagucucucaucaaggacgauagccuggacaauagagugcugacaacccacgagcggaaccuuaaaaaguccaaucgcuucgccaccgaacucuuugcugaucagagaaagaagugggagaaauggcaccggcugggacugauuagcucucgcaagcucaaacaucugacaaugcagccgaacuccguggaaaaguucgcccacggcuuuaucgcgagacaacuuacggagacccggcagauuauccaucugacagcuaacguccucagcaaucuguaccaggaaaacgacaccaagaucgugaugauuaaagccgggcuuaauucugaguucagacgcacauucgauuuuccuaagaaccgguccguuaaugacuaucaccacgccuucgacgcuuuucuuaccgccaaaaucggaagauaccuccuggcgcgcuaccccaagcuggagccuuucuuuguguauggcaacuucgucaaaaaucccaaggcuaugaagcggcucagcucuuuugauuucauugcccaacuggccgcuaaaacggacgauacaagccauaucgaccagagaucccuuaaacaggugccuguugugaacgaagagaccggggaaauugucugggauaaagacaucgagcuggccgaacucgauaagaccuacaauuauaaaacaaugcuggugaagcgcgcucagaccgagaacaaugcccaaauguuuaagcagacaguuuucaaagcgcgggacaaccagaauaagacgcugauccccgugaaaaacggacuuagcaccgaugucuacggcgggcacucucagcaagccauuuccuaucugugcaucgugugggugggccagaagaaaaaguacagaguccucggaauuagcacagcucaugccggcauccugaauaacuuugagaagaacuaugggcgcuucgaagcuaaaaagaaacuccaggagauuguuuccaauacccuggacaacgccgaucggaaugacuucaagaucguggccccgaaagugcuuuuugaacaggucguggaggaugacaacaugaaguucggacugggcucugcuagcgacuacagaaauguucaacagcucuuucugucccggaagaaccagcugcuucuggcgaauaugaugacagaucagauccacgaccaagaucucgugcaucuguucgacgaaauugucgggcagaugaacgcccacuuuccuaucuucgaucgcggaggcuacagaucuagccucacccagucccgggacaaauuucugaagcugcccuucaaaaagaaugaggaucugauuacgaaacaagaggugauccgccggauucucgacgggcugcacgcuaacgccaauagaaaggaucugaaaaucauuggcucuaagggagacuuuggcagacuugggaccaagaaaaucuaucugagcaaggaugccaaacucaucuacacaucccccaccugucuguucacacgcaccguuccucucagcucucuguga

SEQ ID NO: 4352 - RNA, 4137 nt, Artificial Sequence
  Cas9 variant
augaccaacgagaaguacagcaucggccuggacauugggacauccucuaucggauucgccguggucaaugauaacaauagaguuauucgggugaaaggcaagaacgcuaucggggugcgccucuuugacgaaggaaaagccgcggcugauagacggagcuuccgcacgaccagacggcgccuguccagacggcgcuggagacuuaagcugcuccgggagauuuuugacgccuauaucacacccgucgaugaagccuucuuuauccgccugaaagagucuaaucuuagcccuaaggacuccaagaaacaguacucuggcgauauucuguucaacgacagaagcgauaaggacuuuuaugaaaaauacccgaccaucuaucaccuccggaaugcucugaugacagagcaucgcaaguucgaugugagagagauuuaccuggccauccaccauauuaugaaauuucgggggcacuuccucaacgcuacccccgccaauaacuuuaagguuggaagacugaaucuugaagagaaguucgaggaacugaacgacaucuaucaacgcguguuuccugaugaguccauugaauuucggacagacaaucucgagcagaucaaagaaguccugcuugacaacaagagaagccgcgcggaucggcagagaacccuggugucugacaucuaccaguccagcgaggauaaagacauugaaaagcgcaauaaagccguugcuacggagauccucaaggccucucugggcaacaaagcuaagcugaacgugauuaccaaugucgagguggauaaggaagccgcgaaagagugguccaucacauucgacagcgaaucuauugaugacgaucucgccaagaucgagggccaaaugaccgacgaugggcaugaaaucauugaggugcugcggucccuuuacagcggaaucacacuguccgcuauuguccccgagaaccacacccucucucagagcaugguugccaaauaugaccugcacaaggaccaucuuaaacuguuuaagaagcucaucaauggcaugacggauacaaagaaggcuaaaaaccugagagccgccuacgacggguauauugauggagugaagggcaaagugcugccucaggaagacuucuacaagcagguccaagugaaucucgaugacuccgcugaggcgaacgaaauccagaccuauaucgaucaggacauuuuuaugcccaagcagcgcacaaaagccaaugggagcaucccucaccaacugcagcagcaagagcuugaucagauuaucgaaaaccagaaggcuuacuauccguggcuggccgagcucaaucccaacccugacaaaaagcggcagcaacuggccaaauacaaacuugaugagcugguuaccuucagagugcccuacuaugucggaccuaugauuaccgcuaaggaccagaaaaaucagucuggcgccgaauuugcguggaugauccgcaaggagcccggcaacauuacaccguggaauuucgaucagaaaguggaccggauggcuacggccaaccaauuuaucaagagaaugaccacaaccgacacauaccuccugggggaagauguucugccugcccagucccuccuguaucagaaauucgaggugcuuaaugagcugaacaagauccggauugaccauaaacccaucagcauugaacagaagcaacagaucuuuaacgaucucuucaagcaguuuaaaaaugucaccauuaagcaucugcaggacuaccuggugucucaaggacaguauagcaaacgcccucuuaucgagggccucgcugaugaaaagagauucaacuccucucugagcacguacuccgaccugugcgggaucuuuggagccaaacucgucgaggaaaaugaucggcaggaggaccuggagaagauuaucgaauggagcacaauuuucgaggauaagaaaaucuauagagcuaaacuuaacgaccugaccuggcucaccgaugaccaaaaagaaaagcuggccacaaaacgcuaccagggcugggggcggcugucuagaaaacuucucgugggacugaaaaauuccgagcaccgcaacauuauggauauccuguggaucaccaaugaaaacuucaugcagauucaggcggagcccgacuuugccaagcucguuacagacgcuaauaagggcaugcuggagaagacggauagccaagacgugaucaacgaucuuuacaccucuccccagaauaagaaagccauuagacagauccugcucgucgugcacgacauucagaacgcuaugcacggccaagccccugcgaagauccauguugaguucgcccgcggggaagaacggaauccgagacgguccgugcagcgccagagacaggucgaggcugccuaugaaaaggugagcaacgagcugguguccgcuaaaguucggcaagaguuuaaggaagccaucaauaacaaacgcgauuucaaggacagacugcuucucuacuuuaugcagggaggcauugauaucuauacagggaaacagcugaacauugaccaacugucuagcuaccagaucgaucacauucucccccaggccuucgucaaggacgauucccugaccaaucgggugcuuacaaacgagaaucaggugaaagcugacucugucccuaucgacauuuuuggaaagaagaugcugagcguguggggccgcaugaaagaucaagggcucaucuccaagggcaaauauagaaaccugaccaugaaucccgaaaacaucagcgcgcauacggagaauggauucauuaaccggcagcugguugagaccagacaggugaucaaacuugccgucaauauucucgcugacgaauacggcgauucuacacagaucauuuccgugaaggccgaccugagccaccaaaugcgcgaggauuuugaacugcucaagaaccgggacguuaaugauuaucaccaugccuucgacgcuuaccuggccgcguuuaucgggaacuaccuucugaagagauauccuaaacucgagucuuacuucguguauggagauuuuaagaaauucacccagaaggaaacaaaaaugcgccgguucaauuuuaucuacgaccugaagcacugugaucaggucgugaacaaggagaccggcgagauucuguggacgaaagacgaagauaucaaguauauuagacaucuuuucgcuuacaaaaagauccugguuucccacgaggugcgcgaaaaacggggagcccucuauaaucagacaauuuacaaggccaaggacgacaaagggagcggccaagggucuaagaaacugaucagaaucaaggaugacaaagagaccaagauuuacggcggauauagcggcaagucccucgcuuacaugacaaucguccagauuaccaaaaagaacaaagugagcuaucgcgugaucgggauucccacccuggcccuugcgcggcugaacaagcucgaaaaugauucuacagagaacaauggagagcuguacaaaaucauuaagccgcaguuuacgcacuauaaagucgacaagaagaacggcgaaaucaucgagaccacagaugacuucaaaauuguuguguccaaggugagauuucagcaacugaucgaugacgcugggcaguucuuuaugcuugccagcgauaccuacaaaaauaacgcccagcaacuggucauuuccaauaacgcucucaaggccaucaauaacacaaauauuaccgacugcccucgggaugaccuggaacgccucgauaaccugagacuugacucugcuuucgacgagaucgugaaaaagauggauaaguauuuuagcgccuacgacgcgaauaacuuccgggaaaagauccgcaauuccaaccugauuuucuaccagcuccccguugaggaucagugggagaauaacaagaucacggaacugggaaaaagaacagugcugacccggauucuucagggccugcaugccaacgcuaccacaaccgacaugucuaucuucaagauuaaaacaccuuucgggcaacucagacagcgcagcggcaucucccugucugagaaugcccagcucaucuaucagagccccacgggacuguuugaacggagaguccaacuuaacaagauuaaguga

SEQ ID NO: 4353 - RNA, 4137 nt, Artificial Sequence
  Cas9 variant
augaagaacaaagacuacagcaucggccuggauauugggaccuccucuaucggauucgccguggucgacgagaauaaccacguuaugagagugaagggcaaaaaugcuauuggggugcggcucuuugaugaaggaaagcccgccgcggaccgcagagcuuuccggacaacgcgcagacggcugagccgcagacgguggcgccuuaaacugcucagagagaucuuugauuccuauauuaccccugucgacgaagccuucuuuauccggcugaaggagucuaaccuuagcccgaaggauuccaaaaagcaguacucuggcgacauccuguucaaugaucgcagcgacaaagauuuuuauacaaaguaccccaccauuuaucaucucagaaacgcccugaugacagaacaccaacgguucgacauccgcgagauuuaccuggcuauccaucacauugugaaauuuagagggcauuuccucaaugccaccccugcuaacaauuuucagguuggaaagcuggaucuugaccagaaguucgaggaccugaacgauaucuaucagcggguguuucccgacgauuccauugaguucagaaucgacaaucucgaacaaaucaaagccguccugcuugauagcaagcgcucucgguccgacagacagcgcagccugguggaugacguuuaccagacaucugaagauaaagagguggagaagcagaacaaagcggucgccaccgaagugcucaaggcuauucugggcaauaaagccaagcugaacaucauugcuaauguggaggucgacaaggaagccgcgaaagaguggacgaucaccuucgauuccgaaagcauugacgacgaucucgccaagaucgacggccaaaugacagaugacgggcgggcuaucguugagauucugagaucucuuuacuccggaaucacccugagcgccauugugccugagaaccacacacucucccaggcuaugguggccaaauaugaucugcacaagaaacaucuuacccugcucaagaagcugaucaacucuaugacggacacaaagaaggccaaaaaucugcgcgcugcguacgauggcuaugucgacggggugaagggaaaaguucucacccaggaugaauuuuacaagcagauucaaagcaaccuggacgaguccguggaagccagcgagauccagacauauaucgaucaggacauuuucaugcccaagcaacggaccaaagcuaauggcucuaucccucaccagcuucagcagcaagaacuggaucagauuaucgagaaccagaaggaguacuauccguggcucgccgaacugaaucccaacccugacaaaaagagacagcaacuugccaaauacaagcuggacgagcucgucaccuuucgcgugcccuacuauguugggccuaugauuacagcugaagcccagaagaaacaguccggagcggaguucgcuuggaugauccggaaggaaagcggcaauauuacgcccuggaacuuugaucagaaaguggacagaauggccaccgccaaucaauucaucaagcgcaugacaaccacagauaccuaccugcugggcgaggacguccucccgucucagagccugcuuuaucagcgguuugaggugcugaacgaacucaauaaaaucagaauugaucggaagccuaucuccgucgagcugaaacagcaaauuuucaacgaccuguuuaagaaguucaaaaaugugacgaucaagcaucuucaggauuaccucguugcucaggggcaauauucuaaacgcccccugauugaaggacuggccgacgagaagagauuuaacagcggccucuccacauacaaugauuucugcgggaucuuuggagcuaaacugguggacgagaacgaucggcaggccgaccuugaaaagaucauugaguggagcaccaucuucgaagauaagaaaauuuauagagcgaagcugaacgaccucgccuggcugaccgacgagcagaaagauaagcuggcuacaaaacgcuaccagggcugggggcggcuuucuuccaagcuccugaucggacugcaaaauagcgaacacagaaacauuauggaccuccuguggaucggcaaugagaacuucaugcagauccaggccgauucugacuuugcuaaacuuauuaaagaugccaaucagaacgcgcugcaaaauaacgacucccaggaugucaucaaugaccucuacaccagcccucagaacaagaaagccauucgccagauccugcuggugguucacgauauucaaaaugcuaugcauggccaggcccccacaaagauccacguggaguucgcuaaaggggaagagagaaacccccggcgcuccguccagagacaacgccagguggaagccgccuaugagaaggcuucuaaugaacuugugggagcgaacguucgggaggagcucaaggacgccaucacgaauaaaagagauuuuaaggaccggcuguuccuguacuuuaugcagggcggggucgacauguauagcggagaaccuauuaacaucgauaaccucucccgcuacgacauugaucauauccugccgcaggcuuucgugaaagacgauucucuuaauaacagagugcugaccgacgccgagaagaaucggcgcaaaagcgaugccguccccaacgaacucuuuggcgcuaagaugagagugacaugggagcggaugaaagaacaagggcugauuuccaagggcaaguauagaaaucugaccaugaacccugagaauaucaacaaauacacagagaauggauucauuaaccgccagcuuguugaaaccagacaggugaucaagcucgccgucaauauccuggcggacgaguauaaagaaaacacgcagauuaucagcgugaaggcugaucugucucaccaaaugcgggaggacuuugagcuccugaaaaaucgcgauguuaacgacuaccaucacgccuucgaugccuaccuugcugccuuuaugggcaauuaucugcucaagcgguaccccaagcugagauccuauuucguguacggggacuuuaaaaaguucacccagaaagaaauuaagcugcgccgguucaacuuuaucuaugaccuuaaacacgaggaucaggucauugacaaggaaacaggagagauccuguggaacaagaaugaagauaucgcguacauuagacaucucuucgcuuauaaaaagauccugauuagccacgaggugucugagcgccggggcgcccucuacaaccagaccguuuacaaagccuccgacgauaaggcuagcgggcaaggaucuaaaaagcugaucccuauuaagagcgacaaacccacagaaaucuauggcggguacaccggcagaacgcuugccuauaugacaaucgugaaggucaccaaaggaaagaaaauuuccuacaagguggugggcgucccgacagcuguucuggccaagauggcgggggugcggcagggaagccaggaggaacaggauaaacucuauggcgugcugaagccucaauuuacccaucagaaagagaauaagaaaaccggggaaaucacagagacggucgacaaguucgauauuaucgugcccaaaguuaaguaccagcaacuggugaacgacaauggacagcuuuuuaugauuggcucugauacccugccuuauaacgccgagcagcucguccuguccaaggaaagcgugcagacaaucaauaaccccgggauuaaagacgagggcuccgaugaagagucugaaaauaagaaacucgacaacguuuacgacgagaucgugcuguguaugaauaaguacuucccucuuuaugauaaccgcggauuuagaaauagcaucaccaacggcaaaaauaaguuccugaagcuccccauuaaaaacaucuacaagaaugggaaacugauuaacgucggaaagcgggaggugaucaaccgcauucugcaaggccuucacgcuaaugccuccguuacagaccugucuaaccucgggaucaaaagcccguuuggauuccugcagaagggcgcugggcucucccugucuggcgaagcccagcuuauccaccagagcgccaccggacuguuugagcauagagugcaacugaauaagauuaaauga

SEQ ID NO: 4354 - RNA, 4137 nt, Artificial Sequence
  Cas9 variant
augagcaacaagcccuacuccaucggccuggacauugggaccaauucugugggaugggccgucaucacagaugacuauaaaguuccuagcaagaaaaugaaggugcucggcaacacggauaaacacuucauuaagaagaaucugaucggggcccuucuguuugacgagggaaccacagcugaaggcagacggcucaaacgcaccgcgagacggcgcuacacaagacggaagaaccgccugagauaucuucaggagauuuucuccgaagagaucucuaaaguggauagcuccuuuuuccaucggcuggacgauucuuuucucgucccggaagacaagcgcgggagcaaauaccccaucuucgcuacccuggccgaggagaaggaauaucacaagaauuuuccuacaauuuaccaucugagaaaacaacucgccgauuccaaggagaaagcugaccugcggcuuaucuaucuggcccucgcucacaugaugaaguaccgcggacauuuccuguacgaagagagcuuugauauuaaaaacaaugacauccagaagauuuucaacgaguuuaucucuauuuaugauaauaccuucgaaggcuccagccuuucugagcagaacgugcagguugaagccaucuuuacggacaaaaucuccaagagcgcgaagagagagcgggugcugaaacucuuccccgacgaaaagucuaccggccuguucuccgaguuucugaaacucauugucgggaaucaagccgaguucaagaaacacuuugaucuggaagagaaggcuccucuucaguucagcaaggacacauacgaugaagaccuggagaaccuccugggacagaucggcgauggguuugccgaccuuuuccugguggcuaaaaagcucuaugaugccauucugcuguccggaauccucaccguuacagaccccucuaccaaagcgccucugagcgccuccaugauugaacgcuacgagaaucaccagaaggaucuugcuagccugaaacaauuuaucaagaacaaucucccggccgagaagugcguggaagucuucucugaccaguccaaagauggcuaugcuggguacaucgacggaaagacgacacaggaggccuuuuauaaauacauuaagaaccugcuuagcaaacuggaaggcgccuacuauuuccucgacaagaucgagagagaagauuuucugcggaagcagagaaccuucgacaacggcucuauuccccaucaaauccaucugcaggagaugaaugcuauucuccgccggcagggggagcacuacccuuuucugaaagaaaacagagagaagaucgaaaagauccuuacauuccgcauucccuaucacgugggaccucuggcgcggggcaauagagauuucgccuggcucacccgcaacagcgacgaggcuauccggcccuggaauuuugaggaaauuguggaucaagccuccucugccgaggacuucaucaacaagaugaccaauuacgaucuguaucugccggaagagaaaguccuuccuaagcacagccuccuguacgaaacauuugcuguuuauaacgagcugacgaaagugaaguucauugccgaggggcucaccagauaccaguuucuggacaagaaacagaagaaagauaucuucuacacauuuuucaaggcggaagacaaacgcaaggugaccgagaaggauauuauccauuaucuucacaaugucgacggauacgauggcaucgaacugaaagggauugagaagcaguuuaacgcuucccucagcacauaucaugaccugcugaaaaucauuaaggacaaagaauuuauggaugaccccaagaaugaggagauccuugaaaacauugugcacacccucacgaucuuugaggaucgggaaaugaucaagcaaagacuggcccaguacgacucucuguucgaugagaaaguuauuaaggcccucacacgccggcauuauaccggauggggcaaacuguccgcuaaacuuaucaauggcauuugugacaaacagaccgggaagacaauccuggauuaccucauugacgauggaaagaucaacagaaauuuuaugcagcugaucaacgacgauggccugagcuucaaagaaauuauccaaaaggcccagguggucgggaaaaccuaugacgugaagcagguugugcaggagcuuccuggaucucccgcuauuaaaaagggcauccuccaauccgucaaacugguggaugagcuggucaaggugauggggcacgcccccgaaagcauuguuaucgagauggcgcgggaaaaccagacaacggccaagggcaaaaagaacucccagcagcgcuacaaaagaaucgaggacgcuauuaagaaucucgccccuggacuggacucuaccauccuuaaagagcacccgacagauaauauucaacugcagaacgacagacucuuccuguacuaucugcagaauggccgggauauguacaccgggaagccccuugaaaucaaccaacucagcaauuaugacauugaucauaucauuccucaggcuuuuaucaaggacgauucccuggacaaccgcgugcugacaucuagcaaagagaaucggggaaaguccgauaacguccccagccucgaagugguugagaaaaugaaggccuucuggcagcagcugcuugacucuaaacugaucuccgaaagaaaguuuaauaaccucaccaaggcggagcgcggcgggcuggaugagcuggacaaagugggauucauuaagagacaacuugucgaaacgcggcagaucaccaaacacguggcccagauucuggacgcucgcuuuaauaaggaggugacagagaaaaacaagaagaauagaaacguuaaaaucauuacccucaagagcaacauggucucuaauuuccggaaagaauuuggccuguacaaggugcgcgaaaucaacgauuaucaucacgcccacgacgcuuaccucaaugccguggucgccaaagcuauccugaagaaguauccuaaacuugagcccgaguucguguacggggauuaccagaaguaugaccugaaaagauacauuuccaagagcaaagauccgaaggaaguugagaaagcgacagaaaaguauuucuucuacucuaaccuccugaacuuuuucaaggaggaagugcauuaugccgacggcaccaucgucaaacgggagaauauugaguacagcaaggauacgggagaaaucgcuuggaauaaagagaaggacuucgccacaauuaaaaaggugcuguccuuuccucaaguuaacaucgugaagaaaaccgaggaacagacagucggccagaaugggggacuuuucgauaacaauaucgugagcaaggagaaaguuguggacgccucuaagcugauucccaucaaauccggccucagcccugaaaaguaugggggauacgcucgccccaccauugccuacuccguccuggugaccuauaagcagaacaauaaaaucaagaacacaauggugggcauuccuguccucacgaaacuggaguuugaaagagaucccaaucuuuaccugcggaaccucgggaucaacaauguuucucacgugauuaagcuggugaaacauaccguccuggaguucaagcacaaguauggcacauaccgcagauuuaucgugagcaaccaagaacuuaaacgggcgaaucagaucuucguuaccacaaagcagaugaaacugauuucccaauauaccacgcucgacaagaacgagcaugauucucugcucaaaaauaaccagcagcugauccagagcauuuggaaucaauuucuugaguucaugcuggcuacagaccuggugaacaagaaacaguacgacgaacucauccugaccaauaaccagaccauugaggaaugcagaaauaucaugaaccgcgucaucacaacccuuuccuuuacaaauauuaacgccggacagaagaagaucauuuucgaugacacgcugucucucccgaucaaacgguggcaauuuaccgauagcgacaagauggugaaaaagauuaucgaguccacacugauccaccagagcauuaccggccucuaugaaacaagaaucgaucugaauaaacuuggggaggacuga

SEQ ID NO: 4355 - RNA, 4137 nt, Artificial Sequence
  Cas9 variant
augaacaagcccuacagcaucggccuggacauugggaccaauuccgugggauggucuaucauuacagaugacuauaaagucccugccaagaaaaugagaguucucggcaacacggauaaggaguacaucaaaaagaaucugauuggggcucugcuguucgacggaggcaacaccgccgcggaucggcgccucaagagaacagcucggcgcagauauacccggcgcagaaaucggauccuguaccuucaggaaaucuuugccgaggaaaugagcaaaguggacgauuccuucuuucaccgccuggaggacucuuuccucguggaagaggauaagagagggagcaaauauccgauuuuugccacaaugcaagaggaaaaguacuaucaugagaaauuccccaccaucuaccaucugcggaaggaacuggcugacaagaaagagaaggccgaucuccgccugauuuaccuugcucuggcccacaucauuaaauuuagaggacacuuccucaucgaggacgaucgguuugacguccgcaacacagacauucagaagcaguaucaggcguuccuggaaaucuuugauaccacguucgagaauaacgaccuucugucccaaaauguggauguugaagccauccucaccgacaaaauuucuaagagcgcuaaaaaggauagaauccuggcccgguacccuaaccagaaguccacaggcauuuuugcugaguuccugaaacucaucgugggcaaucaggccgacuucaagaaacauuuuaaccuggaagauaagacaccccuucaguucgcgaaagacagcuaugaugaggaccuggagaaucuccuggggcaaauuggagaugaauuugccgaccuuuucucugcugccaagaagcuguacgacuccguccuccugagcggcauccugaccgugaucgaucucucuaccaaagcuccucuguccgccagcaugauucagagauaugacgagcaccacgaagaucuuaagcaucugaaacaguuuguuaaggccucucuccccgagaacuaccgcgaaguguucgcugacuccagcaaagauggguaugcgggauacaucgagggcaagacgucccaggaggccuuuuacaaguaucugcuuaaacugcucacaaagcaagaagggucugaguaccugcuggaaaagauuaagaaugaggacuuccuccggaaacagagaaccuuugauaacggaagcaucccucaccagguccaucugacagaacuucgcgcuauuauccggagacaauccgaguauuacccguuccugaaggagaaccucgaccgcaucgaaaagauucugaccuuucggauccccuauuacgugggcccucuggccagagagaaaagcgauuucgccuggaugacccgcaagacagacgauucuauucggcccuggaauuuugaagaccuuguggauaaagagaaguccgcugaggccuucauccacagaaugacgaacaaugaccucuaucugccugaagagaaaguccugcccaagcacagccucauuuacgaaaaauucaccguuuacaacgagcugacaaaggugcgcuuucuugcggaaggcuucaaggacuuucaguuccugaaucggaaacagaaggagaccaucuuuaacucucucuucaaagagaagagaaaagugacagaaaaggauauuaucagcuuucugaauaaggucgacggguaugagggaaucgcuauuaaaggcaucgaaaagcaguucaacgccucccugucuaccuaccaugaucuuaaaaagauucucgggaaagacuuucuggauaauacggacaacgagcugauccucgaagauauuauccaaacacugacccuuuucgaggaccgggagaugaucaagaagcgccuggauauuuauaaagacuuuuucaccgaaagccagcucaagaaacuguacagacggcacuauacaggauggggcagacuguccgccaagcugaucaaugggauucgcaacaaagagaaucagaagaccauccucgauuaccugauugacgauggaagcgcuaaccggaauuuuaugcagcugaucaaggacgccggccucucuuucaaaccgaucauugacaaggcuagaacaggcucccauagcgauaaccugaaagaagugguuggggagcuugccggaucuccugcgaucaagaaaggcauucugcaaucccucaagaucguggacgaacuggucaaagugaugggguaugagcccgagcagauuguuguggaaauggcccgcgagaaccagacgaccgcuaagggacugagcagaucccggcagcgccuuacaacccucagagaaucucugggcaaucugaaaagcaacauccucgaggagaaaaagccuaaauacgucaaggaucaaguggaaaaucaccaucuguccgacgaucggcuuuuccuguacuaucuccagaacgggaaagacauguacacagaugacgagcuggauaucgacaaucugucucaguaugauauugaccacaucauuccccaggccuuuaucaaggacgauagcauugacaaccgcguccuuguguccagcgcuaagaauagaggcaaaucugaugacguucccuccaucgaaauugugaaggcccggaaaauguucuggaagaaccugcucgaugcgaaacugaugagccaacgcaaguacgacaaucucaccaaggccgagagaggaggccugacgucugaugacaaagcucgguuuauccagcgccagcuugucgaaaccagacaaaucacaaagcacguggcccggauucuggaugagagauucaacaaugagcucgacuccaaagggcgccggaucagaaagguuaaaauugugacccuuaagagcaaccuggucucuaauuuucgcaaggaguucggauuuuauaaaauccgggaagugaacaauuaccaucacgcucaugaugccuaucuuaacgccgugguugcuaaggcgauucugacaaaauacccucagcucgaaccggaguucgucuacggccuguauagacgcaagaaacucagcaagaucgugcgggaagacaaggaggagaaauacuccgaagccaccagaaagauguuuuucuauagcaaccugaugaauauguuuaaacgcgugguccggcuugcugaugggucuaucgugguuagacccgugauugagacgggacgguacaugggcaagacagccugggacaaaaagaaacacuucgccaccguccgcaaggugcuguccuauccucagaacaauaucguuaagaaaacagaaauucagaccgggggcuucagcaaggaguccauccucgcucacggaaacucugacaaacugauucccagaaagaccaaagauaucuaccuggacccuaagaaguauggcggguuugauagccccaucguggccuacuccguccuugugguugcggacauuaaaaagggaaaagcucaaaagcugaaaacagugacggaacuccugggcaucaccauuauggagcggucucgcuucgagaagaauacaagcgccuuucucgaauccaagggguaccugaacaucagagaugacaaacuuaugauucugccgaaguauucucuguucgagcucgaaaauggacggagacgccugcuugccagcgcuggcgagcugcagaaagggaacgagcucgcccugccuacccaguuuaugaaguuccucuaccuggcgucccgguauaaugaaagcaaaggcaagcccgaggaaaucgagaagaaacaggaauuugucaaccaacaugugucuuacuucgaugacauucuucagcugaucaaugauuuuuccaacagagugauccuggcugacgccaaucucgagaagauuaacaaacuguaucaggauaauaaggagaacaucccugucgacgaacuugccaacaauauuaucaaccuguucacauuuaccagccucggagcucccgccgcuuucaaauuuuucgauaagauuguugaccgcaaacgguacacgucuacaaaggaggugcuuaauuccacccucauccaccagagcaucaccggccuguaugaaacaagaauugaccuugggaagcugggagagggcuga

SEQ ID NO: 4356 - RNA, 4137 nt, Artificial Sequence
  Cas9 variant
augaccaacgagaaguacagcaucggccuggacauugggacauccucuaucggauucgccguggucaaugauaacaauagaguuauucgggugaaaggcaagaacgcuaucggggugcgccucuuugacgaaggaaaagccgcggcugauagacggagcuuccgcacgaccagacggcgccuguccagacggcgcuggagacuuaagcugcuccgggagauuuuugacgccuauaucacacccgucgaugaagccuucuuuauccgccugaaagagucuaaucuuagcccuaaggacuccaagaaacaguacucuggcgauauucuguucaacgacagaagcgauaaggacuuuuaugaaaaauacccgaccaucuaucaccuccggaaugcucugaugacagagcaucgcaaguucgaugugagagagauuuaccuggccauccaccauauuaugaaauuucgggggcacuuccucaacgcuacccccgccaauaacuuuaagguuggaagacugaaucuugaagagaaguucgaggaacugaacgacaucuaucaacgcguguuuccugaugaguccauugaguuccggacagacaaucucgaacagaucaaagaaguccugcuugacaacaagagaagccgcgcggaucggcagagaacccuggugucugacaucuaccaguccagcgaggauaaagacauugaaaagcgcaauaaagccguugcuacggagauccucaaggccucucugggcaacaaagcuaagcugaacgugauuaccaaugucgagguggauaaggaagccgcgaaagagugguccaucacauucgacagcgaaucuauugaugacgaucucgccaagaucgagggccaaaugaccgacgaugggcaugaaaucauugaggugcugcggucccuuuacagcggaaucacacuguccgcuauuguccccgagaaccacacccucucucagagcaugguugccaaauaugaccugcacaaggaccaucuuaaacuguuuaagaagcucaucaauggcaugacggauacaaagaaggcuaaaaaccugagagccgccuacgacggguauauugauggagugaagggcaaagugcugccucaggaagacuucuacaagcagguccaagugaaucucgaugacuccgcugaggcgaacgaaauccagaccuauaucgaucaggacauuuuuaugcccaagcagcgcacaaaagccaaugggagcaucccucaccaacugcagcagcaagagcuugaucagauuaucgaaaaccagaaggcuuacuauccguggcuggccgagcucaaucccaacccugacaaaaagcggcagcaacuggccaaauacaaacuugaugagcugguuaccuucagagugcccuacuaugucggaccuaugauuaccgcuaaggaccagaaaaaucagucuggcgccgaauuugcguggaugauccgcaaggagcccggcaacauuacaccguggaauuucgaucagaaaguggaccggauggcuacggccaaccaauuuaucaagagaaugaccacaaccgacacauaccuccugggggaagauguucugccugcccagucccuccuguaucagaaauucgaggugcuuaaugagcugaacaagauccggauugaccauaaacccaucagcauugaacagaagcaacagaucuuuaacgaucucuucaagcaguuuaaaaaugucaccauuaagcaucugcaggacuaccuggugucucaaggacaguauagcaaacgcccucuuaucgagggccucgcugaugaaaagagauucaacuccucucugagcacguacuccgaccugugcgggaucuuuggagccaaacucgucgaggaaaaugaucggcaggaggaccuggagaagauuaucgaauggagcacaauuuucgaggauaagaaaaucuauagagcuaaacuuaacgaccugaccuggcucaccgaugaccaaaaagaaaagcuggccacaaaacgcuaccagggcugggggcggcugucuagaaaacuucucgugggacugaaaaauuccgagcaccgcaacauuauggauauccuguggaucaccaaugaaaacuucaugcagauucaggcggagcccgacuuugccaagcucguuacagacgcuaauaagggcaugcuggagaagacggauagccaagacgugaucaacgaucuuuacaccucuccccagaauaagaaagccauuagacagauccugcucgucgugcacgacauucagaacgcuaugcacggccaagccccugcgaagauccauguugaguucgcccgcggggaagaacggaauccgagacgguccgugcagcgccagagacaggucgaggcugccuaugaaaaggugagcaacgagcugguguccgcuaaaguucggcaagaguuuaaggaagccaucaauaacaaacgcgauuucaaggacagacuguuucuuuacuucaugcagggaggcauugauaucuauacagggaaacagcucaacauugaccaacugucuagcuaccagaucgaucacauucugccccaggccuuugucaaggacgauucccucaccaaucgggugcugacaaacgagaaucaggugaaagcugacucugucccuaucgacauuuucggaaagaagaugcuuagcguguggggccgcaugaaagaucaagggcugaucuccaagggcaaauauagaaaccucaccaugaaucccgaaaacaucagcgcgcauacggagaauggauuuauuaaccggcagcugguugagaccagacaggugaucaagcuggccgucaauauucuugcugacgaauacggcgauucuacacagaucauuuccgugaaagccgaccucagccaccaaaugcgcgaggauuucgaacugcugaagaaccgggacguuaaugauuaucaccaugccuuugacgcuuaccucgccgcguucaucgggaacuaccugcuuaagagauauccuaaacuggagucuuacuuuguguauggagauuucaagaaauucacccagaaggaaacaaaaaugcgccgguuuaauuucaucuacgaccucaagcacugugaucaggucgugaacaaggagaccggcgagauucuguggacgaaagacgaagauaucaaguauauuagacauuccuuugcuuacaaaaagauccugguuagccacgaggugcgcgaaaaacggggagcccuuuauaaucagacaauuuacaaggccaaggacgacaaagggucuggccaagggagcaagaaacugaucagaaucaaggaugacaaagagaccaagauuuacggcggauauuccggcaagagccucgcuuacaugacaaucguccagauuaccaaaaagaacaaagugucuuaucgcgugaucgggauucccacccuggcccucgcgcggcugaacaaacuugaaaaugauuccacagagaacaauggagagcuguacaagaucauuaagccgcaguucacgcacuauaaagucgacaagaagaacggcgaaaucaucgagaccacagaugacuuuaaaauuguugugagcaaggugagauuccagcaacucaucgaugacgcugggcaguuuuucaugcuggccuccgauaccuacaaaaauaacgcccagcaacuggucauuucuaauaacgcucuuaaggccaucaauaacacaaauauuaccgacugcccucgggaugaccuggaacgccucgauaaccugagacucgacagcgcuuuugacgagaucgugaaaaagauggauaaguauuucuccgccuacgacgcgaauaacuuucgggaaaagauccgcaauucuaaccugauuuucuaccagcuucccguugaggaucagugggagaauaacaagaucacggaacugggaaaaagaacagugcucacccggauucugcagggccugcaugccaacgcuaccacaaccgacaugagcaucuucaagauuaaaacaccuuuugggcaacuuagacagcgcuccggcaucucucugagcgagaaugcccagcucaucuaucagucccccacgggacuguucgaacggagaguccaacucaacaagauuaaguga

SEQ ID NO: 4357 - RNA, 4137 nt, Artificial Sequence
  Cas9 variant
augaccaacgagaaguacagcaucggccuggacauugggacauccucuaucggauucgccguggucaaugauaacaauagaguuauucgggugaaaggcaagaacgcuaucggggugcgccucuuugacgaaggaaaagccgcggcugauagacggagcuuccgcacgaccagacggcgccuguccagacggcgcuggagacuuaagcugcuccgggagauuuuugacgccuauaucacacccgucgaugaagccuucuuuauccgccugaaagagucuaaucuuagcccuaaggacuccaagaaacaguacucuggcgauauucuguucaacgacagaagcgauaaggacuuuuaugaaaaauacccgaccaucuaucaccuccggaaugcucugaugacagagcaucgcaaguucgaugugagagagauuuaccuggccauccaccauauuaugaaauuucgggggcacuuccucaacgcuacccccgccaauaacuuuaagguuggaagacugaaucuugaagagaaguucgaggaacugaacgacaucuaucaacgcguguuuccugaugaguccauugaguuccggacagacaaucucgaacagaucaaagaaguccugcuugacaacaagagaagccgcgcggaucggcagagaacccuggugucugacaucuaccaguccagcgaggauaaagacauugaaaagcgcaauaaagccguugcuacggagauccucaaggccucucugggcaacaaagcuaagcugaacgugauuaccaaugucgagguggauaaggaagccgcgaaagagugguccaucacauucgacagcgaaucuauugaugacgaucucgccaagaucgagggccaaaugaccgacgaugggcaugaaaucauugaggugcugcggucccuuuacagcggaaucacacuguccgcuauuguccccgagaaccacacccucucucagagcaugguugccaaauaugaccugcacaaggaccaucuuaaacuguuuaagaagcucaucaauggcaugacggauacaaagaaggcuaaaaaccugagagccgccuacgacggguauauugauggagugaagggcaaagugcugccucaggaagacuucuacaagcagguccaagugaaucucgaugacuccgcugaggcgaacgaaauccagaccuauaucgaucaggacauuuuuaugcccaagcagcgcacaaaagccaaugggagcaucccucaccaacugcagcagcaagagcuugaucagauuaucgaaaaccagaaggcuuacuauccguggcuggccgagcucaaucccaacccugacaaaaagcggcagcaacuggccaaauacaaacuugaugagcugguuaccuucagagugcccuacuaugucggaccuaugauuaccgcuaaggaccagaaaaaucagucuggcgccgaauuugcguggaugauccgcaaggagcccggcaacauuacaccguggaauuucgaucagaaaguggaccggauggcuacggccaaccaauuuaucaagagaaugaccacaaccgacacauaccuccugggggaagauguucugccugcccagucccuccuguaucagaaauucgaggugcuuaaugagcugaacaagauccggauugaccauaaacccaucagcauugaacagaagcaacagaucuuuaacgaucucuucaagcaguuuaaaaaugucaccauuaagcaucugcaggacuaccuggugucucaaggacaguauagcaaacgcccucuuaucgagggccucgcugaugaaaagagauucaacuccucucugagcacguacuccgaccugugcgggaucuuuggagccaaacucgucgaggaaaaugaucggcaggaggaccuggagaagauuaucgaauggagcacaauuuucgaggauaagaaaaucuauagagcuaaacuuaacgaccugaccuggcucaccgaugaccaaaaagaaaagcuggccacaaaacgcuaccagggcugggggcggcugucuagaaaacuucucgugggacugaaaaauuccgagcaccgcaacauuauggauauccuguggaucaccaaugaaaacuucaugcagauucaggcggagcccgacuuugccaagcucguuacagacgcuaauaagggcaugcuggagaagacggauagccaagacgugaucaacgaucuuuacaccucuccccagaauaagaaagccauuagacagauccugcucgucgugcacgacauucagaacgcuaugcacggccaagccccugcgaagauccauguugaguucgcccgcggggaagaacggaauccgagacgguccgugcagcgccagagacaggucgaggcugccuaugaaaaggugagcaacgagcugguguccgcuaaaguucggcaagaguuuaaggaagccaucaauaacaaacgcgauuucaaggacagacuguuucuuuacuucaugcagggaggcauugauaucuauacagggaaacagcucaacauugaccaacugucuagcuaccagaucgaucacauucugccccaggccuuugucaaggacgauucccucaccaaucgggugcugacaaacgagaaucaggugaaagcugacucugucccuaucgacauuuucggaaagaagaugcuuagcguguggggccgcaugaaagaucaagggcugaucuccaagggcaaauauagaaaccucaccaugaaucccgaaaacaucagcgcgcauacggagaauggauuuauuaaccggcagcugguugagaccagacaggugaucaagcuggccgucaauauucuugcugacgaauacggcgauucuacacagaucauuuccgugaaagccgaccucagccaccaaaugcgcgaggauuucgaacugcugaagaaccgggacguuaaugauuaucaccaugccuuugacgcuuaccucgccgcguucaucgggaacuaccugcuuaagagauauccuaaacuggagucuuacuuuguguauggagauuucaagaaauucacccagaaggaaacaaaaaugcgccgguuuaauuucaucuacgaccucaagcacugugaucaggucgugaacaaggagaccggcgagauucuguggacgaaagacgaagauaucaaguauauuagacaucuguuugcuuacaaaaagauccuuguuucccacgaggugcgcgaaaaacggggagcccuguauaaucagacaauuuacaaggccaaggacgacaaagggagcggccaagggucuaagaaacucaucagaaucaaggaugacaaagagaccaagauuuacggcggauauagcggcaagucccuggcuuacaugacaaucguccagauuaccaaaaagaacaaagugagcuaucgcgugaucgggauucccacccucgcccuggcgcggcuuaacaagcuggaaaaugauucuacagagaacaauggagagcucuacaaaaucauuaagccgcaguucacgcacuauaaagucgacaagaagaacggcgaaaucaucgagaccacagaugacuuuaaaauuguuguguccaaggugagauuccagcaacugaucgaugacgcugggcaguuuuucaugcuggccagcgauaccuacaaaaauaacgcccagcaacuugucauuuccaauaacgcucugaaggccaucaauaacacaaauauuaccgacugcccucgggaugaccucgaacgccuggauaaccucagacuggacucugcuuuugacgagaucgugaaaaagauggauaaguauuucagcgccuacgacgcgaauaacuuucgggaaaagauccgcaauuccaaccuuauuuucuaccagcugcccguugaggaucagugggagaauaacaagaucacggaacucggaaaaagaacagugcugacccggauucugcagggccuucaugccaacgcuaccacaaccgacaugucuaucuucaagauuaaaacaccuuuugggcaacugagacagcgcagcggcaucucccucucugagaaugcccagcugaucuaucagagccccacgggacucuucgaacggagaguccaacugaacaagauuaaguga

SEQ ID NO: 4358 - RNA, 4140 nt, Artificial Sequence
  Cas9 variant
augaagcagauccugggccucgaccuggggaccacaagcauuggaugggcccuugugagagaggcugaaaacaaagaugagcaauccucuaucguccggauuggcguucgcgugaauccccugacgagcgacgaacagaagaacuucgagcaggggaaauccaucaccacaaaugccgauagaacccucaagcggucuaugcgcagaaaccugcagcgguacaaacuucgcagagaccaccugaaggauugccuccaaaagaauggaauuaucacagacaaagcggugcugagcgaaaacggcaauuauaccacauuucagaccuacuaucugcgggcuaaggccgucaacgagaaaaucucccucgaggaguucgcccgcgugcugcuuaugcugaauaagaaaagaggguacaagucuagccggaagaugaaauccgcugaugaaggacagcucauugacggcaugagcguugccaagcgccuguauaacgauaauaucacgccuggccaguacgugcuuucucugcucgaagaggggagaaaauauauuccggacuuuuaccgguccgaucugcuggacgagcucgauaagaucuggaccuuccaacaguguuuuuaccccgaaauucugacaccugagugccgcaaacuuaucgcuggaaagggcaaacaggccaccgcgaagauuuuccuggggaaguauaaaaucuacacagccgacaacaagagcaaagacaagagacuccaggcuuaucaauggcgggucgaagcccugucuggacagcuucccaucgaggugguugcuuuuguggucugugaaauuaauggcgccauccaggcguccagcggguaccugggagccauuucugauagauccaaagagcucuauuucgagggccugaccgugggccaauaccuggugaagcagcucgaaaagaacccugacacgagccugaaaaauaaggucuuuuaucgccaggauuaccuuaacgaguucgaaaagaucugggagaagcaggcugaauaccauacagagcugacaccccaacucaaaaaggagguucgggacauuaucaucuuuuaucagagaacccugaagucccagaaagggcuugugggauucugcgaauuugagucucgccagauugaagugaugaucgauggcaagcugaaaaagaaaaccgucgggugucgggugugcccuaagagcuccccgcuguuccaagaguacaagauuuggcacaaccucaauaaccugaaaaucguugaaaaggagcucggaaaaagcagauuccugaaucaggacgagaaggaaucucuuuuucaggagcugaacauuaaagaaaagcucuccaaaaccgauauccugaagcugcuuugucucaaggccaaagaguucgaccugaauuuugagaagguggaaggcaaccgcacacaggcugagcuguuccgggccuaucaagccaucauugaaaugagcgggaauggagauuacgacuuuucuaaaaugacgagcuccgagauccaggauaccgucacaggcguguucagaggccucggguauaacaccgacauucugucuuuugacgcugaaaaggaggagaaaacauucgauaagcagcccauguaccuucuguggcaucuccuguauagcuacgaaggagacuccagcgauaccggcaauaaggcgcugaucacgaaaauuaagaaacuuugcggguuugagucugaagaguacgcccgcauccucacagacguuaccuuccaguccgaauauggaaaccugagcaccaaggcuauucggagaauccugccuuuuaugaaaaagggcucugaguacuccgaggccugucgccacgccggguaucggcauagcgaaagaucccucacaaaggaggaacuggauaaaaagguguacaaagaccaccuugagcugcucccccgcaauucucugcggaacccugucguggaaaagauccugaaucaaaugauucacgucgugaacaccguuguggauacauauggcaaacccgacgagaucagaauugagcuugcucgggaacucaaaaagagcgccaaagagagagaugaaaugacggcguccaucaauaagaccgcugccgagcauaaaaaguacugcgagguccugcagaaagaguucggauuuacacacgugucucgcaacgacauuauccgguauaagcuguaccucgaacuggaaaacaauggcuacaaaacccuuuauagcgauacauacaucccgagagagaagcuguucuccaaggaguucgacauugaacauaucauuccucagagcaaacucuuugaugacucuuucuccaacaagacccuggagugucgcagcguuaauaucgaaaaaucuaacgacacggccuaugauuacgugcugaauaaguauggggagcaaggcauucuugacuacaaaaacagaaucgaaaaucucuauaaggauuccaagaucagccggaccaaauaccagaagcugaugaugaaaaacucugacauuagcggaaauuuuaucgagcgcgaacugagagauucccaguacauugcuaagaaagcccgggagauccucgaggaacuggucaaguucguggugcccacaaccgggagcguuacagcucgccuuagagaggacuggcagcuggucgaugugaugcaagaacucaacuggaagaaauaugacaagcugggacugaccgaugugcgguacgacaaagauggccgcgagauuagauauaucaaggacuggucuaaacggaaugaucaccgccaccaugccauggacgcgcuuacgaucgccuuuacaaagagauccauuauccaguaccugaacaaucucaacgcuaagagcgacaaauccgggucuauuuaugccaucgaacagaaggagcuguuccgggauaaaagaggcaagcucaaauuuauuccucccaugcccugcaauaucuuccgcgcugaggccaagcggcaccuggaaaacguccuugugagcguuaaggcgaaaaacaagguggucaccccuaauauuaacagauccaaaggaaagaauggcaucaacaaaaagauccagcugacaccgcgcgggcaacuccauaaugagaccauuuacggaucuaugaaacgguaugaaaccaagugggagaagaucggcagcggguuugacgagagacagauugccaaaguggcuaacaagaaauuccgcgaagcccugcugucccggcuugcugaguuuggaaaugauccccagaaggccuucacaggcaaaaacucucuggaaaagaauccucucuacguugacgagcugcacacgcagaaggugcccgaaaaagucaagaucgugacccucgagaaccuguacacaauuagaaaagagaucaccccugaucuuaagaucgacaaaguuguggaugccgggguccgccgggugcugcaagaaagacucgacgaguuugaugacgauagcaagaaggcuuucuccaaucuggacgaaaaccccauuuggcugaauggcaaaaagaugaaacgggugacaaucaugggagucagcaacgcgguuccgcuucaugacaagaaagauuauaagggcaaucugguguucgacucuaaggggcgcaaacagccuguggauuuugucaacaccggauccaaccaccacguggccauuuacagagacgagagcggcgaacuccaggauaucguugugucuuucuaugaggcuacgacacgguccacccuggggauucccgucaucgacaaggaguacaaaaaggccgaaggauggaauuuucucuucagcaugaaacaaaacgaguauuuuguguucccuaaugaagagaccggcuuuaaccccaaggaaaucgaucugaugaauccugacaacuacacaaccauuucucccaaucuuuaucgcguucagaaauucuccaagugcauguacgggaacagcuccgugagagaguacgucuuucggcaucaccuggagacaagcgugaaugauucuaagggccugaaaaacaucgccuauaagaauguuaaaagccucguguaccuggaaggaauugucaaggugagaaucaaccauauuggccagaucguguccgucggggaguauuga

SEQ ID NO: 4359 - RNA, 4140 nt, Artificial Sequence
  Cas9 variant
augagaaucgacaacggccuggaggaacucaaggugaauaaccggauuuacaauaucgggcuggauauuggaaccagcuccgucggcuucgccguuacagacgcucaggauaaacuugugcgcgugaaggggaaaacggccaucggagucagacuguuugaggaaggccacaccgcggcugagcggcgcggguucagaacaacccggcgcagacucucucggcgcaaguggagaauuaaccugcuuaaucaaaucuuugaacccuauaucagcgagauugacccuacauucuuugcccggcugaaaaacuccucucucgccggaaaggauaagaaauucgagggcagccugcuguuuccggaccgcaccgauuaccaguucuauaaggacaaucccacaauguaccaucucagaaaacaccugauggaaaaggaucggcaguuugaccuucgcgagaucuaucuggcuaugcaucacauuaucaaauacagaggcaacuuccucaauaccacgccuaugaaccauuuuaagaaugaagagauugauuucuccgcccuguuuucucggcuuaacgagcuguaucaggaaaucgacgaugagaauauuuucgaacucaacaucgagaauguggacgaaaucaagaaaauucugcugaaccacgaccucuucaagauggagaaacaaaagcagguugcuaaacugcuuaacguggauaccgacgauaagcagcugaaaaaggagaauacagcccucgcgagcaacuuuuccaaggccauccugggguacaaauucaaucuugcucuggucaccaagauucccgaccaggauaaaaaggaauggacaaucagccucggagacgaggauuuugacgauagacuggacaacgugccuguugcccugaccgaaucucaacucgagguggucgaagugcugcacuccauuuucaauagcaucucucuuaacgagaucguggagaauggcgaaacgcuguccagcgcuaugguccgcaaauacaacgaucauaagcacgaccucaagcugcuuaaaaauguuaugacaacccuggaggaccggaagaaagccaagaaaauucaggggaucuauaacguguuugugggaaaggauacagaccucauuucugauaaggacaaaaauaaguacaaagauaaggacgaguucuauaaagaaauccagaagaaccuggauaauuccagcgacgcggaagagauuaucaagagaaucaaacaggaucaauuucugcccaagcagcgcaccuccaaaaacggcgucauuccucaucagcuccaccaacgggagcuggaccuuaucauugaaaaucaggccaaguacuauccguuccugaaagaggcuaaccccaacaagaaaagacucaagcaggccaaguacaaacuggaugaacugaucgcuuuuaagauuccuuauuacaucgggcccaccucuggagccgagaauagcgacuucuccuggcuuaaacgcaagaaagauggccagauuacaccuuggaacuuugacgagaagguggaccggaucgaaagcgccaauagauucauccgccggaugacgaccaaggauacauaccuccuggcugaggacguucugccccucgaaucucugauuuaugagaaauacuccgugcuuaacgaacugaauaacgucagaaucaaucgccaaaagcucagcgugaacgauaaacaggacauuuauaaugagcuguuuaagaacucuaaaaccguuacacugaagcagcuucagaaguacuucgaggugaccaaaaagcucaaaacggucguggucgaaggccuggcggauccgaagaaauuccugagcaaucucgggacauaucacgacuuuaagcugaucuucggagauauuguggacgauccugaguaccaaaccgaccuugaaaacaucaucgagugguccaccauuuuugaagaucggggcaucuucaauucuaagcugaacgagauuacauggcucaccgacgagcagagaaagaagguucugagcaaacgguaucagggguggggacgcuuuuccaagaaacugcuugugggccucaagaauagccaggggaacucuauccuggaugaacuguggaacacaaaucucaacuucaugcaacugcagucccaggacgacuuugccgagcuuauucaugcugaaaaugccaaacaguucaaggccaacgaucccgacaauccuuggaacggaaucgaugcuauccugaaugacgccuacacgagcccccaaaacaagaaagcgauuagacaggucgugaagguugugcaggauaucgagaaagcuaugggcaauaagccccagaaaauugccaucgaauuuacccggucugccgacaagaacccuagacgcacagauucccggauuaagagacucagcgacaucuacaaagaggcugccgagaaggucgugggcgaaucccugaaacuggagcuuaaugaauaucucaccucuaagaaaaagaugacagauaagauguaccuguauuucacccaacuggggacggacaucuacaccggcaaaaagauugauaucgaccagcucaacaauuaugacauugaucacgugcugccgcagagcuuucuuaaagacgauucccuggacaaccgcguucucacaaauagaucugauaacagcgagaaguccgacaccgucccccugcauaaauucggagcuaagauggggaacuuuuggcggcaacuggccgaugagggacuuaucacaaagcgcaaauacaagaaucugaccacggacccugcgacaauugauaaauauaccauccagggcuucauuagacggcagcucguggaaacaagccaggugaucaagcugaccgccaacauccucgggggccuguaccccgaggaaaccgagauucuugaaaucccugcuaaacugaaucaccaauuccgcgacauguuugaucucgucaaggugagagagguuaacgacuaccaucacgccuucgaugcuuauauuacaguguuugucggaaauuuccuguaccggcgcuaucccaagcugagaucuuacuuuguguauggcgacuucaaaaagcugaacaaaacggacgaugacauccggaaguuuaauuuccuuaaccucuuuaauaaagauaagguugaggacaacgaaaccgaugagauucugugguccaaagccgaaagcauccgcgacaucaagaauauuuacaacuauaaguucaugcucgugucuagagaggucuacacacggcacggggcgauguuuaaucagaccaucuacccggccuccaaaaacgauagcaagaaacugauuccuaucaagaaaggaaaggacacagcuauuuauggcggguacucuggaaauaccgaugccuauauggcuaucguggccguugaagacaagaaaggcgagaaguucaaaguggucggggugcccacgagagccgugagccgccuugagcagcuggcugcggaugaccaugaucaguaccucacagcccugcacgacguccugaagccuaacuucaccaaaaucaagaccaaucggaagacaaaagcuaaggaagagguuaccacacccuuucgcauucuugugggcaaagugggauauagacaacugauccaggacggccaggucaagaugaugcucggguccagcgccuacaaauauaacgccaagcaacuggugcucucugaaaagucccugaaaguuauuaagaacaauaaaaaguacaacccugaugacgagaaucaggaucuuaucgacguguacgaugaaauucugggagucgugaaccgggcuuucaaucuguaugacacgaacggcuuucgcaaaaagcucaaugauaacagaguuaaauucguggagcugcccaucaauaacauuuuugacgggaccaaacuuguccagaugggaaagcgggccgugcugacacagauccucaauggccugcaugcgaacgcugcccucggggaucugaaagcccuuggcaucagcaccccguucggaaagaugcaauccaaaucuggcauuccucugagcauggacgcuucccugguuuaccagucucccacagggcucuuugagagaaagcugaaucuuagcgaucuguga

SEQ ID NO: 4360 - RNA, 4140 nt, Artificial Sequence
  Cas9 variant
augaccaagaaaaacuacagcaucggccuggacauugggacaaauuccgugggaugggccgucaucacggaugacuauaagguucccgcuaaaaagaugaaagugcucggcaacaccgauaagaaguacauuaaaaagaaucugcuuggggcccuucucuucgacucuggagagacagcggaagcuaccagacugaaacggacagcccgcagacgguauacccgcagaaagaaccggcuucgcuaccugcaggagaucuuugccgaugaaauggcuaaaguggacgagagcuucuuucaaagacucgaugaauccuuccugcggugggacgaugacaauaagaagcugggccgcuauccuauuuuugggaacaaagccgaugucgugaaguaccaccaggaguucccgacaaucuaucaucucagaaaacaccuggcugacucuagcgagaaggccgaucuucggcugguuuaccucgcgcuggcccauaugaucaaauuucgcggacacuuccuuauugaaggcgagcugaaugcugaaaacaccgacgugcagaagaucuuuuccgacuucgucagaguguacgaucggacguuugacgauucucaucucagcgagauuaccguugacgccgcuuccauccugacagagaaaauuagcaagucucgcagacuggaaaaucucaucaaguauuaccccaccgagaaaaagaacacacuguucggcaaucuuauugcccuggcgcucgggcugcagccuaacuuuaaaaugaauuucaagcuguccgaagaugccaaacugcaauucagcaaggacucuuauaacgaggaucucgaggaacugcugggaaagaucggcgacgauuacgcugaccucuuuaccuccgccaaaaaucuguaugaugcuauccuucugagcgggauucucacgguggacgacaacucuacaaaggcuccccuguccgccagcaugaucaaacgguacgccgagcaccacgaagaucuugagaagcugaaagaauuuauuaaggcgaacaaguccgagcucuaucaugacaucuuuaaagaugaaaccaagaauggauacgccggcuacauugagaacggggucaaacaggacgaguucuauaaguaccugaaaaauacacugucuaagaucgcuggaagcgauuauuuucucgacaagaucgaaagagaggauuuccugcgcaaacagcggaccuuugacaacggcuccauuccucaccagauccaucuucaagaaaugcacgccauucugagacgccagggcgauuacuaucccuuccucaaggagaaucaggaccggaucgaaaagauucugaccuuuagaaucccuuacuauguggggccgcuggcccgcaaggauagccgguucucuugggcugaguaccacuccgacgagaaaaucacacccuggaacuuugauaaggugauugacaaagaaaagagcgccgagaaguucaucacgagaaugacccuuaaugaccucuaccugccugaagagaaaguccugcccaagcauucucacguuuaugagacauacgcgguguauaacgaacucaccaaaauuaaguacgugaaugagcagggaaaagauagcuuuuucgacuccaacaugaagcaagaaaucuucgaucaugucuuuaaggagaaucgcaaagugacaaaggaaaaacugcuuaacuaucugaauaaggaguucccugaguaccggauuaaagaccucaucggccuggauaaggaaaacaagucuuuuaaugcuagccuggggaccuaucacgaccuuaaaaagauucucgauaaagccuuccuggacgauaagguuaacgaggaagugaucgaggacaucauuaaaacgcugacacucuuugaagauaaggacaugauccaugagagacugcagaaguacuccgauauuuucaccgccgaccagcuuaaaaagcuggagcgccggcacuacaccggauggggcagacucagcuauaaacugaucaacgggauucggaauaaggaaaacaauaaaacaauccuggacuaccuuaucgaugacggaucugcuaaccgcaauuuuaugcaacucauuaacgaugacacccugcccuucaagcagaucauucagaaaucccaggucgugggcgauguugacgauaucgaggccgugguccacgaccugccgggcagcccugcuauuaagaaggggauccuccaaucugugaaaaucgucgaugaacuggugaagguuaugggagacaaucccgauaacauugugaucgagauggccagagaaaaucagacaacgaaccggggcagaucccagagccagcaacgccuuaaaaagcugcaaaauucccucaaagagcuggggucuaacauucugaaugaggaaaagccuagcuauaucgaggacaaggucgaaaacucccaucuucagaaugaccagcucuuucuguacuauauucagaacggaaaagauauguacaccggcgacgagcuggauaucgaccaccucucugauuaugacaucgaucauauuaucccccaggcguucauuaaggacgauagcaucgacaaccgggugcugacauccagcgccaaaaauagagggaagucugaugacguucccucccuugauauugugcgcgcuagaaaagccgaguggguccggcuguacaagagcggccucaucucuaagcgcaaauuugacaaccugaccaaggcugaaagaggaggccugacagaggccgacaaagcgggguucauuaagcggcagcuuguggaaacccgccagaucacgaaacacguggcccaaauccuggaugcuagauuuaauaccgaguccgacgaaaacgauaagguuauucgggacgucaaggugaucacacucaaaagcaaucuggugucucaguuccgcaaggauuucgaguuuuacaaagucagagagauuaacgacuaucaccaugcccacgaugcuuaccucaaugccgugguuggaaccgcccugcuuaagaaauauccuaagcuggcuagcgaguucguguacggcgaauauaagaaauacgacguccauaagcucaucgcgaaauccagcgaugaccacucugaaauggggaaggccacagcuaaauauuucuucuacuccaaccugaugaacuuuuucaagcgggugauucgcuacagcaauggaaaaguuaucgugagaccggucguggaguauuccaaggauaccgaagacaucgccugggauaagaaaucuaauuuucggacgauuugcaagguucugagcuacccccaggugaacaucgucaaaaagguggagacacaaaccggcggguucuccaaagagucuauucuuccuaagggcgacagcgacaagcugauccccagaaaaacaaagaaagccuauugggauaccaagaaauacggaggcuuugacuccccuaccguggcuuauucugucuucguuguggccgauguggaaaaggggaaggcgaaaaagcucaaaacagucaaggagcuggugggaauuagcaucauggaacgcuccuuuuucgaggaaaaucccguugaguuccucgagaacaaaggcuaccauaauauccgggaagacaagcugauuaaacuuccgaaauauagccuguuugaguucgaagggggaaagagacgccuccuggcuucugccuccgagcugcagaaaggcaacgagauggugaucccugggcaccuugucaagcugcucuaccacgcccagcggauuaacagcuuuaauucuacgaaauaccuggauuauguguccgcucauaagaaagaguucgaaaagguucucagcuguguggaagacuuugccaaccuguacgucgauguggagaagaaucuuucuaaaaucagagcgguugcugacuccauggauaacuucagcauugaagagaucuccaauagcuuuauuaaccugcugacccucacagcccugggcgcccccgcugacuucaauuuucuuggagagaagaucccucgcaaacgguauaccucuacaaaggaaugccugaacgccacccucauccaccagagcauuacgggccuguacgagacaagaaucgaucucuccaaaauuggggaagaguga

SEQ ID NO: 4361 - RNA, 4143 nt, Artificial Sequence
  Cas9 variant
augggcaaguacaaccuggggcucgacaucggaaccaauagcgugggcugggccgucguugaugagaacaaucagauugugaaaaagggagggaaagcucuguggggcgugagaauguucgacgaagcccaauccgcgaaggagacacggaucuaucgcaacucuagacggcgcauugucagacggaaucagcgccuucugcuccugcagaaagaauuuuacgaugagaucauuaagguggaccagacguucuuucaaagacuuaaggauagcuucuuuaaaaaggaagacaaacugaacaagaauaacuauaccuucuuugaugacgauaucacagaccgggaguacuucaaaaaguuucccaccaucuaucaccuccgcucccaucugcuguacaaugaugagaagauugacaucagaaugcucuaucuggcccuucaccauauuguuaaauaccgggggcacuuccuggauucuggagaagugaacgagagcaauuuuuccaagaucaaagacguccucgacacauucaacaauaagaugucugaaaugagccuggaguuugaggauaacgaagacuacuucugcaaaauugaguucgaugaaaauuuugagaacaaacuuaaggacaucaugcugucccagcucagcaagaaggaaaaacgccaggagcugauugaucuguucaagguggacaaaaagucucucguuaacgagcugcuuaucgaacugcucgugaauaaaaaggucaagcugaacucccuuagcaucaccaauggcaaaaaguaugaggugugugaaauugauuuugagaaagaggaacuguucgagaagcucgaagacgcuaaaaagaucauuacagagcuguuugauauccuggacgaaauugugaacaucaagaaaaucgucgauuacuauuacguucucaagauuaucggcgacaaugaguaucugucugaagccauggugaaaaaguacgacaaacaugauaaggaccuuagagagcugaaguccuucauuaaaaccuauugcccuaacaaguacuacgaguguuuucggaaaacgagcaauccgaaccucugcaauuaucccaaguacguggggaucaacucugucaauaaaaagauugaacgcuucgcucacuguaaaaaggaggaauuuuauaaguaccugaaaucccuuuucaacaccaucaaggaugagaaugccaaacugaagaucgaccucuuucagaaagauauggagaacgacgauuuccugaauagacaaaacagcaaccacaauuccucuauuccuaugcagcugaacuuuugcgaacucaagaagauccuggagaaucagagcaaauauuaccccuuccuuaugcugaagaacuccgacggauauagcacaucugaucggauuaucgcuauuuucaaauacaagaucccuuacuaugugggcccccucaauaaaaacuccaaguacagcuggcugguuaagaaaucuaaugaaaacauuaccccuuggaauuaugagaaggugaucgaccuggaugccagcgcgaaagaauuuauccagagaaugcaaaacaaguguacauaccuuaaaggggagaaugacuauugccucccgaagaaguccauucuguucucugaguacaacugucugcaguaucucaaucgccugaucauuaacggagcccuuaucgaaaauaaacugaagaacgagauuuacgaaaacaucuuucucugcuacaaaaagcccaccaaaaagagcaucgucgaguaucugaaaacgaauuacaacuaugaugaaacaacccugaaguccaauauucuugaggugaacugugacaugagcucuuacauccaguucaaggagauuuauggcgaagacuuugagcaaaaucucaacaucguugaagauauuaucaaagacaucacaauuuucgaggauaagaaaauccuggaaaagcggcugagagagauuuaccaucucuccgaggacaaagugcagaagaucaaggggcugaauuauaaaggauacgcuacccuuagcaagcacuuucugaacaauuucuacucugucaacgaagagaccggcgaaauuuauggcccuaucauccagauuaugcgcgauacaaauuacaaccuccagcaagugaucuauaaugaccgguacaacuuuaugaaagccauugauaaguauaauaaaaagaaccuggacacggagaagaaacugaacgucuccgauuucaucgacgaguacauuuaugugagccccaucaugaagagaucccuuauucagucuuacaauaucauccaggaacucgagaaaauucugggggaaagcaucuccaaguacuauauugagugcgcucgcguucggucuaacagcaaagaugugaucaauuccagauaccgccagcugagcgaacucuauaaggacugcgagcaucaagucucugauauuuccaagaacuacaucaauaucaacaaacugaagaaacagcuugaggacaauaagaacgaacugcgggccgacaaacucuaucuguacuuuacccaguucggaaaguguauguauacacugaaggauauugaccuugaugacguguuucucggcaaauacgauaucgaccacauuuacccucagagccugaucaaggaugacucucugaauaacagaguucucgcguccaaagagaagaaugggaaaaaggauaaccaauucauuuucaauauccccgaauuucugccgaaaaacgccgagcuuuucuauaagaagcugcucgaaugcaaacugaucaccaaggagaaauaccgccggcugacaaugaagaaaauugacgaugacgagcuugacaucuuugugaauagacagcuggucgcuaccaaccagagcgugaagggacucguggauguucugaagauuuauaaaggcgucaagccuacgaauaucguguacucuaaagccgugaacauuagcgacuuccggaacaauuauaaccucuacaagucccgcacagcuaauaacuaucaccaugcccacgaugccuaccugaaugucgugaucgggaaagcucuugacguuuacuaucaguguaacuacuuucaaaauuauaaggaugugauuaagcugaaagacagaaacaucaccaucaaucccgaaauuauccucagcaagaaccgguacgucaauagaaacggagagaaaaaggugauuugggaucuggacaauacccugaaacuuaucaagaacaaucuguauaaccgcuucgauauuacagaaaccaucaugacacggaagucuaacaaaauguuuuccaagagcuccaucucuccugcgaaaaauagcaagaaccucauucccaucaaaacguccgaccccagaugcaauguucugaaguacggcggcauuaaaucuaacagcuauaauuucuacuguaucguggagcucuacgauaagaaggggaaaaaguccuauauucuggaagccaucccuaaaacccauucugacaaacuugaggaguacaucaagaacagcauugaugaaaagaaugucuccaacuuuaagaucauuaauaaaaacaucaagagcaauauuaucauugaguauaaaaagcugcgcuacgugaucacaggaaaaucuggcaaguauuaccucaucaagaacuucaaagacagaaauuuuuccuauaacgcuauuaagaccaucaaauacauugaaaaguacaauuaucagaaaaaguacgagaucccguucgaggaaacaaaggagaaaauuauccuggcccccaagaaaaaggacaccaaagaaaucagccugacgcuugauaacugccaggcccugcucgacgagauuaucucucuguucaagaaagauauuuauaacuacgacaucauuuauaagaucaccuccaagcucgaagagaauaaacaaaaccugacacuuaccaaucugaucaagguucugacagagauucucauccugcuuaaaaccaacgaacgggggacggcugaucugacacucauugacaugagcaaggauaccggaacacuguguaucucuaaaacccucaagccuggcaugaaguuuauuuccgagagccccaccggguacuaucgcaaaaucauuuucgaagugccuaauggcaucuga

SEQ ID NO: 4362 - RNA, 4143 nt, Artificial Sequence
  Cas9 variant
augaagagaauccugggccucgaccuggggaccacaagcauuggaugggcccuugugaacgaggcugaaaauaacaaugaggccuccucuaucguccggcugggcguucgcgugaacccccucacgguggaugaaaaaucuaauuucgagaaggggaaagcgauuaccacaaacgcugacagacagcugcggcacggagcccgcaucaaucuucaaagauacaagcugcggcgccagaaccuccaugauugccugcagaaacagggcuggcuggggaccgaagccauguaugaggagggaaaggcuuccacauuugaaaccuacaagcucagagccaaagcugccgaggaagagauuucucugcacgaguucgcgcggguccuuuuuaugcugaauaagaaacgcggcuauaagagcaacagaaaagccaauaacaaggaagacggccaacucuucgaugggaugacaaucgcuaagaaacuguacgaggaacaucuuaccccugccgaguauucccugcagcuccugaauaagggaaagaaguuuacgcagggcuacuaucggucugaccugaacgcugaacucgagcgcaucugggaugagcagaaaaaguacuacccggaaauucugaccgacgaguucaaacaacagcuugaagggaagacaaagaccaauacaagcaaaaucuuucuggccaaguauggaauuuacuccgcggaucucaaaggccuggacagaaaguuccagccccuuaaauggcggguggaggcccugcagcaacagguugauaaggaagugcucgcuuuugucaucagcgaccugaaggggcagauugccaacaccucuggacugcucggcgcuaucuccgaucgcagcaaagagcuguauuucaacaagcaaacggugggccaguaccuuugggccucucuggaggaaaauccucacauuuccaucaaaaacaagcccuuuuauagacaggacuaccucgacgaguucgagaaaaucugggagacacaggccgcuuuucauaagcaacugaccccugaacuuaagcaggagauucgggauaucauuaucuucuaucagagaccccugaaaagcaagaaaucucucauuuccguuugugagcuggaacagcgcaaggugaaagcgacaaucgacgggaaggagaaggaaaucaccauuggaccuaaagucgccccgaaaagcucccccguguuccaagaguuucggaucuggcagaaucugaacaaugugcuccugauugauaacgacaccaaugagaaaagaccucuugaugaagucgagcgcaaccugcucuacaaggaacugucuaucaaagcuaagcugagcaaaacagaggcccuuaagauucucaauaagaaaggcaagcagugggaccugaacuaccgggaacuggaggggaauagaacgcaggccauccucuucgauugcuauaaccgcaucauuacccugacaggacacgaggaaugugacuuuaaaaagaucaaggcuuccgagauucggcacuacguuagcaccaucuucaagaaucuuggcuuuucuacagaaauucuggauuucgaccccucccucaagaaacaugagcuggaaaagcaaccuauguaucagcuguggcaccuucucuacagcuaugagucugauaacagcagaaccgggaaugagucccugcugcgcaaacucgaaacgacauuuggauuccccgaggaauacgccaccgugcugugcgacguggucuuugaggaagacuauggcaaccuuucugugaaggcgaugcgggagauccugccguaccuccaggcuggcaacgauuacagccaggccugugccuaugcuggguacaaucauuccagacacagccugaccaaagaggaacuggaccaaaagguuuauaaggagcgccuugaacuccugccuaaaaacucucugcggaaucccguggucgagaagauucucaaccagaugaucaaugugaucaacgccauuaucgaugaguacggaaaaccugacgaaauuagaaucgagauggcucgggaacugaaguccagcgccgcggaucgcaaaaagacaacccacgccauuucucagggcaaugcugagaaccaaagaauccgggaaauccuugagaaggaguucucccugagcuauauuuccagaaaugacaucauuaaauacaagcucuaugaggaacuggaacccaacuacuacaaaacacuguauucugauacguacaucaccaaggacaaacuuuuuagcaaggauuucgacauugagcauaucauccccaaagcccgccucuuugaugacuccuucucuaauaagacacuggaagcucggaacauuaaucuggaaaagagcaacaaaaccgccuucgauuuuaucaaggagaaauauggggaagacggagcggaggccuacaagaaaaagcucgacaugcugcuugaaaaugaugcuauuuccagaccuaaguauaacaaccugcuccgcgccgaggcugacaucccgagcgauuucauuaauagagaccugcggaacacacaguacaucgccaaaaaggccugcgaaauccugggcgagcuuguuaaaaccgugacgcccaccacagggaagauuaccaaucgccugagagaggauuggcagcucgucgacgugaugaaagaacugaacuuugagaaguaugaaaagcucggccugacagagaucgucgaggaucgggacggacgcaaaauuaagagaaucaaagauuggaccaagcggaaugaccaccgccaucacgcuauggaugcgcuugccauugcuuucacgaaaccuucuuuuauccaguaccugaacaaucucaacgccagauccaauaagggcgacagcauuuacgccaucgaaaacaaggagcugcauuaugaagaggggaaacugcgguucaaugcucccaucccugugaacgaauuucgcgccgaggcgaagagacaccuuucugcuauucugguuuccaucaaagccaagaauaaagugaugacacaaaacgucaauaagauuaagaccaaacacggaaucauuaagaaaauccagcucacaccccggggcccgcugcauaacgagaccaucuacgggaccaagaugagaccuauuaucaaaauggugaagguuggagccgcucucgaugaagccacaauuaacaaagugagcucucccgcgauccgcgaggcucugcuuaagcggcugaaugaauauagcggcaacgccaagaaagccuucacggggaagaauacccucgagaaaaacccuauuuaccugaaugcuggcagaacaaagaccguccccucccuggugaaaacaguggaaugggagagcuuucacccuacccgcaaacuuaucgacaaggaccugaacguugauaaagucguggacaagggaauccgggagauucucaaagccagacuggaagaguucaauggcgaugcuaagaaagccuuuucuaaccucgaagagaaucccaucuaucuggacgaagcgaagaagauugcccuuaaacgcguguccaucgaggggguccugagcgcuauuccgcugcauacgcucaagaaccaggccggaaaaccuaucacaggcaaggaugggaaacccgugcugggaaauuacguucagaccuccaacaaucaccacauugcuuucuauuacgacgaggauggcaaccuucaagacaaugccgugagcuuuuucgaagccgcugagagaaagagccaggggauccccgucaucgauaaggacuacaaccgggauaaaggcuggcgcuuccuguuuaccaugaagcagaaugaauauuucguguuuccuaacgaggcgacaggauucauuccguccgagguugaccucaccgacgaagccaacuacggcaucauuucucccaaucuguaucgggugcagaaagucagcagaaucgauaaggggacauccgcuucucgggacuacugguuucgccaucaccucgagacgauucugaacgaugacgccaaacuuaagaaucuggccuucaaaagaauccggggacugcucgaacugaaggauaucauuaaggugcgcaucaacagcaccggcaaaauuguugcugugggggaguaugacuga

SEQ ID NO: 4363 - RNA, 4143 nt, Artificial Sequence
  Cas9 variant
augaagaaaauccugggccucgaccuggggaccacaagcauuggaugggcccuugugaacgaggcugaaacggaguccgaaaagucuagcaucauuagacugggcguccggguuaauccccucaccaucgaugagaaagggaacuucgaaaagggaaaagccauuacaaccaauuccgaccgccagcaaagacacucugcgcggaucaaccugcagcgcuacaaacuuagacggcagaaucugugcgauugucuccagaucggcgggcugcugggaagcgaguccauguaugaggaaggcaaggagucuacauuugaaaccuacaagcuccgcgcuaaggccgccacagagaaaguggcucugcaugaguucgcccggauucuuuuuaugcugaacaagaaaagaggcuauaagagcaaucgcaaggcuaacuccaaagaagacgggcaagccuucgauggaaugaccaucgcgaagaaacucuacgaggaaaaucugacgccugccgaguauagccuucagcugcucaacaagggcaaaaaguuuucuccguccuacuauagaagcgaccuggaaucugagcugaaucggauuugggaggaacagaaaaaguacuaccccgagauccucaccgaugacuucuaucagcaacuggaagggaagacaaaagugaacaccacaaagauuuuucuugcuaaauacggaaucuauaccgccgaucugaagggccucgacaaaaagaugcagccucugaaguggcgcauugaggcucuuaauaaacaggucgauaaggaagugcugacguucguuguguccgaccucaaagggcagaucgagaagacaagcggacugcugggcgagaucucugauagauccaaagaacucuacuuuaacaagcaaaccgucggccaguaugugugggccagccugaaggagaauccccacguuuccauuaaaaacaagccuuucuaccggcaggacuaucuugacgaauuugagaaaaucugggaaacacaagcggccuuccauaaggagcugacccccgagcucaaaaaggaaauucgcgauaucauuaucuuuuaccagagaccucugaagucuaaaaaggggcuuaucagcauuugcgagcuggaacagaaaaaggagaaagugaucauugagggaaaggaaaaagagauccucauuggcuccaaggucgcucccaagagcucuccgauguaccaggaguuccggaucuggcaaaaccugaauaacgugcugcucaucgacaccgaaauuaaugaauccagaccucuggaugaggaggaaaaagcccuucuguauaacgagcucagcgugcgcgcuaagcugucugaaacagaggcccugaaaacgaucaauaagaaagggaagcacugggaccuuaacuucaaggaacucgagggaaaucggacccaggccguccuguuugaguguuacaacagaauuaucacacagaccggccaugaagagugcaauuucaaaaagauuagcgcugaagauauccgccacuauguugcgacaauuuuuaaaaaccugggguucaauaccgacauccucgauuuuaaccccucccuggagaagcacgaacuugagaaacagccuauguaccaacuguggcaucuccuguauucuuacgagagcgacaagucccggacgggaaaugaaagccugcuuaacaagcucgaggccaauuucggcuuuccccaggaauaugcuucugugcuggccgaugccacauucgaggacgauuacggcaacaucuccgugaaagcuauuagaaagauccugccgcaccuccaugacggguacgacuauagcgaggccugugaacgcgcgggauacaaccacucuguccggucccugaccaaagaggaacuugcucagaagguguauaaagauagacuggaccuccugccuaagaauagccugcgcaaccccguuguggagaagauucuuaaucagaugaucaacgucauuaaugccaucaucguggaauacggcaaaccugaugagauucggaucgagauggccagagaacucaaguccucugcugccaaacgcgaggaacggaccaagagcauuaaccaaaaugcugccgagaacaaaagaaucacagaaauucugcagaccgaguuugggcuguccuauaucucucggaaugacaucguuaaguacaaacucuaucaggagcuggaagcgaacggauucaagacacuuuacagcaauacguacauucccaaggagaaacuguuuuccaaggauuucgacaucgaacacauugugcccaaagcccgccucuuugaugacagcuucggcaacaagaccaucgaggcuagagaugucaaucuggccaaaucuaacaagacagcuuucgacuuugugaaggaaaaauauggggagcagggcauugaggaauacaagaaaaagcuggauacccuucucaaagagaaugccaucuccagcggaaaguauaagaaacugaugaugucugaagcggacaucccuuccgauuucauuaaccgggaccugagaaacacacaauacaucgcccgcaaggcuuaugagauucucggcgagcuggucaaaaccaucacgccgaccacagggaagauuaccgaccggcuuagagaagauuggcagcugaucgacgugaugaaagagcucaauuuugaaaaguacgaucgccugggacugacagagguuauugaagacagagauggccggaagaucaaacgcaucaaggacuggaccaaaagaaacgaucaucggcaccaugccauggacgcucuuacgauugccuucacaaagcccagcuauauccaguaccugaauaaccucaaugcccgcucugauaaaagcggguccauuuacgcuaucgagaccaaggagcugcacagagaaaacaauacacuccgguuuaacgcgccuaugccccugaaugaguuccgcaaggaagccaaaagacaucuuagcgcuauucuggugucuaucaaggccaaaaacaaggucaugacccaaaaugugaacaaaaucaagaccaaaaauggaauuaucaagaagguucagcucacaccucggggcgcccugcacaacgagacgauuuaugggaccaaaaugcgccccaucauuaagauggugaaaaucggcgcugcccuggacgaagcgacaaucaauaaggucuccagcccgaccauuagagaggcccuucugaaacggcucaacgaguacuccggagaugcuaagaaggccuuugcuggcaaaaacgccaucacaaagaauccuauuuaucugaacgcggaacacaccaaaacggcucccgccauggugaagaucguggagugggaaauguacuauccuauuagaaaacucaucacacccgaccugaagauugagaagguuaucgauaaugggaucaaagaaauucuuaagaaacgccugaaggaguucggaggcgacgccaaaaaggcuuuuucuaaccucgacgagugcccuaucuaccuggaugaagagaagaauauuacccugaaacgggucagcaucgaaggggugcuuuccgccauucccgugcauacccugaagaaccacgcuggaaaagagaucaaggacgaggauggcaaagccguccucggggacuaugugcagacaucuaauaaccaucacguugcgaucuaccaggaugccaagggcaaucugcaagacaacgugauuagcuucuuugaagcugccgagagaaaaucccagaaugucccgaucguggauaagaaccucaaucgcgacaagggauggcacuuccuguacaccaugaaacagaacgaauauuuuguuuucccuaaugaggaaacaggcuucgugcccucugagauugaucuuauggacgagaacaauuacgaaaugaucagccccaaccuguuucggguccagacgauguccagaguggauuaugggaagaccauuauccgcgaguacguuuuccggaaccaucuggaaacaauccucaaugacaaccugaaacuuaagggacugguguuuaaaaagauuaagagccucaaagcucuggagggcaucgucaaggugagagugaaugccauugggaaaaucgucgccguuggagaauaugacuga

SEQ ID NO: 4364 - RNA, 4143 nt, Artificial Sequence
  Cas9 variant
augaagaaaaaguacgccaucggcauugacaucgggaccaacagcgugggaugguccgucguuacagaugacuauaaagugcccucuaagaaaaugaagguguucggcaauacggagaagagauacauuaaaaagaaccugcucgggacccugcuuuuugaugaaggaaauacagcugagaaccggcgccugaaaagaaccgcccggcgcagauauacacggcgcagaaaucggauccucuaccugcaggaaauuuucgcggaggaaaucaacaagaucgacgauagcuuuuuccaacgccuugacgauuccuuucugauugucgaggacaaacagggcucuaagcacccuaucuucgggacccuccaggaggaaaaggaguaucauaaacaguuuccgacaauuuaccaccugagaaagcaacuggcugauagcucccagaaagccgacauccggcucauuuaucuggcccuugcucauaucauuaaguaccgcggacacuuccuguuugaaggcgaucucaaaucugagaauaaggacgugcagcaucuguucaacgauuuuguugagauguucgacaaaaccguggaaggcagcuaccuuuccgagaaucugcccaacgucgccgacgugcucguugaaaaggugagcaagucuagacaccuggagaauauccugcacuauuuuccuaacgagaaaaagaauggacucuucggaaacuuccuggcucuugcccugggccuccagcccaauuuuaaaacgaacuucgaacuggcggaggaugccaagauccaauuuuccaaagaaaccuacgaggaagaccuugaggaacugcucgggaagauuggagaugacuaugcugaucuguucaucgccacaaagagccuguacgacggcauucuccuggcugggauccuuucuaccacaaacuccaccacgaaagccccucugucuagcuccauggucaaucgguaugaggagcaucagaaggaucucgcgcugcuuaaaaacuuuauucaccagaaucugagcgacuccuacaaggaaguguucaacgauaaacucaaggacggauaugccggcuacaucgagggcaagacaacccaggaaaauuuuuaccgcuucaucaaaaaggcuauugagaaaaucgaugggucuaacuauuuuauugaaaagaucgagagagaggacuuccugcggaaacaaagaacauuugacaauggaagcauuccccaucagauccaucugcgcgaaaugcaggccaucauucggagacaagcuaaguucuacccuuuucucgaggaaaaccaggauaagaucgagaaaauucugaccuuccgcaucccguauuacgugggcccccuugcccgggggaaguccgaguucgccuggcugaauagaaaaagcgacgaaaagauucgcccuuggaacuuugaugagauggucgacaaagaaaccucugcugagaauuucaucacacggaugacgaacuaugaucaguaccuccccgaccagaagguucugccuaaacacucccugcuuuaugaaaaguuugcgguguacaaugagcucaccaaggugagauacgucacagagcaaggaaagagcuucuuuuucgaugccaacaugaaacaggaaauuuuugaccgcaccuucaaaguguaucggaagguuacaaaagagaagcugauggauuuucugucuaaggaauuugacgaguuuagaaucguggaucuccugggccuugacaaagauaauaagagcuucaacgcuucccuggggaccuaccacgaccucaaaaagaucgucucugaagacuuucuggauaacagcgagaaugaggacauucuggaaaacgugguucuuacgcucacacuguucgaggaucgcgaaaugauccggaaaagacuggagaaguauaaggacgugcucaccgaggaacagcggaaaaagcuggagcgcagacacuacaccggauggggccggcuuuccgccaaacugauuaauggcaucagagauaaggucacacgcaaaaccauucucgacuaucugaucgaugacgggacaagcaaccggaauuucaugcagcugaucaacgaugacacgcuuucuuuuguggaugaaauuagacucgcccaaggauccggcaaggcugaggacuaccgcgccgaaguccagaaucuggcggggagccccgcuaucaagaaagggauucugcagucucucaagaucguggaugagcugauugagguuaugggcuaugacccggaacauaucguggucgagauggccagagaaaaccaguucaccaaucaagggcggcgcaacucccagcagagauacaaaaagaucgagaaugccauuaaaaaccuugacagcaaucugaacuccaagauccucaaagaauacccuacaaauaaccaggcucugcaaaacgaucggcuguuucuuuauuaccuccagaauggcaaggacauguauaccgaugaggagcuggacauugaucagcugucucaauacgacaucgaucacauuaucccccaggccuucaucaaggacgauagccucgacaacaaagugcugacaaaguccgcuaaaaaucgcggaaagucugaugacguuccuagccuugaaauuguguauaaaaagaagaacuuuuggaaacagcugcucgacucccagcugaucagccaaagaaaguucgauaaucugaccaaagccgagcggggcgggcuuacgaacgaagacaaggcgcgcuuuauucagagacagcuggucgagacccggcagaucacaaaacauguggcccgcauucucgauaccagauucaauacaaagcuggacgaagcuggaaaccggaucagagaucccaaggugaauauuaugacccucaaaucuucccugguuagccaauuucgcaaggacuaccagcuuuauaaaguccgggagaucaacaauuaccaccacgcccaugaugcuuaccugaacgccgugguggcgacggcccuccugaagaaauauccccagcuggcuccugaguucgucuacggcgacuauccgaaguacaauucuuauaaguccagaaaaagcgccacagaaaaggugcuuuucuacucuaacaucaugaauuucuucaaacgcguucugguguauagcaagaccggggagguccggauuagacccgugaucgaaguuaacaaagagacaggagaaauugugugggauaagaaguccgacuuucgcaccguccggaaagugcucagcuacccucagguuaacguggucaagaaaaccgaggugcaaaaucacggccuggauagagggaagcccaaaggcuucuacaacgcuaaucucucuccucgccccaaggagggauccguggaaaaccuggucccggccaaacagagcuuugacacaaagcgguauggcggguacgccggaaucuccaauucuuaugcuguucuugugaacggcauuaucgagaaggggaaaaagaaaagcaaggcggaagugacggaguuccagggaaucuccauucuggccagaaaagauuuugacaagaauccuaagcaauaccuccugaaccugggcuauaaagacaucaagucuauuaucaaacuucccaaguacagccuguucgagcucgaaaaugggucccggcgcaugcuggcuucuauucucagcaccaacaauaaaagaggcgagauccauaagggaaacgaaauguaucugccugauaaguuugucacacuucuguaccacgccaugcgggugaaucgcacccuggagcccggccacaaaaaguacguugaagcccauagacacguguucgacgagcuccugacauauauccuugaguacaacgagaaaauugucggggcuaaggccaauggaaaacggaucguggaagcguauuccgcuagaaaggauaccgacaaccuggaggaacucugcaauagcuuuauuaaccugcucaaccugacggcccuuggcucugccguugauuucgaauuucuggggacaaagaucccucgcuaccgggacuauacccccuccagccugcucaaagcuacccugauucaucagucugugacaggacuuuacgagaccagaaucgaucuguccaagcucggcggggacuga

SEQ ID NO: 4365 - RNA, 4143 nt, Artificial Sequence
  Cas9 variant
augaagaaaauccugggccucgaccuggggaccacaagcauuggaugggcccuuguguacgaguccgaaaacgcugaugagaagucuagcaucgucagacugggcguucgggugaauccccucuccguggacgaaaaagggaacuucgagaagggaaaaucuauuacgaccaaugccgaucgccagcaaacacacggcgcgagaaucaaccugcagcgguauaaacuucgcagagaaaaucugaaggacugccuccagaaacagggguggauuggaaccgaggcucuguacgaggaaggcaagacaagcaccuuugagacauauaugcugcgggccaaagccgcugaagaggagaucucccuccaugaacugugucgcguccuuuucaugcugaacaagaaaagaggcuacaagucuaaucggaaggccaacaauaaagaggaugggaagcucuuugacggaaugaccguggcuaaaaagcuguaugaggaacaccuuacgccugccgaauacagccugaaacuccuguccagcggcaagaaauucaagcaagaguauuaccgcucugaucugaaggaggaauuugacagaaucuggaacgagcagcagaaauacuauccggaaauucucaccgaugacuucaagcagcaacugcaggggaaauccaagggaaauacaagcaaaaucuuucuuggcaaguacgggauuuauucugcggaucugaagggacucgaccggaaacugcagccccuuaaguggcgcguugaggcccugaaacagaagguggauaaagaaguccucgcuuucgugaucuccgaccugaacggccaaauugccagcaccucuggccugcucggggcuaucuccgacagaagcaaggagcuguacuuuaauaagcagacaguuggacaguaucuuuggaccucccugaaagagucuccucaugugagcauuaagaacaaacccuucuaccggcaagauuaucucgacgaauuugagaagaucugggaaacgcaggccacauaccacaaagagcugaccccugaacuuaagcaggagauccgcgauauuaucauuuucuaccagagaccccugaaguccaaaaagggccucaucagcgucugcgagcuggaacaacggaaagugaaggugacaauugacgggaaagagaaggaaaucucuaucggaccuaaagucgcgccgaaguccagccccauguuucaggaguucagaauuuggcagaaucugaacaacauccuccugauugauaagggcaauaacucuaaucgcccucuuuaugaggaggaacggaaccugcucuacgaggaacugagcguuaaagaaaagcuguccaaagccgaggcucuuaaggugcucaauaaaaacgggaagcagugggaccugaauuauaaggagaucgaaggaaacagaacccaagccgugcuguacgauuguuauaaucgcauuaucggcaugaccggccaugaggaaugcaacuucaaaaagcucaaggcuucugacauccgguacaaugucaagacaauuuuuaaaaaccugggguucagcacggauauccuugacuuugauuccagccugcagggacacgagcucgaaagacagcccucuuaucagcuguggcaucugcuuuacuccuacgagagcgacaauucucgcaccggcaacgacgcccuccugcggaagcuggagacagccuucuccauuccuaaggaauaugcugcggugcucagcgauguuguguuugaggacuccuacgggaaucugucugucaaagccaugagaaacauccuuccccaucugcaagcuggacucgauuauagccaggccugugaaaaggccggcuacaaacacucccgccggucucugaccaagaacgagcuggacaaaaaggaauauaaggagaaacuugagcuccugccuaagagcucccugcacaauccggugguugagaaaauucucaaccagaugaucaaugugauuaacgcugucaucgaugaauacgggaagcccgacgaaaucagaauugagcuggcccgcgagcuuaaaaucggcgcggcugaacgggagaauaugacaagaagcauuaaccagggaaaugccgaaaacaagcggauccgcgagauucuggaaaaagaguucgcccucucuuauaucuccagaaaugauaucauuaaguacaagcuguacgaggaacugaaaagcaacggcuuuaagacccuuuauucugacacguacaucuccaaagauaaacucuucagcaaagacuuugauauugagcacaucauuccuaaggcucggcuguucgacgauucucugagcaauaagacaaucgaagccagagacgugaacaucgcuaaauccaauaagaccgccuuugacuucauuagcgagaaauaugaucaacaggggaucgaagcguacaagaaaaagcucgacauucugcuucaggauggaucuaucuccaaggccaaauauaaccgccugcucaugaaggaggcugacauucccagcggcuuuaucgaucgggaccugagagauacccaauacaucgccaaaaaggcuuaugagauucuguccgaccuuguccgcaaugugacacccaccacaggggccguuacgucuagacugcgggaagauuggcagcucguggacgucaugaaagagcugaacuucgaaaaguaccagaagcucggacugguggagguuaucgaagaucgcgacggcagaaaaauuaagcggaucaaagauuggaccaagcgcaacgaccacagacaucacgcgauggacgcccuuacaauugcuuucaccaaaccuagcuacauccaguaucugaauaaccucaaugcccgguccgauaagaacucuagcauuuacgggaucgagaauaaggagcugcaucgcgaagacaacaaacugagauuuaaugcuccgcuucccaucaacgaguuccgggccgaagcccgcagacaccugaaguccauucucgugucugucaaagcuaagaauaaagugaugacacaaaacgugaauguuaucaagaccaaacauggcgucauuaagaaggugcagcugacgccucggggagagcuccacaacgcgaccuuuuauggcaccaaaaagagacccaucauuaaaauggugaaggucggggccgcucuggaugaggugacaaucaaaaagguuagcuccagcuucauccgcgaagcccuucuggaccggcuccacgaguacaauggagaugccaagaaggcuuuuacaggcagaaacucuauugacaagaauccuaucuauauugaugaggaacauaaaaagaccgugcccgcccuggucaaaacgaucgaaugggagauguaccacccgacacgcaagaugauuuccccugaccugaagaucgauaaagugaucgacaaggggauucgggagauccuuagaacccgccuggcgaaauucaacggagaugcucagaaggccuuuagcaaccucgacgaaaaucccauuuauaaagacgaggccaagaagaucacacugaaacggguuucucucgaaggcguguccagcgucauuccucugcauaaacuuaaggauaugggcgggaagcccgugguuggaaaagacggcaagccuguguggggagauuacguccagaccucuaacaaucaccacaucgcuuucuacauggacgagaacgggaaucugcaagaugacguggugaccuuuuucaaagccgcgagacgcaagucccagggcguccccguuauugauaagaacuauaaucaugacaaaggguggcacuuucuguucacaaugaagcagaacgaauacuuuguguucccgaaugaggcuacgggauucaucccuaccgagguggaucucauggacgaagccaacuaugauaugaucagccccaaucuguaccggguccagaaaauguccaagacaaaacaaggcauuaccgacaagagagauuauugguuucggcaucaccuugagacagugcugaacaaugaccucaagguucgcaacagcaucuucaaacagauuaauucucugaagccccucgaagggaucgugaaagucagaauuaacgccaucggcaagaucguggcuauuggagaguacgacuga

SEQ ID NO: 4366 - RNA, 4143 nt, Artificial Sequence
  Cas9 variant
augaagagaauccugggccucgaccuggggaccacaagcauuggaugggcccuugugaacgaggcugaauccaauaacgaggccucuagcaucguccggcugggcguucgcgugaauccccucacgguggaugaaaaauccaacuucgagaaggggaaagcgauuaccacaaaugcugacagacaacugcggcacggagcccgcaucaaccuucaaagauacaagcugcggcgccagaaucuccaugauugccugcagaaacagggcuggcuggggaccgaagccauguaugaggagggaaaggcuucuacauuugaaaccuacaagcucagagccaaagcugccgaggaagagauuagccugcacgaguucgcgcggguccuuuuuaugcugaacaagaaacgcggcuauaaguccaauagaaaagccaacaauaaggaagacggccaacucuucgaugggaugacaaucgcuaagaaacuguacgaggaacaucuuaccccugccgaguauucucugcagcuccugaacaagggaaagaaguuuacgcagggcuacuaucggagcgaccugaaugcugaacucgagcgcaucugggaugagcagaaaaaguacuacccggaaauucugaccgacgaguucaaacaacagcuugaagggaagacaaagaccaacacauccaaaaucuuucuggccaaguauggaauuuacagcgcggaucucaaaggccuggacagaaaacuucagccccugaaauggcggguggaggcccucaagcagcaaguugauaaggaagugcuggcuuucgucaucucugaccugaaagggcagauugccaauaccuccggacuccugggcgcuaucagcgaucgcucuaaggagcuuuauuuuaacaaacagacggugggccaauaccugugggccucccucgaggaaaacccucacauuagcaucaagaauaaacccuucuauagacaggacuaccuggacgaguuugaaaagaucugggagacacaggccaccuuccauaagcagcuuacaccugaacugaaacaagagauucgggauaucauuaucuuuuaucagagaccccucaagucuaaaaagucccugauuagcguuugugagcuggaacagcgcaaagugaaggcuaccaucgacgggaaggagaaagaaaucaccauuggaccuaaggucgcgccgaaauccucucccguguuccaggaguuccggaucuggcaaaaccucaauaacgugcugcuuauugauaaugacacaaacgagaagagaccucuggaugaagacgagcgcuaccuccuguacaaagaacugagcaucaaggccaaacuuuccaagacggaggcucucaagauucugaauaaaaagggcaaacagugggaucugaacuauaaggaacucgaggggaaucggacccaggccauccuguuugacugcuacaacagaaucauuacacuuaccggacacgaggaaugugauuucaaaaagaucaaggccagcgagauucgccacuaugucucuacaaucuuuaaaaaucugggcuucuccaccgaaauucucgacuuugaucccagccuggagaagcaugaacuggagaaacagccuauguaccaacuuuggcaccuccuguauucuuacgagagcgacaacucccggacggggaaugaaucucugcucagaaagcuggagacaaccuucggauuucccgaagaguaugcuaccguucuuugcgacgugguguucgaagaggauuacggcaaccugagcgucaaagccaugcgcaagauccucccguaccugcaggcgggcaaugacuauucccaggcuugugccuacgccggguauaaccauagccggcacucucugacaaaggaggaacuugaucagaaaguguacaaggagagacucgaacugcugccuaaaaacucccuccgcaaucccguuguggagaagauucugaaccaaaugaucaaugucaucaacgcuauuaucgacgaguauggaaaaccugaugaaauucggaucgagauggccagagaacuuaagagcucugcugccgaccggaagaaaaccacacacgcgauuaaucagggcaacgaugagaaucagugcauccgcgaaauccuggagaaggaguuugcccucuccuacauuagcagaaacgacaucauuaaauauaagcuguacgaggaacugaaacccaauggguucaagacgcuuuacuccgauaccuauauccccaaagacaagcucuuuucuaaggauuucgacauugaacauaucaucccuaaagcucggcuguuugaugacagcuacuccaacaagacacuggaggccagagacauuaaucucgcuaaaucuaacaagaccgccuucgauuucgugaaagaaaaguauggagagcaaggcgcggaggccuacaagaaaaagcuggacaugcuucuggggaauaacguuaucagcaaaccgaaguauaauaaacuccugaugacagaagcugauauucccuccgacuuuaucaaccgcgaucugcggaacacccaguacauugccagaaaggcuugugagauccuuggcgaacuggugcgcacggucaccccuacaaccggaaagaucacaaauagacuccgggaggacuggcagcugguggaugucaugaaagaacucaacuucgagaaguaugagaaacugggccuuaccgaaauuguggaggaccgcgaugggagaaagaucaaacggauuaaggacuggacgaagcgcaaugaucacagacaucacgccauggacgcccuggcuaucgcguuuacaaaacccagcuacauucaguaccucaacaaucugaacgcccggucuaauaagggagauuccaucuaugcuauugaaaacaaagagcugcauuacgaggaaggcaaacuucgcuucaaugccccuauccccguuaacguguuuagagccgaggcuaaacggcaccugagcgccauccucgucucuauuaaggcgaagaauaaagugaugacccaaaacguuaauaagaucaaaacaaagcacgggauuaucaaaaagauucagcugaccccgcgcggaccucuccauaacgaaaccaucuauggcacaaaaaugagacccaucauuaagaaggugaaagucggggcugcccuggacgaggccacgaucaauaagguguccagcccugcuauucgggaagugcuucugaaaagacucaacgaguacucuggcaacgccaagaaagcguucaccggaaagaauacacuggacaagaaccccaucuaucugaaugcugagcgcaccaaaacaguuccugccagcgucaagaccguggaaugggagaacuaccaccccauucggaaaccgaucacgccugaucuuaagguggacaaagucaucgauaagggcauuggggaaauccugaaggccagacucgaggaauuuaauggagacgcuaaaaaggccuucuccaaccuggaggagaaucccauuuaucucgaucagacaaagaagaucgcucugaaacgcgugagcauugaaggcguucuuucuaccaucccccugcauacccugaagaaccaggccgggaagccuauuaugggaaaagacggcaagccggugcucgggaauuacguccaaacauccaacaaucaccacaucgcguuuuacuaugaugaggacggcaaccugcaggauaaugccgugagcuucuuugaagcugccgagcggaaaucccagggaaucucuguuauugacaaggauuacaacagagacaaaggcuggcgcuuccuuuuuaccaugaagcagaaugaauauuucguguuccccaacgaggcuacaggguuuaucccuagcgaggucgaccugacggaugaagccaauuacggaauuaucucccccaaccucuaucgggugcagaaaaugucuagaauugagaagggcaccagcguuucccgcgacuacugguuccggcaucaccuggaaacaauccucaacgaugacucuagacugaagaauagcgccuuuaaacggaucaacucccuuaagccucuggaggggauuaucaaagugcgcauuaauagcaucggaaagauugucgcugugggcgaguaugauuga

SEQ ID NO: 4367 - RNA, 4143 nt, Artificial Sequence
  Cas9 variant
augaagaaaggcuacagcaucgggcuggacauuggaaccaacuccgugggcuucgccgucaucacagaugacuauaagguucccucuaaaaagaugaaagugcucgggaauacggauaagagauuuauuaagaaaaaccugaucggagcccuucuguucgacgagggcaccacagccgaagcgcggcgccucaagagaaccgcucggcgcagauacacacggcgcaaaaauagacugcgguaucuucaggagauuuuuagcgaagagauguccaagguggauucuagcuucuuucaccgccuggacgauuccuuccucaucccugaagacaaaagagagucuaaguacccgaucuuugccacccuggaggaagagaaggaauaucauaaaaaguuccccacaauuuaccaucugcggaaacaccucgccgauagcaaggagaaagcugaccugcgccuuaucuaucuggcccucgcucacaugauuaaguacagagggcauuuucuguacgaggauaccuucgacaucaaaaacaaugauauucaaaagaucuuuaacgaguucauuuccaucuaugacaaugccuuugaaggaagcucucuuuccggccagaacgcgcaggucgaagccaucuucacggacaagauuagcaaaucugcuaagcgggagcgcgugcugaaacucuucccugaugaaaaguccaccggccuguuuagcgaguuccugaaacucaucguugggaaucaggccgacuuuaagaagcacuucgaucuggaggacaaagcuccccuucaauuuucuaaggauacauacgacgaagaucuggagaaccuccugggacagauuggcgacgauuucgccgaccuuuuuguggcggccaaaaagcuguaugaugcuauccuccuguccgggauucugaccgucacagacccuagcaccaaagcuccccucuccgcuucuaugaucgaaagauacgagaaucaccagaacgaccuggugguucuuaagcaguucaucaagaauaaccugccugaaaauuauguggaggucuuuagcgaugacuccaaaaacggauacgccggcuauguggggguggauagcaagauucggaaaagaaacgccaagcucgcuacggaggaagaguucuacaaauaccugaagaauauccuuaacaaugucaagggagcggacuauuuucuggauaaaauugaacgcgaggacuuccuccggaagcaaagaacauuugauaacggcucuaucccgcaucagauucaucugcaggaaaugaaugccauccugcgccggcagggcgagcacuaccccuuccucaaagagaacagagaaaagaucgagaaaauucugaccuuccgcaucccuuauuacguugggccccuugcucggggaaauagagacuuugccuggcugacacgcaacuccgaucaagccauucggccuuggaauuucgaagagaucguggacaaggcuagcucugccgaggauuuuauuaacaaaaugaccaauuaugaccucuaccugcccgaagagaaggugcugccgaagcacagccuucucuaugaaaaauucgcggucuacaacgagcugaccaaggugaaauuuaucgcugaaggccugagagauuaccaguuccucgacuccgggcagaagaaacaaauuguuaaucagcuguuuaaggagaagcgcaaagugacagagaaggacaucauccacuaucuucauacggucgauggauacgacggcauugaacugaaagggaucgagaagcaguucaacgccucucucagcaccuaucacgaucugcugaaaauuaucaaggacaaggaauuuauggaugacccuaaaaaugaggaaauucuugagaacaucgugcauacacucaccaucuucgaggaucgggaaaugauuaagcagagacuggcccaauacgacucccuguuugaugagaaaguuaucaagagccucacacggcgccacuauaccggauggggcaaacugucugcuaugcuuauuaacggcaucagagacaagcagacggggaagacaauucuggauuaccucaucgacgaugccuauuacaaucggaacuucaugcagcugaucaaugacgacggacuguccuuuaaagaaauuauccagaaggcucaaguggucggcaaaaccgaugacgugaagcaggucgugcaggagcuucccgggagcccugccauuaaaaagggaauccuccagucuauuaaaaucguugaugaacuggugaagaucaugagacauaaccccgaguccauugucaucgagauggcgcgcgaaaaucaaaccacagcccggggcaagaaaaacagccagcagagauacaagcgcauugaggacgcucugaaaaaucucgcccccgggcuggauuccaacauccuuaaggaacacccuaccgacaaugugcagcugcaaaacgauagacucuuccuguauuaccugcagaauggcaaagacauguauacaggagaggcucuugauauuaaccagcucucuagcuacgacaucgaucacauuaucccgcaagccuucaucaaggacgacuccuuugauaaucggguucugacgucuagcaaggacaaccgcggcaaauccgauaaugugcccagcauugaggucgugcagaagagaaaagcguucuggcagcagcugcucgacucuaagcugaucuccgaacggaaauuuaacaaccuuaccaaggccgagcgcgggggacuggaugaaagagacaaggugggcuucauuaaacggcaacucguugagacacgccagaucaccaagcaugucgcucagauucuggaugccagauauaauacagaagugaacgagaaagacaagaaaaaucggaccgugaagaucaucacgcuuaagagcaaccuggucucuaauuuucgcaaagaguucagacuguacaaggugcgggaaauuaacgauuaucaccaugcucacgacgccuaccucaaugccguuguggcuaaagcgauccugaagaaauacccuaagcucgagcccgaauuugucuauggggaguaccagaaguaugaucugaaaagauacauuucccgcagcaaggacccuaaagaaguggagaaggccaccgagaaauauuucuuuuacucuaaccuucugaauuucuuuaaggaagagguucacuaugcugauggaacaaucgugaaacgggaaaacauugaguacagcaaggacaccggcgaaaucgccuggaauaaggagaaagacuucgccaucauuaagaaaguccucucccugccccaagugaacaucguuaagaaaagagaggugcagacagggggcuucagcaaggaaucuauucugccgaagggaaauuccgauaaacuuaucccucgcaagaccaaagacauucugugggauacgacaaaguacggcggguuugacagccccgucaucgcuuauuccauucuccugaucgccgauaucgagaaaggaaaggcgaagaaacucaagaccgugaaaacacuggugggcauuaccaucauggaaaaggcugccuucgaggacaacccuauuaccuuucuugagaauaaaggguaccauaacguccggaaggaaaacauccugugccuccccaaguauucucuguucgagcuggaaaauggaagacgccggcuucuggccagcgcuaaagagcuccagaagggcaacgaaauuguucugccuguguaccucacaacgcugcuuuaucacuccaaaaaugugcauaagcuggaugagcccgggcaccuggaguacauccagaaacauagaaacgaauuuaaggaccuccugaaucuugucucugaguucagccaaaaauaugugcuggccgaugcgaaccucgaaaagaucaagucccuguacgcugacaaugagcaggccgauauugaaauccucgccaacucuuuuauuaaucugcuuaccuucacagcucugggcgccccggcugccuuuaaauucuuuggaaaggacaucgaucgcaaacgguacaccacaguuagcgagauucugaacgcgacccucauccaccaguccaucacgggccuguaugagacaagaauugaccuuagcaagcugggggaagacuga

SEQ ID NO: 4368 - RNA, 4143 nt, Artificial Sequence
  Cas9 variant
augaaccugagacacgugggcaauuacaacaucgggcucgacaugggaaccgccagcgucggcugggcugccauugaugagcagggggaacugcuucauuucaagggaaaacccacauggggcucccggcuguuugacucugcgaauacggcugccaccgcccgcaugccuagagggcaacggcgcagauauauccggcgcagauggcggcucgaucugcuucagaaguucuuuagcgaggaaauggcugagaaagacccggaguucuuuauucgccugagacaguccucucucuggcccgaagaucgggagggaggccacacagccuaccauuggccucuguucaacgacagcgauuuuaaugaaaaggaguauuacgaaaaauuccccaccaucuuucaucugcgccaguggcucauggagacagacgagaaggcugauauuagacugaucuaucuugccuuccacaacaucguuaagcaccggggcaauuuucugcaagaaaacaaugacucccucucugcgcagaacgccaauaugcgcgagagccuggaauccuucugcauugcucuugaggaauggugugaugagaaagagcugaccugcagcugugacccucagaagcucgaacaccuguuuaaagaggugaaguacagaucugauauccgggacggguucgccgcucugcucggacuggccugcuccggcgaaaacgagguggacgucaaagcgauggccaaggaaauggggaaggcuauugugggauauaaagccgauuucagcaagaucuuuacagagugugacaaagagggcagcuccuucagacuuagcgaugacgaagggcccgaggcuuuucuggauauuugcccugacgauggaaucgcccucuucgaagccauucagaugguuuacucuuccuuuauccugaccggcaugcuuacggagaagggccugagccucuccaaaaucucugcuuacaaucaauaugggcaggaccuggaaagccugaaggcgcucgugaaagaguacgucccgaacgaguauuccagcuucuuucgcggacccaccuacucuggcuccacagaauaugauccuagcaaggcccagggguacacccgguauaaucugggacccucuaagaaaggcagcggggcuaagccuauggccuacgaggacuucaaaaaguccguggaacagcuuuuugccaacacaaacgcuauuaaugaugagagauacaaagagaugaugggacgcuucgccgaagagaaguuucugcggagacuccgcaccucugacaacggccggauccccuuccaacugaaucuugaagagaugacggcgauuaucauuaaccagggcaaguauuacccguuucugcucgaacagcaagagaaacuggagagccugguuagauuccgcaucccuuauuacguggggccccucacacggaucaaugcuagacuggacuccaagggaaacgccuguuucgccuggagcaaacgcaaggauggcauggacucugcuuccauuaaaccuuggaauugggaugaagucaucgacaagcaugccagcgcucaggccuuuauugagcggaugaccgggacaugcaccuaucuuagaggagaacccgugcugccccgguguucucuccuguacgaggaauauugcgugcugaacgagcuuaauggcgcgcgcuggacccaggauggggacaaguucaucagauuugauuacaaagaccgguccgauauuaucgaggaacucuucaagaaaagacgcggccggauccaguacgccgcugucgccgacuggaugaagcaagagagaagccacgcuaacguucauguguccggaggccagggggaaaaugccuuugagucucgccugagcuccuaucacuucuuuuguaacgauguguucggagucgacgaacugccuggcucuuacguggauaugguugaggagauuauccucuggagcacacuguuugaagacagauccauucuucgggaggaaauccagcgcaaauauggggacgugcugaaugaggagcagauuaagacgaucugcaagaaaagauucagcggauggggccggcucucucgcaagcugcugugcucccuuaaagcgcaaaccgauaacgggccgaagucuauuauggacauccuccaggaaggcgaucagaauaacggaagagucggccgggccaugguguuucaggagauccugcacgacgaacaacugggguucgagcagaaaauugaagaggagaacacacagucuaugcucgaaggagagaaucugcuuaucgaagaucugcccggcuccccugcuauucgcagaagcaucaaccaggccguucggauuguggacgagaucgucgggaucgcuggacaugcccccgauaauauuuuuaucgaagugacccgcgaggacgauacaaagaaaaagggcaagagaaccacgacacgguacucuaacauucaaaaagcccucgaggcucugaaggaagagggggcggaagcccugagagagcuuaaaaccuauaagcacaaugaacucgacaaacgccugagccuguacuucaugcagaacggcaagucccucuauagcggaaucccucuggauauucggagacuuucugaguaccagaucgaccauaucauuccccaauccuacaucaaggaugacagcuaugagaauauggcucugguccucccgggcgaaaaccaguccaaagccgacaaucugcugauuucucaggauauccgcauuaagaugaaagccaccuggacagcccuucacaaggccgggcucaugggagacaaaaaguacaacaaucugaugaacagcuccaucucugaugcgaagaugaaaggcuucaucaaucggcagcugguggagaccagccaauccguuaagcucacacagaugaugcugucucagaaauauccuggggcuaaggugagacccauuaaagccagcaucuccagccagcuucgcgacgccugugaucuggucaagugccgggaagcuaacgacuaccaucacgcccacgaugcguaucucgcuugucaagugggaagauuuguucugaagcgccauucuuccauguucgacaauccuauuggcaugacgaaagugauccgggauuuugucaagagacaggggcaggaguucaaacggaacggcaagcugcccgccuacgccagccgcucuggauuuauugugcaguccuucaugagaagcggcuuugacgcugagaccggggaacuucugcgggaugacuggaacgccccuuucgagaucgcucgcauuaaaagaugccucaauuaucgggacuguuacaucucuagaaugcccauggaagauuccggagccuuuugggacgcgacaaucuacagcccgaaggccggcaaaaagggggcucugccugugaagcaaggacuccccguugagaaauauggcuccuacagccgcgaacaguucgccuacuuuuucgucuauaaggcuuauaaccccaaaaagaaagccuaccggcuggaguucgaggccgugccugugagagucgcuucugcgguggaaacccgcgagaaugcccuugaagaguaugcuaagagcguugccaagcaggccggccuggaauuuguggaggucgcucggccgaaaguguacaaguaccaacucauugagcugggggaagauagacuguauaucacaggaaaacgcgagguucggaacgccucccagcuugcguucucucuggacgaaauugaucuccugaagagacucgcugagggcgaagagaccagcuccgaggaacgcgagagacuguuugacgugcuuaucgaaaaauacgcccgguaugcuccccgccuggcuagacagcucucugucgauagcauguccgccacguucgagacccugaaugcggaggaacagcuggggauucuucugucucucguggagaucgcuaacggaaagcggaauaugaucgaccugagcuccgccggcgggagcaagaacgccggaugcaugaauccuacauuuucuuccgaacucagcucucccggcuccaacuucaccuuuauugaucaaagcguuacaggcauguucgagcgcagacagcggcuggaacuuuga

SEQ ID NO: 4369 - RNA, 4146 nt, Artificial Sequence
  Cas9 variant
auggugaagaaaaaguacgccaucggcauugacaucgggaccaacagcgucggaugguccauuguuacagaugacuauaaagugcccucuaagaaaaugaagguguucggcaauacggagaagagauacaucaaaaagaaccugcucgggacccugcuuuuugaugaaggaaauacagcugagaaccggcgccugaaaagaaccgcccggcgcagauauacacggcgcagaaaucggauucucuaccugcaggaaaucuucgcggaggaaaucaacaagauugacgauagcuuuuuccaacgccuugacgauuccuuucugaucgucgaggacaaacagggcucuaagcacccuauuuucgggacccuccaggaggaaaaggaguaucauaaacaguuuccgacaaucuaccaccugagaaagcaacuggcugauagcucccagaaagccgacauucggcucaucuaucuggcccuugcucauauuaucaaguaccgcggacacuuccuguuugaaggcgaucucaaaucugagaauaaggacgugcagcaucuguucaacgauuuuguugagauguucgacaaaaccguggaaggcagcuaccuuuccgagaaucugcccaacgucgccgacgugcucguugaaaaggugagcaagucuagacggcuggagaauauccugcacuauuuuccuaacgagaaaaagaauggacucuucggaaacuuccuggcucuugcccugggccuccagcccaauuuuaaaacgaacuucgagcuggcggaggaugccaagauucaauuuuccaaagaaaccuacgaggaagaccuugaggaacugcucgggaagaucggagaugacuaugcugaucuguucauugccacaaagagccuguacgacggcauccuccuggcugggauucuuucuaccacagauuccaccacgaaagccccucugucuagcuccauggucaaccgcuaugaggagcaccagaaggaccucgcgcugcuuaaaaauuuuauccaucagaaccugagcgauuccuacaaggaaguguucaaugacaaacucaaggauggauaugccggcuacaucgagggcaagacaacccaggaaaacuuuuacagauucauuaaaaaggcuaucgagaaaauugaagggucuaauuauuuuaucgacaagauugaccgggaggauuuccugagaaaacaacgcacauuugacaacggaagcaucccccaccagauccaucugcaggagaugcacgccauuauccggagacaagcugaauuuuacccuuuucucguggagaaucaggauaagauugaaaagauccugaccuuccgcauuccguauuacgucggcccccuugcccgggggaaauccgaguucgccuggcugaacagaaagagcgacgagaaaauccgcccuuggaauuuugaugaaaugguugacaaggagaccucugcugaaaacuucauuacacggaugacgaauuaugauagauaccuccccgaccagaaagugcugccuaagcacucccugcuuuaugagaaauuugcgguguacaacgaacucaccaaggucaaguucaucgccgagggaaugcgcgauuaccaguuucuggacagcggccagaaaaaggauaucgugaaaacacuguucaagaccaaacggaagguuacagcuaaggacauuaaagccuaucucgaaaauucuaacggguacgccggaguggaacugaagggccuugaggaacaauuuaaugcuagccugcccaccuaucaugaucuccugaaaauccugagagacaaggccuucauugacgcggaggaaaaccaggagauccuugaggauauuguccucacgcugacacuguuugaagaccgcgagaugauccggaaaagacucgaaaaguacaaggauauccugaccgaggaacagcggaaaaagcuggagcgcagacacuauaccggcugggggcggcuuuccgcuaaacucauuaacggaauccuggacaaggugacaagaaaaaccauucugggcuaccuuaucgaugacgggacaucuaaucgcaacuucaugcaacucauuaaugaugacacgcugagcuuuguugaugagauccggcuggcccagggauccggcgaagccgaggacuauagagcugaagugcagaaccucgccgggagcccggcuaucaagaagggcauucugcagucucuuaaaaucgucgaugagcugauugaggugaugggauacgaaccugagcauaucgucguggaaauggcccgcgagaaucaauucaccaaccagggcagaagaaauucccagcagcgcauuaacagacucgaaaaugcgcugaaggacuuugggagcaaaauccuggaggagcaaaagcccuacggaguuucuaaagugaacaauauccaccuucaguccgaucgccucuuccuguauuaccugcagaacggcaaggacauguauacagacgaggaacucgauauugaccaucugagcgaauacgauaucgaccacauuaucccucaagccuucauuaaagaugacucccuugauaauaagguccugaccaagucugcuaaaaaccggggaaagagcgacgaugugcccuccauggagaucguucacaaucggaaaaacuuuuggcggcagcuccugaagucuaaacugauuagccagcgcaaguucgacaaccuuacaaaggccgaaagagggggccugaccaaugaggauaaagcucgguuuauccagcgccaacucguggagacgagacagaucaccaagcaugucgcccggaugcuggacacaagauucaacaccaaacucgacgaagcggggaaucgcauucgggaucccaaggugaacaucauuacacugaaauccaaucuugugagccaguuuagaaaggacuaucagcuguacaagauccgcgagauuaacaauuaucaccaugcccacgaugcuuacaucaacgccguugucgcuaccgcccuccugaaaaaguacccucaacuggccccggaguucguguauggcgaauaccccacguauaauucuuacaacucccggaaaagcgcuacagaaaaggugcuuuucuauucuaauaucaugaacuucuuuaaaagaauugucgugcacuccaagaccggagagguucgcauccggccugugauugaggucaauaaggaaacaggcgagaucgugugggacaaaaagagcgauuucagaaccguucgcaaagugcugucuuacccccaggucaacgugguuaagaaaaccgaagugcagaaucaugggcucgaccggggaaagccuaagggcuuuuauaacgcgaaccugagccccagaccgaaagagggguccgucgagaaucucgugccugccaagcagagcuucgauacaaaacgguacggaggcuacgcugggauuucuaacuccuaugccgugcuggucaauggcaucaucgaaaaggggaaaaagaaaagcaaggccgagguuacggaguuccaaggcauuuccauccuugcucgcaaggacuuugauaaaaaccccaagcaguaccugcucaaucugggguauaaagacauuaagucuaucauuaaacugccuaaguacagccuuuucgaacuggaaaacggauccagacggaugcucgccucuauccugagcaccaauaacaagcgcggcgagauucacaaagggaaugagauguaucuccccgauaaguuugugacacugcuuuaccaugcgaugagagugaaccggacccuggaaccuggacacaaaaaguaugucgagacacauagacacguguucgacgaacugcucaucuacauccuggaguacaaugagaaaauuguuggcgcuaaggccaacgggaagcgcaucguggaagccuauuccgcucggaaagauaccgacaaucuugaggaacugugcaacucuuuuauuaaucuccugaaccucacggcccugggcagcgcggucgacuucgaguuucuuggaacaaagauccccagauaccgcgauuauaccccguccagccugcugaaagcuacccucauucaccagucugugacaggccuguacgaaacccggaucgaccuuuccaagcugggaggggauuga

SEQ ID NO: 4370 - RNA, 4146 nt, Artificial Sequence
  Cas9 variant
augaacuacgugaaggaguaucacaucggccuggacauugggaccagcuccaucggaugggccgucacagauucucaguucaaacucaugagaauuaagggcaaaacggcuaucgggguucggcuguuugaagagggaaagaccgccgcggaacgcagaacauuccggaccacacgcagacggcuuaaacgcagaaaguggcggcugcauuaccucgacgagauuuuugcuccccaucugcaagaaguggaugagaauuuccuucgcagacugaagcagagcaacauccacccugaggacccggccaaaaaucaggccuuuaucggcaagcuccuguuccccgaucugcucaaaaagaacgaacggggguauccuacccugauuaaaaugcgcgacgagcuucccguggaacagagagcucacuacccugucacaaauaucuauaagcugcgggaggccaugauuaacgaggaucgccaauuugaccucagagaaguguaccuggcuguucaucacaucgugaaguaucggggacacuuccuuaauaacgccuccgucgauaaauuuaaggugggcagaauugacuucgauaaaucuuuuaauguucugaacgaggcguacgaagaacuccagaauggcgaagggagcuucaccaucgagcccuccaagguggagaaaauuggacagcugcugcucgacacgaagaugcgcaaacuggaucggcagaaggccgucgcuaaguuucuugaagugaaaguggccgacaaggaggaaaccaaaagaaacaagcaaaucgcuacagccaucucuaaacugguccucggcuacaaggcggacuucgccaccguugcuauggccaaugggaacgaguggaagauugaucugagcuccgaaacaagcgaggacgagaucgaaaaauuccgcgaggaacuuucugaugcucagaaugacauucugaccgagaucacgucccucuuuagccagauuaugcugaacgaaaucgugccuaacggaaugucuaucuccgagagcaugauggaucgguauuggacacaugagagacagcuggccgaagugaaggaguaccucgccacccaaccggcuucugcgcgcaaagaguucgaccaggucuauaauaaguacauuggccaggcccccaaagagaagggguuugaucuggagaagggacuuaaaaagauccuguccaaaaaggaaaacuggaaagagauugacgaacuccugaaggcuggcgauuuccuuccuaagcaacggacaagcgccaaugugguuaucccccaccagaugcaucagcaggagcuggacagaauuaucgaaaaacaagccaaguauuacccuuggcucgcuaccgagaaccccgccaccggcgagcgcgaucggcaccaggcgaaauaugaacuggaccagcugguguccuuuagaaucccguacuacgucgggccucucgugacacccgagguucagaaggcuacgucuggagccaaauucgccugggcuaagcgcaaagaagacggcgagauuaccccuuggaaucugugggauaagaucgaccgggccgaaagcgcugaggccuuuauuaagagaaugacagugaaagauaccuaucuucugaacgaggacguccuccccgccaauucccugcuguaccaaaaguauaacgugcuuaaugaacucaacaauguccgggugaacgggcgcagacugagcguuggaaucaaacaggauauuuacucugagcuguucaagaaaaagaagacagugaaagcguccgacgucgcuagccucgugauggccaagacccggggcguuaauaaacccucuguggaagggcugagcgauccuaagaaauuuaacuccaaucuugcuacguaucuggaccucaagucuaucgucggagauaagguggacgauaacugcuaccagacagaccuggagaacauuaucgaauggagaagcguguucgaggauggcgagaucuuugccgacaaacugaccgaaguugaguggcuuaccgacgaacagcgcuccgcgcucgucaagaaacgguauaagggcugggggagacugagcaaaaagcugcucacaggaauuguggaugagaauggccaacgcaucauugaccugauguggaacaccgaucagaauuucaugcagaucgugaaccagccggucuuuaaggagcaaauugaccagcuuaaucagaacgccaucacaaaugaugggaugacgcugagagaacggguggagucuguucucgacgaugcuuacaccagcccccaaaacaaaaaggccaucuggcaagugguccgcgugguugaagacauugugaaagcugucggaaaugccccuaaguccaucucuauugaguucgccagaaacgaaggcaauaaaggggagaucacacggucccgcagaacccagcugcagaagcuguucgaggaucaggcucacgaacuugugaaagacacaagccucaccgaggaacuggagaaggcgcuggaucucuccgaccgguacuaucuguacuuuacgcagggcggaaaggauauguauaccggcgaccccauuaacuucgacgaaaucucuacaaaauacgauaucgaccauauucuuccucagagcuuuguuaaggaugacucccuggauaaucgcgugcucgucucuagagccgagaacaauaaaaagagcgaccgggugcccgcuaaacuguaugccgccaagaugaagccguacuggaaccagcugcuuaaacaagggcucaucacccagcgcaaguucgagaaccugacaauggauguggaccagaauauuaaauauagaucccugggauuugucaagcggcagcucguugaaaccagacaagugaucaaacugacggcuaacauucuuggcagcauguaccaggaggccgggacagauaucaucgaaacccgcgcgggacugacaaagcagcuccgggaggaguucgaccugccuaaggugagagaagucaaugauuaccaccaugcuguggacgccuaucugaccaccuuugccggccaauaccuuaaccgccgguaucccaaacugagaucuuucuuuguuuacggggaguauaugaaguucaaacgcggcuccgaccucaagcugcggaauuuuaacuucuuucacgaacucauggagggagauaaaagccagggcaagguggucgaccagcagacaggggaacugauuacgaccagagaugagguggcuaagucuuucgaccgccuucugaauaugaaauacaugcucguuuccaaggaggugcaugaucggagcgaccaacuguauggagccacaaucgucaccgcgaaagaaucuggcaagcugacaagcccuauugagaucaaaaagaacagacccguggaucuuuacggggcuuacaccaauggaacguccgccuucaugacaauuaucaaguuuaccggcaacaaaccuaaguauaaaguuauuggggugcccaccacaagcgccgucggccugaagcgggugggaaaaccgggcucugaauccuacaaucaggagcuccaccgcaucaucaagagcaacccuaaagugaagaaggacuucgaaauugucguuccccacguguccuauucucagcugaucguggauggggacuguaaauuuacccucgcuagcgauacauaccagcaucccgccacgcaacugguccuuuccaaggagucuauggagauuaucgcugacgauuucaaauuugugaaggaaaauccugccaccgcggacgagcagcugguuagaguguucgacgaaauugucaaccagaugaaucacuauuuuacaaucuucgaucagcggagcaaccgccaaaaagugaccaaggccagagacaaguuuguuucccucccgacagagucugaauacgagggagcuaaaaagacccaggugggcaaaacggaggucaucaccaaccugcugauggggcuucaugccaaugcugcccagggagaucugaaggugcucggccugagcacauucggguuuuuccaguccagcggcggacucaaccugucugaagacgccaugauugucuaucaaucccccaccggccuuuucgagcggagaaucugccugaaagauauuuga

SEQ ID NO: 4371 - RNA, 4146 nt, Artificial Sequence
  Cas9 variant
augaagcagauccugaaaaaggugcaaggcuacaacauugggcucgacaucggaaccaauagcgucggcuggguugugacagaugagaacgccaaucugcuucaguucagaaagaagaacauguggggagcucggcuguuugaaaaaggagacacggcccagggccgcagacucucccggucuacccgcagacgguaugaucgcagacggcagcgcauucacuaccugcaagagaugcuugcgacaauggugcugcccaucgacgagagcuucuuuauuagacucaaugaggcuuuccuguggaaggaagauaaguccguccagcgggacuauauccuguuugccgauaaacaguucaccgaccgcgauuuuuacaagcaguucaaaacaaucuaucaucucagaaaguuucugcuugacaccaaagagaaggccgauccucgguucauuuaccuggcucuccaccauaugaucaaguaucgcgggaacuuucuguaccaaggacagucuuucgacgugguugagaaugugcaggagagcuuuagaguccuucuggaagaaauguacgagcagcucggcaaagagugggaauauggcgagcacuucgaugacauucaacggauccuggaaaacacaaccauugggaagaaauccaagcaggagcagaucgccgcuauucugacggaacaauacggaaauaaaaagcucgccaacgaggugaccagagcgugccugggcuauucuuucgaccuuacaguugugauggagaaugaaaaccugcucgaugagagcgggaaaaagaucaagaucuccuuuagcgacucuaaauacgaggaacaggaacuggagcuucagaaucgccuggaggaaaaguucgccgucauugaggcucucaaacggaucuauaacuggcuggugcugaaggauacccucagagggaaaaaguacauuuccgaagccauggugaauaaguaugaggcucaucacgaagaccuggucaaacuuaagcgccuguuucggacauaccucagcaccgaggaguacucuuguuucuuuagaaaagaaaagcagaaagauaaguauaucuccaacuacguuaacuaucgcaagggcgccgagcggugcagcaaagaaaagcuguacaaagcgauucacgagcuuuucgacacgguggccaaggaugacguggucuaucaagagaucguggaaaagauggaucagggggaguuucugacaaagcagaaugaaguuucuaacgcuuacaucccguaucaguguaaugagguggaaaugaagagaauccucaaacaacagggagaguucuaccccgagcugaaggaaaacgccgacaaaauucugcagcuccugcuuuuucgcauuccuuacuaugucggcccccugguggaugagaagcaguccaaauucgcuuggaugaagcggagaaccggcauggaacaaguuaaaaucuacccuuggaauuuugaacagguggucgacauugaccagacagccgaagccuucaucacccgcaugaccaacuauugcacauaccuccccgaggagaaggugcugccuaagcagagccugcuuuauuccgaauacgagcuccugcaagaacugaauaaaaucaagauuaacgggaaauuuucucucgagacgcggaauaagaucauugaacagcuguucaaaaagcagaagaaagucaccgagaagcaacuuaaaaaguggcuggugagagagcaguauuguacaaccaaaguuacagaaaagauggugaagcucgaugagaacgcuuacuacaucaccggauuccagaaagaaaaugaguuugcgagcucccugacgagcuauauugacuucacaaagauccugggcgagauuaccgaacggaaccgcaaaaugaucgaggaaaucauuuacuggcuuaccgucuuugaggaaaagucuaucgugaaaagaaagauucagaagaaauaugggaaugagaucaacgauaagcaacucgcccagauucugaaacugaauuacuccggauggggccgguucagcgagaaguuucucaacgggaucaaaggauucgacagacagggccagaagaaaacaaucauggaacugcuucgcgaggauucucggcugcucaacauuaugcaaaucauuaauaacgaagagaugggcuuuugcaagaucauugaagcuaaucagaagaaacuguaugggaacgagaaucugcuugacguugugcaggagcuccauggaagcccggccaucaagagaggcaucuggcagucccugaaaauugucgaagagaucauuucuaucaugggaggagugccccaaaacauuuucaucgaauuugcccgcgaggaugacgauagagugcggaccaauagccgcguuaagcagaucgaaagacuguacaaaaaguucaaggaggaggucaacgacuuuaaugaacacgcugccaacgagcucaaagaaaagcgguaucagaaucgcauugaugaggagaaaguguuccuguacuuuaugcaaaacggcaagucccuuuacagcggggugacacuggacaucgauagacucaaugaauaugaggucgaccauauuaucccucggacgcuggugaaagacgauucucuggaaaacaaggcgcuuguucucaagggcgagaaucagcgcaaaggagaaggccugauuccccacgaguggcagaacagacagaaggagguguggaaaaagcugcucuccugugggcugauggggaaaaagaaguacgcuaaccuuugcaaagagagcuucggcaaugaaaaggaacaaaaacacuucaucgcccggcagauugucgagacccgccagaucaucaaacagguggccaacauucuggcucaauauuaccaggggguuaauguggccgcugucaaagccucucucggauccgaacugagagagaacuauacaaucgagaagaaggacgauaauggcuuuuucauggaaaacaaaagcuacaccaugcugaagucccggaaaauuaaugacuuucaucacgcgcaggaugccuaucuugcuugugccguggggcuguacaucaaggcugccuucccuaaauacgagaaggaaauugacuaugagggcuacagaaaauauuaccagaagaagaaccaacagaaagauggaguucgcaaugaaaagcggcaguuuuucucuuaugugaugagcagauuuuccgagcagaucgucgacaaagagacaggcgaaauccucugggaugggacccaaaagcuggcguacauuaaaaagaucuucggauaucgcgacugccucauuacgaagaaacuggaggaaaacaccggcgaguuuuacaagcagacaaucaaugccaaacccgagaaggggaaagaaaacaauaccaaacuucugccgauuaagaaaggacucucuguggagaaguacggcggguaucagggcggagaagcugccuacagcugucuggugcgguaucaacagggcagaaaaacaaagcugucccuugagaaaaucagcgucaucauugcuaagaagaucgccgaaaaagagguuucucuggaucgcuaccucaaggagaaacuggggguggaagagauugugauccuccggaagaaagucaugaagaaccagcugauugaagacuccgauggaaauagauucuaucuuaccgccgcuacggaggugguuaacgcgaaacaguuuauccuggacggcaagcaucaacaccuccugcgcacaauugccaucauggaaaagggggaguacuauggauaccggcuggacgagcuugaaaacagcauggaugagcuguacgcuuauuacagaaugaaaauccagcagcaguauccugccuacgaaucuauugugaagaaaaucgucgagucccauguguaugaaagccuccacguugaggagaagauuaaagccgugcaagaaaagggcaaguuccugauccagcuccugcggcuuaccgaggcuaaugccgaaugcauugaccugaaaacaaucucugaugggcgccuggcggacagaaucggccggaagaaccacuacaccauuaaagagggaaucaaguucauugaucagagcaucaccggccucuaugagcgcuacaugacagucuga

SEQ ID NO: 4372 - RNA, 4146 nt, Artificial Sequence
  Cas9 variant
auggacuacgugaaggaguaucacaucggccuggauauugggaccagcuccaucggaugggccgucacagacucucaguucaaacucaugagaauuaagggcaaaacggcuaucgggguucggcuguuugaagagggaaagaccgccgcggaacgcagaacauuccggaccacacgcagacggcuuaaacgcagaaaguggcggcugcauuaccucgauaagauuuuugcuccccaccuucaagagguggacgaaaacuuccuucgcagacugaaacagagcaauauccauccugaggauccggccaagaaccaggccuuuaucggcaaacuccuguuccccgaccugcucaagaaaaaugagcggggguauccuacccugauuaagaugcgcgaugaacuucccguggagcagagagcucacuacccugucacaaacaucuauaagcugcgggaagccaugauuaaugaggaccgccaauuugaucucagagagguguaccuggcuguucaucacaucgugaaauaucggggacacuuccuuaacaaugccuccgucgacaaguuuaaagugggcagaauugauuucgacaagucuuuuaacguucugaaugaagcguacgaggaacuccagaacggcgaggggagcuucaccaucgaacccuccaaaguggagaagauuggacagcugcugcucgauacgaaaaugcgcaagcuggaccggcagaaggccgucgcuaaacuucuggaggugaagguggccgacaaagaagagaccaagagaaauaaacaaaucgcuacagccaugucuaagcucguccugggcuacaaggcggauuuugccaccguugcuauggccaacgggaaugaauggaaaaucgaccuuagcuccgagacaagcgaagaugagauugagaaguuccgcgaagaacugucugacgcucagaacgauauccucaccgaaauuacgucccuguucagccagaucaugcugaaugccauugugccuaacggaaugucuaucuccgagagcaugauggaccgguauuggacacaugaaagacagcucgccgaggugaaagaguaccuggcuacccaaccggcgucugcccgcaaggaauuugaucaggucuauaacaaauacaucggccaggugcccaaggagaagggguucgaccuugaaaaaggacugaagaaaauucucuccaagaaagagaauuggaaggagaucgaugaacugcuuaaggcuggcgacuuucugccuaaacaacggacaagcgccaacggcguuauuccccaccagaugcaucagcaggagcucgauagaaucauugaaaagcaagccaaauauuacccuuggcuggcuaccgagaaucccgccaccggggaacgcgaccggcaccaggcgaaguaugagcuggaccagcucguguccuucagaaucccguacuacgucggaccucuggugacacccgagguucagaaagcuacgucuggcgccaaguuugccugggcuaaacgcaaggaagauggggagaucaccccuuggaaccuuugggacaagauugaucgggccgaaagcgcugaggccuucaucaaaagaaugacagugaaggacaccuaucugcucaaugaagauguccugcccgcgaacucccugcuuuaccaaaaauauaaugugcucaacgagcugaauaacguccgggugaauggacgcagacugagcguuggcauuaagcaggacaucuacacagagcucuuuaaaaagaagaaaaccgugaaggccggggaugucgcuucucuggugauggccaaaacgcggggaguuaacaagcccuccguggaaggccuuagcgacccuaaaaaguucaauucuaaccuggcuacauaucucgaucuuaagagcauuaugggcgacaaagucgaugacaauagauaccagauggaucuggagaacaucauugaauggcgcuccguguuugaggacggggaaaucuucgccgacaagcugaccgagguggaguggcucaccgaugaacagcggucugcgcugguuaaaaagagauauaaaggauggggccgccugagcaagaagcuccugacagggaucgucgacgagaacggacaaagaauuaucgaucuuauguggaauaccgaccagaacuuuaugcagauugugaaucagccgguguucaaagaacaaaucgaucagcugaaccagaaggccauuacaaaugacggcaugacgcuccgggagcgcgucgaguccgugcuggaugacgcuuacaccagcccccaaaacaaaaaggccaucuggcagguugugagagucguggaagauaucguuaaagcuguggggaaugccccuaagucuauuuccaucgaguuugcccggaacgaaggcaauaaaggagagauuacacgcagcagacggacccagcugcagaagcuguucgaagaccaagcucacgagcucgucaaggauacaucucugaccgaggaacuggagaaagcgcccgaccucuccgaucgcuacuauuucuacuuuacgcagggcgggaaggacauguauaccggagacccuaucaacuucgaugaaauuagcacaaaauacgacaucgaucauauccugccccaguccuuugugaaggacgauucucuugacaauagaguucuggugagccgggccgagaacaauaaaaaguccgaucgcgucccggcuaagcucuaugccgccaaaaugaagccuuacuggaaccagcugcugaaacaaggccuuauuacccagagaaaguucgaaaaucucacaauggacguggaucagaacaucaaauaucggucucugggguuugugaagagacagcuggucgagacccgccaaguuauuaagcucacggcuaacauccugggaagcauguaccaggaggccggcacagacauuaucgaaacccgggcggggcuuacaaaacagcugagagaggaguucgaucuccccaaggugcgcgaggugaaugacuaccaccaugcugucgacgccuaucugaccaccuuugccggccaauaccugaaccggagauauccuaaacuucgcuccuucuuuguguacggagaauauaugaaguucaaacacggcagcgaucugaagcuccggaauuuuaacuucuuucaugagcugauggagggggacaagucucagggaaaaguuguggaucagcagacaggcgaacucaucacgaccagagacgaggucgcuaaguccuucgaucgccugcuuaauaugaaauacaugcuggugagcaaggaaguucacgaccggucugaucaacucuauggggccacaauugugaccgcgaaagaguccggaaagcugacaagccccaucgagauuaagaaaaacagaccugucgaccuguacggcgcuuacaccaaugggacgucugccuucaugacaaucauuaaguuuaccggcaacaaacccaaguauaaagugaucggaguuccgaccacaagcgccgugggccuuaagcgggucgggaaaccuggauccgaaagcuacaaucaggagcugcaccgcauuaucaagucuaaccccaaggugaaaaaggauuucgaaaucguggucccccauguuuccuauagccagcucauuguggacggcgauugcaaauuuacccuggcuuccgacacauaccagcacccugccacgcaacucgugcugucuaaggagagcauggaaaucauugcugaugacuucaaauuugucaaggagaauccggccaccgcggacgagcagcuugugagaguuuucgaugaaaucgugaaccagaugaaucauuauuuuacaauuuucgaccagcgguccaaccgccaaaaggucaccaaagccagagauaaguuugugucucugcccacagagagcgaauacgagggggcuaaaaagacccagguuggaaaaacggaagugaucaccaaucuccugaugggccugcacgccaacgcugcccagggggaccuuaagguccugggccucuccacauucggauuuuuccagucuagcggcgggcugaaccucuccgaggaugccaugaucguguaucaaagcccuaccggacuguucgagcggagaauuugucuuaaggacaucuga

SEQ ID NO: 4373 - RNA, 4146 nt, Artificial Sequence
  Cas9 variant
augaagaaaagcuacgccaucggcauugacaucgggaccaacuccgugggacacugcgucauguauacagagaauuacaagguucccucuaaaaagaugaaaguguucggcaacacggaaaagagauauauuaagaaaaaucugcucgggacccugcuuuuugaugagggaaacacagcugaaaaucggcgccugaagagaaccgcccggcgcagauacacacggcgcagaaaccggauccucuaucugcaggagauuuucgcggaagagaucaauaaaaucgacgauagcuuuuuccaacgccuugacgauuccuuucugauuguggaggacaagcagggcucuaaacauccuaucuucgggacccuccaggaagagaaggaauaccacaagcaguuuccgacaauuuaucaucugagaaaacaacuggcugauagcucccagaaggccgacauccggcucauuuaccuggcccuugcucacaucauuaaauaccgcggacauuuccuguuugagggcgaucucaagucugagaacaaagacguccagcaccuguucaaugauuuuguggaaauguucgacaagaccguugagggcagcuaucuuuccgaaaaccugcccaauguggccgauguccucguggagaaaguuagcaagucuagacggcuggaaaacauccugcacuacuuuccuaaugagaagaaaaacggacucuucgggaauuuccuggcucuugcccugggccuccagcccaacuuuaagacgaacuucgagcuggcggaagacgccaaaauccaauuuuccaaggagaccuaugaagaggaccuugaagaacugcucgggaaaauuggagaugacuacgcugaucuguucaucgccacaaagagccuguaugacggcauucuccuggcugggauccuuucuaccacagauuccaccacgaaggccccucugucuagcuccauggugaaucgcuacgaggaacaucagaaagaccucgcgcugcuuaaggauuuuauuagacagaaccugagcgacuccuauaaagaguucuuuaaugauacacucaaggacggauacgccggcuacaucgaaggcaaaaccacacaggagaacuucuaucgguuuaucaagaaggcuauugagaaaaucgaggggucuaauuacuucauugauaagaucgacagagaggacuuucugcgcaaacaacggaccuucgauaacggaagcauuccccaccagauccaucugcaggaaaugcacgccaucauuagacgccaagcugaguuuuauccuuuccucgucgaaaaucaggacaagaucgagaaaauucugaccuuccggaucccguacuaugugggcccccuugccagagggaaguccgaguuugccuggcugaagcgcaaaagcgaugaaaagauucggccuuggaacuucgacgagaugguggauaaagaaacaucugcugagaauuuuaucacgagaaugaccaacuacgaccaguaucuccccgaucagaagguccugccuaaacacucccugcuuuacgaaaaguucgcgguuuacaaugagcucacaaaagugcgcuaugugaccgagcaaggaaagagcuuuuucuuugacgccaacaugaagcaggaaauuuucgauggcgucuuuaaaguguaccggaagguuacaaaagagaagcugauggacuuccuggggaaagaauuugaugaguucagaaucguggaccucaugggacuggauaaggacaauaagucuuuuaacgcuagccuuggcaccuaucaugaccugaaaaagaucgucuccaaagaucuccuggacaaucccgaaaacgaggauauucuggagaacgugguucuuacgcucacacuguucgaagaccgcgagaugauccggaagagacuggaaaaauacaaggaugugcucaccgaggaacagcggaagaaacuggagcgcagacacuauaccggcugggggcggcuuucugccaagcugauuaauggaaucagaaacaaaacaacccgcaagacaauucucgacuaccugaucgaugacggcacgagcaaucggaacuucaugcagcugauccaugaugacacccuuuccuuugucgaugagauuagacucgcccaagggagcggagaagcugaggacuaucgcacagaagugcagaaucuggccggcucuccggcgaucaaaaaggggauucugcagucccucaagaucgucgaugagcugauuggcgugaugggauacaacccugagcacguuguggucgaaauggcuagagagaaucaguucaccaaccaaggccggcgcagcucucagcagagauacaaaaagaucgaaaaugccaucaaaaaccuugacuccaaucugaacagcaagauucucaaagaguaucccacaaauaaccaggcccugcaaaaugaccggcuguuucuuuacuaucuccagaacgggaaggauauguacaccgacgaggaacuggauaucgaccagcugucccaauaugauauugaccauaucauuccucaggcuuucaucaaagaugacucucucgauaacaaggugcugaccaagagcgccaaaaaucgcggaaaguccgacgauguucccucucuugagaucgugcacaaaaagaaaaacuuuuggaagcagcugcucgacagccagcugauuucccaaagaaaguucgacaaucugacgaaagcugaacggggcgggcuuacaaacgaggauaaggcccgcuuuauccagagacagcuggucgaaacccggcagauuacaaaacacguggcgcgcauccucgacaccagauucaauacgaagcuggaugacgccggaaaccggauuagagaucccaaagugaauaucauuacacucaagagcucucugguuucccaauuucgcaaggacuaccagcuuuauaaaguccgggagaucaacaauuaccaucacgcucaugaugccuaccugaacgcugugguggccaccgcgcuccugaagaaauauccucagcuggccccggaguucgucuacggcgacuaucccaaguacaauagcuauaaaucuagaaaguccgcuacagaacgcgugcuuuucuacagcaacaucaugaauuucuucaagcggguugugaaaucuagcaagaccgggaccgucaaaauuagaccuaucauugaggugaacaaggaaacaggcgagaucguuugggauaaaaaguccgacuuucgcacggugcggaagguccugagcuauccccaggugaauguugugaaaaagaccgaaguccaaaaccacggacucgauagaggcaaaccuaagggguucuacaacgccaaucugucuccccgcccgaaagagggauccguggaaaaccucgugccugcuaagcagagcuuugacacaaaacgguacggcggguaugccggaauuuccaauucuuacgccguccugguuaacggcaucaucgagaaggggaagaaaaagagcaaagcugaggugaccgaauuucagggcauuuccauccuugcgagaaaggauuuugagaaaaaucccaagcaauaucugcucaaccugggauacaaggacauuaaaucuaucauuaagcugccuaaauauagccuuuucgaacuggagaauggcucccggcgcaugcucgccucuauccugagcacaaacaauaagagaggggagauccacaaaggaaacgaaauguaccuccccgacaaguuugugacccugcuuuaucaugcuaugcgggucaaucgcacgcuggagccuggccacaagaaauacguggaaacacauagacacguuuucgaugagcugcucaccuacauucuggaauauaacgagaagaucgugggggccaaagccaauggaaagcggauugucgaggcuuacuccgccagaaaagacaccgauaaccuugaggaacuguguaauagcuuuaucaaccuccugaaucucacagcgcugggcucugcuguggacuucgaauuucuugggaccaagauuccccgcuaucgggauuacacaccguccagccugcugaaggccacgcucauccaucagucuguuaccggccuguaugagacaagaauugaccuuuccaaacugggaggcgauuga

SEQ ID NO: 4374 - RNA, 4146 nt, Artificial Sequence
  Cas9 variant
augaagaaaaucauuggccuggaccucgggaccacaagcaucggaugggccuacgugcacgaggcugaauccgcccaggagagaucugaaauuguccggcugggcgcgcgcguugugccccuuacgaccgaugagcaagacgaguucaagaaaggaaagagcaucacaaccaacgcugccagacuguccaaacggucucuccgcagaaaugccgaucgguuucagcugcgcagagacgagcuugcuggagugaugaaggaggccggcuggauugaugaaacaaccguccuggcugagcaggggccucggagcacauucgaaacccuccgccugagagccaaggcggccuccgaggaggugacgcuggcugaauuugcccggauccuccugcagaucaaccgcaaaagaggauauaagucuaaucggaaaaccgacggcgaugaggaaggcgcucuuauugacgggauggauguuagcaagcaacugaacgccuccggacagacaccgggcgagugggugcucgcgcgcaugcaggaagggaaugccgucauccccgcuuucuacugcagcgaccugucugaggagcuugauagaauuuggcggaaacagcaagccucccaucaggcuuggaugaccgaagaacugcacacagugcucagacaugccgacggacgcagcgccauccggcugauggauaaggcuggcguugugccugacucugucaacgugaaggaaagacgccgggugauguaugaguggagagcggccgcuguccgcgacugucugcccgccgggcggguugccgcugcccucaugcaaguguccaaagaaauugggagagcggauagcuaccugggccgcaucggcgaccggucuaaggagcuuuauuuucacagacagaccguggggcaguaccuguggcgccucauuugcgauaauccuaaccagucccugaaaaaucuugucuucuaucggcaggacuaccaacaugaguuugaaacgcuguggagcauccagacaaaguaccacguggagcucaccgaagaucugagaaaacggguuggacgcaucauuuucuuucagagaccccugaaguccaaaaagggccucgugaaccggugugagcugguccacuauucugugugcgaaaauagcggggacgaucuuacagagaagguugacgugggaccuaaagucuguccgaaguccagcccccuguuccaggaguuuaaaguguggcaaguccucaacaauguggaaguuauccauccuucuacccaggaggcuagacgccuggaaauggaggagaaggaacuucuggccuccgagcuccuguuccgggauagaaugaaaaagauugacgugcugaagcuccuguuuagcaacuggcgcgaucuugaccugaauuacaaagaacucgagggcaacagaaccauggccgcuuucuaucgggucuacgaacaggugaucgcccagacagggcacggagacuaugauuucgcuaagaugcgcgccgcgaaaguuaaggagcuggccgagggcguguuugcuggccugggguucgaagucggacuucucacguuugacgccgagcuggauucucccgcuuacgaacaacagccuugcuauagacuguggcaucuccuguacagcuacgagggcgacaaauccgccaccgggaacaagugucuucugaagaaacucugccggcugacaggaaugaaugcggaacuggugggccuuuucaugcagauucgcuuuucuggggauuauggcagccucuccaccaaggccaugagacggauccugcccuaccugaaagcuggaaacacauaugacguggccugugaguacgcuggcuuccgccacagcgccagaucucucacccgggaggaacuggcccagaaggaguauaaagauuaccuugaccugcucccgcgcaauucccugagaaacccuguugucgaaaagauccugaaucaaaugauucacguggugaacgggcuuagcucuacguauggaaagcccgaugagauccgggucgaaauggcuagagagcucaaaaaguccgcgcgcgagcgggaagagaugacaagcgccauuuccaaaaccaccaaggaaaaugcugagaucacagccauucugcagagagacuuuggccugcgcuacgugucucggaacgauauccucagauacaaacuguauugcgagcuucgcaucaaggggaauggaugucggacccuguacagcaacacauauauuaauccuaacgaacucuucuccagagaguuugacaucgaacauauuaucccccagucucgccuguucgaugacagcuuuuccaauaaaacgcuggagagccggaccgccaaccuugaaaagggcgacagaacagcuugggauuacguuaaugagaaguauggggccgagcgggcggacgaauaccgcgcucagguggaggcccucuauagagauggcaccauuucuaaagccaagcgggacaaacugcugaugcccggagauaagaucccugaagacuucauugaucgcgacaucagaaacacacaauacaucgcuaaaaaggcccucgagauuuuugaagauuucgucccguccgugguugcgaccagcggcaacgugacggcucggcugagagaggacugggggcuugucgaugugaugaaggagcugaauuggucuaaauacgaaucccagggaaugguucacaucgaguaugaccgcgauggccggcccauuagacgcaucguggacuggaccaagcggaacgaccauagacaccaugccauggaugcccucgcugucgccuucacaaaacgcagcuacauucaguaucugaaucaccugaacgcucggaaggaagccaccucuguggcguacgccauccaacacaaagagauggaacuugacgggagcaauagauggcgcuuuaagugcccuuucggagauagauccgcuuuucggcgcgaggccaaggcucagcuggagagaauccucgugagcauuaaaucuaagaacaaaguccugacacccuccguuaaucggaccaagaaacgcggcggguucaacaagaagguggaauggacgccuagaggcgcccuccauaaugagacaguguauggacggaucagacgcuacgacgucaaagaacugcgggugggcagcuccuuuaccgccgagguuauugggaagguggcugauucuagauaucgcgcggcccuuaugcaccggcuggcugaguucggaggcgaccccaaaaaggccuuuacagggaaaaacagccucgaaaagaauccgcuguacaccgaugaggcccauaccgcuugcgucccuuccucugugaaaguugugagcuucgucgaaaucggaacaauuagaaagggcguggaccccaaccugaauguugauaagguggucgacacgcacaucaaaaacauccuucuggcccggcucuccgcguacgggggcgaugcuaagaaagccuuuucuaaucuggacgccgacccuauuuggcucaacaaggagaaaggaaucgcuauuaagcgcgugaccaucagcgaugacuccgaagugagacccauucacgucaagcgggauaugcgcggcagacugguuugugacgagcaugggcggccugugcccagcgauuaugugcagcuucgcaacaaucaccaugucgccaucuucagagacgcgaacggagagcugaaagaacgggugguuacauuuuucgaggcuguggaacgcgucagacagcuccggucugagggcagagccguggaaguuaucgauaagaauuacaaaugcgaggagggguggaccuuucuguucuccaugaagauuaacgaauauuucguguuuccggacgccgcuagcggauucgauccucgcgagaucgaccugacagaucccgccaauuacgcucuuauuucuccccaccuguuucggguccaaaaacucuccagcaaggacuauuacuucagacaucaccuggaaaccacggugaacgaugucaagcagcuccgcgacaucacauggaaacggauuucuucccugcaggaccuugccggcaccgugaagguuagagugaaucacaucggccagauugucgcggugggggaguauuga

SEQ ID NO: 4375 - RNA, 4146 nt, Artificial Sequence
  Cas9 variant
auggugaagaaaaaguacgccaucggcauugacaucgggaccaacagcgucggaugguccauuguuacagaugacuauaaagugcccucuaagaaaaugaagguguucggcaauacggagaagagauacaucaaaaagaaccugcucgggacccugcuuuuugaugaaggaaauacagcugagaaccggcgccugaaaagaaccgcccggcgcagauauacacggcgcagaaaucggauucucuaccugcaggaaaucuucgcggaggaaaucaacaagauugacgauagcuuuuuccaacgccuugacgauuccuuucugaucgucgaggacaaacagggcucuaagcacccuauuuucgggacccuccaggaggaaaaggaguaucauaaacaguuuccgacaaucuaccaccugagaaagcaacuggcugauagcucccagaaagccgacauucggcucaucuaucuggcccuugcucauauuaucaaguaccgcggacacuuccuguuugaaggcgaucucaaaucugagaauaaggacgugcagcaucuguucaacgauuuuguugagauguucgacaaaaccguggaaggcagcuaccuuuccgagaaucugcccaacgucgccgacgugcucguugaaaaggugagcaagucuagacggcuggagaauauccugcacuauuuuccuaacgagaaaaagaaugggcuguucggaaacuuccuggcucuugcccugggccuccagcccaauuuuaaaacgaacuucgaacuggcggaggaugccaagauucaauuuuccaaagaaaccuacgaggaagaccuugaggaacugcucgggaagaucggagaugacuaugcugaucuguucauugccacaaagagccuguacgacggcauccuccuggcugggauucuuucuaccacagauuccaccacgaaagccccucugagcagcuccauggucaaccgcuaugaggagcaccagaaggaccucgcgcugcuuaaaaauuuuauccaucagaaccugagcgauuccuacaaggaaguguucaaugacaaacucaaggauggauaugccggcuacaucgagggcaagacaacccaggaaaacuuuuacagauucauuaaaaaggcuaucgagaaaauugaagggucuaauuauuuuaucgacaagauugaccgggaggauuuccugagaaaacaacgcacauuugacaacggaagcaucccccaccagauccaucugcaggagaugcacgccauuauccggagacaagcugaauuuuacccuuuucucguggagaaucaggauaagauugaaaagauccugaccuuccgcauuccguauuacgucggcccccuugcccgggggaaauccgaguucgccuggcugaacagaaagagcgacgagaaaauccgcccuuggaauuuugaugaaaugguugacaaggagaccucugcugaaaacuucauuacacggaugacgaauuaugaucaguaccuccccgaccagaaagugcugccuaagcacucccugcuuuaugagaaauuugcgguguacaacgaacucaccaaggucagauacgugacagagcaaggaaagagcuucuuuuucgaugccaauaugaaacaggagaucuuugaccgcaccuucaagguuuaucggaaagugacaaaggaaaaacugauggauuuucugucuaaggaguucgacgaauuuagaaucgucgaucuccugggccuugacaaggacaacaaaucuuucaaugcuucccuggggaccuaccaugaucucaagaaaauugugucugaggacuuucuggauaacagcgaaaacgaggacauccuggagaauguugugcuuacgcucacacuguucgaagaucgcgagaugauucggaagagacuggaaaaauauaaggacguccucaccgaggaacagcggaagaaacuggagcgcagacacuacaccggauggggccggcuuuccgccaagcugaucaacggcauuagagauaaagugacacgcaagaccauccucgacuaucugaucgaugacgggacaagcaaucggaacuucaugcagcugauuaaugaugacacgcuuucuuuugucgaugagaucagacucgcccaaggauccggcaaagcugaagacuaccgcgccgaggugcagaaccuggcggggagccccgcuauuaagaagggaauccugcagucucucaaaauuguugacgaacugaucgaggugaugggcuaugauccggagcauaucgucguggaaauggccagagagaaucaguucaccaaccaagggcggcgcaauucccagcagagauacaagaaaauugaaaacgccaucaagaaucuugacagcaaccucaauuccaaaauucucaaggaguacccuacaaacaaucaggcucugcaaaacgaucggcuguuucuuuauuaccuccagaacggcaaagacauguauaccgaugaggaacuggacaucgaucagcugucucaauacgacauugaucacaucaucccccaggccuucauuaaggacgauagccucgacaauaagguucugacaaaauccgcuaagaaccgcggaaaaucugacgaugugccuagccuugagaucgucuauaagaaaaagaauuuuuggcagcagcugcucgacucccaacugauuagccagagaaaguucgauaaccugaccaaagccgaacggggcgggcuuacgaaugaggacaaggcgcgcuuuauccagagacagcugguggaaacccggcaaauuacaaaacauguggcccgcauccucgauaccagauucaacacaaagcuggacgaggcuggaaaucggauuagagaucccaaaguuaacaucaucauucucaagucuaaucuggucucccaguuucgcaaggacuaccagcuuuauaaagugcgggaaaucaacaauuaccaccacgcccaugaugcuuaccugaacgccguggucgcgaccgcccuccugaagaaauauccccagcuggcuccugaguucguguacggcgaguauccgacguacaauagcuauaacucuagaaaguccgccacagaaaaaguucuuuucuacagcaauauuaugaacuucuucaagcgcaucgugguccacucuaagaccggggaggugcggauuagacccguuaucgaagugaacaaagagacaggagaaaucgucugggacaagaaaagcaauuuucgcaccgugcggaagguucuguccuauccucaagugaacgucgugaaaaagaccgaggugcagaaucauggccucgauagagggaagcccaaaggcuucuacaacgcuaaucugagcccucgccccaaggagggaucugucgaaaaccucguuccggccaaacaguccuuugacacaaagcgguacggcggguaugccggaauuagcaauuccuacgcugugcuggugaacggcaucauugagaaagggaagaaaaagucuaaggcggaagucacggaguuccaaggaaucagcauucuugccagaaaagauuuugacaagaauccuaaacaguaucugcucaaccugggcuacaaggacaucaaauccaucauuaagcugcccaaguauucucuuuucgagcuggaaaaugggagccggcgcaugcucgcuuccauccugucuaccaacaauaaaagaggcgagauucacaagggaaacgaaauguaccucccugauaaauuugugacacugcuuuaucacgccaugcggguuaaucgcacccuggagcccggccauaagaaauacguggaagcccacagacaugucuucgacgagcugcucacauacauccuggaguauaacgaaaagauugugggggcuaaggccaauggaaaacggaucguugaggcguacagcgcuagaaaggauaccgacaaccuugaggaacugugcaacuccuuuauuaaucuccugaaccucacggcccugggcagcgccguggauuucgaauuucuugggacaaaaaucccucgcuaucgggacuacacccccucuucccugcugaaggcuacccucauccaccagagcgucacaggacuguaugagaccagaauugaucuuucuaaacugggcggggacuga

SEQ ID NO: 4376 - RNA, 4146 nt, Artificial Sequence
  Cas9 variant
auggugaagaaaaaguacgccaucggcauugacaucgggaccaacagcgucggaugguccguugugacagaugacuauaaagugcccucuaagaaaaugaaggucuucggcaauacggagaagagauacauuaaaaagaaccugcucgggacccugcuuuuugaugaaggaaauacagcugagaaccggcgccugaaaagaaccgcccggcgcagauauacacggcgcagaaaucggauccucuaccugcaggaaauuuucgcggaggaaaucaacaagaucgacgauagcuuuuuccaacgccuugacgauuccuuucugauuguggaggacaaacagggcucuaagcacccuaucuucgggacccuccaggaggaaaaggaguaucauaaacaguuuccgacaauuuaccaccugagaaagcaacuggcugauagcucccagaaagccgacauccggcucauuuaucuggcccuugcucauaucauuaaguaccgcggacacuuccuguuugaaggcgaucucaaaucugacaauaaggauguucagcaucuguucaacgaguuuguggagauguucgacaaaaccgucgaaggcagcuaccuuuccgagaauauccccgacguggccgauauccugguugaaaaggugagcaagucuagacggcucgagaacguccugcaguauuuuccuaaugagaaaaagaacgggcugcucggaaauuuccugucccuugcucugggccuccaacccaacuucaaaacgaauuuugagcuggccgaggacgcgaagauucaguucagcaaagaaaccuacgaggaagaucuugaggaacugcucgggaagaucggagacgauuaugccgaccuguuuauugcuacaaagucucuguacgauggcauccuccuggccgggauucuuuccaccacagacagcaccacgaaagcuccucugucuuccagcauggugaaccgcuaugaggagcaccagaaggaucucgcccugcuuaaagacuucaucagacagaaccuguccgauucuuacaaggaaguguuuaaugacgcgcucaaagacggauaugccggcuacaucgagggcaagacaacccaagaagauuucuacaaguuugucaaaaagacaauugagaaaaucgaagggagcgacuauuucauugauaagaucgaccgggaggauuuucugagaaaacagcgcaccuucgacaacggauccauuccccaccagauccaucugaaggagaugcaagcuaucauuauccggcaggccaaguuuuacccuuuccucgaagagaaucaggauaaaauugaaaagauccugaccuuucgcauuccguauuacguuggcccccuugcuagagggaacagcgaguucgccuggcugaaucggaaaucugacgagaagaucagaccuuggaacuucgaugaaauuguggacaaagagacauccgccgaaaauuuuaucacgcgcaugaccaacuaugaucaguaccuccccgaccaaaaggugcugccuaaacacagccugcuuuaugagaaguucgcugucuacaaugaacucacaaaggugcgguacguuaccgagcagggaaaaucuuucuucuuugaugcgaacaugaagcaggagaucuucgacggcguguuuaaagucuauagaaaggugacaaaagaaaagcugauggacuuccuggggaaggaguuugaugaauuucgcauuguugaccuccugggacuugauaaagacaauaagagcuuuaacgccucccugggcaccuaccaugaucucaaaaagaucgugucuaaagaccugcuggauaaucccgagaacgaagacauucuugagaaugucgugcucacgcugacacuguucgaggaucgggaaaugaucagaaagcgccucgagaaguauaaagaaguccugaccgaggaacagcggaagaaacuugagagacggcacuacaccggcugggggcgccugagcgcuaagcucauuaacggaaucagagacaaagugacacggaagaccauccuggauuaucugauugacgauggcacauccaacagaaauuuuaugcaacuuaucaacgacgacacgcucagcuucguugaugagauucgccuggcccaggggucuggagaagccgaggacuaccgggcugaagugcagaaucuggccggcuccccggcgaucaagaaagggauucuccagagccugaagaucgucgaugagcuuaucgaggugaugggcuaugaaccugagcacauuguuguggaaauggcuagagagaaccaauucaccaaucagggacgcagaaacucucagcagcgguacaaaaagaucgaaaaugccauuaaaaaccuggacuccaaucucaacagcaagauccugaaagaguaccccacaaauaaccaagcccugcagaaugaucgccuuuuucucuauuaccugcagaacggcaaggacauguauaccgaugaggaacuggacauugaucaacucucccaguacgacaucgaucauaucauuccucaggcuuucaucaaggacgacucucuggauaauaaaguccuuacaaagagcgccaaaaacagagggaaguccgacgaugugcccucucuggagauuguguauaaaaagaaguccuuuuggaaacagcuccuggacagccaacugaucagccagcggaaguucgauaaccuuaccaaagcugaacgcggaggccugacgaaugaggacaaggccagauuuauucagcggcagcucguugaaacccgccaaaucacaaaacacgucgcgagaaugcuggauacccgguucaacacaaagcucgacgaggccgggaaucgcauuagagaucccaaggugaacaucaucacccugaaaucuaaucuugugucccaguuucggaaggacuaccagcuguauaaagucagagagauuaacaauuaccaucacgcucaugaugccuaccucaacgcugugguugccacggcgcugcugaagaaauauccucagcuugccccggaguucguguacggagaauaucccacauacaauagcuauaacucucgcaaguccgcuaccgaaaagguccuguuuuacagcaauaucaugaacuucuuuaaacggauugugguucacucuaagacaggcgaggugagaauccgcccugucauugaagugaauaaagagaccggggagaucguuugggacaagaaaagcgauuuccggaccgugagaaagguccucuccuauccccaagugaacguggucaagaaaacagaaguucagaaucacggccuggaccgcggaaagcauaaaggcuucuacaacgccaaccucagcccucggcccaaggaggggucuguggaaaaucuggugccggcuaaacaguccuuugacacgaagagauacggaggcuaugccgggaucagcaacuccuacgccguccuugugaauggaauuaucgagaaaggcaagaagaaaucuaaggcugagguuaccgaguuccaagggauuagcauccuggcgcgcaaagauuuugacaagaacccuaaacaguaucuccugaaucugggcuacaaggauauuaaguccaucaucaaacuucccaaguauucucuguucgaacucgaaaacggaagccggagaaugcuggccuccauucucucuacaaauaacaaacggggcgagauccacaaggggaaugaaauguaccugccugacaaauuugugacccuucuguaucaugcuaugcgcgucaacagaacacuggagcccggacacaagaaguacguggagacccaccggcauguuuucgaugaacuccugauuuacauccuugaguauaaugaaaagauugugggcgccaaagccaacgggaaacgcaucgucgaggcuuacagcgccagaaaggacacggauaaucuggaagaacucugcaacuccuuuauuaaucugcucaaccugacagcgcuuggaagcgcuguggacuucgaguuucugggcaccaaaaucccucgguauagagauuacacccccucuucccugcucaaggccacacugauccaccagagcguuaccgggcuuuaugaaacacgcauugaccugucuaagcucggcggagauuga

SEQ ID NO: 4377 - RNA, 4146 nt, Artificial Sequence
  Cas9 variant
auggugaagaaaaaguacgccaucggcauugacaucgggaccaacagcgucggaugguccguugugacagaugacuauaaagugcccucuaagaaaaugaaggucuucggcaauacggagaagagauacauuaaaaagaaccugcucgggacccugcuuuuugaugaaggaaauacagcugagaaccggcgccugaaaagaaccgcccggcgcagauauacacggcgcagaaaucggauccucuaccugcaggaaauuuucgcggaggaaaucaacaagaucgacgauagcuuuuuccaacgccuugacgauuccuuucugauuguggaggacaaacagggcucuaagcacccuaucuucgggacccuccaggaggaaaaggaguaucauaaacaguuuccgacaauuuaccaccugagaaagcaacuggcugauagcucccagaaagccgacauccggcucauuuaucuggcccuugcucauaucauuaaguaccgcggacacuuccuguuugaaggcgaucucaaaucugagaauaaggacguucagcaucuguucaacgauuuuguggagauguucgacaaaaccgucgaaggcagcuaccuuuccgagaaucugcccaacguggccgacguucucguggaaaaggucagcaagucuagacaccuggagaauauccugcacuauuuuccuaacgagaaaaagaaugggcuuuucggaaacuuccuggcucuugcccugggccuccagcccaauuuuaaaacgaacuucgaacuggcggaggaugccaagauccaauuuuccaaagaaaccuacgaggaagaccuugaggaacugcucgggaagauuggagaugacuaugcugaucuguucaucgccacaaagagccuguacgacggcauucuccuggcugggauccuuucuaccacaaacuccaccacgaaagccccucugagcagcuccauggugaaucgguaugaggagcaucagaaggaucucgcgcugcuuaaaaacuuuauucaccagaaucugagcgacuccuacaaggaaguguucaacgauaaacucaaggacggauaugccggcuacaucgagggcaagacaacccaggaaaauuuuuaccgcuucaucaaaaaggcuauugagaaaaucgaugggucuaacuauuuuauugaaaagaucgagagagaggacuuccugcggaaacaaagaacauuugacaauggaagcauuccccaucagauccaucugcaggaaaugcaagccaucauucgccggcaggcuaaguucuacccuuuucucgaggaaaaccaggauaagaucgagaaaauucugaccuucagaaucccguauuacgucggcccccuugcccgcgggaaguccgaguucgccuggcugaaucggaaaagcgacgaaaagauuagaccuuggaacuuugaugagaugguugacaaagaaaccucugcuaagaauuucaucacacgcaugacgaacuaugaucaguaccuccccgaccaaaaagugcugccuaagcacucccugcuuuaugagaaguuugcgguguacaaugaacucaccaaaguccgguacgugacagagcagggaaagagcuucuuuuucgaugccaacaugaaacaggagauuuuugacggcguuuucaagguguauagaaaagucaccaaggaaaagcugauggauuuucuggggaaagaguucgacgaauuucgcaucguggaucuccugggacuugacaaggagaauaaaucuuucaacgcuagccugggcacauaccacgaucucaagaaaaucguuuccaaggacuuucuggacaacucugaaaaugaggauauucuggagaacgugguccuuacccucacgcuguucgaagaccgggagaugaucagaaagcgccuggaaaaauauaaggauauucucacagaggaacagcggaaaaagcuggagagacggcacuacaccggcugggggcgccuuagcgccaaacugaucaauggaauuagagacaaggugacccggaagacaauccucgauuaucugaucgacgauggcaccuccaacugcaauuucaugcaacugauuaacgacgauacacuuagcuuugucgacgagaucagacucgcccaggggucuggagaagcugaggauuaccgcgccgaagugcagaaucuggcgggcucccccgcuauuaaaaaggggauccugcagagccucaaaauuguugacgagcugaucgaggugaugggcuaugauccggaacauaucgucguggagauggcccgggaaaaccaauucacgaaucagggaagacgcaacucucagcagagauacaagaaaauugagaaugccaucaagaaccuugacuccaaucugaacagcaaaauucucaaggaauacccuaccaauaaccaagcucugcagaacgaccggcuguuucuuuauuaccuccagaauggcaaggauauguauacagacgaggagcuggauaucgaccaacugucccaguacgauauugaccacaucaucccccaggccuucauuaaagaugacucucucgauaacaagguucugaccaaaagcgcuaagaaucgcgggaaauccgacgaugugccuucucuugaaaucgucuauaagaagaaaucuuuuuggaagcagcugcucgacucccaacugauuagccagagaaaauucgacaaccugacaaaggccgagcggggaggccuuaccaaugaagauaaagcgcgcuuuauccagagacagcugguggagacgcggcaaauuaccaagcauguggcccgcaugcucgacacaagauucaacaccaagcuggaugaagcugggaaucggauccgcgaccccaaaguuaacauuaucacacucaagucuaaucuggucucccaguuuagaaaagauuaccagcuuuauaaggugcgggagaucaacaauuaccaccacgcccaugacgcuuaccugaacgccguggucgcgaccgcccuccugaaaaaguauccccagcuggcuccugaguucguguacggagaauauccgacguacaauagcuauaacucuagaaaguccgccacagagaaaguucucuuuuacagcaauauuaugaacuucuucaagcgcaucgugguccacucuaaaaccggcgaagugcggauuagacccguuaucgaggugaacaaggaaacaggggagauugucugggauaaaaagagcgacuuucgcaccgugcggaagguucuguccuauccucaagugaaugucgugaaaaagaccgaggugcagaaccauggccucgauagaggaaaacccaagggcuucuacaaugcuaaccugagcccucgccccaaagaagggucugucgagaaucucguuccggccaagcaguccuuugacacaaaacgguacggaggcuaugccgggaucagcaacuccuacgcugugcuggugaauggaaucauugaaaagggcaagaaaaagucuaaagcggaggucacggaguuccaagggaucagcauucuugccagaaaggauuuugacaaaaacccuaagcaguaucugcucaaucugggcuacaaggauaucaaauccauuaucaagcugcccaaauauucucuuuucgaacuggagaacggaagccgccggaugcucgcuuccauccugucuaccaauaacaagagaggcgaaauucacaaagggaaugagauguaccucccugacaaguuugugacacugcuuuaucacgccaugcggguuaaccgcacccuggaacccggacauaagaaauacguggagacacacagacaugucuucgacgagcugcucaucuacauucuggaauauaaugagaagaucgugggcgccaaagcuaacgggaagcggauuguugaagccuacagcgcgcgcaaagauaccgacaaucuugaggaacuguguaacuccuuuaucaaccuccugaaucucacggcucugggaagcgccguggauuucgaguuucuuggcacaaagauuccuagauaucgggacuacacccccucuucccugcugaaggccacccucauccaccagagcgucacagggcuguaugagaccagaaucgaucuuucuaaacugggcggagacuga

SEQ ID NO: 4378 - RNA, 4149 nt, Artificial Sequence
  Cas9 variant
augaagaaaaucgugaacuacaaucugggccucgacauugggaccagcuccaucggauaugccgcuauugaugaccagggcagacccguccggcaccaaaacaagacaguuaugggggugcgccuguucaaagagggaaagacggccgaaucuaccagaaucuuucggggcacacgcagacggcuuagccaucgccacuggagacugggguaccucgaucggauuuucgacaaugagaucgcgaaaguggaugaaaacuuucugccucgccuuaaggcuuccaagagagcccggucugacgagaaacgcagcuucagaggaucccugcucuuuccggaaaccggcgaugacgccuauuaccagaaguaucccacaaucuaccaucugcgguaugcucugauuacccagaaaaagcaguucgauauccgccucauuuaccuggcccuucaccauaugaucaaauacagaggcaauuuucuggacacaaccccugucucugcuuucaacauucacgauaucgaccucacggaucaauuugccagccugaaugacugcuaucagcuucuggacauggauuucgaguuucaguucgaccucaacaauauugaacaggugcaaaagcugcugcucgaugaaacccuguccaagacaaaacggcaggcggccguuagcaaggugcuugucaugucuaccgggaacaaagccuuugacgaucagcagaauggaaucgccuccgaguucaucaaggcucugcucggcgggcccuucgaccugagcaaaauucuuaaccugucuguggccgauguuaaguccuggaaacuccacaugacagacaaggauguggacgauacccugaauagccuggucgaggagcucgacgagaaccauaagcaaaucgugaaucugcuucagaugauuuacucucaggugaugaugcugggacuccugaacggccaacaguccaucagcgcguccaugauugaaagauaugacgaucacgccaaacauugggcugcccuuaagaaacugcucccugcucugggggagcaggaacagucuacgaucauccacgccuacacagccuauaccggacacagccgcacaaagcaacugucccgggcugaguuuuacaccaaagucaacagcauucucaagaagcaugaaaauaucgcggaggccaccggccugauugagcuuaucgacagaaacgaguucaugcccaaacagcgcgaugcuguuaauggcgugauuccucaccagcugcaucagcgggaacuccaacugaucauccagaaccagcagaaguauuacccguuucuggccgccaaggcuuaccccgacgccgaugaaacaaugauugagcaacuucucucuuucagagugccuuauuacgcggggccccuggucgaccgcgauuuuaucaaugaauccagcgaccaggagcaggcuaugcagaacacgaaguucucuuggcugaaacggagagaggccggagaaauuaccccuuggaauuuugagcaaaagguggauguucaggaaacagccaaccgcuucaucaagcggcucaccacaaaagacaccuaucugaugacggaggaugugcuucccaaggaaagccugauuuaccagagauuugagguccucaaugagcugaacgcuauccgcauuaaugaccggagacugacagccgaaaacaaacaacuugcuuuccagcagcucuuuauggccggcaauaccaagaacguguccaucaaaaaguuccggaauuuuguuuucgauucucugaaguucccggagaaagugaagaucaccggguuugcgggacagcacaacuuccuggccaaacucagcacauaucaugacuuuaagaaaauuuucggcgaacgcgucgaccacaccgaucugcaaccugacuuugagagaaucguggagugguguacaauuuucgaagaucggcacaucuacagagagaaacuuaaagaaauucaguggcugucccagagcgagaucgaccagcucguccugauccgcaaccauggguggggacggcugucuaagagacuucucacgggcauucgcgauuccgacggcagaaccgugauggaucaacugugguuugggacagacaauuucaugcggaucauuagccagucugauuuugcugccgcuaucgccaacgaaaaucgcacccagcugaaccagcacggacucgaggacguucuggauuccgcguucaugagcccccaaaauaagaaagccauuagacaggugcuuaaggucguggacgauaucgagcagacacugggcugcccucccaaaaagguuaugaucgaauuuacccggucccccgacaaaaagaagcaacgcacggugaccagacucgagaaaguccagcaggcuuauaaggccguggcugaccagcuggccgggcaaucuauugugagcgaacuggaucaguacgccaacacacauuccaaacuuucugacaccuacuaucucuacuucaugcagcugggacgggaucuguauagcggcaagccuaucgacauugauuccccgaugcucgacgaugaccacauccugccccgcgcuuuuaugaaagauaauagccuugacaacagagcgcugacagagaagccuauuaauaacaccaaggccgcuaaauuccccucuaagguuuucgggcagcaaaaagaagucacggauuuuuggaagcuccugcggcgcuguggccugauguccaauaucaaagagaagcaccuuuaccuggacccugacaacguggauaaguggacaagacggggauucauccauagacagcucguggagaccagccaggucauuaaaaucguggccaauauucugaacgaccgcuaucagcaaucucagacagaaguucucgaggugcccgcccggcugggcaccgaacuuagagagugcuuugggugguacaagguccgcgaagugaaugauuaucaccauguuuucgacgcuuaccuggccgcguuuaucggaaacuaccucuaucggagauacccgaaacugcagccuuauuucguguacggcaacuuugcugagcugaauaaggcccagcuuaaaaacauuaaguccuucaauuuucuguauaacaucaccgauaauaaacgcgucgugaaggacauugagacagggcaaacgcucugggaugaccagauccggcagcaaauccagcacauuuacgaauauaaguacaugcugaccagccaugaggccuucacacagcacaaagaacucuacggacagaccaucuaucccagacgcgaguuuaagccuggcacacugaaagcuauuaagcaagaucagccccaggagcuuuacgggggcuauaaaaaccugaccgccgcguacauguguaucguuaagauucaggcucggaagagacgggccgccgaauaucgcguggucagaguggcuacggagucucucagcgcccugcaacaggcuaaacggcugggagugcaggccuacgaacgcugccuuagacaggagcugguccggaauaacgaaauccucagaacaaaugcggacccuaacuccgcuccccgcgaguucgagguucugcucgaucgggugcugugucaccaaaugaucauuagcgacggccagaaguaucuucuggggucucaugcuuacaaaaucaauugcaugcagcuggugcucuccaacaauagcaugaagauucuguccaccucuaucgucaaacuuaagcaaaugaccaacgaaccgcuggugcagguuuacagagagauucucgauguggucaauaaguauuucacacuguacgacgugaacagcuuucgcgaaaaccucaaucaguucuuugacaaauuccggacccugccuaucacaaacgaguaugaauccucuaagagcggaaagaaacuuauccacagaggccagcuggagacgcugacccucauucugcgcgggcuucaugccaauuccgauaaaguucaauacggagaccagucuacacugcucggcggguuucagaccaaggauggcaucaagcugagcaaagacuccgugauucaguauacaagccccgcuggacucaacguccggaccgugaagcugagagaucuugagcaaaaagaagcccagaaguga

SEQ ID NO: 4379 - RNA, 4149 nt, Artificial Sequence
  Cas9 variant
augguggacgagaagaucuucuggggccuggauauugggaccgacagcgucggaugggccguuacaaacuccgaauacaaacucaagaaauauaagaauaaccugauguggggcgugcaccuuuuugaugaggcuaaacagucugccgaaagacggagcuuccgcacggcgagacggcgccuggacagacggaagcaacgcaucauucuccugcaggaguuuuucgugagagcugucugcgaaaaggaugagaacuuuuuccggcgccuuaaagaguccgcccugcuccccgaagacgccgagcauagaaccaacaauaucuuuuucgaugacccugauuacacagacaaggauuauuuugaagaguacccgaccauucaccaucugaucugugagcugauggaaucuaaagagccccacgacgugcggcucguuuaucuggcuugcguguaccuucuggcccaucgcgggcacuuccuccugccugucagcgaagaugacaucuccaaggugacagaguuugaaccccuuuaugagucuuucuacaaagcucuggaggaaaagcucgacgaugagccucccuuugacagaagcgccgaugacuucgcggaaauucugaagucccacaaaaccguuagcgccaagaacaaagauuucgacaagcugcucuuuggaggcaaagugaagacauacgauaaugagaacaucucuuauuccgcucugauuaaacuucugagcgggggaaccgaaaagcucucuaaguucuuugccaaugaggaguacacggaccuggaaaaagauuccgucugugugcggaacgcugacuucggcgauacccuugagaugcuggaaggccagaucgacgagcucgacuuugcccugcucaagagcgugaaaucucucuaugauuggucccugcuugucgacauucuggaaggcaagagccucaucuccgaggcgaaaaaggauaaguacgacgagcauggauaugaucuggacgcccuuaaauaccuguuccgcgaauaucucacaaaggaugacuacaaugagauguuuaaagaaguuucuggcaagcagaacuacgcuagcuauguguacaaugccuccagcgauaaaaccagagacucuaaguauaagaaaugcucccaaaaggauuucuguaaauuuacaaagaaauuccugagcaagauuaagccuaacgagaaagacaagccgugccuggauaaacuccuggagaagugugaacaaaauucucuuugccccaaacaggugaccacggacaaccgggucaucccuuaccagcuguauuacguggagcucaagaaaauccuggaaaacgcuuguggguaucugcccuuucuuaaugagagagacgaauacggaacaguugccgauaagauucugagcaucaugaaguucagagugccuuacuaugucgggccccugguggacuccaaaaagucuccgaaugccuggcugguucggaaacucgaugggaagauuaccccuuggaauuuuacagacauggugaacgaggaugagagcgaaaaugcuuucaucagacgcaugaccugcaaauguaccuacgucgcgggacaggacgugcugcccaaguauucccuucuguacagcaaguucucuguccucaacgagauuaauaacaucaaacugaauggcgaaccuaucuccgugcagacaaagcaggagauuuauacggaacuguuugagcggaacaaaagcagaguuucuaagaaaaagauccgcgauugccuuauuucccacggcuacgccgcugacagcgaugaggugaccgggaucgacgauauugccaaguccgcccuccggucuuaucaugacuucaaaaagaugcugagcaauggaauccugacagaacagcaagucgaggaaaucauugagcacaucaccgugacaaccgauaacauuagacucaaaaaguggcugaaaacgcaguuucccaugcuugcugacgaagacguuaaguacaucacaaagcugaaauacaaggauuauggccgccucucccggugcuuccuggaggacgugcugcccgucgauaccaaaaccggggaggccgaaucugacaagaauauuaucacaaugcuuugggagaccaacgaaaauauuaugcagcuccugagcuccaaauacagauauagcgagaacaucgagcacaugaaccgccaauacuaugcgcugccugaaaaucauaagucuauguccgagcggcucaaagauauguacgugccgacagcugugagacgggccguuacgcgcaccuuugacaucgucaaggaacugaagaaaauucagggaagagaucccgacaagaucuucauugagauggcccggggcacaggggaaaccccuaaaggaaagagaacaaacagccgcaaagaucagauccuugagcacuggcauggccuggacaauaaggauauuaacgaccucaagaaaucuggcaucugggagcaccuggacaccaucgaugacgcuaagcugcgguccgauaaauauuuucuuuacuucaugcagcucgggagauguauguacacggaaaagcccauuccuuuugaggaaguggagaaugaacauaaauggaacaucgaccacauuuggccccaagccaagaucaaggaugacagccuggauaauaaagugcuggucucuagcaacgagaauggaaagaaauccgacagcuauccgauuucugaugacauccgccacuccauggcuggccucuggcauagccuguacaagaaagggcuuaucuccgagaagaaguaucagagacugacccggucuacaccuuucaccgaugacgaacucagcggauuuauugcccgccagcugguggagacaagacaguccaccaaagcgguugccacgcugcuuaaggaacaauuccccaacacagagaucguguacgucaaagcuggccuggugucugauuuucggcaggaaauggggaugcucaagugccgcgagguuaaugaccugcaccaugccaaagacgcuuaucucaacauugugcugggcaaugucuacaacaccagauucacaaaggauccucuuaauuucgugaagaacaacgagaaauauagcaucaagauuuuucagaaaaauuccgacggaaagaaaaccggcguuaucacccggaagguggaacgcgggggagaggucgccugggaucccgaaacaucuuucgcgaucgugagaaaaaugaugagcaagaacuccauucgguacgugcgcuacgccuauaugagaaagagcggccagaaugggggauuuuucgaccaaaacccucugcggaaaggcaaggggauggucucuaucaaacacaaucucuccauugagaaguacggcggauaugauaacgcuacgaucagcuuuuucucucugguuuccauuaaagacuuuggcgugauccugcuugccguggagcugcucagcgcuaauaaguuccugaagaacauuucugaagccaaagaguacgccgcugauaagcucuccaaagaacugaaugucaagaucgugcccaacgacguugcguuuccgcuuaauaacagauauaauguggucaaaaucaacgccgugcuggagcucgauggguaccgcguuaugauugcugccaagcagaauagcuccaucaaguucgugagcaacgaaucucugauucugagcucccagcacauggccuaugucaaaaagaucaccaaauuuauugagaagcggaaacaggacaagguguguaugaucaacgcuuucucuggaaucagcauugaggauaauaucgaacuuuacgacguucugguguccaagugcaacauuaaaccuuucaauaucauguacgagaaccucggcauuaagcugucugauaauagagacaacuuuaucaaaaagagcgucgaaaaucaagugcucauccuguccgagauggugcgccuuuucaaaacagggcggaaggccggagucaaccuggaagagguuggcgggcgcaaaaauucuggcgugaagacccugaacacaugucucuauaaggugaaagacuacagcaauauuuuucuggucgaucagucccccaccggacuuaucgagcauaagagccccaaccugcucgaccuguga

SEQ ID NO: 4380 - RNA, 4155 nt, Artificial Sequence
  Cas9 variant
augaacaagcccuacagcaucggccuggacauugggaccaauuccgugggauggucuaucauuacagaugacuauaaagucccugccaagaaaaugagaguucucggcaacacggauaaggaguacaucaaaaagaaucugauuggggcccuucuguucgacggaggcaacaccgccgcggaucggcgccucaagagaacagcucggcgcagauauacccggcgcagaaaucggauccuguaccuucaggaaaucuuugccgaggaaaugagcaaaguggacgauuccuucuuucaccgccuggaggacucuuuccucguggaagaggauaagagagggagcaaauauccgauuuuugccacacugcaagaggaaaaggacuaccaugagaaauucuccaccaucuaucaucugcggaaggaacucgcugauaagaaagagaaggccgaccugcgccuuauuuacaucgcucuggcccacauuaucaaauuuagaggacacuuccucauugaggaugacucuuuugacguccggaacacagauaucagcaagcaguaccaggacuuccuggaaaucuuuaauaccacguucgagaacaaugaucuucugucccagaacguggacguugaagcgauucucaccgauaaaaucagcaagucugccaaaaaggaccgcauucuggcucaauaucccaaucagaaguccacaggcaucuuugccgaguuccugaaacucauugugggcaaccaggcugauuucaagaaauacuuuaaucuggaagacaagaccccucuucaguucgccaaagauagcuaugacgaggaucuggagaaccuccuggggcaaaucggagacgaauuugcggaccuuuucucugccgcuaagaagcuguacgauuccguccuccugagcggcauccugacagugauugaccucucuaccaaagcuccccuguccgcuagcaugauccagagauaugaugagcaucgggaagaccuuaagcagcugaaacaguuuguuaaggccucccucccugagaaauaccaagaaauuuucgccgauucuagcaaggacggguaugcuggauacaucgagggcaagacgaaucaggaggcguuuuacaaauaucuguccaaacuucugacaaagcaggaagauagcgagaacuuccucgaaaagauuaaaaacgaggacuuucugagaaagcaacgcaccuucgauaaugggucuaucccccaccaggugcaccugacagaacucaaggccaucauucggagacaguccgaguacuauccuuuucugaaagagaaccaggaccgcaucgaaaagauucuuaccuuccggaucccguacuauauuggaccccuggcuagagagaaaagcgauuuugccuggaugacccgcaagacagacgauucuauccggccuuggaauuucgaagaccucgucgacaaagaaaagagcgccgaggcuuucauucauagaaugacgaacaaugauuuuuaccugcccgaggagaaagugcugccuaagcacucccuuaucuaugaaaaguucaccguguacaacgagcucacaaaaguccgcuacaagaaugaacaaggcgagaccuacuuuuucgacucuaacaucaaacaggagauuuuugauggcguuuucaaggaacaucggaaagugagcaagaagaaacugcuggacuuucucgccaaggaguaugaagaguucagaaucguggaugucauugggcuggacaaagaaaauaaggcguuuaacgcuucccuuggaacauaucacgaucuggagaaaauccucgacaaggauuuccuggacaaucccgauaacgagagcauucuggaagacaucgugcagacccuuacgcucuuugaggaucgcgaaaugaucaagaaacggcuggagaauuacaaggaccuguucacagaaucucagcucaaaaagcuguauagacggcacuacaccggcugggggcgccuuuccgccaaacugauuaacggaaucagagacaaggagagccaaaagaccauucucgauuaucugaucgacgauggccggucuaauagaaacuuuaugcagcugauuaacgacgaugggcgcuccaaucggaacuucaugcagcuuaucaaugacgauggacucagcuucaaauccaucauuucuaaggcccaggcuggcagccauuccgacaaccugaaagagguugugggcgaacuggccgggucuccggcuaucaagaaaggcauucuccaaagccugaagaucgucgaugagcuugugaaaguuaugggauacgaaccugagcagauuguggucgagauggccagagaaaaucagacaaccaaccaggggcgcagaaauucccggcaacgcuacaagcugcucgacgauggagugaagaaccuggcgagcgaccugaauggcaacauccuuaaagaguaucccacagacaaucaggcccuccagaacgaaagacuguuucuguacuaucuccaaaaugggcgggauauguacacgggcgaggcucuggacaucgauaaccuuucucaguaugacauugaucacaucauuccucaggccuucaucaaggacgauuccauugacaaucgcguccuggugagcucugcuaaaaacagaggaaaguccgaugacguucccagccucgaaaucgugaaagauugcaaggucuuuuggaagaaacugcuggacgccaaacuuaugucucagcggaaguacgauaaccugaccaaggcggagcgcggcgggcucacaagcgacgacaaagccagauucauucaacggcagcugguggagacccgccagaucacaaagcauguugcuagaauccucgaugaacgguuuaauaacgagcuggacuccaagggaagacgcauucggaaagugaagaucgucacccuuaaaagcaaucuggugucuaacuucagaaaggaauuuggcuucuauaaaauucgcgaggugaauaacuaccaccaugcccacgaugcuuaccucaaugccguugucgccaaggcuauccugacgaaguauccccagcuggaaccugaguuuguguacggggacuauccgaaauacaacuccuauaagacccggaaaagcgcgacagagaaacuuuucuuuuacuccaauauuaugaacuucuucaagaccaaggugacacuggccgauggaaccgucgugguuaaggacgauaucgaagugaauaacgacacgggcgagaucgucugggauaaaaagaaacacuuugcuacagugagaaagguucucucuuauccccaaaauaacauugugaaaaagaccgaaauccagacagggggcuucagcaaagaguccauucuggcccauggaaauucugacaagcucaucccucgcaagaccaaagauauuuaccuggaccccaagaaauacggcggguuugauagcccuaucgucgccuauuccgugcuuguuguggcugacaucaagaaaggaaaggcccagaagcugaaaaccgucacagaacuccugggcauuacgaucauggagcggucuagauucgagaagaaccccagcgcguuucuggaauccaaaggguaccuuaacauucgcgcugacaagcugaucauucucccgaaauauagccuguucgagcucgaaaauggacggagacggcugcuugccucugccggcgagcugcagaaggggaacgagcuggcucucccuacccaauuuaugaaguuccuguaccuugccucccgcuauaaugaaagcaaaggcaagcccgaggaaaucgagaaaaagcaggaauuugugaaccagcacgugucuuacuucgaugacauucugcaacucaucaaugauuuuuccaaaagagucauccuggcggacgcuaaccucgagaagauuaauaagcuguaucaggauaacaaagagaauaucagcguugacgaacuugccaacaauauuaucaaccuguucacauuuaccucucugggagccccugcugccuucaaguucuuugauaaaauuguggaccggaagcgcuacacauccaccaaagaggugcucaauagcacgcugauccaucaguccaucacaggccuuuacgaaaccagaauugaucuggggaagcucggagaggacuga

SEQ ID NO: 4381 - RNA, 4155 nt, Artificial Sequence
  Cas9 variant
augaagcugagaggcaucgaggacgauuacagcauugggcucgacaugggaaccuccucugugggcugggccgucacagaugaacgggggacgcuggcucacuucaaacgcaagcccaccuggggaagcagacuuuuucgggaggcccagacagcggcuguugcccgcaugccuagaggccaacggcgcagauaugugcggcgcagauggcggcuggaccuccugcagaaacuuuucgaacagcagauggagcaagccgauccggacuuuuucauccgccugagacagucccggcuccugcgcgaugacagagcugaagaacaugccgauuaccgguggccccuguuuaacgacugcaaguucaccgagagagauuauuaccagcgcuuuccuacaauuuaucacgugcggucuuggcucauggaaaccgacgagcaggcugauaucagacugauuuaccuugcccugcauaauaucgucaaacaccgcgggaacuuccuccgggaaggacaaagccuguccgcgaagucugccagacccgacgaggcucuuaaucaucugcgcgagacacuccggguguggagcuccgaaagaggcuuugaguguagcaucgccgacaacggcucuauucuggcuaugcugacccacccugaucucucccccagcgaccgccggaagaaaaucgccccucuguucgauguuaagucugacgaugcggccgcugacaaaaagcuggggauugcccuugcuggagccgugaucggccucaaaacggaauuuaagaauauuuucggggauuuuccgugcgaggacuccagcaucuaucugucuaacgaugaagccgucgacgcugugagauccgcgugucccgaugacugcgccgagcuuuucgaccgccugugugagguuuacagcgcuuacgugcuccagggacugcuguccuaugccccuggccagaccauuucugccaauauggucgaaaaguaccggagauauggggaggaucucgcucugcuuaaaaagcuggugaaaaucuacgcccccgaccaguaucggauguucuuuagcggagcgacauacccuggcaccggcaucuaugaugcugcccaagcccgcggguacacaaaguacaaccucggacccaaaaaguccgaauauaaaccgagcgagucuaugcaguacgacgauuucagaaaggcuguggaaaagcuguuugccaaaaccgacgcucgggccgaugagagauaucgcaugaugauggaccgguucgauaagcagcaauuucuuagacgccugaaaacguccgacaauggcagcauuuaccaccagcuccaucuggaggaacugaaggcgaucgucgagaaccaggggagauucuauccuuuucucaaacgggaugccgacaagcugguuucucuugugagcuuccgcauucccuacuaugugggaccucuguccacaagaaaugcucggaccgaucagcacggcgaaaaccgcuuugccuggucugagagaaagcccgggaugcaagacgaacccaucuucccuuggaauugggagagcauuaucgaccgguccaaaagcgcugagaaguuuauccuccgcaugacaggaaugugcaccuaccugcagcaggaaccgguccugcccaaaucuucccuucucuacgaggaauuuugugugcugaacgagcugaauggcgcccauuggagcauugauggcgacgaugagcacagauuugacgcggccgaucgggaagggaucauugaggaacucuuccgcagaaagcggaccguuucuuauggagacguggcuggcuggauggagagagaacgcaaccagaucggggcccacgucugcggaggccaaggggagaaaggcuucgaguccaagcugggaagcuacauuuucuucuguaaggauguguuuaaaguugaacggcuugagcaguccgacuauccuaugaucgaaagaaucauucuguggaacacacucuucgaggaucgcaagauccugucucagcggcugaaagaagaguacggcagcagacuuuccgcugagcagauuaagacgaucugcaaaaagcgcuuuaccggguggggacggcucucugaaaaguuccugacaggcauuaccgugcaagucgacgaggauagcguguccaucauggacguccugagagaagggugucccgugagcggaaaacgcggccgggccaugguuaugauggagauucucagagaugaggagcugggguuucagaagaaaguggacgacuucaaucgggccuuuuucgcugagaacgcgcaggcccuuggcgucaaugaacugccuggaucucccgcugugcgcagaucccucaaccagagcauccggaucguugaugagauugccucuaucgccggcaaggcuccggccaauauuuuuaucgaagugacacgcgacgaggauccuaaaaagaaagggagacggaccaagagacgcuauaacgaccugaaggaugcgcuggaggcuuucaaaaaggaagaccccgagcuuuggcgggaacucugcgagacggccccuaaugauauggacgaaagacugucccuguacuuuaugcaacgcggaaaaugccucuauagcggccgggccauugauauccaucagcugucuaacgcugggaucuacgaggucgaccacauuauccccagaacauacgugaaggaugacagccuugagaauaaagcccugguguaucgcgaagagaaccagcggaagaccgacaugcuccugauugauccugaaaucagacgcagaauguccggauacuggcggaugcugcaugaggcgaaacuuauuggcgacaagaaguuccgcaaucuccugagaagccggaucgaugacaaagcucugaagggguucaucgcccgccaacucguugaaaccggccagauggucaaacuggugagaucucuucuggaggcccgguaucccgagacaaacauuaucuccgugaaggcuagcauuucccacgaucucagaaccgccgcugaacuggucaagugucgcgaggccaaugacuuucaucacgcgcacgaugccuuccuggcuugccgggugggacuuuuuauccagaaaagacauccguguguuuacgaaaacccuauuggccugucucaggugguccgcaauuaugugcggcaacaggccgacaucuucaagagaugccggacaauccccgggagcuccggauuuauuguuaacucuuucaugacgagcggcuuugauaaagagaccggggaaaucuucaaggacgauugggacgcugaggccgagguggaaggcauucgcagaucccucaacuuucggcaguguuucaucucucgcaugcccuuugaggaucacggagucuucugggacgccacaauuuacagcccuagagcuaaaaagaccgcggcccugccgcucaagcaggggcugaaucccucccgguauggcagcuucucucgcgaacaauuugcuuacuucuuuaucuacaaagccagaaacccucggaaggagcagacacuuuucgaguuugcccaggugcccguucgccuguccgcucagauuagacaagacgaaaaugcccucgagcgguaugcgagagaacuggcuaaagaucagggacuggaguucauccgcaucgaacggagcaagauucuuaaaaaccagcugaucgagauugacggcgauagacucugcaucaccgggaaggaggaagugcgcaaugccugugagcuggccuuugcucaagacgaaaugcgggucauuagaaugcucgugucugagaaaccugugucccgcgaaugcgucaucagccuguucaaccggauccuucugcauggagaucaggccucuagacgccucuccaagcagcugaagcuggcgcuucugagcgaggcuuuuuccgaggccagcgacaauguucagcggaacguggugcucggccugauugccaucuucaaugggucuacgaacauggucaaucucagcgauauuggaggcuccaaauuugcuggcaacgugagaaucaaguacaaaaaggaacuggccucucccaaaguuaaugugcaccuuauugaccaaagcgucaccgggauguucgagcgccggacaaagaucggacuguga

SEQ ID NO: 4382 - RNA, 4158 nt, Artificial Sequence
  Cas9 variant
augaccaagcccuacagcaucggccuggacauugggacaaacuccgugggaugggccgucaucacggaugacuauaaaguuccuucuaagaaaaugaaggugcucggcaauaccagcaaaaaguacauuaagaaaaaccugcuuggggcucuccuguucgauuccggaaucacagccgagggcagacggcugaagcgcaccgcgagacggcgcuauacaagacggcgcaaucggauucuuuaccugcaggaaaucuuuucuaccgagauggcuacacucgacgaugccuucuuucaaagacuggacgauagcuuccuggugccggacgauaaacgcgacuccaaguaucccaucuuugggaaccucgucgaagagaaaguguaccacgaugaguucccuaccauuuaucaucugagaaagcaccuugccgacucuagcaagaaagcugaucugcggcucguuuaccuggcccuugcucauaugaucaaguaccgcggacacuuucugauugaaggcgacuucaauuccaaaaacaaugaccuccagaagaacuuucaggauuuccuggacacguauaaugccaucuuugagagcgaucugucucucgaaaacuccaaacagcuggaggaaauugugaaggacaaaaucagcaagucugcgaagaaagaucggauucuuaagcuguuccccggcgagaaaaauuccgggaucuuuagcgaguuccucaagcugaucgucggaaaccaagccgacuucagaaaauacuuuaaucuugaugaaaagaccucucugcaguucuccaaggagagcuaugacgaagaucucgagacacugcugggccauauuggggacgauuacuccgacguguuucucaaagcuaagaaacuguaugacgccauccuucugucuggcauucucaccguuacagauaacggaaccgaagcuccucugagcuccgccaugaucaugcgcuacaaggagcacgaggaagaccuugcgcugcucaaagccuauauuagaaauaucagccuggagacguacaacgaaguguucaaggauaacacaaagaauggguacgcuggauauaucgacggcaaaaccucucaggaggauuuuuacgucuaucugaagcggcuccuggccggccuugaaggggcugacuacuuccuggagaaaauugauagagaggacuuucuccgcaagcagcggacauucgauaacggauccauccccuaucaaauuuaccugcaggaaaugagagccauccuggacaaacaggccaaguuuuauccuuuccuugcuaagaauaaagagcgcauugaaaagauccucaccuuucggaucccguacuacgugggcccccuggcgagagggaacagcgauuucgccuggucuauucgcaaacggaaugagaagaucaccccuuggaacuuugaagacgugauugauaaagagagcuccgcugaggccuucaucaauagaaugacaucuuucgaccuguaucuccccgaagagaagguccugccuaaacacagccuucuguacgaaaacuuuacgguuuauaaugagcucaccaaggugcgcuucauugccgagggaaugcgggacuaccaguuucuggauuccaagcaaaagaaggacaucgugagacuguauuucaaaggcaagcgcaaagucacagauaaggacauuaucgaauaccuucaugcuaucgauggguaugacggaauugagcucaagggcaucgaaaaacaguuuaacagcucucuguccaccuaccacgaucugcucaauauuaucaacgacaaggaguuccuggaugacagcucuaaugaaacaauuaucgaggagaucauucauacccuuacgauguuugaagaucgggagaugaucaaacagagacuguccaaguucgacaacauuuuugauaaaagcgugcucaagaagcugucccggcgccacuacacaggcugggggaaacugucugccaaacuuaucaauggaauuagagacgaaaagagcggcaacaccauccucgacuaucugaucgaugacgggguuuccaaccggaauuucaugcaacugauucacgaugacgcgcucucuuuuaagaaaaagaucaagaaagcucagauuaucggagauaaggacaacauuaaacagguggucaagagccugcccggcuccccggccaucaaaaaggggauccuucagagcauuaaaaucguggaugagcugguuaaggugaugggcagagaaccugagucuauugucguggagauggcccgcgaaaaucaauacaccaaccagggaaaguccaauagccagcagcggcucaaaagacuggaggaaucucugaagggccuuggguccaaaauccucaaggagaacguccccacacgccugagcaaaauugacaauaacgcucugcaaaaugauagacucuaucuguacuaucuucagaacggaaaggacauguacaccggcgaggaacuggauaucgaccggcucucuaauuaugacauugaucauaucaucccucaggccuuccugaaggacgauagcauugacaacaaagugcugguuuccagcgcuucuaaucgcgggaaguccgaugacgugcccagccuugaggucgugaaaaagagaaaaacacugugguaccagcuccugaaguccaagcucaucucucaacggaaauuugauaaccugacgaaggccgaacgcggaggccuuagccaggaggaaaaagcgggguucauucagagacagcugguugagacccggcaaaucacaaagcacguggcccgccuccuggacgagagauucaauaacaaaaaggaugaaaacaaucggacccugcgcacagucaagauuaucacccuuaaauccucucuggugagccaguuuagaaaggacuucgagcucuacaaagugcgggaaaucaacgauuuucaucacgcucaugacgccuaucugaaugcuguugucgccuccgcgcuccugaagaaauaccccaaacuugagccugaguucguguauggcgauuacccgaaguauaacucuuuuagagaacgcaaaagcgccacggagaagguguacuucuauuccaauauuaugaacaucuuuaaaaagagcauuccccuggcugacggaaccgucaucgaccggccucucauugaagugaaugaggaaacaggcgagucuguuuggaacaaaguggccgaucugaauaccgucagaaaggugcuguccuacagccagguuaacaucgugaaaaaggucgaggaacaaaaucacgggcuugaccgcggaaagcccaaaggccuguucaacgcuaaucucucuuccaagccuaaacccaacagcaaggagaaucuggugggggccaaagaauaccucgauccgaagaaguauggaggcuacgccgggaucucuaacuccuuugcuauucugguuaaaggcacaaucgagaagggagcgaaaaagaaaauuaccaacgugcuugaguuccagggcaucagcauucuggaccggaucuauuacagaaaggauaagcugaauuuucuccuggaaaaaggguauaaggacauugaacuuaucaucgagcugccuaaauacucccucuucgagcugagcgauggaucucgccggaugcucgccagcauucuguccacgaacaauaagagaggcgaaauccacaaagggaaccagauuuucaucucucagaaguuugucaaacuucuguaucaugcuaagcgcauuagcuccacauucaaugagaaccaccggaaguacguggaaaaucauaaaaaggaguuugaggaacuguucuacuauauccucgaguuuaacgaaaauuacgugggagccaaaaagaacggcgagcugcuuaaaucugccuuccaaagcuggcagaaucacuccaucgacgaacugugcucuagcuuuauugggcccaccggcuccgagagaaagggacucuucgagcugacaagccggggcggggcugccgauuuugaguuccucggagucaagaucccucgcuauagagacuacacccccucuucccugcuuaaagaugcgacccugauucaccagagcguuacaggccuguaugaaacgcggaucgaccucgggaagcugggagaagauuga

SEQ ID NO: 4383 - RNA, 4158 nt, Artificial Sequence
  Cas9 variant
augcagaccuacuucggcaugaagaaaauccuggggcucgaccugggaacaaacagcauuggcugggcccuugugaaugaggcuaacgaugacaaugaaaaguccucuaucauuaaacugggggucagaguuaacccccucacgguggaugagcaaagcaauuuugaaaagggaaaauccaucaccacaaacgccgagcggaccauuaagcgcucuaucagacggagccugcagcgcuauaaacuuagacgggaaaaucugaucgagauucucaaagagcacaacuucaucacagacgauaccauucuguccgaagacggcaaugcgucuacauuugagaccuaccgccugagagcuaaggccgccagcgaaaagaucucccucgaggagcuggggcgggugcuucugaugauuaacaagaaacgcggauauaagagcucuagaaaggcuaaaaaucaggaagagggccagcucaucgauggcauggaagucgccaaggagcuguacgaaaagaacauuacgccugggcaauucguguuucagcuucugaagcagggaggcaaauucaucccggacuuuuaucgguccgaucuccaggcugaguucgacaagaucugggaguuucaaaaacuguuccaugccgaaauucugguugaugacuuuaagaagcagcucgagcgcaaagggaagcugaauagcucuaaaaucuuccuuggaagauuuggcauuuacaccgcggaaaacaaggggaaugauaaacggcugcaggccuaucaguggcgcguggacgcucucacaaaggagcugaccaaggaggaacuugccuacgucaucuccgaccugaacggaauuaucuccucuuccagcggcuaccucggcuccaucucugauagaagcaaagagcuguauuucaacaaucaaacaguggggcaguuccugauggcucagcucgaccacagcccccauaccagccugaagaaccaaguguuuuaccggcaggauuaucuugacgaguucaauacgcugugggaaaaccaggcccacuaccauaaaguucucacaucugaucugaaguccgaaauuagagacgucaucaucuuuuaucagcgccggcuuaaaacccaaaagggacugauuagcuucugcgaguuugaaucuagaaagauugagguggagaucgauggcaaaaagaaaaucaagaauguggggagccgcgucuguccuaaauccucucccauuuuccaggaauuuaagaucuggcagauucucaacaauaucgagcugcuggaaaagagcuccaaagcgaagcgguuccucgaccaggaggagaaagaacugcuuuuuaaggagcugagcauuaaaucuaagaucuccaaaagcgaugcccucaagcugcuguucaagaacucuagagaacuugaccucaauuacaaagagauugaaggaaaccgcacacaauccgcucuguuugaugccuauagcaagaucaucgagcuguccggccacggggaguacgacuucucuaaaauggaagcuagcaauauuaucgagcucguucaggaaguguuuaccggacugaacuacaauaccgagauucuuuauuucgacuccucucuggaaggcaaggauuucgagaaccagccuauguaccggcucuggcaucugcuguauagcuuugagggcgacgauuccaaaacagggaaugaaaaacuuaucaacaagcucagcgagcuguacggauucgaaaagaaguauucuauugugcuggccaacgucuccuuucaggaggacuacggcagccucucuacgaaagccaucagaaagauccaccccuaucugaaagaagggauucaauacgauguggcuugcgaguucgcgggauaccgccacuccaagagcucucuuaccaaggaggaaaucgagaauaaaauucugaaggaccagcucgaaauccugccuaaaaacagccugcggaauccgguuguggagaagauucuuaaccagaugaucaaugucgugaacgcccucaaugaguccuauggcaaacccgaugaaaucagaauugagcuggcucgcgaacugaaaaagagcgccaaagagcgggaggaacucacagccucuaucggggagaccacaauuaagcaugaaaaauacagagcuauccuggagaacgaauuuggcauuucccacguuagccggaaugacaucauccgcuauaaacuuuaccuggagcucgaaaacagaggauauaagacccuguacuccaauacguaugugucucaggagaagcuguucagcaaagaguuugauauugaccacaucauuccucaauccugucuuuucgaugacucuuuuagcaacaagacacucgaauccaagucugucaauaucgagaaaggcaacgauaccgccuucgacuacguguuugcgaaguacggggaagcuggacugagcgacuauauuauccauauugaggaacuguucaaagauggcaagaucuccaaaaccaagcucaauaagcugaaaaugaaggggaacgagauccccagcgacuuuauugcccgggauaucagagacacacaguacauugcccgcaucgcuaaaaacauucuugaggaaaccguccggaaugugguuucuacauccggaagcaucacggauagacugcgcgaggacuggcagcucaucgaugugaugcaagaacugaacugggagaaguauucugcccugggccuuaccgagauuuacgaaaauagagaggggcacacaauccggcgcauuaaagacuggaccaagagaaacgaucaucggcaccaugcuauggacgcccugacaaucgcguucaccaagcgcucccacauucaguaucucaauaaccugaaugccagaagcgauaaaucuggcuccaucuacggaaucgaaacgaaggagcucuaucgggacgaucacggcaaacugaaguucaaaccucccauuccgcuuaacgaauuucgcgcugaggccaagaagcaucuggagaauacccucaucagcauuaaagcuaagaacaaagucgccacaaucaauauuaacaccacauccaccaaggaagggaaaaauaagaagagacagcugacgccucggggacagcugcaccuugagacaaucuacggcagcauucaacaguacgugaccaaacaggaaaagguuggggcgucuuucaacgaggaacagaucagcaaaguggccaagcaaaaauaucgccaggcucugcucaauagacugcgggaguuugacaacgaccccaagaaagccuucacaggaaacaauuccuuugagaagaacccuaucuaccucgauguccugcagacccagaaggugcccgacaaaguggaaaccguuucuaaggagauuaucuauacaauuagaaaagauaucacgcccgaacuuaagauugagaaagucaucgacaagaagaucaaaaccauucugcaaagccgccucaaugaauacuccggcgauucuaagcgggcuuucagcaaccugaaagagaauccuaucuggcugaaccaggagaaggggauugaaaucaaaagagugacaauuuccggcaucucuaaugccguggccauccaugacaagaaggauaaaaacggaaaucuuauucuggacaacgagggcagcacccaggcugucgauuuugugaauacagggaacaaucaccacguugcgaucuauaaggacgaacgcggaaaccuccaugaguccguggucagcuucuuugaggccugcacccgggugaaucugggcgggccgguuauuuucaaaaacuacaauaagucugauggaugggaauuucucuucuccaugaaacaaaacgaguauuucguguuucccaacgaaaagacgggcuucaauccuaacgagaucgaccugcuugaccccgauaauuacagacugauuagcccuaaccuguuucgcguccagaagaucucuuccaaaaauuacguguucaaccaccaucucgaaacaagcgcuauuaccggggagacccugaagaauaaaaagcagcuuuccucuguuacauaucacuuuauccagagccugcccccgaucaaagacauugugaagguccggaucaacaauauuggccaaaucgugugggugggagaguacuga

SEQ ID NO: 4384 - RNA, 4158 nt, Artificial Sequence
  Cas9 variant
auggacgagcugcagaacuucgaaaagggcaaaagcaucaccacaaaugccgauagaacggcugggcgguccaugcgcagaaaccuccaacgguacaagcugcgcagagagaaucuuauugaagugcugaaagaguauaacuuuaucaccgacgaaaugauucucucugagaauggaaaccggacaaccuucgagacauaccgccugagagccaaggcggcugucgaagagaucagccuugaacaguuugcccggguucugcucaugauuaauaaaaagcgcggcuauaaguccucuagaaaagccaagggggcugagaacggaacccugaucgauggcauggagguggccaaaaagauguacgacgaagggaucacacccggagagcugugccuccagcugcuuaccgcuggcaaacgguauuucccugauuuuuaccgcagcgaccugcaggccgaauuugauagaauuuggaauuuucaaaagcaguucuauccggacucccucaucgauaaggugaaagacgagguccggggcaagaacaaaucucagacgugggcgauucuggccaaguacuuuguguggaaagaaguugagaauagcuggaacgaggaagaggcucagacccgcagaguggaaaaggaguaccggcuugucgggaucaaaagaggagugaagcgcgaggagcugaagcucgagaauuuccaauggcggguuaaagcccuguccgaaagaaugaaccccgaggaacuggcuauugugcuccaggagaucaaugaacagauuagcaacucuuccggcuaucugggggccaucagcgaucgcucuaaggagcuuuacuuuaaccggcagacagucggacaauaucagauggcggugcuggacaauaacccuaauaucggccucagaaacaugguguucuaccgccagggguaucugggagaguuuaauaccauuugggaaaaacaagccgaguuccacaaggaacuuacagaggaucugaaaaaggagauccgggacauugucaucuucuaccagagacgccucaagucccagaaaggccugauuaacaucugugaauuugagcggagacagaucgaaguugagauugacggcaagaaaaagaucaaaaccauugggagccgcgugaucccccggucuuccccucuguuccaagaauuuaagauuuggcagacgcucaaugauaucgaggugagcguccugggagugaagaacaaaagaaagaaacaggacgauaauuccacaacccuucuggacucugcugagaacaucgauagccucaagcugaauguuucccggccccuugacgccgaugaaaagagccugcucgcuaaggagcuguucauucgcgacaagcugacaaaaucugaugugcucaagcugcuuuuuaacaauccucagaaccugaaucucaacuucaaaaacaucgacggcaauagaaccggguccgcccuguaucaagccuuuagcaagauucuggaaaucucuggacaugagagcauuaacuucaaaaaguccgcugaugaaaucgucgaacaggugaaaaccauuuucucugcgcuuggcuggaauacagagguucucugcuucgacagcgaaaaggagcuggacaagcagccguacuuuaaacuguggcaccuccuguacuccuucgaaggggauagcacgcccaccggagacggcaaccuuauccagaagaucgccgaucuguguggcuuugagaaagacuaugcuucuauucucgccaauaucacauuccaagaagauuacgggucccugagcaccaaggccauucggaaaauccugccucaucuuaaggacggaaaccaguaugauguggcuugcgaguacgccggcuauaagcacucuaaauccagccucaagaaagaggaaauuaagaauaaaguccugaaggacaagcuggagcuccugcccaaaaacucccuuagaaauccuguggucgaaaagauccugaaccagauggugaauguuaucaacgcgauuaucacaaccuacgggaaacccgaugagauucgcaucgagcucgcucgggaacugaagaaaaaggccaagaaaagagaggaacugacgaagacaauuguggacaccaccaaaacacaugagggaauccgcgccauccuucagaaugauuucggcaugucucacgucagcagaaacgcuauuauccgguauaagcucuacgaggaacugaaagacaauggguacaagacccuguauuccaacacauacauuccgaaagagaagcucuuuucuaaggauuucgacaucgaacacauuaucccucaagcccgccuguuugacgauagcuucuccaacaaaacgcuugagguuaagagcaucaauauugaaaaaggcucuaagaccgcuuaugacuuuguggaggaaaaauacggagagcagggccugcaggaguaucucaacagaugugaagugcuguuccgggauaagaagacaaaacugcgcaaacuuaaaaugcaagaguccgaaauccccgagggguuuauugacagagaucuccggaauacccaguacaucgccaagaaagcgcugagcaugcugaacgaaauuugccgcagagucguggccacaaccggagcuaucacggacgagcuccgggaggauuggcagcugguggacguuaugaaggaacuuaauugggagaaguauaaaguccugggccucguggaauacuucgaggauaacgacgggcgccugauuggaagaaucaaggauuggaccaaacggaaugaccauagacaccaugccauggaugcucugacaguggccuuuaccaaggacgucuucauccaguacuuuaacaauaaaaacgcgucucuuaagccugacacaaaugaggccgcuauucgcaacaaguauuuccaaaauggcaaagccaucccucccaugucccuggaugaauuucgggcugaggccaagaaacaccucaacgacacccugauuagcaucaagacgaaaaauaaggugguuacaauuaaccucaacagaaccaagaaaaagaaugggaucaacaaaaagcagcagcagacaccccgcggccaacugcaccuugaaaccguguacggaucucauaaacaguaugucgugaaggaggaaaaaguuaaugccagcuucgaugcugcgaagaucgccaccgugaacaagccggcuuaccgggacgcccugcucagacgccugcaggagaauggcaacgauuccaaaaaggccuucacagggaaaaauagccuggacaagcagcccgucuggcuugaugcuaaacaaaacgagugugugccugaaaagguuaagacggugaugcuggagaccgucuauacagugcggaaacccauugacgaaaagcucaauguggauaaagucguugacgccagaauccgcaagcugcuccaggaucggauuaaagaguacggaaacgcgaagucugcuuuugccaaucuggacgaaaacccuaucuggcuuaauaaggagaaaggcauuaccaucaagagaguguccgugagcgggaucuccaaagcccagucucugcacgagaagaaagacaaggauggaaacuucauucucgacaaggauagccggcgcauccccgucgacuuugugaauacaggcaacaaucaucacguugcuauuuauagaaaaccggugcuggauaagaaagggcaagccgucuucgacgaaaacggcgagcugaaguuugaacuugaggaagugguuguguccuucuuugaugcggucacccgggugaaccugucucagccuaucauugacaaagauuacaagcgcagcgagggauggaaauuccucuuuuccaugaagcagaaugaguacuucguuuuucccaacgaaaagacgggcuucgacccuaaagagaucgaucugcucaaucccgaaaacuaugcucugauuucuccuaaucuuuucagagugcagaagaucgccagcaaagacuacgucuuucggcaucaccuggagacagugguggccgauagaaaggagcugcaagaaaucaccuggaaacgcauuuccagccucucuauccugaaccggauuaucaaggucagaguuaaucacauugggcagaucgugaugaucggagaguauuga

SEQ ID NO: 4385 - RNA, 4158 nt, Artificial Sequence
  Cas9 variant
augaccaagcccuacagcaucggccuggacauugggacaaacuccgugggaugggccgucaucacggaugacuauaaaguuccuucuaagaaaaugaaggugcucggcaauaccagcaaaaaguacauuaagaaaaaccugcuuggggcucuccuguucgauuccggaaucacagccgagggcagacggcugaagcgcaccgcgagacggcgcuauacaagacggcgcaaucggauucuuuaccugcaggaaaucuuuucuaccgagauggcuacacucgacgaugccuucuuucaaagacuggacgauagcuuccuggugccggacgauaaacgcgacuccaaguaucccaucuuugggaaccucgucgaagagaaagccuaccacgaugaguucccuaccauuuaucaucugagaaaguaccuugcugacucuacgaagaaagccgaucugcggcucguguaccuggcucuugcccacaugaucaaguaucgcggacauuuucugauugaaggcgaguucaauagcaaaaacaaugacauccagaagaacuuucaggacuuccucgauaccuacaaugcgauuuuugaauccgaccugagccuggagaacucuaaacagcucgaagagaucguuaaggauaaaauuuccaagagcgccaagaaagacagaauccugaaacuuuuccccggcgagaaaaauucugggaucuuuuccgaguuccugaagcucauugugggaaaccaagcugauuucaaaaaguauuuuaaucuggacgaaaaggccccucuucacuucagcaaagaaucuuacgaugaggaccuggaaacacuccugggcuauaucggggaugacuacuccgaugucuuucugaaggcuaaaaagcucuaugacgccauucugcuuagcggaauccugaccgugacagacaacggcaccgaggcgccccucuccucugccaugauuaugcgguacaaagagcaugaagaggaucuggcccuucugaaggcuuacauccgcaauaucagccucgaaacguauaacgagguuuucaaggacgauacaaagaacggguacgcuggauauauugacggcaagaccucccaggaagauuuuuacgugcaccugaaaaagcugcucgucggccuggagggggccgacuauuuccuugagaaaaucgauagagaagacuuucugcggaagcagagaacauucgauaauggaagcauuccuuaccagauccaccuccaagagaugcgcgccauucuggacaagcaggcuaaauuuuauccguuccuggcgaagaacaaagaacggaucgagaagauccuuaccuuucgcauucccuacuacgugggcccucucgccagagggaauagcgauuucgcuugguccauccggaaaagaaacgaaaagauuacccccuggaauuuugaggacgugaucgauaaagagagcucugccgaagccuucauuaaccgcaugacaucuuucgaccuguaucugccugaggaaaagguccuccccaagcauucccugcuuuacgagacguuuaauguuuauaacgagcugaccaaagugcgguucaucgcugaaucuaugagagacuaccaguuucucgauagcaagcagaaaaaggacauugugcgccuguauuucaaaaauaagcggagagucacagauaaggacaucaucgaguaccugcacgccauugauggauaugacggcaucgaacuuaaagggauugagaagcaauuuaacuccagccucucuaccuaccaugaucugcugaauaucauuaacgacaaagaguuccucgaugacuccagcaaugaagcgaucaucgaggaaauuauccacacacugaccauuuuugaggaucgcgaaaugaucaagcagcggcuuucuaaauucgagaacauuuuugacaaguccgugcugaagaaacucagcagacggcacuacacgggauggggcaagcuguccgcuaaacugaucaauggcauccgcgaugaaaagucugggaacacaauucuugacuaucucaucgacgauggaguuagcaacagaaauuucaugcagcugauucaugacgaugcccuguccuuuaaaaagaagaucaaaaaggcccaaauuaucggcgacaaagauaacaucaaacaggugguccaggcucucccggggcggccugccauuaagaagggaauccugcagucuauuaaaaucguggacgagcuuguuaaggugaugggcagacgccccgagagcauugucguggaaauggcucgggagaaucaauacaccaaccaggggaaguccaauagccagcagagacugaaacgccucgaagagucucugaaggaacugggcuccaaaauccuuaaggagaacauuccugccaaacucagcaagaucgauaauaacgcgcugcaaaaugacagacuguaucucuacuaucugcagaacggaaaggauauguacaccggcgaggaacuugacaucgaucggcugucuaauuaugacauugaccacaucauuccccaggccuuccucaaagauaacuccaucgacaauaagguccuggugagcucugcuagcaaccgcgggaaauccgaugacguucccagccuggagguggucaagaaaagaaagacacuuugguaccagcugcucaagucuaaacugauuucccaacggaaguuugauaaucucaccaaagccgaacgcggaggccugagcccugaggcuaaggccggguucauccagagacagcuuguggagacacggcagaucacgaaacauguugcgcgccugcucgacgaaagauucaacaacaagaaggaugaggacaauaaaacccugcggacagugaagauuaucacccugaaauccucucuugucagccaauuucgcaaggauuucgaacuguacaaagugagagagauuaacgacuuucaccaugcccacgaugcuuaucucaaugccgugguugcuuccgcccugcucaagaaguacccgaaacuggaacccgaguucgucuauggagacuacccuaaguauaacucuuuucgggagagaaaaagcgccacagaaaagguguacuucuauuccaauaucaugaacauuuuuaaaaagucuaucagccuugcugauggcaccgugaucgagcgcccccugauugaagucaaugaggaaacgggggaguccguguggaacaaaguugcggaccucaauaccgugcggaagguccugagcuacucucaggugaacaucguuaagaaaguggaggaacagaaucacggccuggacagaggaaagccuaaaggccuuuucaacgccaaucuguccagcaagcccaaaccgaacucuaaggagaaucucgucggggcuaaggaauaccuggauccuaaaaaguauggaggcuacgccgggauuuccaacagcuuugccgugcucguuaaaggaacaaucgagaagggcgcuaaaaagaagauuaccaacauccuggaguuccaagggauuucuauccuugaccgcaucacauaucggaaagauaaguuuaauuuccugcuggaaaaaggcuacaaggacauugaucucaucauugagcugcccaaauauucccuuuucgaacugagcgacggauccagacgcaugcucgccagcauccugucuaccaacaauaagcggggcgagauucauaaggggaaccagaucuuuaucagccagaaauacgugaagcuccuguaucacgcgaaaagaauuuccaauacguucaacgauaaucaucgcaaguacgucgaaaaccacaaaaaggaguuugaggaacuuuucuacuauauccuggaguuuaaugaaaacuacgugggagcuaaaaagaauggcgagcugcucaagucugccuuccagagcuggcaaaaccacuccauugacgaacugugcucuagcuuuaucgggccuacaggauccgagcggaaaggccuuuucgagcugaccucuagagggggcgccgcugauuuugacuuccucggagugaagauuccccgguaucgcgauuacacaccuagcucccugcucaaagacgccacccugauccaucagagcgucaccggccuuuaugaaacaagaaucgaucuggggaagcugggagaggacuga

SEQ ID NO: 4386 - RNA, 4158 nt, Artificial Sequence
  Cas9 variant
augaagaacaaaaccugguaccugggccucggggugggacccacaagcaucggcugggccgcuacggacuccaauuauaagcugcuucggaaaaacaagaaacggcuguggggaguccgccucuucgaggaagccaagaccgcgguugauagacggacauuucgcgcugagagacggcgccuggccagacggaaguggcgcauuucucuucuggaagaacucuucgccaaagaagugagcaagaaugacccuaacuuuuuccugagacugaaagaguccaaguaccacuuugaggauaaaucucucaugaaugaauauauccuguucaacgacaaggauuacaccgacaaggauuauuacaaagaguauccgacaauuuaccaucuucggcugagccucaccacagaagagaaucccgacauccgcaagguguaccuggcuguccacuccaugcuuaaaaacagaggacauuuucugcuccagggccaaucuuucaaugauagcaacauugacuccgugaucaaggagcugcuggaacucgagaccguuaaaaucaauuuugaagugacggaugaggucauucacagccugaagaaaaucgcccuugaaaagaagaaccugucugacaaaaauaacgaugugaagaaacucuauccuaaggagaaacagcugcaggagauuuucaaacuuguuuuugggggaaagaccucccuggacaaacucuacgacaucgaagaguauaaggaacuggauaauagcgugaaaucuauuuccuucaaggagaaagucuacgaagaggugcggcccgacuaugagcagauccugagcaacuacauugaacuccuggaucuugcuaagcugguguaugacucuaucguccucgccgauaucaagaaagagggcaagacaauuuccgaaagcaaaguugagcuguacaacaagcauaaagacgaucuugcgaaucugaagaagcucgugaaaaucgacuccaagcugucugaagauaaaaagaaagagguguacuuuaccauuuucaaggaggacaaagaaaagggcacaaacuaugucaauuacacccaccgcagccaagaggggaaguccugcagcuaugaagauuucaaaaaguuucugaaaaaggagcucgagaaacuggaagacucuccuacgaagacaaccauccuugaggaacuggaccucgagacauuccugccccugcagagaaccaaggauaacuccgugguuccuuaccagauucacaaagaggagcuugugaagauccucgacaaugccgcuaaauaucauagcuuucuggccgagaaggaugacucuggauacagcacccgggaaaaagucgugcagcuguucgaguuuagaaucccguauuacauuggcccccucaacgcucaccauaauacagaaaacgggggauacuccugggccauccgcaagaagggcauggagucuguuccugugacgcccuggaauuucaaagaugucauugacgaaagcgcguccgccgaggcuuuugugaacaaucugaagaacaaaugugccuaucuuagcggggaggauguccugccuaaaaauucucuccuguacuccgaauaugcucugcuuaacgagcucaaugcccugcgguacgaaggaaacagaaucagcguggaggcccgcgacguuauugugaccaagcuguucaaggaacaaggcaagaaagucacaaagaaaaccaucaaggagcuccugaaaacagagggcuuuaucgaugggaagggagaaauugugggcaucgacaacauuguuaaaaaugaucuuaagucuuaucgggacuucaagaaaauccuggcugauaaguuugacaaagagagaguggaaaacauuauccucuggauuacccuguacggggagucccgcaagcugaucaaagagaagaucacgaaggucuauggagacuucuacacaguggaugaaauugagaaaaugagccggcuuaccuacaaggacuggggcauccucuccagaaaacugcugaccgaacucgugucugagaagcuguauaaugaagagacaggggagugccuuaacauuaucggagcgaugcgccagggcaccauucuguuuauggaacuccuggccgauaaauucgacuacaugagccagaucaagaaucacaacaaggagaauaaagaugacaucacagaaauuacgcccgauauccuggagaaccuucacgcuuccccggccguuaagcggucuauuuggcagaccgucagaaucguggaggaacucaaaacaauuaucggcugugugccuaccaagaucuucauugagacaaccaaacgcaauaacgcccccuauaaggucccuacgcugaaucggaacgaccuggugaccaaguacaaaacaaucagagaacaugagauuuuugaacucgagaaggaacugaaaaauacccuugauuucacacugaacaagaaucggcucaucaacgaggagcccagcaaacugaaggcuaccaagcuguaucuuuacuauacgcaacuggggcgcugcauguacacaggaaagaagauugaccucggcgaacuguuugauaacaauaacaaauacgacaucgaucacaucuauccccaguccaagguuaaagacgggagcuucaauaacauugugcucgucaccaaggccucuaaugacaugaaagcggauguguuuccucugaaguccaaguuccagacaaaagagaacaagaucuuuuggagauuccuuaaagaaaagaaacugauuaccgaggagaaguacaaucggcucguuagaaccgaagaguuuagcaacggagaacugacaggcuucaucacgcgccaacugguggagaccucucaggcuauuaaggucaucuccaaugugcuucgggaacugaacccggagacaaccauuuguuauagcaaagccgagaauguuucuagcuuuagacaguccuucgggaagaucaaagaagccaaccgcaaggcugagaauaacgaaaaacucaucagagugcaggagauuaaugacuacuauaacgccaaggaugcuuaccugagcaucgucgugggcaacguguaugacgucaaguuuacacggaauguucauaacuucauuaaaaauaacaaggaugcccgcagauacucucucaauggacuguucuacaccgacgugaaaaacgcgaauacgaucgccugggaaauggauaagacagugcacgucguggagaaaaccaugaacaauaacaauauucuuaucacccggcgcacauccgagcaaaagggcgcucuguaugacgccacccucuacaaggcuaaaguugccgaaaaggcgaaagaggggacauauuacccccugaagacgaccgauagcaaaaucaaggacgugggaaaauauggcggguuuacaaagauuaagaucgccuacuauuccauuuucgaauacacccuggaugggaaaaagggcaaacagaagaucacaagaauugucccuauccccaucuacauuucucagaacaucaaagacgacaaggcccuucuggaguaugcucagacccggcucccugggaaggaucugaaaauuaaguaccgcaaacucugcaucggcagccuggugaagauuaauaacuuuaauuauuacaucggaggcaaaacgaacaauaacuucaccuuugacuccgcuguucaagugauucuugauaaggacucugaaagcuauaucaaggagcuggccaaauaccugaacuggaagaaagagaauaaggaugggaaacucugggaauccaucacagaggacaagaacauucagcuguaugauucucuugucaagaaaaugaauaccggaaucuucauuagaaagacacccaacaaauacaccgaacugcucacacuggaggugaagaauaaauuuaucaacauugacaucgaugagcagguuaagcuccugcuugaaauccugaaucugcucaccaacaaaaaguucacgagcaagcugaaugagauuggcaucacagccuccagagggguguguagcuuuaaccuuucuaaucagucccaauucagcauuaucgaacagucugucaccggaguguacgagaaagaaaagcugauuaucgagaaaaagaaagagggcauccucuga

SEQ ID NO: 4387 - RNA, 4161 nt, Artificial Sequence
  Cas9 variant
augaaccagaaguacagcaucggccuggacauugggaccaauuccgugggaugggccgucaucacagaugacuauaaaguucccgcuaagaaaaugaaggugcucggcaacacggauaaacaaucuauuaagaagaaucugcuuggggcccuccucuucgacagcggagagaccgcggaagcuacaagacugaaacggaccgcccgcagacgguacacacgcagacggaaccgccuuagauaucugcaggagaucuuugccgaagagaugaugcaaguggaugaauccuucuuucagcggcucgacgauucuuuccuggucgacgaggauaagcgcggcgagagacacccuauuuuugggaauaucgcugccgaagugaaauaccaugacgaguucccgaccaucuaucaucugcggaagcaccucgcugauauuagccagaaagccgaccugcgccuuguuuaccuggcgcucgcccacaugaucaaguuuagaggacauuuccugauugaaggccagcuuaaggcugagaacacaaaugugcaggcccuguuuaaagauuucgucgagguguaugacaagaccguugaagagucccaccucucugaaaucacgguggacgcucugagcauucugaccgagaaagucuccaagagccggcgccucgaaaaccugaucgcccacuaccccgcggagaaaaagaauacacuuuuuggcaaccugauugcccucuuccuggggcuucagccuaauuuuaaaaccaacuuccaacugucugaggaugcuaagcuccaguucuccaaggacacauacgaagaggaucuggaaggacugcucggcgaggugggggacgaauaugccgaucuguuugcuagcgccaaaaaucuuuacgacgccauccugcucucuggaauccugaccguggaugacaacuccacgaaggcuccccuuagcgcgucuauggucaaaagauaugaggagcaucagaaggaucugaaaaaguucgaagacuuuauuaagguuaaugcccucgaucaguacaacgcuaucuucaaagacaagaacaaaaagggcuaugccggguacauugaguccggagugaaacaagacgaauuuuauaaguaccugaagggcauccugcuccagauuaauggcagcggggauuuccuggacaaaaucgaucgggaggacuuucuuagaaagcagcgcacauucgauaacggauccaucccucaccaaauucaucugcaggaaaugcacgccauccuccggagacagggcgagcacuaccccuuucugaaagagaaucaggacaagauugagaaaauccugaccuuccgcauuccuuauuacguggggccgcuugcucggaagggaucuagauuugccugggcggaauauaaggcugaugaaaagaucacacccuggaacuucgacgauauccucgacaaggagaaaagcgccgagaaguuuauuacccgcaugacccugaaugaucuguaccucccugaagagaaaguccugcccaagcauucccuucuguaugaaacauucacgguguacaacgagcucaccaaaguuaaguaugugaaugaacaaggcgaggccaaguucuuugacgcuaacaugaaacaggagaucuucgaucacgucuuuaaggaaaaucggaaagugacaaaggacaaacugcugaacuaccuuaauaaggaguucgaagaguuuagaauuguuaaccucaccgggcuggacaaggaaaauaaaguguucaacagcucucugggaacauaccaugaucuccgcaagauccugaauaaauccuuucuugacaacaaggagaacgcccagauuaucgaggauauuauccagacccugacgcuguucgaagaccgggagaugaucagacaacgccugcagaaauauagcgauauuuuuacaaaggcucagcugaagaaacuugaacggagacacuacaccggcuggggccggcucucuuauaagcugaucaaugggauucgcaacaaagagaauaagaaaaccauccuggacuaccucauugaugacggauaugccaacagaaauuucaugcagcugaucaacgaugacgcgcuuagcuuuaaggaagagaucgccaaggcucaaauuaucggcgaugucgacgauauugccaaugugguccaugaccugccugggucccccgcuaucaaaaaggggauucuccagucugugaaaaucguugacgagcuggugaaggucaugggccacaacccggccaauaucauuaucgaaauggcgcgggagaaccagacaaccgauagagggcgccggaauagccagcaaagacugaaacuucuccaggacucccugaagaaccuggauaauccugugaacauuaaaaauguugaaaaccagcaacuccagaacgaccgccuguuccuuuacuauauccagaauggcaaggauauguacacaggagagacgcuggacauuaacaaucucagccaguacgauaucgaccacaucauuccccaagccuauaucaaggaugacucuuuugauaacagagugcugaccuccagcucugagaaucggggcaaauccgacaacgucccuagcauugaaguggugugcgcucgcaaggccgacuggaugagacugcggaaagcugggcuuaucucccagcgcaaguucgauaaucugacaaaagccgagagaggaggccucaccgaaaacgacaaggccggguucauuaagcggcagcugguugagacacgccagaucaccaaacaugucgcucaagugcucgaugcgagauuuaaugccaagcacgacgaaaacaaaaaggugauucgggaugucaaaaucaucacgcugaagucuaaucuugugagccaguuccgcaaggacuuuaaauucuacaagguuagagagauuaacgauuaucaucacgcucacgacgccuaccugaaugccgugaucggaaccgcucuccugaaaaaguaucccaaacuggccuccgaguuugucuacggcgaguucaagaaguaugaugugcggaaauuuauugcgaagucugacaaagaaaucgggaaggcuacagccaaauacuucuuuuacagcaaccuuaugaauuucuuuaagaaggaaguuaaauucgccgauggcaccguggucgagagacccgacauugaaacauccgaggauggagagaucgcuuggaacaagcagaccgacuucaaaaucgugcgcaagguucugagcuauccucaggugaacauugucaaaaagacggaagugcaaacacauggccucgaccgggggaaaccgagaggacuguuuaaugccaaccccucuccuaagcccaagccugauuccagcgagaaucucgugggcgucaaacgcaaccuggaccccaagaaauacgggggauaugcgggcaucucuaauuccuacgcuguucuugugaaggccauuaucgaaaaaggggugaagaagaaagagaccaugguccuggaguuccagggcauuagcauccucgaucggaucacauuugaaaaggacaaaagagccuuccugcugggaaagggcuauaaagauauuaagaagaucauugagcuuccgaaauacucucuguuugaacucaaggacgggagccgccggaugcuggcuuccauccucagcaccaacaauaaaagaggagagauucacaagggcaacgaacuguucgugccucagaaauuuaccacacuucuguaucaugccaagcgcaucaauaaccccauuaauaaggaucacaucgaguacguuaaaaagcaucgggacgauuucaaagagcugcucaacuacgugcuggaauuuaaugagaaguaugucggggcuacgaaaaacggagaaagacuuaaggaggccguggcggacuucgauucuaaauccaaugaagagaucuguaccagcuuucugggcgccguuaacuccaagaaugcuggacucuucgagcugacaucucucggcagcgccuccgacuuugaguuccugggagugaagauuccucgguaccgcgauuauacccccucuagccuucugaaagacuccacacugauccaccaaucuauuaccggccucuacgaaacgagaaucgaccugagcaaacuuggggaagauuga

SEQ ID NO: 4388 - RNA, 4161 nt, Artificial Sequence
  Cas9 variant
augaccaagaucacagaggacuacauugugggccuggauaucgggacgaacagcugcggaugggucgccauggacuccaaaaauaccauucucagaaugcacggcaagacagcuaucgggucucaucuguucgaugccggaaacagcgcggcugaccggcgcgccuuuagaaccacacggcgcagaauuaaacggcgcaaguggagacuuaaacugcucgaagagaucuucgauucccaccuggccaagguugaccccuacuuuuucgcucggcuuaaggaaucuggccugagcccucucgauacccgcaaaaauguguccucuaucauuuauccgacaagccuggaggacaagaaauuuuauguggauaaccccaccaucuaccaucugagauauaagcucaugacggaagaccggaaauucgaucugcgcgaggucuaccuugccauucaccauaucgugaaguauagagggaauuuucuguacaacaccccuguuaaggcuuucgaggccuccaaaauugacgugaagggaagccucaaaaagcugaaugaacuuuacgagggccuggauucugaauuuaacgucgagcucgacuccaauaacgcgcuggagaucgaaaauauuauccgggacaaaaagaucuucaaaauuaacaaggugaaggagaucaaucagcugcucagccugaaaacagaagauaaggagcgcaccaaacuuaugaaggacguuucuaaacaaauugugaacgccauccugggcuauaagacaaaguuugaaaccauucuccugaaagaugucuccaaggacgaggcugaugacugggaguucaaacuuacggauguggacgccgauaauaaguuugaaaaccugaucggggaccucaacgagaaugaacaggagauccugcuggugauuagaaaacucgcuaacgccaucacacugagcaauauugucgaagagggaaagacccuuucugaguccaugaaggauaaauacaagaaacacagcgacgaccugaagcuccugaaacagguuaucuccgaucaccccgaccgggauaaggcgaagaaacuugcccuggcuuaugaccucuacgugaacaauagacauggcaagauucugcaggccaaagauauccuggaaaagaaaaagacacucucuaaagaggacuucuauaaggaaaucaagaaaaaccuggaugacagcaaggagucccaagaaauucuugaugcuaucagccuggacucuuucaugccuaaacagcgcaccaaugagaacggggugauucccuaccagcuccaccagcuggagcuggauaagaucauugaaaaucaaggaaaauauuacccuuuucuuaaggaggucaacccgguguccagccaucucaagcaggcccccuacaaacuggacgaacugauccgguucagaguuccuuauuacgugggcccccucauuucuccuaaugagagcaccaagaacaaacagacaaagaaaaaucagaacuuugccuggaugauccgcaaggagcaagggcagaucacgcccuggaauuucgaucagaaggucgaccggauggcuuccgcgaacaaauuuauuaagagaaugaccacaaucgacaccuaucugcuuggagaagaugugcugccggccaacucucuccuguaccaaaaauucacaguucugaaugagcuuaacaaugugaagauuaacggcaaacgcaucagcgucccucucaagcaggaacuguauaauaaccuguuuaagaaaaauuccaccgugacgacaaacaagcucaaaagcuaccugaaggagaauuauaaacuuauuaaggucgaaaucaaaggccugucugacgagaagaaguucaacuccgggcucaccaccuacaauaaacugaagaaccugaaaaucuuugaucagcagauugacgaucccaauuacaacaaggacuucgagcggaucauugaauggagcacaaucuuugaggauaaagcuauuuauaaggaaaaacuuaaaaccaucgacuggcucucugauagacaaaucgacaagcuguccaaaauucgcaugcagggauggggccagcugagcaagaaacuccugucccagcuuacagauaauaacgggcaaacgaucauugagcagcugugggacucucagaacaauuucaugcagaucgugaaccaagccgauuuuaaggacgccauugcuguugccaaucagaaccuccugguggacaccagcgucgaagauauccugaaugaggcguacacauccccugcuaacaagaaagccaucagacaggugguuaagguggucgacgauauugugaaagccaccucuggaaaggugcccaaacagaucgcuauugaguucacacgggacgccgaugacaaugcuaagaucagccaaucccgcgccaacaaacuucggaaaguuuauaaggaaaugagcaaugagcucgcgucugaaaccauuagaaacgagcuggaacgggucgccaaagaucagaagcugcucaaagacaagcacuaccuguauuucaugcagcuuggccgcgaugcuuacacgggggagcugaucgacauugauaaucucgagcaauaugacaucgaccacgugcugccccaguccuuuaucaaggaugacagccuggaaaacagagugcuugucaaaaaggccgugaauaacggaaaaucugauaauguuccugugaagcuguacggcaaccggauggcuaccgaccucggcaugacaauuagacauaugugggagaaauggaaggaacaggggcugaucaccaaaacaaaguacaacaaucucauuaucgauccggacaagauuaacaaauaugaguccagcggauucauccaccgccagcuggucgagaccucucaaaucauuaaacuugugagcacgauccugcaguccaaauaccccgauacagaaauuaucguugugaaggcccgguauaaucauuaccucagaaaacgccugaaccuguauaagagcagagaggucaaugacuaccaccaugcgauugaugccuaucuuucugcuaucuguggcaaccugcucuaccagguguacccuuaucugcggcccuuuuucguuuacgggcaguauaagaaauuuuccagcgaaccugagaaggaaaagaucauuuacgacaagacccgcagauauaauuucaucucccaaauuuuugagaacaaagauaaugacaucauuucucgggagacaaagaagaaaguguucgauaagaaagacaucauugaaaagcucaaacgcgccuacaacuauaaguacaugcuggucagcagagagaccgaaacccacgaccaggagauguuuaagaugacaguguacccccggcuuucccgcgauacgaaaaagucuagaaaucugaucccgaaaaagaaagacaugccuaccgaaaucuauggaggcuacacaaacaauagcgaugcuuauaugauuaucgcccggauuaacaagaaaaaggggcccgaguaccgcguguucggcgucccuaugagagagcucguuaaucugcggaaggccgaaaagaacggacacuauaaggcuuaccugaaacaggugcuugagcccgaaaucauguauuccaagaauggcaaaaagaacaagaccauuucuagcuuugagaucgugaaagcgaaggucccuuacaaacaggugauccuggacggggauaagaaauucaugcucgccuccagcacauacguucaaaacgcuaagcagcugacccucucucaguauuccaugcaagccauuacggacaauugcgaaaacgauacagaggaggaaaaggcccugguggaggcuuacgacgaaauccuuaccaauauugauaaauaucugccccuguuugacaucaacaaguucagagagaaacuccaugccggacgcgagaaguucgucgaucugccgcuugcggaaaagaaggagaccauucuccaggugcugaauggccugcacgacaacgcuguuaugccuaagaucaaaagccucgggcugucuacaccccuuggauuuaugcaguuccauaccggcgugucccugagcgaaaaugccaagcugaucuaccagucucccacagggcucuuugagaaacggcugaagauuuccgaucuuuga

SEQ ID NO: 4389 - RNA, 4164 nt, Artificial Sequence
  Cas9 variant
augagcgacuccaagaaauucgagggcgaaaacgugaagucuggggauaaaaagaccaauaaaaaccacggaaagguccuuaagagcucccccaaagagaucagaaagaauacagaauacuuuauuggccucgacaucgggacgucuagcguuggaugggccgugaccaacacagauuaugagauucugaaauucaauggcaagcggaugugggggucccgccuuuuuaacgaggcuucuaccgccgaagagagacggggacaucgcgugaauagacggcgcauccagagacggcgcgacagacugaaccuccuggaagagauuuucagcgaagagauggcgaaagucgauccugaguuuuucaugcggcuuaaggaauccaaguuucaccuggaggacaaagaugaacgcauccucggcgagagcaauaucauuuucaagggcucugaagacggggauaaaaaguacuaugagaaauacccgacaaucuaucaucugagacacaagcugaugcaauccugcgaggacguggauauucgggaacucuacauggcucugcaucacaucauuaaauaucgcggacacuuucuuuucaagggcgacuuugaggaaaccgggacaagcaucgagaacauuaucaucgaacugcucgagcugauuaauaacaaucuuggaguuaagaaauucgaguacaacgaaucucugaucaaugagcucaagaacauuguguccaacaccagcaauacgaucaccaacaaaaagaaacugcugggcgaauuuuucaauaagaaggaguacaaagcccauaagucucucuucauucuguccaucggggccagcgucaaacccguggaucuuuuucuggaagaggaguauaaggacaucgacgauauuaaaaacaucuccuucaagaaucucgaauacgaccagguuagagauacauaugagucuauuuuucuggacaagaucgaguucauugauguggcuaaacggcuuuacgacgccaccauccugcucagcaucaagccugaaggaaaaacacuguccgaggcuaaggucgauauuuauaacaaacaccauaaugaccuggaacuccugaagaaggugcuuaaaaccgauaaggagaaauacgacagcauccugaagcucgauauuaaaaagggcaacaauuaugugaacuacgucaaaaagucuaagaauggcaucuccuguagcaaagaagaguuucacaacgcccugaagaaaguucuugugaagauugaaaagacggacgacaucaaguacauucugaaugagaucgagcucgaaagauuccugccccugcagcgcgugaaggauaacucugucaucccuuaucagauucaccgguacgagcucaaaaagauccuggaaaaugcgagcaaaaaguuuacauuccuuaacgaggaauccgacgggcauaccaacauugagaaaaucauuaagaucauggaguauagaauccccuacuaugugggaccucugaaugaucaccauucuguuuacaacaauggcuuugccugggugagccgcaagcgguccgggagaauuacaccguggaacuucgacgaaauggucgauaaagaggaaagcgcugagcgcuuuaucgaaaaucucaccaacaagugcucuuaucugauuggagaggacgugcugcccaaagagucccuucucuacagcgaguucucucugcugaaugaacucaacaauaucaaguacgauggcauuucccugccuaucgacaucaaaaagagcauuguugaaaagaucuuucggguggagaaaaagagagucaccaaaaaguauauuaaagaguuccuuaagcaagaaggguacuccgauggaaaaggcgaggugucuggcaucgacauugauaucaagagcgaccugaaguccuaucgcgauauggucaaaaucuucgggacagaaauugacuaccggauggccgagaacaucauuaagugggugacgcucuuuggagacucuaaagaucugcugaagaccaaaaucaauaaggaauauggcgagaagguuagcaaagaccagcuuaagaaaguguguaagcucaaauacagagauugggggcgccuguccaagaaguuccugacaggcauucggagcucuguccucgugaacgacgcuaccggagagggguauacaaucauugaagccaugagaaauaccgauaacaaucugaugcagcuucugcggaacgaguacgacuaccucaaaaagaucgaucagaucaacaugcugucccgcaaagacauugaugaaaucagccacgacauucuggaugaccuuuauugcucucccgcgguuaagagaucccucuggcaaacgaucaaaauuguggaggaaaucaagaagaucaugggccaugagccuaaaaaggucuuuguggaggugacacggaccaauaaagccgauaagaaaaccacaauuaccagaaagaaccgccugcuggaacucuacagcgcuaucaaugccgagucucgggacuggguuaacgaacugaauagcacagaggucuccaaguucaacagcaaaaagcuguaucuguacuauacgcagaugggaaaauguauguacaccggcaagaauauugacaucgaaucucucuuuacagauauguaugacauugaucacaucuuccccagauccaaaaccaaggacaacagcuuugagaaucuggugcuggugacacgcaaagcuaacgccgauaagagagacgucuacccgaucgauccuaagauucagaccgagcggaaaucccuuugggacaugcuccacgauaagaaacugaucggggacaagaaauacgaucgccugacgagaaccacaggauucaccgacgacgaaaugucuggcuuuauugcccggcagcucguggagacaagccaggcuuccaaggcggccgcugaaaugcugaaacuuaucaauaacgauucugagauuguuuaugugaaagccgagaaugucagcgacuuccgccaugaaaacgaguuuaucaaggugagagaaauuaaugaucaccaucacgccaaagacgcuuaccugaacaucguuguggggaacgucuauaaugagaaguucaccaaaaaccccgccaauuacaucaagaagggaggcgggaacaauuauucccucaacugcauuuuuaaucggaaccuggaucgcaauggcaaaagaaucugggacgaaaagaaaucuauugauacggugaaccggaugaugaaaagcaaugacguucgcgugacauucaaaaacagagucgauaagggaccuauccugaauaaggugaccauucacaaagcguccgaguucauggacgauggcaagaaaaacaagaaaggguuucccaucaagagcucugagaaaaauggaaacaaucggcuuuguaaccuguacaaguauggcggguacaaggaccucaacuacucccauuauacaaucgugagauacaaugucuaugaaaagaagggacuggauauuaaauacuauaugauccccauuccuuacuaucucugccuguguaacaucaaucaacacgacuacguuuacgacuauauuagcaaccgcucuaagaaagaugugaauaacaucgagaucauugugaaugaacuuaagaugggcucccugaucaacauugacggguacaauuauuaccucggcggaagcaagccgaaaaccuucuaugucgaucccgcuuaccagaucauucuggacaaggagaucgaacggugcauuaaagagaucgugaaggccaaaaacaaugaguauagauuuaucaacaccgauaagauuaauaagaaccugaauaugaaaaucuacaaguacauuguuaacaaaaagaucauuggcguguuccgcaaccggaaaugggacaagggggaauaucuuaauucuuccgagacaaucgaaaaguuuagcggacuguccgucgagagccaauguaacgugauccucagacugauuaaugauaugcgcggcucuaacaaagggggagccaauagcaaguucgacgaacucgagaugacgaucucccgggcugagauuccucagacccugucuaacguuagcuccuuuaaaaucauuaaucagucuaucacaggccuuuucgaaaacgaggugaccaucgucuga

SEQ ID NO: 4390 - RNA, 4167 nt, Artificial Sequence
  Cas9 variant
augaccaagcccuacagcaucggccuggacauugggacaaacuccgugggaugggccgucaucacggaugacuauaaaguuccuucuaagaaaaugaaggugcucggcaauaccagcaaaaaguacauuaagaaaaaccugcuuggggcucugcuuuucgauuccggaaucacagccgagggcagacggcugaagcgcaccgcgagacggcgcuauacaagacggcgcaaucggauucuuuaccugcaggaaaucuuuucuaccgagauggcuacacucgacgaugccuucuuucaacggcuggacgauagcuuccuggugccggacgauaaacgcgacuccaaguaucccaucuuugggaaccucgucgaagagaaagccuaccacgaugaguucccuaccauuuaucaucugagaaaguaccuugcugacucuacgaagaaagccgaucugcggcucguguaccuggcucuugcccacaugaucaaguaucgcggacauuuucugauugaaggcgaguucaauagcaaaaacaaugacauccagaagaacuuucaggacuuccucgauaccuacaaugcgauuuuugaauccgaccugagccuggagaacucuaaacagcucgaagagaucguuaaggauaaaauuuccaagcuggagaagaaagacagaauccuuaagcuguuccccggcgaaaagaauagcgggaucuuuucugaguuccucaagcugauugugggaaaccaagccgauuucaaaaaguauuuuaaucuugacgaaaaggcuucccugcacuucagcaaagagucuuacgaugaagaccucgagacacugcugggcuauaucggggaugacuacuccgaugucuuucucaaggccaaaaagcuguaugacgcuauucuucugagcggaauccucaccgugacagacaacggcaccgaggccccucuguccucugcgaugauuaugcgguacaaagaacaugaggaagaucuugggcugcucaaggccuacauccgcaauaucagccuggagacguauaacgaaguuuucaaggacaacuccaaaaauggauacgcuggcuauauugauggcaagacaaaccaggaggacuuuuacguguaucugaaaaaucuccugagcaacuucgagggggccgauuacuuucuugaaaagaucgacagagaggauuuccugcggaaacagagaaccuuugacaauggaucuauucccuaucagauccaccuccaagaaaugcgcgcuauuaucgauaagcaggccaaguucuacccuuuucuggccaacaauaaagagcggaucgaaaagauucugacauucagaaucccguacuaugucggcccccuugcucgcgggaacuccgacuuugcguggagcauucggaaaagaaaugagaagaucaccccuuggaacuucgaggaugugauugacaaagaaucuagcgccgaggcuuucaucaaucgcaugaccuccuuugaucucuaccugcccgaagagaaggugcugccuaaacacucucuccuguaugagacauucaacgucuacaaugaacuuacgaagguucgguuuauugccgagagcauguccaaguaucaguuccuggacagcaaacagaagaaagacaucgugagacucuacuuuaaggauaaacgcaaggugaccgacaaggauaucauugaauaucugcaugccaucgacggauacgauggcauugagcugaaagggaucgaaaagcaauucaacucuucccuuagcacauaccacgaccuccugaauauuaucaacgauaaagaguuucuggacgauucuuccaacgaggcuaucauugaagagaucauucauacccucacaaucuucgaagaccgggagaugauuaagcagagacugagcaaauuugaaaauaucuucgauaaguccguccuuaagaaacugucucgccggcacuauaccggauggggcaagcucagcgccaaacugaucaacggcauuagagacgagaaguccgggaauacgauccuggauuaccuuauugacgacggaaucucuaaccggaauuuuaugcagcucauucacgaugacgcgcugagcuucaaaaagaagauccaaaaagcucagaucauuggcgaugaggacaaggggaacaucaaagaagugguuaagucccugcccggaagcccggccauuaaaaagggcauccuccagucuauuaaaaucguggaugagcuggucaaggugaugggcgggcgcaagccugaauccauuguuguggagauggccagagaaaaucaguauacaaaccaaggaaaaagcaauucucagcagcggcuuaagagacuggagaaaucccucaaggagcugggcagcaaaauccugaaggaaaacauccccgcuaagcucucuaaaauugacaauaacgcccuccagaaugaucgccuguaccuguauuaccuccaaaacgggaaggacauguauaccggagaugaccuggauaucgaccggcuuagcaauuacgacauugaucauaucauuccucaggcuuuucugaaagacaacuccaucgauaacaagguccucgugagcucugccuccaauagaggcaaaagcgacgauguccccucccuggaggugguuaagaagcgcaaaacccugugguaccagcuucugaagucuaaacucaucagccagagaaaguucgacaaccugacaaaagcggaaagagggggacucucccgcgaggauaaggccucuuucauucaaagacagcugguggagacccggcagaucacaaagcacgucgcucgccuucuggacgaaaaauuuaauaacaagaaagaugagaauaacagagccgugcggacgguuaagauuaucacccucaaaagcacacuggugucccaguuccgcaaggacuuugaacuguauaaggucagagagauuaaugaucuucaucacgcucaugacgccuaccugaacgcggugguggccucugcucuccugaaaaaguaucccaaacucgaaccugaguucguuuacggcgauuauccgaaguacaauagcuuucgggagcgcaaauccgccaccgaaaaggucuauuucuacagcaacaucaugaauaucuuuaaaaagucuauuucccuggcugacgggacagugaucgagaagccccuuauugaagugaacgaggaaaccggcgagagcgucuggaauaaagagucugaccuggccacggugagacggguucucuccuacccucaagugaacgucgugaagaaaguugaaaagcagaaucacggacuggauagaggcaaacccaaggggcuguucaacgccaaccuuagcucuaagccuaaacccaauuccaacgagaaucuggugggagcuaaggaauaucucgacccgaaaaaguacggcggguaugcgggaaucagcaacuccuuugccguccuggugaaaggcaccauugagaagggggcuaagaaaaagaucacaaauguucucgaguuccagggcauuagcauccuggaucgcaucaacuaccggaaagacaaacuuaauuuucugcuggaaaaaggauauaaggauauugagcucaucauugaacugccuaaguacucucuuuucgagcugagcgacggcuccagacgcaugcucgccucuauccugagcaccaacaauaaaagaggggaaauucacaagggaaaccaaaucuuccucucccagaaauuugugaagcugcuuuaucaugccaaacggaucucuaauacaauuaacgagaaucaccgcaaguacgucgagaaccauaaaaaggaguucgaagaacuguuuuacuauauccuggaguucaaugaaaacuacgugggcgcuaagaaaaaugggaagcuccugaacagcgccuuucaguccuggcagaaccacucuauugaugagcuuugcagcuccuucaucggacccaccggcagcgagcggaaagggcuguuugaacucacgucuagaggcuccgcggcugacuucgaguuucugggagugaagauuccucgcuaucgggauuacacacccagcucucuccugaaagacgccacccuuauccaccaauccgucacaggccuguaugaaaccagaaucgaucuggccaagcucggggagggauga

SEQ ID NO: 4391 - RNA, 4167 nt, Artificial Sequence
  Cas9 variant
augaccaagcccuacagcaucggccuggacauugggacaaacuccgugggaugggccgucaucacggauaauuauaaaguuccuucuaagaaaaugaaggugcucggcaacaccagcaaaaaguacauuaagaaaaaucugcuuggggugcugcuguucgacuccggaaucacagcugagggcagacggcugaagcgcaccgccagacggcgcuauacaagacggcgcaaccggauucuuuaccugcaggaaaucuuuucuaccgagauggcgacacucgaugacgcuuucuuucaaagacuggaugacagcuuccuggucccggaugacaaacgcgauuccaaguaucccaucuuugggaaucucguggaagagaaaguuuaccacgacgaguucccuaccauuuaucaucugagaaaguaccuugccgauucuacgaagaaagccgaccugcggcucguguaccuggcucuugcccacaugaucaaguaucgcggacauuuucugauugagggcgaguucaacagcaaaaauaacgauauccagaagaauuuucaggacuuccucgacaccuacaacgcuauuuuugaauccgaucugagccuggaaaauucuaaacagcucgaagagaucgucaaggacaaaauuuccaagcuggagaagaaagauagaauccuuaagcuguuccccggcgaaaagaacagcgggaucuuuucugaguuccucaaacugauugugggaaaucaagccgacuuccggaaaugcuuuaaccuugaugaaaaggcgucccugcacuucagcaaggagucuuaugacgaagaucucgagacacugcugggcuacaucggggacgauuauuccgacguuuuucucaaagccaagaaacuguacgaugcuauucuucugagcggauuccucaccgugacagacaaugagaccgaagccccucuguccucugcuaugaucaagcgcuauaacgagcauaaagaagaccuugcccugcucaaggaguacauuagaaacaucagccugaagacguacaaugaagucuuuaaagaugacacaaagaacggcuaugcgggguacaucgauggaaaaaccaaucaggaggacuucuauguguaccugaagaaccuccuggccgaguuugaaggcgcugauuauuuccuugagaaaauugaccgggaagauuuucugagaaagcagcgcacauucgacaauggcuccauccccuaccagauucaccuccaagagaugcgggccauccuggauaagcaggcuaaauuuuauccuuuccuggccaagaacaaagaaagaauugagaagauccuuaccuuucgcaucccguacuacguggggccccucgcccggggaaauagcgacuucgcuuggucuauuagaaaacgcaacgagaagaucaccccuuggaauuucgaagaugucauugacaaagaguccagcgcggaagccuuuaucaaccggaugacaucuuucgaucuguaucugcccgaggagaagguucucccuaagcacagccugcuuuacgaaacguuuaauguguauaacgagcugaccaaagugagauucauugcugaauccaugcgcgacuaccaguuucucgacucuaagcagaaaaaggauaucguccggcuguauuucaaagacaagagaaaggugacagauaaagacauuaucgaguaccugcaugccaucuauggcuacgaugggauugaacuuaagggaaucgagaaacaauuuaauagcucccucagcaccuaccacgaccugcugaacauuaucaaugauaaggaguuccucgacgauucuuccaacgaagccauuaucgaggaaaucauucauacacugaccaucuuugaggaccgcgaaaugauuaaacagcggcuuagcaaguucgagaacaucuuugauaagucuguucugaaaaagcucuccagacggcacuauacgggcugggggaaacugagcgcuaagcugauuaauggaauccgcgacgagaaauccggcaacacaauccuugauuaccucauugacgacggcaucucuaauagaaacuucaugcagcugauucacgaugacgcccugagcuuuaagaagaaaauccaaaaggcgcagauuaucggggaugaagacaaaggaaauaucaaggagguggucaaaucccuccccggcucuccggcuauuaagaaagggauccugcagagcauuaagaucguggaugaacuuguuaaggugaugggaggccggaaaccugaguccauugucguggaaauggccagagagaaccaguauaccaaucaaggcaagagcaacucucagcagcgccugaaacggcucgagaagucccugaaagaacuggggagcaagauccuuaaggagaauauucccgccaaacucucuaagaucgacaacaaugcucugcagaacgauagacuguaccucuauuaccugcaaaauggaaaagacauguauaccggcgaugaccuugauaucgaccgccuguccaacuacgacauugaucauaucauuccucaggccuuccucaaggacaauagcaucgauaacaaaguccuggugucuagcgcuuccaacagaggaaagagcgacgauuuccccucucuggaaguugugaagaaacggaagacauuuugguaccagcuucugaaauccaagcucauuagccagcgcaaauucgacaaucugaccaaggccgagagagggggccuccugcccgaggauaaggcgggguuuauccaacggcagcuugucgaaacacgccagaucacgaaacacguggccagacugcucgacgagaaguucaacaauaaaaaggaugaaaacaaucgggcuguucgcaccgugaaaauuaucacacugaaguccacccuggucucucaguuuagaaaggacuucgagcuuuauaaagugcgggaaauuaacgauuuucaucacgcccaugacgcuuaccugaaugccgugaucgcgagcgcccuccugaagaaauauccuaagcucgagccggaguucguuuacggagauuaucccaaauacaacuccuuucgcgaaagaaagucugcuacagagaaagucuauuucuacagcaauauuaugaacaucuuuaagaaguccaucucucuggccgacggccgggugauugaaagaccucuuaucgaggugaaugaagagaccggggagagcgucuggaacaaagaauccgaccuggcuacggugcgccggguucucagcuacccccaagugaaugucgugaagaaaguugaggaacagaaccacggccuggauagaggaaagccuaaaggccuguucaaugccaaccuuucuuccaagcccaagccgaacagcaaugagaaccuggugggggccaaagaauaucucgacccuaagaaauacggaggcuaugcugggauuucuaauuccuucgcgguccuggugaagggaaccaucgagaaaggcgccaagaagaaaauuacaaacguucucgaguuucaggggaucagcauucuggaucgcaucaauuaccggaaggacaaacuuaacuuccugcuggaaaagggcuauaaagauaucgagcucauuaucgaacugcccaaguacucucuuuuugagcuguccgacggaagcagacgcaugcucgcuuccauucugagcaccaauaacaagcggggcgagauccacaaagggaaucaaauuuuccucucucagaaguuugugaaacugcuuuaucaugccaagagaaucagcaacacaaucaaugaaaaccaccgcaaauacgucgagaaucauaagaaagaguucgaagaacuguuuuacuauauucuggaguucaacgagaauuacgugggagccaagaagaacggcaaacuccucaauuccgcuuuucagucuuggcagaaccacagcaucgaugaacuuuguuccucuuucauugggccuaccggaagcgagcggaagggccuguuugaacucacguccagagggucugccgcggacuucgaguuucugggcgugaaaaucccccgguaucgcgauuacacaccuagcucccuccugaaggacgcuacccuuauucaccaaagcgucacaggacuguaugaaaccagaaucgaucuggccaaacucggcgagggguga

SEQ ID NO: 4392 - RNA, 4167 nt, Artificial Sequence
  Cas9 variant
augaccaagcccuacagcaucggccuggacauugggacaaacuccgugggaugggccgucaucacggauaauuauaaaguuccuucuaagaaaaugaaggugcucggcaacaccagcaaaaaguacauuaagaaaaaucugcuuggggugcuucucuucgacuccggaaucacagcugagggcagacggcugaagcgcaccgccagacggcgcuauacaagacggcgcaaccggauucuuuaccugcaggaaaucuuuucuaccgagauggcgacacucgaugacgcuuucuuucaaagacuggaugacagcuuccuggucccggaugacaaacgcgauuccaaguaucccaucuuugggaaucucguggaagagaaagccuaccacgacgaguucccuaccauuuaucaucugagaaaguaccuugccgauucuacgaagaaagcugaccugcggcucguuuaccuggcccuugcucacaugaucaaguaucgcggacauuuucugauugagggcgaguucaacagcaaaaauaacgauauccagaagaauuuucaggacuuccucgacaccuacaacgccauuuuugaauccgaucugagccuggaaaauucuaaacagcucgaagagaucgugaaggacaaaauuuccaagcuggagaagaaagauagaauccuuaagcuguuccccggcgaaaagaacagcgggaucuuuucugaguuccucaaacugauugucggaaaucaagcggacuuccggaaaugcuuuaaccuugaugaaaaggccucccugcacuucagcaaggagucuuaugacgaagaucucgagacacugcugggcuacaucggggacgauuauuccgacguguuuauuaaagcuaagaaacucuacgaugccauccugcuuagcggauuccugaccguuacagacaaugagaccgaagcuccucucuccucugccaugauuaagcgcuauaacgagcauaaagaagaccuggcgcuucugaaggaguacaucagaaacaucagccucaagacguacaaugaaguguuuaaagaugacacaaagaacggcuaugccggguacauugauggaaaaaccaaucaggaggacuucuaugucuaccugaagaaccugcucgcugaguuugaaggcgccgauuauuuccuggagaaaaucgaccgggaagauuuucuuagaaagcagcgcacauucgacaauggcuccauucccuaccagauccaucugcaagagaugcgggcuauucucgauaagcaggccaaauuuuauccuuuccuggccaagaacaaagaaagaaucgagaagauccugaccuuucgcauuccguacuacguggggccccuugcucggggaaauagcgacuucgcguggucuaucagaaaacgcaacgagaagauuaccccuuggaauuucgaagaugugaucgacaaagaguccagcgccgaggcuuuuauuaaccggaugacaucuuucgaucucuaucugcccgaagagaagguccugccuaagcacagccuccuguacgaaacguuuaauguuuauaacgagcuuaccaaagugagauucaucgccgaauccaugcgcgacuaccaguuucuggacucuaagcagaaaaaggauauugugcggcucuauuucaaagacaagagaaaggucacagauaaagacaucaucgaguaccugcacgccauuuauggcuacgaugggaucgaacugaagggaauugagaaacaauuuaauagcucccuuagcaccuaccacgaccuccugaacaucauuaaugauaaggaguuccuggacgauucuuccaacgaagcuaucaucgaggaaauuauccauacacucaccauuuuugaggaccgcgaaaugaucaaacagcggcugagcaaguucgagaacauuuuugauaagucugugcuuaaaaagcuguccagacggcacuauacgggcugggggaaacucagcgccaagcugaucaauggaauccgcgacgagaaauccggcaacacaauucuggauuaccuuaucgacgacggcauuucuaauagaaacuucaugcagcucauccacgaugacgcgcugagcuuuaagaagaaaauucaaaaggcucagaucaucggggaugaagacaaaggaaauauuaaggagguugugaaaucccugcccggcucuccggccaucaagaaagggauucuccagagcaucaagauugucgaugaacuggugaagguuaugggaggccggaaaccugaguccaucguggucgaaauggccagagagaaccaguauaccaaucaaggcaagagcaacucucagcagcgccuuaaacggcuggagaagucccucaaagaacuggggagcaagauucugaaggagaauauccccgcuaaacuuucuaagaucgacaacaaugcccuccagaacgauagacuguaccuguauuaccuccaaaauggaaaagacauguauaccggcgaugaccuggauauugaccgccuuuccaacuacgacaucgaucauauuaucccucaggcuuuccugaaggacaauagcauugauaacaaagugcucgucucuagcgccuccaacagaggaaagagcgacgauuuccccucucuggaagugguuaagaaacggaagacauuuugguaccagcugcuuaaauccaagcugaucagccagcgcaaauucgacaaucucaccaaggcggagagagggggccugcuccccgaggauaaggccggguuuauccaacggcagcugguggaaacacgccagauuacgaaacacgucgcuagacuucuggacgagaaguucaacaauaaaaaggaugaaaacaaucgggccgugcgcaccguuaaaaucauuacacucaaguccacccuggugucucaguuuagaaaggacuucgagcuguauaaaguccgggaaaucaacgauuuucaucacgcucaugacgccuaccuuaaugcggugauugccagcgcucugcucaagaaauauccuaagcuggagccggaguucguguacggagauuaucccaaauacaacuccuuucgcgaaagaaagucugccacagagaaaguuuauuucuacagcaauaucaugaacaucuuuaagaaguccauuucucucgcugacggccgggucaucgaaagaccucugauugaggugaaugaagagaccggggagagcguguggaacaaagaauccgaccuugccacgguccgccgggugcugagcuacccccaaguuaauguggucaagaaaguggaggaacagaaccacggccucgauagaggaaagccuaaaggccuguucaaugccaaccugucuuccaagcccaagccgaacagcaaugagaaccuuguuggggcuaaagaauaucuggacccuaagaaauacggaggcuaugcggggaucucuaauuccuucgccgugcucgucaagggaaccauugagaaaggcgcuaagaagaaaaucacaaacgugcuggaguuucaggggauuagcauccucgaucgcaucaauuaccggaaggacaaacugaacuuccuucuggaaaagggcuauaaagauauugagcugaucauugaacuccccaaguacucucuguuugagcuuuccgacggaagcagacgcaugcuggccuccauccucagcaccaauaacaagcggggcgagauucacaaagggaaucaaaucuuccugucucagaaguuuguuaaacuccuguaucaugccaagagaaucagcaacacaauuaaugaaaaccaccgcaaauacguggagaaucauaagaaagaguucgaagaacuguuuuacuauauccuggaguucaacgagaauuacgucggagcuaagaagaacggcaaacugcucaauuccgccuuucagucuuggcagaaccacagcauugaugaacuguguuccucuuucaucgggccuaccggaagcgagcggaagggccuuuuugaacugacguccagagggucugcggcugacuucgaguuucucggcgugaaaauucaacgguaucgcgauuacacacccagcucccugcucaaggacgccacccugauccaccagagcgugacaggacuuuaugaaaccagaaucgaucuggccaaacugggcgagggguga

SEQ ID NO: 4393 - RNA, 4167 nt, Artificial Sequence
  Cas9 variant
augaagagaauccugggccucgaccuggggaccaacagcauuggaugggcccuugugaaugaggcugaaaacgagaaagaaaucuccaagauuaucaaacugggcguccggguuaauccccucacaauugaugagaagacgaacuucgaaaaagggcgcccucugucuaccaaugccgacagaacacuuaagcggggagcgcgcagaaaccugcagcgguacaagcuccgcagagagaaucugaucgagauccugauugauaaccacaucauuaccaaagaaacaccgcucaccgagaucggcaaggggacaaccuaucaaacgcugagccuucgggcuaaagccgugcgcgaaagaauugaccuggaggauuuugccaaggugcuccuggcuaucaauaaaaagcggggauacaaguccucucgcaaagccagcaacgacgaggaaggccaggcuauugauggcauggccaucgcgaaggagcuuuaugaaagagggaucacccccggacaguacguccuggagcuccuggaaaaugaccggaaauauauuccugauuucuaccgcuccgaccugaagcaggaguuuaacaaaaucuggaauaaccaaaagacauucuaucccgagauucucaccgaugaacuguuuaaagagcuugacggcaagaauaagucucagacaugggccaucugccagaaaccuuucaacauuaaggggaucaaaagaaucaccaagggacgggaaaagacgauugagaacuaccauuggagagugaagggccugagcgggaagcucaaucuggaaaaacuugcuaucauucugcaggagaucaacaaugauauuaaccaauccagcggauaccucggcggcaucucugacaaguccaaaaagcuguaucugaauaaagagacaguuggggaauuucucuacaagcagaucgccaagaacccccacaccagccugaaaaaucagguguucuaucgccaugacuaccuugaugaguuugaacagauuuggaagacacaaucuaacuucaaugcuaaccugaccgacgagcucaaacaggaaauccgggaugucauuaucuuuuaucagagaaagauuaaaucccaaaagagccugaucucuuucugucaguuugaguccugggagcaggaauacuucgacaaggagaccggaaaaacaaagacgcgcaccgugggccggagaguuauuccuaaaagcuccccgcuuuuccaggaauuuaagaucuggcaaaaucugaaccaccucguguucacaaauucugagaccgaugagaaaaucgaaauuaaggaggucgaacaggagauccgcaaagaacuguuugaggagcugaaccuccggggagaccugaaucccaacgaucuucugaagauucucagaagccaguucaagaucggaaaacuguccaacuggaagugcaauuuugagaaaauugagggcaaccgcacaaaugccgcgcuguucaacaucuaucagaagaucagcgacuuugaaggguacggaauugauuggaauaaaucuaacgccaagaagauccggaaagagcuuaaggcuaccuucccugaaauuggcaucgacgccuccauucucgaguuugaugcuuacaaaaagcaacugacgaaucagagcucuuaugagcuguggcaucuccuguacagcgccgaagaggacuucaaaaucuccgaacaggacaaacuuaucuauggcaacucuagcgugucccugaagaaaaagcuccaccugaaauuuggguucaaucccgaguacgccaagaugcuggcuaaccuuagccucaugucugauuauggaaaucuguccgcgaaagccauuaagaagauccugccuuaccucgaagacggccaccuguauagcgaggcuuguagacuugccggguacaaccauucuaaaucccugacagccgaggaacucgagaaguuugaacccaaagcuaagcuggaucugcuuaaaaagaauagccuccgcaacccgguggucgagaaaauucugaaucagaugguuaacguggugaaccaagucaucgacaccuacggaaagccugauggcgugcggauugagcuggccagagaacucaagaaauccgcgaaggagcgggcugaaaugaccaaagggaucgccgacggcacacgcagaaaugaggaaaucaagaaaauuaucacccagaaguucgggauucccaacccuacaaagucugaucugguucgguauagacuuuggcaggagcuggagagccgcggcuacaaagacaucuucacggauaaguauauuucccccgacaaaaucuuuucuagcgaaauugauaucgagcacaucauucccaaggcccuccuguucgacgauuccuuuagcaauaaaacccugucuuuccggaacgugaaucuuaagaaggcuaacagaacagcccucgacuuuaucacccaggacuaccaauccaaugucgaggcuuauaaagagcgcguggaaacauggaacaaggauaaucauauuagcaaagggaagagaaacaaacugcugaugucucucaaggacaucccugauggauucauugagcgggaccugcgcaauucccaguacaucgccagaaaggcgaaacggaugcuuuaugagguuuuuccgaacgaagugcuggccaccagcggcucuaucacggauaagcuccgcagcgacugggaucugauuaaugucaugaaagagcugaaccuucccaaguacaaagcucuggggcucaccgaauacgaggaaagacuggacaagggaacagaggaacucuucaagcacgaagugaucaaagauuggaccaagcggaaugaccaccgccaucacgccauggaugcucuggccgucgcguuuacaacccauaaccacauucaguauaucaacaaucuuaacgccagaaaagacauuacgcaagauaaucauccuaucaucaagaacauugagaaucugaucacagaagugaacuccaaaggcaagcggguuuucaaagcucccaugagcucuuuucgcgaguccgccaaggagcagauugaagcuauccucgugagcuucaagaauaaaaacaaggucgugaccaaaaauauuaaccagacaaagaaagaagggggcuuuaauuaccagaacgccaagaccccuagaggacaacugcacaaggaaaccaucuauggcaaauccaagcagccccuggagaaaccgguuaagauuaauaaccgguucugcaaaaagcaaguggggcuuaucaucaauuucaaggaacaggaggccguccugcaccaucucaaaaaguacgacaacaaugagaaaauugcuuuuucuaacaagacacugaaaagcgacccuauccaggugaacggaucuccccucagagaagugaagauuuucgaggaaaucuuuacgauucgcaaggauaucaauccugacaacuucaaaacccagaagcaccuggauaaaaucauugacaagggcaucaaagagguuaugaagaaacggcuugaagaguauaauggggauuuuaagacagcguucuccgaccuggauaagaaccccauuuggcucaaucagagcaaaggaaucaccauuaagagagccacaaucuccggcgucaccaacgcugagccucugcaucaggccaaagaccaccuggggaauaucauucuugaugacaacggcaaggaaauccccauugauuacgugucuacgggaaauaaccaccauguggccaucuaucaagacgagagcggcaaucugcaggaagaggucguguccuuuuacgaagcuguuauucgcaaaaaccaggaccaaccgaucauuaagaagcggcacccuaaaggguggaaguuccucuuuacaaugaaacagaaugagauguucguguuuagcucugagaacuucaaucccuccgaaaucgaucugcucgacgagaagaacgccgcgaucauuagccccaaccuguucagaguccagaaaaucgcuaccaagaauuacauguuucgccaucaccuugaaaccgaggugacaaacaaucuggauuucaccuaucggcauuuucaggccacagaguggcugagaaaccucuguaagguucgcauugaccacaucggacggauugugcaaaucggcgaauacuga

SEQ ID NO: 4394 - RNA, 4170 nt, Artificial Sequence
  Cas9 variant
augaucauuagaaccuacgagcugaagacaaucacgaccauugccauccucaaaauguuccagcugcuuacaggcgggcugagcaugaccaagcucggaaaacccuauggcauugggguggacaucggauccaacucuaucggcuuugcugccgucgaugaaaauagccaccugauucggcuuaaggggaaaacaguuaucggagcgcgccuguucgaggaaggcaaggcugccgccgacagacgggcuucccgcaccacaagacggcgccucucuagaaaccgguggcgccugagcuuucugagagauuucuuugagucccauauuaccccuacgggcccgaauuucuuuaugcggcaaaaguacucugaaaucagccccaaagacaaggcccgcuauaaauacgagaagagacucuucaacgaucggaccgacgcugaguuuuaucagcaguacccuacaauguaucaucugcgcaauagacuucugaccgaucccuccaaagccgacgugcgggaaauuuacuucgcgauccaccacauucucaagagcagagggcauuuucugacaucuggauacgccaaggauuucaacaccaauaaaguggcucuuaacgagaucuuuccugcccugcaggacgcuuaugcccaagucuaccccgaucucgacaucacguucgaugaaaauaaggugaacgaguucaaaacaguucugcugaaugagaaggcgaccccuuccgacacacagcgcgcccucgugaaccugcuucuggcugaagacggcgauaaagacauucucaagcagcagaaacaaguccugaccgaguuugccaaggcugugguugggcuuaagaccaaacugaauguggcccucggaacagaagucgauagcucugaggccacgguguggaacuucucccugggccagcuggacgauaagugggcugggaucgaaagcgcgaugaccgacgagggaacagagauucucgaucagauccgggaccuguauagagcccgccuucugaauggcauugugccggcuggcaaaacccucucucaggccaaggucgaugacuacgcccaacaccacgaagaucuggagcuuuuuaaagacuaucugaagcagcucgaagacgaugggacagcuaaggccauccggcagcuguacgacagauauaucgauggagacgaugcgaaacccuucguucgcgaggacuuugugaaggcucugaccaaagaagugacggcccauccuaacgccaagucccccgagcuccuggagcggcuugcucaaccugauuucaugcugaaacagagaaacaaggccaauggcgcuauucccguccagaugcagcaacgcgaacucgaccagaucauuaagaaccagagcguguacuacgauuggcuggccgcgccgaauccuguugagaaacaccggaaguccaugcccuaucagcuggacgaacuucucaacuuuagaaucccuuacuauguggggccccuggucacagccaaagagcaaaaggcugcccagggaggcguguucgcuuggaugguucgcaaagaucccgacgggaauauuaccccuuacaacuuugaugaaaagguggaccgggaggccucugcgaauaccuucauccagagaaugaagacaaccgacacauaucugaucggagaggauguccucccgaaacagagccugcuuuaccaacgguaugaagugcugaacgagcucaauaacguccgcgugaauaacgaaaagcuguccauugagcagaaacagcagguuaucagagagcuguuugaacggcauaauagcgugacgauuaagcaauucgccgagaaccuuagagcucacggcgacuacgcccacauccccgaaauucgcggccucgcugaugagaaacgguuucugucuucccugagcaccuacagacagcucaagucucugcuuccugacgccaucgaugaccccgccaaacaggcugauauugaaaauaucaucgcguggagcacagucuucgaggacgccgcuauuuucaagaccaagcugaaagagaucaacuggcucgauucccaaacaauuaccaagcugucuaacauccgcuauagaggguggggacaguuuagccauaaauuccugaauggccuuacgcucgggaacggacacaccauuauccaggaacuguuucuguccaauaacaaucucaugcagauccugacagacgagacccuucaaaagaaaaugacagaacugaacgccgauaagcucaaggccgcuaauauuaacgacgccaucgaugacgcguacaccagcccuucuaauaaaaaggcucugcgccaggugcugcggguuauugaggacaucaaaagagccgccgauggccaggaccccuccuggcuuuauguggaaacggcugaugggggcggaacaccgggcaagcggacccgcgccagacagcaucaacuccaggagauuuacgcgaacgcugcccacgagcugaucgacagcgccguccgcggggaacuggaggauaaaaucgcugacaaggccgauuucaaugaccggcucgugcuguauuuuaugcagggaggcagagauauuuacacagggaccccucuuaacaucgaccagcugucuuccuaugauauugaccauauccucccccaaagccugauuaaggacaauucccuggauaaccgggugcuuguucacgcuaucaucaaucgcgagaaaaacgccaccuucgcgucuacaauuuacgcccagaagaugaacgcuacguggagacaguggcacgaggccggacugaucagcggccggaaacucagaaaucugcaaaugcgcccugaccagauugauaaguacgcuuccggguuugucgcccggcagcucguggaaaccagacagaucauuaaacugacagagcaaaucguggccgcucaguaucccgagaccaagauuaucgcggucaaggccggccuuucucaucagcugcgcgaagaacucgaguucccuaaaaaccgggacgugaaucacuaccaucacgcuuuugaugccuuccuggccgcuagaaucggaacauaucugcuuaagcgcuuucccaaccugcaggccuucuuuaccuacggcaaauucaagaaagcggacguuaagaaacuccggggguucaauuuuauuagagauaucacgcacgcugaagacaagauuguggucaaggauacaggagaggugaucugggacaaaaagcgcgauguugacgaacuggaucggauuuauaacuucaaaagaaugcucaucacccaugaggugcacuuugaaaaggccgaccuguucaaacaaaccgucuacggcgccaaggacagcaaggaggcugggggcaaaaagcagcuuaucuccaaaaagaaaggauauccgguggauauuuacgggggcuacacacaggaaaccggaagcuaucugucuguugugcggcucacaaagaaggccauguacgcggucgugaaaguguccacgcgcgacgcugccaagcuggccgucgcuaaaagcaucucugagcagaaggagaaugaaacccugaacgauauuaucgacgagaaacuuuccaagauuagcaagaauggcaaaaucacacaugaacuguuugagguugugcucccuagaguggggcaaaagacccuguucaaaaacucuaaguauaaucucuuucuggucaacagcgauacauacaugcacaauuaucaggaacuuuggaugccccgggaguaccagaaaauguggaaggacaucucccugagcaaguauggagaugcccagaccgaggaccaacuggaucagauuuucggcuuuaucgugucucagguuaacuccuacuucaaucucuacgacauuaaccaauuucgcaaaaagcugaacgaugcugccgacaaauucgcgacgcuucccaugagagauaccgacgacaugcaggggaagaucgccacaauuggacagcugcucaucggccugcaggcuaaugccgcucggagcgaucucagaaaccuggacauuaaaaccccucuugggcugcugcaaaucccgaauggcaucucccucgauucugacacaagcguggucuaucagucccccaccggacugcuugaacgcgaggugcaucugucugaucucuga

SEQ ID NO: 4395 - RNA, 4170 nt, Artificial Sequence
  Cas9 variant
auggccagagacuacagcgugggccuggauaucgggaccuccucugucggaugggcugccauugacaacaaguaucaccucauccgggcgaaaagcaagaaucugauuggcguucgccuuuucgauuccgcugugacagccgagaaaagacggggguaccgcacgaccagacggcgccugucuagacggcauuggcgccucagacugcuuaacgacaucuuugccggaccccugacagauuucggcgacgaaaauuuucucgcucggcugaaguauagcugggugcacccucaggaucaauccaaccaggcccauuucgcugccgggcugcucuuugacucuaaagagcaggauaaggacuucuaccgcaaguauccgaccauuuaccaccugagacuugcgcugaugaaugaugaccagaaacaugaucuccgggaagucuaucuggccauccaccaccuugugaaguaccgcggacauuuucugaucgagggcgacguuaaagcugacagcgccuucgaugugcacacauuugcugacgccauucaaagauacgcggaauccaacaauagcgaugagaaccuccugggcaagaucgacgagaaaaagcugucugccgcucucaccgauaagcauggguccaaaagccagcgggccgaaacagcugagaccgccuucgacauucuggaucuucagucuaagaaacagauccaagccauucugaaguccgucgugggaaaucaggcuaaccucauggcgaucuuuggccuggacagcucugccauuuccaaagaugaacagaagaauuauaaauucagcuuugacgaugcugacaucgacgagaagaucgccgauuccgaggcccuucugucugacacggaguucgaguuccucugcgaucugaaggcugccuuugacgggcugacccucaaaaugcugcuuggagaugacaagacaguuagcgcggcuauggugagacgcuucaacgaacaccagaaagauugggaguacauuaagucccacauccggaaugccaaaaacgccggcaaugggcuguaugaaaagagcaagaaauuugacggaauuaacgcugccuaccucgcucugcaaucugauaacgaggacgauagaaagaaagccaagaaaaucuuccaggacgagauuuccagcgcggauauccccgacgacgucaaggccgauuuucuuaagaaaaucgacgaugaccaguuccugccuauucaacgcaccaagaauaacggcacaaucccccaucagcuccaccggaaugaacuggagcagauuaucgaaaaacagggcauuuauuacccuuuucugaaggauaccuaucaagagaacucucaugaacucaauaaaaucacggcucugaucaacuucagagugcccuacuacguggggccucuugucgaggaggaacagaagauugccgacgauggaaagaauaucccggaccccacaaaccacuggaugguucgcaaaagcaaugauaccauuacaccuuggaaccugucccaggugguggaccucgauaagucuggccggagauuuaucgagcgccugaccgggaccgacacauaucugauuggagaacccacgcuuccuaaaaauagccuccuguaccagaaguucgauguccugcaagagcucaacaauauccggguguccggcagacgccuggacauucgggcuaaacaggacgccuuugaacaucuuuucaagguucagaaaaccgugagcgcgacaaaccugaaggauuuucucguccaggccggguauaucucugaggacacccaaaucgagggacuggcugaugugaauggcaagaacuucaacaaugcccugacaaccuacaacuaucuuguuuccgugcucggcagagaguucgucgagaaucccagcaacgaagaacugcuggaggaaauuacggagcuccagacaguguuugaagacaaaaagguccugcggcgccagcuugaucagcuggacgggcucucugaucacaauagagagaaacugucccggaagcacuacaccggauggggcagaaucagcaaaaagcugcuuaccacaaagauugugcaaaacgcugacaaaaucgauaaucagaccuucgacguuccgcgcaugaaccaguccauuaucgauacacucuauaauacgaagaugaaccugauggaaaucauuaauaacgccgaggacgacuuuggggugcgggccuggaucgauaaacaaaauaccacagacggagaugagcaggacgucuacucucugauugaugaacucgcuggcccuaaggagaucaaaagagggauugugcagagcuuccgcauccuggacgauaucaccaaggcgguuggcuacgcccccaagagaguguaucuugaauuugcucggaaaacacaggagucccaucugaccaacucucgcaagaaucaacucagcacgcugcugaaaaacgccggacuuuccgaacucgucacccaggugagccaguacgacgccgcugcccugcagaacgauagacuguaucucuacuuccugcaacagggcaaggacauguauucuggggagaaacuuaaucuggauaaccucuccaauuacgacauugaucacaucauuccucaggcguauacaaaggacaacagccuggacaaucgggugcugguuucuaacaucaccaaucgcagaaaguccgauagcucuaacuaccuucccgcucugauugacaaaaugcggcccuuuuggagcguccucuccaagcagggacugcucagcaaacauaaguucgccaaucugacacgcaccagagauuuugacgauauggagaaagaacgguucaucgcccgcucucuuguggagacgagacaaaucauuaagaacguggcuucccugaucgacagccacuuuggcggggaaacaaaagccgucgcgauucgguccucucucaccgcugauaugagacgcuacguggacaucccuaagaaucgggauauuaacgacuaucaccaugccuucgaugcccugcuguuuagcacaguuggacaguacaccgaaaauuccggccuuaugaagaaagggcagcugucugacagcgcuggcaaccaauauaauagauacaucaaggaauggauucacgccgcucgccucaacgcccagucccagcgggugaacccguucggauucgucgugggcucuaugagaaaugcggcccccgggaaacugaacccugagaccggagagaucacacccgaagagaaugcugauuggagcaucgccgaccucgacuaucugcauaagguuaugaacuuucgcaaaauuacggugacccggagacuuaaggaucagaagggccaacuguacgacgaaucccgcuauccuagcguccuccacgaugcuaaaucuaaggccuccaucaauuucgacaaacauaagcccguggaucuguacgggggauuuagcucugccaaaccggcuuacgcggcccugauuaaguucaagaacaaauuucggcuuguuaaugugcugagacaguggacauauuccgacaagaacagcgaggauuacauccucgagcagauucggggcaaauauccuaaggcugaaaugguccugucucacauccccuacgggcagcucgugaaaaaggacggcgcccuggugaccaucuccagcgccacagagcuucacaauuucgaacaacuguggcugccucucgcugauuauaagcugauuaacacccuucugaaaacgaaggaggacaaucucgucgauauccugcauaaccgccucgaccugcccgaaaugacaauugaguccgccuuuuacaaagcguucgacagcauccuuucuuuugcuuucaauagauaugcccugcaccagaacgcccugguuaagcuccaggcucaucgggaugacuuuaaugcccugaacuacgaggauaaacagcaaacccuugaacgcauucuggacgcgcuccacgcuagcccugccuccucugaucugaagaagaucaaucucagcuccggauucggcagacuguucucucccagccauuuuacccuugccgacacagaugaguucaucuuucaguccgugaccgggcuguucucuacacagaaaacgguggcucagcuguaccaagaaaccaaguga

SEQ ID NO: 4396 - RNA, 4170 nt, Artificial Sequence
  Cas9 variant
augaagaacuacaauaucagccuggugcccuccccuucuggcgucggguaugccguuaccgacgauaaccucaauauuaucaaaccggugcaccaugugagcggaauuggcuccagacuguucaacgaggggucuagcaagcaggaccggcgcaauuccagaucugcucggcgcagcagacaccggcaacagggacgcaucaaagcccuuaacuccauuaugaaggaugaaaucaucaaagucgaccccacauuuuucgauagacuguaccagagcgagcucucuccucuggacaagaauaagaaauaucggaacauuaucuuugauaagcccuccguggaaagcuacuauuacaaaaaguucccuacgauuuaucaucuugagaaauaccugaucaauaccgacggcaaggcggauauucgccucaucuacugggcucugcacucucugcucacacauagagggcacuuuuauaacaccacacccguuucccaguucaagccuggagcccugaauauuaaagacaaguuuaucgaacuuaaccaacugaaucaggugaaaaccuucgaguuuagcgucgccaacacaccggagaucgaacacauucucaaggaucgguacaucucuaaacagaauaagauuaaccagcuggcugagcuucuguucgaacaagagcccgagaaagacauccagaaggccaacaccaagguggcuaaaacgauugccaaggcgauccucggcaauaaauuucagcuggaugaaaucauuggccuggacguuaacaaguccgagaaaaaggaauggagccuccagcuguccgaccuuaaucuggauucuaagaucgacgagcucagcgauucccugaccgaccaacagcuucgcauucuggaaauccuccaggagauguaugccgcuacaacccugcuggauauucuccaagggagcgacucucugcuugaugccaaaaucaaguccuacaacgaguauaaacagaauagacuccuguucuuugaccugcuuaagacacugccugauaaaaaggcucaucuccugcggcagggauacacccuguaucucaacaaucaccaucgcgaccuggccagcgcgagaaaggaucuuggcaucguggccgcuacgaacuucucuaaaacagaccuguacgcccucauuaagaaaacccugaaggacgaacccgagacaccugaaagcaaaaagguccuggggcuuaucgauaagggagaguuccucaauaaacagcggaccgaccugaacaccuacauucccuaucaacugaaugcucucauccugaacaagauucuuaaaaaucagggcaagcacuacccguuucugaucaaagaaaacccugccgagcccgauagaaaggaggccccuuaugaaauuucccagcucaugcaguucacaauccccuacuauugcgggccccuggcuacgccugaggaacaaaagaaucugccggagucuagccgcuuuggauggcuugugcggaaggaagagggcagaaucacccccuggaacuucuacaacaagauuaaugugaucgagacagcgaacgccuuuauuaaacgcuccaucggcaaggacaccuaucuccugagcgaaccuguccugcccgauaauucucuccuguaccagaaauacaagguucuuaacgagcuguccagcauuucucucguggacgcuaauaccaaaaaggaaaagaaacugacagccaagaucaaacagcugcuuuauaaggagggguucaaaaagcacgugacggucuccaagacaauggcccucaaaauccugaacgauaauaacgugccuaccagcgacauucugggacucuccaccggcaagaaauuugauaauucucugagcacauacaacuccuggaagaaggcuuuccccgagcagaucgacaauccgcauuaucggcaagaucuugaauacaugauugaguggucuaccguuuuuacagacagaaagauccugguggaaaagcucaaagagauugaauggcugcgcccugagcagaucaaguucguccuggagcaccggcuuacgggguggggaaaacucagcaagagacugcugguggaacucaaagauaacaagggcaaauccaauaucgacaaccuguuuaauaccaagaagaacuucaugcagauuguuagccagcaaguguauaacacacagaucgaggccauugcgcuuaaaaccacaaagaaucagucucuggacaacauccucgaagcugccuacaccucccccgccaaucgcaaagcuauucggcaaacgaugaaggucgugaacgagaucgucacccuggccgggaaaggaacacauccugauaagaucuuucugaccuuccagagaagcaaggaacaggagggcaaacuuacaaccgaccgcgcuucuucccugcucaagauuuaucggggcaucaaagauccccuguguacgaaggagcucguggacgaacugagcaaaaauguuagagccaaccuuauuaagacaaaggaguaccuguacuaucagcaacucgggcgggaugcgcugaccggagaaaucauugacaaaacagaucugcgcaauuacgccgugcuucacaucauuccuagaucugucgugguugacgauagcaucaacaaucuggugcucaccaaggucaaaaacgcuaaggaguccaucguggugcaguauggcagcaaaaauauuucugacaucuccaugagcguuaaggauuucuggaaccggcugcagaagcucgggcuguuuuccaaaggaaaacuuagaaaucugaccacagaccucacggaacugaaccaguacgagaaacaaggcuucauugcccgccagcuggucgagaccaaucagaucgugaaacuucuggcuacaauucuccaggggcaauuuccccauaccaaaaucaucgaagugcggcaggagcagauugccaacaucagauaucaacuggauauuuaccgccucagagaccugaacgucuauuaccggggcauggacgcguaccuugccgcugugguuggaacauaucuguacaccguguauccgaaggcccgcagauucuuugucuacggcaaguaucugaaacaggauaagaauaaccgggaagaggggcaguucaaaacgucuggacacagcuuuaauuuccucuggaagcuguuuuacggcggggaggacgaaaucuaugugcagggaacaaacaauauugcuuucaacaaaaaggaucuucugcagaaaaucaaggagguuaauaacuacaaguuucaaaaugugucccucgccaccggcacccgcagaucugaccuguucaaacagacaaucuacccucggcaggaacgcgaugucaagaaaagcagaacccucauuacaaagaaaaacgggcuguuuacggacaucuauggcggauacaccggcaaugugaacuccuauuucguucuugugcaaacaaaguacaagaaagaucccgacaaguucaaucuguaugggguccccaaccgguacguggccaugcuggagcagucuaaaagcaagggaaauuaugaaaccaaacucaaggaggugauggagccuauuaucaagaacuccaauaaacgcaugauuggcuacaagauccugaaagaucggauucuuuacaaccagaucaucgaagacaacggguauaaguuuuucauuacaagcucucaguacagacacaauuuuagacaaaugauccuguccgaucagagcaaaaagauucucauggacuaugucuucgacccgaacuuuuaccgccauaagaaaaccgaggauguuaauaacgacaaggaugcuaaacugaucaagguguaugacgaaauucucuaccagaucgaucacuaucugcagaucuucacgauuggacaucacaucgacaaacuuaagaaagcgcggccccuguuugagaagugcacccuggccgaaaaggcucaagugcucaaugauauucugaucauugccggcucuaaccagacagagcuugcccugaaaccucucaagaccacaaaacugaccuucuccaagcagaauuguccccucacaaaagacgcuaucuuuuacuaccaaagcccuaccgggaugaucacgagaaaggagucuauuaaggauauccugaaacagaacauuuga

SEQ ID NO: 4397 - RNA, 4173 nt, Artificial Sequence
  Cas9 variant
augagcagaaagaacaucguggaggacuacgccauuucccuggauaucggcaaugcuucugucggguggguugccuucacccccaacuaucggcucgugcgcgcgaaaggacacgaacugauuggcgcuagacuuuuugagccugccagcacagccgaggagcggcgcauggcuagaacgacccggcgcagauacucccggcgcagauggcggcugcgcaugcucgacucuauguucgaucaggcccugagcgaaguggacccguccuuucuuaugagacggaaguauucuuggguccaucccgaggauaaaaauaacgaggcucacugguucgggggagugcuguuugacagcaaugaacaagauaagcgcuucuacgagaaauauccuacaaucuaccaucucagaaagucccugauggaagacgaugagcggcacgacauuagagagguuuaucuggccauccaucacaugaugaaguaccgcggcaacuuucucaccgaaggggagcuggcgcccagcucuguguucgaugucgaagacuuucuuaaacugcucacagagauccugcaguacgccgaugaaggagagaccgacgaggaccuugaacugcaggcugaugccaauggccucacagaggcucugugcaccacgaagggcucccggagcauuagagccaaaaacgcgaucucuauucugaaggaaggggccgcucucuccaaacgccaggaggccaucauuagcgcuguguucgccggacuggaaggcaauaaacuugaccugaccaagguuuuuccuaacaaagaguauacacccgaggauaagaaaacccucgcccuguacuucaauaaggcugacuaugaugaaaaacggguggcgaucggggacucuggacuucuggaggauaacgaaugugacuuucucgauugcauuagacgccaauacuccgccaucgcucugaagcagcugcucggcgacuucacaagcaucuccgagucuaugugugcccgguaugaacagcaccagagaaauugggaucugauuaaacgcuacugccgggaggagagcaacgccgaaaauaucaacaagaacuauggggcucuugucggaugggagauugugggcggccaaagacgcuccaucagaggggccaaggacuacgaaaauaaaagaaaggcggcuaacaaauucuuugaggagcugauuaagggaagcgcccucccugaccaggaaaaagagcggcugcuucaugauaucgaaaaugacgagcuguucccggugcagcgcgauucuggcaacggggucauccccuaccagcuccaccugaaugaacugaagaagauuauccaaaaacagggaagauauuacccuuuucuccuggagaccuauauuaaggacggcaaagagguuaacaaacuugaagggcugcucgccuuccgggugcccuacuaugugggaccucuggucuccagagaugacaugcagagcucugauaaucgcgagaaccauuggaugauccggagaaagaagggcgugauuacgcccuggaauuuugacgaaaugguugauaaggacaaaagcggccacgaguucaucaagucccugguggggacagauucuuaccuucucggagaaaccacacugccgaaaaacagccugcucuaucaagaguuugagguccugaaugaacuuaacaaugugcgccuguccaucagaaccggcaaccacugggcugacaagcggcgcguuagacucgggcauaaugagaaaaagcugcugcuugaagaacucuucgccaagcaggcuaccgugacaaagaaggccgcggaaaaccugcugcggcgcacguacggaaacaccuacgagauuagcggccucgccgaugagaaaaaguuugucucuucccugagcucuuaugggaaaauguguagaacacuuaaggcuuccuacgugaauagccacaaagacgucguggaaaagaucauugagcugcagaccguuuucgaagacaagaaaacacucaagcaucagcugcaacugcuuggcgagcucgccgagaccaacugcgaacugcuguccaauacgcacuauacaggauggggcaaacucucucggaagcugcuuaccagcaaaguggucguguguaagaucgggaacgauuuugcuccugccaagcauuccauuaucgagauuaugcgcgaaaccgacagaaauuucauggagaucaucacagauaaagaccugggaguuggcgaauggauuaaccagcagaaugugggggcggaggauggaaacucuuaccaggacaucauugaugaccuccgggucagccccaaggugaaacgcggcaucaaucaagccauuagagugaucgaugacaucuccaaggcuguugggaaagagccuagccggauuuuucuggaacuggccggcgauguccagcagucugcuagaaccgugucccgcaagagccggcuucagggacucuauaagucugccggccugcaaaaagaguucagagaccuggccgaaucccucaacgagugcagcgauaaugaccugcgcgacgaucggcuuuuccuguacuauacacagcucgggaaggacauguacacgggagaaccccugaaccuggauagacuuucuagcgacuacgauaucgaccacauuaucccccaggcugugacccagaaugauucccuggacaaccgcguccucguggcgcggguugccaaugcuagaaaaacagauagcuuucaauaucugccugagauugccaaccgcaugcggaacuucuggcaggagcuccuggacgccggccuuaucucuagagugaaguuugaucggcugaaucgccagaacgacuucuccagccacgaaaaagagagauuuguccaacggucccucguggaaacccgccagaucaugaagaauguugcuacaauuaugagaaagcgguacgggaacucugccgcggugaucggacugaauagcgagcugaccaaagaaaugagacaguaucuuggcuucucccauaagaaccgcgacauuaaugauuaccaccaugcucaggacgcccugugucucgggaucgccggccaauuugcugucaaccggggauucuuugccaauggcauggugucugauggggcgguuaacagcuauaaucuguaccuccaggacuaucugagaggauaccgcgagaaaauguccgcuggcgagcggagacgcaacaaggccuucggguuuauugugggaucuaugaauagccaggauuccgacaaacggaucaacccgaagacgggcgaaaucgccugggaugacgaggauaaagucuaccuuagaaaggugaugaauuaucgcaagaugcugauuacccagaaagugggggacagcuucggcgcucucuacaacgaaacaagauauggaaccucugccaaggagggcgucaacgggauccccuuugauaaacacaagcaagacacagcucuguacggaggcuucuccagcgccaaaaccguuuauguggugcugauugaggcgaagaagaaaacgcggcuugucaauaucacaaugcaggaauacgccgagcugggggaucacccuucugacgacgcucuccgcgccgugcuggcuaagaaaaagcccgaauauggaaaagcccggauucuccugcggcauaucccucccaugcagcuuauucgcuacggcggcgcccugguuaccgugaaguccgcuacagagcugaacaaugcgcagcaacucuggcugccguacaaggaauauugccuuuucgaugacgucaucagcucugccaucgauguggacgaggcuagacugugucagaugcucgauguuauucuggacgccauccagaaauacuauccuaagcaacgguuugaugagaccgggcucuccgccuuccacaacgcuuuuaaugaagugagcgccgaggacaaaaagagaauugucggagaaauggugggcaugcugcaugcggaugcuaaaaacgccaaucuuaaggcccuggggauguccggacgcuggggccggaugagcaaccagucuggguacaccuucgcugacagcgaugaguuuaucuuccagucccccucuggacuguuugaaaagagaauuagcguuggcgagcucaaaaagcgccgggccagauga

SEQ ID NO: 4398 - RNA, 4173 nt, Artificial Sequence
  Cas9 variant
augaaggaggugaaagacuacaucauuggccuggauaucgggaccaacagcugcggauaugucguuacagacaagcagaauaacauucucaaacugaagggcaaaacggccaucggggcuagacuuuucaaggaaggagaggccgcggcugaucggcgcgccuuuagaaccacacggcgcagacuggcccggcgcagauggcggcucggccugcuugaagagauuuucgacgaagagauggcuaagguggauuccucuuucuuccgcagacugaaagagagcgacuacucccccaaggauucucggaaacaauuuaauagcaucguguucgaauccucugaggccgacaaggauuuuuaugacaaauacccuaccaucuaucaccuccgcaacgcucugaugcaugaugaccagaagcacgaucugagagaaauuuuccucgccguccaucacaucgugaaguaccgggggaauuuucugcgcgaggacagcguuaaagcguucaaggccgcuaaauuuacacuucagggagaggacggcauuggcccgguggauaagcugaacgaccuccugaaagaaaucuauauugaggccgcucccgaacuugccaccgauaaucuguccaagaucgaggaaauuaucaaagacaagaagcucuacaaacaggauaagcugaaacaagucgcgacacugcucaccaaggaggccgacacgaaagauaaggcuaagcugaacaaagacguggccaagcagguugcuaaugccuucaugggguacaugaucauuuuugauaccaucuucaaccuuagcgacguggauucuaaagacuauaaggucaaauucuccgacgccaauauugaugagaagcuggacacacucaccagccugcuuacagauaagcagaccgaauuugugcuggagcuccagaacaucuacaauacgauugugcugaacgaaaucgucccugacggaaaaucucuguccgagagcaugguuaagaaauaugaugaccauaaggaagaucucaaacuguucaaggcuuaccuuaauucucugacagacgugaagaaagugaaggagcucaaagcggccuauguccuguacgugaacaacagaaaggcuaaucuucuggccgccaaaaagcuccugggcaaaaaggcugauaacaugaauaacuuugagaucuucuccaaguuuguugccgacaaucuggaugacagcgaacucgcgaacaaaauucgggcuagacuggaucuuggggaguuccugcccaagcaacgcaccaaucagaacggagugaucccuuaucagcuccaccaggucgaacugacacaaauucuggagaaacagggcaaguacuaccccuuucuuaucgccccuaauccgguggaaucccaccggaacaaugcccccuauagaauuucugagcucguuagcuuccgcgugccuuacuaugucgggccccugaucgacccuaacaaugcugaguccgaacaggacaaagccaacagcucuuuugcuuggauggugcggcaaaagcagggacagaucacccccuggaauuucgaggaaauggucgauaccacagaguccgccaacaaguuuauuaaaagaaugacgaccaaggacacauaccugcucggcgaggaugugcugccggcgagcucucuuaucuaucagaaauucguuauucugaacgaacucaauaacaucaaggugaauggcauuaaacugaccagcgaggaaaagcaucaaaucuuugacgagcuguucaagguccagaaauccgugucucuuaagaaccucguuaauuuccugacagcccacggguguguggcuccuaacgucaccggacugagcgauggcacgaaauuuaauuccagcuacucuacauauauugacuaccgcaagaucuucggggccgaaaucgauaacaaagacaagcaggcugauuuugagaagaugauugagugguccaccguguucgaagaccggaaaaucuuuaagagaaaacucgaggaaauuaccuggcugacacccgaucagaucaagcaagugagcucuaaacgcuacuccggauggggccggcuuagcaagaaacugcucacccagauuacagacgagaaugggguuaacauccugcagagacuguggaaugaauccgagaaccuuaugcagauccucucugauccugucauuaaggagaagaucguggccgcgaauagcuccuucacgaaagccaccgacauggaagacauucuggcugaggccuauacaucuccccaaaacaagaaagcuauccgccaggugaugcgggucguggaugacauuaucgccgccgcucauggaaagaaacccagccagaucgcgauugaauuugccagagaggaucaggacaauccucaaaugaccaagucccggaaggcucagcuggaucagaucuacgccaaaauuagcgacgaauuucucgauaacgccguuaagaacgagcugaaaaauaugaaggacaacaaaccgcuugcuaaggauaagguguuucuguauuucaaacaaaugggccgcgacgccuacacaggcgagaagcucucucuggauaaucugcaggacuaugacaucgaucacauuuacccccaguccuuuaucaaagacgauagcuucgacaacagaguccuugugcagcgggcgguuaauaacgggaagucugauaaugugccuguccuccuguuuggaaacaaacaagcugccgaccugggcaugaccaucagacagauguggaagaaguggcucgaacuggggcuuauuuccaaacgcaaguucaauaaccugaucacggaucccgagaaaauuagcucuuauauggccagcggauucgugaaucggcagcucguugaaaccucccaggugaucaagcuggucgcuaacauucugcaagccaaacuuccugacacagagaucauugaggugaaggcgagcuacaauucuauccugagaaaggaauuuaaccucuacaaaucccgcgaggugaaugauuaucaccaugcuaucgacgccuaccugaccacaauugucggcaacuaucucuaccagguuuaucccaagcugagaccguacuucguguaugggcaguuuaaaaaguucggcaaagccgaaagcaaggaggaugacccugugaaaaagaucaagcaguuuaacuucauuuaccaacuucuguggggaaaagaugacgcuaucugcauuucccacaccgaccagcaggucuuuucucggagcgauaucaucaauaagcucacgacagccuacaacuucaaauauaugaaugugucccaagaaguuuacaccaacucuaauaacguguuuaagcagacagucuuccccauuaucgagcgcgacaccgcuaaaagcagaucccugauuccuaagaagcuggaucggcccaccgacaucuauggcggguacucuaauaacaaugaugccuaucuugcgcuggugaaaguugacaagaaaaagggaagcgaguaccgcguggucggcauuccuaugagagccgcugccaugcucaaggcuuccaaaaacuaugaugaagaccugcggaaggugaucgagcccaugguuaugcucgauaaaaaugggaaggccaaacgcggaaucgaaggcuuuagagugcuggucgggaagaugccguucaaacaggccgugcuugacggcgauaagaaguucaugcugacaggaacgaacgacaugccuaaucucaaacagcuggugcugagccaacagaacaugaaguacauucuugauuacaucgacgacauugauugucggaaacauaaguuuggcaauaaaacccaggacgggaacaagugccugcucgaggucuucgaugaaaucauucagaucguugacaaacacuuugagcuguucgauaaucgcucuuuuagagagaagcuccggaacuccagagugaacuucauuaaucuggcucuuagcaagaaagcggaagcccugcuggcuauccucaacggacugcaugccaauucuaugcgcacaaccaucaaggagcuuaaaauuuccgaccugggccggauccaaagcucugugauuucccccgaagcccagcucaucuaucagagccccacagggcuguuugagagacgcgucaaggugaaagaucucuga

SEQ ID NO: 4399 - RNA, 4176 nt, Artificial Sequence
  Cas9 variant
auggagaacaagcaguacuauaucggccuggacguggggaccaauagcgucggaugggccguuacagauacguccuacaaccuccugagagcuaaaggcaaggacauguggggagcccggcuuuucgaaaaagcgaauaccgcugccgagcgcagaacaaagcggaccucucgcagacggagcgaacgcgagaaagccagaaaggcuaugcugaaggaacucuuugccgaugagauuaaccggguggaccccuccuucuuuauccgccuggaggaaucuaaauucuuucuugaugacagaagcgagaauaaccggcaacgcuauacacuguucaaugaugcuaccuuuacagacaaggauuacuaugaaaaauacaagaccauuuuccaccucagauccgcccugaucaacucugacgagaaauuugaugugcggcuggucuuccucgcgauucugaaucuuuuuagccaucgcgggcacuuccugaacgccucccucaagggcgacggggauauccagggaauggacguguuuuauaaugaccugguugagagcugcgaauacuucgagaucgaacuuccuagaauuacgaacaucgauaauuucgagaagauucugucucagaaaggcaagucccggaccaaaauccucgaagaacugagcgaggaacugucuauuuccaagaaagacaagagcaaauacaaccucaucaagcugauuucuggccuugaggcuuccguggucgaacuguauaauaucgaggauauccaggacgaaaacaagaaaauuaagaucggguuuagagagagcgauuacgaggaauccucucucaaagugaaggagauuaucggagacgaauauuucgaucugguugagcgcgccaaaagcgugcaugacaugggccuucuguccaacauuaucgggaauagcaaguaccucugugaagcucgggucgaggccuaugagaaccaccauaaggaucugcugaaaaucaaggaacuccugaaaaaguacgacaaaaaggcguauaaugauauguuuagaaagaugacagacaaaaacuacucugccuacgugggauccgugaauagcaacauugcuaaggagcgccggucugucgacaaaagaaagaucgaagaucuuuauaaauacauugaggacaccgcccugaagaauaucccggaugacaacaaggauaaaauugagauccucgaaaagaucaaacugggcgaguuccuuaagaaacaacugacagcuagcaaugggguuauucccaaccagcuccagucccgcgaacugcgggccauccugaagaaagccgagaauuaucucccuuuucugaaggaaaagggagagaaaaaccuuaccgugucugagaugauuauccagcuguucgaauuucaaauucccuacuaugugggcccucucgacaagaaucccaaaaaggauaacaaagcuaauagcugggcgaagaucaagcagggcgggcgcauucugccuuggaacuucgaggacaaagucgaugugaagggauccagaaaagaauuuaucgagaagaugguucggaaaugcacguacaucagcgacgaacacacacugccgaagcagucucuucucuaugagaaguucauggugcugaacgagauuaauaacaucaaaauugauggcgaaaagaucuccgucgaggccaaacagaagauuuacaaugaccuguuugugaaagggaagaagguuagccaaaaagauaucaagaaagaacucaucucucugaacauuauggacaaggacuccgugcuuagcggaaccgauacagucuguaaugcuuaccuguccucuaucggcaaauucaccgggguguuuaaggaggaaauuaacaaacagagcaucgucgacaugauugaggauaucaucuuccucaagaccguguauggagacgagaagagauucguuaaagaagagauuguggaaaaguacggcgaugagaucgacaaagauaagauuaaacgcauccugggcuuuaaguucuccaauugggggaaccugucuaagagcuuucuugagcucgaaggagccgacgucggcacaggggaggugcgguccauuauccagagccugugggaaacgaauuucaaccugauggagcuccugucuuccagauuuaccuauauggaugaacuugagaaacggguuaagaaacuggagaagccccucagcgaauggacaaucgaggaccuggaugacauguaccugucuuccccugugaaacgcaugauuuggcaaagcaugaagaucgucgaugaaauucagaccgugaucggauaugcccccaagagaauuuucguggagaugacacggucugaaggcgagaaaguuagaaccaagagccgcaaagaccggcuuaaggagcucuacaaugggaucaaagaagacuccaagcagugggucaaggagcuggauagcaaagacgaaucuuauuuuagauccaagaaaauguaccuguacuaucuccagaagggccgcugcauguacagcggagaggugauugaacuggauaaacuuauggacgauaaccuguaugacaucgaucacaucuacccuagauccuucgugaaggacgauucucucgacaaucugguccuggugaagaaagagauuaacaaucggaagcaaaacgaucccaucacgccgcagauucaggcuagcugucagggcuuuuggaaaauccuucaugaccaaggguucauguccaacgagaaguauucucgccucacaagaaaaacccaggaauuuagcgacgaggaaaagcuguccuucauuaaucggcagaucguugagaccggacaggccacaaaaugcauggcgcaaauccugcagaagucuaugggcgaggauguggacgucguguuuagcaaggcucgccucguuuccgaguucagacacaaauucgagcuguuuaagagccggcuuauuaacgauuuccaucacgccaaugacgccuaccugaacaucguggucggaaauucuuauuuugugaaauucacccgcaacccugcuaauuuuauuaaggaugcccggaaaaaccccgacaauccuguuuacaaguaccacauggauagauucuuugaacgcgacgugaaguccaaaagcgaggucgcuuggaucgggcagucugaaggcaacuccgggacaauugugaucgugaagaaaacgauggccaagaauagcccccucaucaccaaaaaggucgaggagggccauggaucuauuacaaaggaaaccaucguuggcgugaaagagauuaaguucgggagaaacaaaguggaaaaggcggauaaaacacccaagaagccuaaucugcaggccuaucggccgaucaaaaccuccgacgagagacuguguaacauucuucgcuacggaggccggacgagcaucuccauuagcggguauugccuggucgaauacgugaagaaaagaaagaccauccgcucucucgaggcuauccccguuuaucugggacggaaagauagccucuccgaggaaaagcugcuuaauuacuuuagauauaaccugaacgacggcgggaaagauucugugagcgacauucgccucugucugccuuucaucuccacaaauucucuggucaagauugacggcuaccuuuacuaucugggaggcaagaacgaugaccggauccaacucuacaaugccuaucagcugaaaaugaagaaagaggaaguggaguacauuagaaagaucgaaaaagcuguuagcauguccaaguuugaugagaucgaccgcgagaagaaccccgugcucaccgaagagaaaaauauugaacuguauaacaagauccaggauaaauucgagaauacagucuucucuaagcggaugagccuugugaaauacaacaagaaggaccuguccuuuggggauuuccucaaaaauaagaaaagcaaguuugaggaaauugaccuggagaaacaaugcaagguucuguauaacaucauuuucaaucuuucuaaccugaaggaaguggaucucuccgacaucggaggcagcaaaucuaccgggaaguguagaugcaaaaagaauaucacgaacuacaaagaguuuaagcugauucagcaguccaucacaggacucuacagcugcgaaaaagaucugaugaccauuuga

SEQ ID NO: 4400 - RNA, 4176 nt, Artificial Sequence
  Cas9 variant
augaaggagaucaaagacuacauuaucggccuggauauugggaccaacagcugcggauauguggucacagacaagcagaauaacauccucaaacugaagggcaaaacggccauuggggcuagacuuuucaaggaaggagaggccgcggcugaucggcgcgccuuuagaaccacacggcgcagacuggcccggcgcagauggcggcucucccugcuugaagagaucuucgacgaagagaugaauaagguugaucccagcuuuuuccgcagacugaaagagucugacuacuccccuaaggaucggcgcaaacaauuuaacucuaucguguucgaaagcuccgaggcugacaaggccuuuuaugaaaaauacccgaccauuuaucaccucagaaaugcucugaugcaugauaaccagaagcacgaccugcgggagaucuuccucgccgugcaucacauugucaaguaccgcggcaauuuucugagagaggauucugugaaagcguucaaggccgcuaaauuuacacuucagggggaagacggaaucggccccguugauaagcugaacgaccuccugaaagagauuuauaucgaagccgcuccugagcuugccaccgacaaucugagcaagauugaagauaucaucaaagacaagaagcucuacaaacaggauaagcugaaacaaauugcgaaccugcuccccaaggccguggacuccaaagauaaggcuaagcugaauaaagacaucgccaagcaggucgcuaacgcccuuaugggcuacauguuccggcuggauacacucuuuagcuucaccgacguggauguuaaagacuauaagcugaaauucucugaugccaauauugacgagucccuugacgcucugacgagccuccugaccgaugcgcagaucgaguuugugcuggaacuccagucuauuuacaacacaaucguccugaaugagaucgugccugacgggaugucccuuagcgaaucuauggugaagaaguaugaugaccauaaaaaggaucugaaacucuacaaggaguauauugacucccugagcgaucaaaagaaggccaagcagcuugaagcugccuacgcccuguaugucaacuacagaaaagcugaccuccuggccgcgaagaaacuguucgagaagaaaaagaucggagauaaaaaguuuguugacgugauuuccaacuucgagguguuuggcaaguucgucucugauaaucucgacgauagcgaacuggcuaacaaaaucaaggcccgccuugaccugggggaguuucuccccaaacagcggaccaaucagaacggagugauuccuuaccaacugcaccagguugaacugacacagauccuugagaagcaaggcaaauauuacccguuccucaucacccccaauccuguggaaucccacagaaacaaugcccccuaugagauuagcgagcuggucucuuuucgcgugccuuacuauguugggccccugaucgacaaccaguccauuaaggauaagcagaauaaaaacaaguucgcuuggauggugcggcagaaacaaggacagaucacgccguggaauuuugaagagauggucgacacaaccgaaagcgccaaccaguucauuaagagaaugacacgcaaagauaccuaccuccuggcugaggacgugcuuccuaagucuagccugaucuaucagaaguuuaugauucucgaugagcugaaucggaucaaaaucgacggcaagaaacugaccuccaaacuuaaacaugauauuuucgaaaaacucuucaagaaacaaaagucuaucaaccuggacaaucugaaaaacuaccuccuggccgagggcaacauucccgggcuuaucgaaggacugagcgauggcauuaauuuuaacaauuccuucagcacauacaucgacuauagaaacaucuuuggggaugagauugacaauccuaacaagcaggcggauuucgaaaagaugaucgaguggucuacggucuuugaggaccgcaagauuuucaaacggaagcucaaggaaaucaccuggcugacacccgagcagauuaaacagguguccagcaagagauacucuggauggggccgccuguccaaaaagcuccuuacccaaaucacagacgaaaaugggguuaacauccugcagcggcuguggaaugagcccgaaacccucacggaggugcuggccaacccugucauuaaaagaaagaucagcgaggcuaauucccuuuuugugcagauuaacaagguugaaaauauccuggaugacgccuauacaucuccgcagaacaaaaaggcuauucggcaagugauccgcgucguggaugacaucauugccgcggcccacggaaagaagcccagccagaucgcuauugaguucgccagauccucucagaauaaagcuaaggugccugauacccggaagaaacaacucgacaagaucuacaacaaaauuagcuccgaaauccuggauagcucuauuaagaacgagcugaaaaaucuuaaguccaacaaguaucucagcaaagacaagcuguuucuguacuucaaacagaugggcagagaugccuauaccggcgacaagcucucucuggaucagcuucagaauuacgacaucgaccauaucuuuccccgcuccuucauuaaagaugacagccuggauaaccggguucucacacaaaagccuaucaaugccaagaaaucugacuacgggauucccgcucuggaauuuggaaacaaguaugucccggaucugggcaucaccgugaaagagauguggaaacuuuggcaggagaaugggcugauuagcaaauccaagcucaucaaccuguguacaaauccuaaaaagaucggaagcaagagagcgucuggcuucauuaaccgccagcucguggaaacgucccaggucaucaaacugguggccauuauccuucaagcugaguuccccgacaccgaaauuaucgagguuaaggcccugcagaauacaacccucagagagagcuuucaccuguacaaaaaccgguccgugaaugauuaucaccaugccaucgacgcuuaccugacaaccauugucgggaacuaucuuuaccagguguauccuaagcugcgccccuacuucguuuacggccaguuuaaaaaguucaaucaagaaaagaacaucgauauucucaaaagacugaagaacuuuaauuuccuccggcagcugaucuuuaacacggacgauaauauuuauaucucuggaaccaaagagauuguguucaacaagaaagacaucauccacaaacuugaaacagccuacggcuauaaguacaugaauauuagccgcgagugcuaucaggaaaccuccucucuguuuaaccaaacacucuacgcgcauaauagcuccgucaagaacucucugaucccuaagaaaaaggggcugcccaccgagauuuauggaggcuacagcgggaauaaagauuccuucuuugugcuuguuaagaucgugaagaaaagaacgaaccuguaccggauugucggaaucccgacacgcgagcucgcuaagcugaauagcucuaacaauuauaaccaggcccucaauaaaaucguggaauccaagcugugucuuaaagagaccgagagcuucaagauucugaucaaaagacugcucuacggcacacugauuguggacaacgggcagaaguuccggaucggcucuuuuaaggaaaaacacaauguccagcaacuuguucugcagcucaaguccaugaaauauauuaaguucuacaucgacggaggccagaacuauuuuaccgauguggaacgcaaaaagcuggagaagcaggacagagauaaaugccuccuguacguguucgacgauaucaugaacgucgugaauaagcgguuuacccuuuucgacaugagcaaauaugagaaggauggggacucucugagagaaaaauuuaacugucuggauuucaaugacaagguuuccauucucagcgaucugcuuaaggccuuucaugcuaacuccgaccgcacaagcaucacgaaacugaagauuaccaaucucggacggcaccaagccggcaaaaacgggaucacacugaccacaaaugcgcagauuaucuaccagucuccuaccggacucuucgagagacgcauuaagaucaaagaucuguga

SEQ ID NO: 4401 - RNA, 4176 nt, Artificial Sequence
  Cas9 variant
augaagaaaauccugggccucgaccuggggaccaacagcauuggaugggcccuugugaaugaggcugaacacgagcaugaacaguccucuaucgucaagcugggcguuagagugaacccccucagcguggaugagaaaacaaauuucgaaaaggggcggccucuguccauuaacgccgaccgcacgucuaaaagaagcgcgcggcgcaaucuucaaagauuuaagcugcggcgcaagaaccucaucaaucugcugcucaaacaccauauuaucuccaacgagaccauccugacagaggucggaaagaauaccacacaccagacccuuaaacugagaucuaaggcuacacaggaaaagauuagccucgaggaauuugcccggauccugcuuuccauuaacaagaagcgcggcuacaaaagcucuagaaaggagaaaaaugaggaugaaggguucaccaucgacggaauggccauugcuaaggagcuguaugauaaccagcucacgccgggccaauacguguauaauauccugcaggacggcaaaaacuacauucccgauuucuaucgguccgaccugcaggccgaauuugaugacguuuggcaguuccaaaagaaauuuuacagcucuauccucaccgaugaguucuaucugaagcugaaggggcagggaaaagaaaauacacgcaagcuguuucucgcuauccaucagguguacaccgccgagaacaaaggcaagagagacgcggucaaacugcaguacuauaaguggcgguccgaggccgugaagaaacaacuuagcauugaagagguugcuuacgugcuggucgaaaucaacaauaacauuaauaagucuuccggguaucucggagccaucagcgaucgcuccaaagcucuguacuucaacaaugagacagugggcgaauaucuguacgggcagcucgugaagaacagacacaauucucugcggaaccaggucuuuuauagacaagacuaccuugacgaguucgagaaaauuugggaaacccaggccaaguuuuacgaugagcugacgaaugaacucaagcaggagauccgcgacguugugaucuucuaucagcggaaacuuaagagccaaaaacaccuuauuuccgauugccuguucgaaaagcaucacaaagcgaucccuaagagcucuccccucuuucaggaguucaagauuuggcagaaccugaauuaccuggaguuugugcauacacaguccaaagaaaagaucuucuuuagcgagcucgacgaugaaaccagacaauucgucuuugccgagcugaacauucgcggaacacuuaaaaucaaggagaucaaaaagcugauuggccucgaaaccccuguguauuggaaaucuaauuucgacgagaucgaaggcaaccggaccaaucagguucuguacaacguguaucagaacauugcugaugaccugggguacggauuugauuggagcaagaagcacgccuucgagaucaaugcugaacuucaggccauuuuuaaagacgucggcaucgauacagccauucucaacuucgacgcuuccaucgaggagaaugacuuugauaagcaaaaaucuuaucagcuguggcaucugcucuacagcgcggaagacacggauaaggccaccgaggaagacaaacugaucuacgggaacauuaauacaaagcugaagaaacagcugcaccagaaguauggauucgaggcuaaauacggcaaccuccuggccaauaucucccugcaacaggauuaugggaaccuuagcgccaaggcuauuaaaaagauccuccccuaccuggaaucuggaaauuccuucuaugaggccuguaccauugugggcuacaacccuagcaauucucugacaaaggagcagcaacagaacagaaaacucaaggacaaacuggaacuucugccgaaaaauucccuccgcaaccccguuguggagaaaauccugaaucagaaggucaaccugaucaaccagcuuauugaugaauauggcaagccugacgaggugcggaucgaacucgcgagagagcugaaaaagagcgcuaaacaacgcgccgaucuguccaagcacauuaaugacgccacccucaaaaaccagaauauccggaagacgcugcagaaagauuuugggauucagaaccccucuaagaaugacgucaucagauacaaacuuuacgaugagcugaaagacaacggauauaagacacucuucaccaauaaauacaucccuaaggaacaacuguuuagcaaagacguggauauugagcauaucauucccaaggcuauccuguucgacgauuccuuuucuaacaagacccuugccuaucgcaauguuaaccucgcuaaagccgacgcgacagccuucgauuuuauuagcuccaagcaccuggacgaucuggacaauuacaaagcucggguggaaacccucuuccagagcaagagaaucucuaaaggcaaguauaagaaacugcuuaugacacggcagaaccugccggaggauuuuaucgagcgcgaccucagaaauucccaguacauugccaagaaagcuacggccaugcugaaggaagucuuccggagcgugguuccuaccucugggagaaucacagauaaacugcgcgaggacugggaucuugugaacgucaugaaggaacugaaucuccccaaguaucggacccugggacucacagaguuuauugaacgcaaaaacggcaacaagaucgagcaaauuaucgacuggaccaaacgcaaugaccauagacaccacgcgauggaugcccugacgguggcuuucaccacacauaaccacauucaguaccuuaauaaccugaaugugacccaugggcucaacggcguugacacagaucacgagaagucccggcuguacgccaucaaacaggcuaucaccaaggucuauauugugggaaagacgaaaaagcgcaaauuuaucccucccauggaaaauuucagaagccacgccaagaaccaucuggagggcauucuuaucucuuucaaaaauaagaacaaaguggucacaaagaauaagaaccggaccaaaacaaagaccaaagggguguuuaaugaaaagauucaacugacccccagaggacagcuccacaaagagacaaucuacggccaugccaagaagguuaucgugacgaaagaaaaggucagcuccaaauucacccacgagaagauucuucaggugacaaaaccugcuuauagagaggcgcuccugaagcggcuugccagcuuuaagaacgacccgaaaaaggcuuucucugggaaaaaugcccuguccaagaacccccucuacuuugauaucaccagcggaaagaagguuccugacacagugaagcuguccuauuucgaaaauucuuacgucauucgcaaagaggugaacagcgauaacuuuaagaaugaaaaaucccugcagaagguucuugacgugggcaucagacggauucuggagaaacgccucgccgauuauaacgggaaugcuaaggaagccuucucuaaccuggagaaaaaucccaucuggaaggacaaggagaaaggcgucugcaucaagaaagugagaauugaagcgcucaagaacgcugagccucugcaugugaaaaaggaucaccuuggaaagaucauucuggacgacgaaaauaaaagcacccccgucgauuuuaucuccacgggcaacaaucaccauguugccauuuacgaggacaaggaugggaaacugcacgacaagguggugucuuucuacgaggucgugagccggguuaaccucggacugccgaucauugauaaauccuuuaauagccaucuugacuggaaguuccuguucucuaugaagcaaaacgaaauguuuguguucccuuccgaggauuuuaaucccaaagaaaucgacaucggcaacccuaagaauaacgagcucauuagcaaauaucuguucagaguccagaaguuuucuaaagugacauacgggaacuccgccguucgcgauuauguguuccggcaccaucucgaaaccgagcugaucgacaagaaggagcuuaaaggaauuaccuacuaucagcucaagagcaucggcaugcuggaaaaacuggucaaggugagaauuaaucacaucgggaaaaucguucacauuggcgaguacuga

SEQ ID NO: 4402 - RNA, 4176 nt, Artificial Sequence
  Cas9 variant
augaagaccauccugggccucgaccuggggacaaacagcauuggaugggcccuugugaaagaggcugaaaaugagaacgaagucuccgauaucauuaagcugggcguuagagugaauccccucacgguggacgagcugaccaacuucgaagggggaaaagccuacucuaauaacgcggagcggacacuuaagcgcggcgcuagacggaaucugcagcgcuauaaacucagacgggagaaccugaucgaaauucugcucaagaaugggcugaucaacaaggauaccgcccuuacagaggucggaaaagaaaccacacaccaaacccugaagcuccgcagcaaauccgccaaugagaaggugucucuggaggaccuugcuaaaauccugcucagcauuaacaagaagagaggcuacaaauccucucggaagguuaaugccgaagaugacggcguggcuaucgaugggauggaggucgccaaacugcuguaugacgaaaacaugacgccuggagaguacgugcuccgccugcuugaaagcggcaagaaacaucugccggauuuuuauagauccgaccuccaggaggaguucaaucugguuuggaagaaacagagcgaauuuuacccccuuauucugaccaaggaacucuucuuugaacugcacgggaagaacaaaucucagacaugggcgaucugcaaggagccucugggaauugugggcgucaaacucaagggguccgccaaagaacaaaaguucgcucgguaucgccugagaaaggaggcccuuacccagcagaucgagcuggaacaucucgcuauugugcugcaggauaucaacaaugacagcaacaaaucuuccggauaccuuggcgccaucagcgaucggucuaaggagcuguuuuucaauaaagaaacagugggccaauaccaguauaagcagcuccagaaagaccccaacaccucccugaagaaucaagucuuuuaccgccaggacuaucuggaugaguucgaaguuauuuggagaaaccaggcgaaguuuuacccucaacucacgaaugagcugaaacaggagauccgggacguggugauuuucuaucagagaaaacuuaaaagccagaagaaccugaucuccuuuugucaauucgaaucuacacagcagaauuacgucgagaaagaaaccgggaagacaaagauucgcaccaucggacggagagugaucccccgcagcuccccucucuuccaggaguuuaaaauuuggcaaagccugaacaaucugaaguucguuaacucugaguccaaucagaucauucaguuuaucgaacuugaggaugacgugaaaaaggucguguucgaugaacucaaccugcggggcgaccugaaaccgaaucagguucucaagauucugagcaaauauaugaagaucgggaaacuuacccaauggaagugcaaccuggaggaaaucgagggaaacagaacaaauucugcccucuacaacguguuucagaugauugcugaggaagagggcuacggguucaauuggggaaagaaaagcgcccuggaaaucaaguccgagcugaaagcuauuuucucuagcaucggcauuaacgauuccauccuugacuucgauuuuagcaagaagcucgaccagcagcugucuuaucaacuguggcaccuccuguacuccgccgaagagggcaauagcaaaauuacggaggaagauaaguucaccuaugggaacacaggagucgcccuuaaaaagaaacugcaucucaaguuuggcuucaagcccgaguacucuacccugaucuccaaucugcgcuuuacaagcgacuaugggaaccuuuccucuaaagcuaucagcaagauucucccuuuccugcgggacggauccgauuacucuaaagcgugucaguaugccggcuacaaucacagcaacucccugagcgcugacgaacucgauaauagagagcugaagcccaaacuugaacugcucaagaagaacucucugcgcaauccuguggucgagaaaauccugaaccagauggugaauguugugaaccaagucauugacaacuacgggaagcccgaugaggugcggaucgaacuugccagagagcucaaaaaguccgccaaagaacgcagccagaugaccaagaauauuucugacgcuacgcggagaaacgccgagaucaaaaaguaucuguccaaggaguucggcaucccgaauccuacaaaaggagauguuauucgguaccgccugugggaggagcucgcgagcaacggcuauaaggaccuguuuagagauaaauacauccccaaggaaaaacuuuucucuaaugagauugacaucgaacacauuaucccuaaggcucugcucuuugaugacagcuucuccaacaagacccuggccuuuaaaguggauaaucugaagaaagccgaccggaccgcuuucgacuuuaugagcacagauuucucuaaggacgucgauuccuauaucgggagaauugagacccuucauaaagacggaaagaucagcuccucuaaguacaaaaagcugaugauucccaaaagcaagcucguggauggcuuuaucgagcgcgaccugcggaacacacaguauauugccaaacaggcuagaaagaugcuccuggaaguguucaagacgguuguccccaccacagggaaaaucaccgauaaacuucgcgaggacugggaucugaucaaugugaugaaggaacucaacuuuccuaaguacaaagcccugggacugacaaagaagauugagagauucgacgugggcuccgaaaagaucaagucuauuaaugucaucgagggguggagcaaacggaacgaucaccgccaucacgcgauggacgcccuugcuguggccuuuaccacgcacaaucauauucaauaccugaacuaucucaaugcuagaaaggauauccaccaugagaugcacggcaccauuaaauccaucgaaaaccagaucauuggaaaggacguuaugggcaaacggcgcuucaucccgcccauuucugaccugagaaugaaggccaagcuccagaucgagagcauucugaucuccuucaaaaacaagaauaaaguggucacauggagcgugaacaagaccaaacuuaaggggaaggauaauuacaacaaacggcgccagcugacaccuagaggacaacuccauaaggaaaccguuuauggcaaaaucaagcugauugaccccaaaccucugaaacuuaauaacaaguuuacgcuggugcgggcgucuaugaucgucgauaaggugcaccgcgagauuguucuccagcaccuguccaaguacgacaauaacagcgaaguggccuucgauucuaaaacaaucaagauugaccccauccucaucgaggggauuggacugaaagaggucgugugcuaugaagauguguuuaagaucagaaagaaaauuuccggcgacaauuucaagaacgagaaacaucuugaaaaggucaucgaugagaaaguuaagcagauucugaaagaccgggugaucaaguuucaggggaauuucaaggaggcuuuuagcaaccuggaagagaauccgauuuggcucaacaaaucuaagggcaucgccgugaaauccgucgcuaucaagggagugaauaacgccgaaagccugcacgagggcaaagaucauuucggggaccaaauucuugacaagaauaagaaacagaucccuguugauuuuguguccaccggaaacaaccaccacgucggcauuuacgaagacaaggaugggaaucugcaggagagagugguuagcuucuuugaggccgugacacgcgucaacgaaggacuccccaucauugacaaaaccuauaauucugauaucggcuggaaguucaaauucaccaugaagcaaaacgagauguuuguguucccuagcgacgauuuugaccccaaugaauuugaucugacagacgggaagaacgcugcgaaaaucuccccuaaucucuaccggguucagaagauugccacgaaaaacuacauguuuagacaucaccuggagaccguggucacaaaugaucuugaguucaccuauaagucuauccgcagcacaggcuggcugcggaaccuggugaaagugagaauuaaucaucucggagaaaucgucuacguuggcgaguauuga

SEQ ID NO: 4403 - RNA, 4176 nt, Artificial Sequence
  Cas9 variant
augaagaaaauccugggccucgaccuggggaccacaagcauuggaugggcccuugugaacgagaaggaaaauaacgaggaacuguccucuaucauuagacucggcguccggguuaauccccugacgguggaugagaaaagcaacuucgaaaaggggaaagacaucaccacaaaugcugaucgcaccaagugcagauccgcccggcgcaaccuucagagauuuaagcugcggcgcgaggcgcucgcugacugucugaaaagacacggacugaugacagaugagaccccucucugcgaaacaaauaacucuauuaucuucaagaccuacagcaaucgggccaaagccgugugugagaagaucgcucuggacgauuuuguccgcgugcuuuucaugauuaacaaaaagagaggcuauaaguccucucggaaacugaauacggacgaugaagggacccucguugacggaauggauguggccaagcugcuuuacaacgagcaaaucacaccgggcgaguaucugcuccgccuguuuaaaaagggcaaaaagaccagacccgacuucuaccugagcgaucucaaagcugaacuggagcggauuugggacuuucagcgcacauucuauccugaaauccuuugcaaugcccugaaggaggaccucaaggggaaauccagaacccagagcucugcgaucuuuuacgccaaguauaaagucuccacggcuaagaucgccggaaaagauaagcggcugcaggaacuuacauggagaaccgacgcucugcgcaagcaacucacaauugaugagguggccuacguuaucuguagcaucaacggcgaggugaaugggucuucccagcggcugagcaugauuucugacagauccaaacugcucuacuucaaccaucagaccaucggacaguaucugaugcaacgccuugaagagaaccccaaugcgggccugaagaacauuaucuuuuaccggcaggauuaugaagacgaguucaaugauauuuggaacagccaggccaccuaccacaaagaacucacaccugagcugaagaaagaggucaaggacaucaucuuuuaucagagagggcuuaaguccugcaaauggcugauuaauuacugugaacucgagcaugaagagaucgaagugaagacgcccgagggaaaacugcgcaagauuaccaucggcucuaaaacaugcccuaagagcuccccgcuguuccaagaguucaagauuuggcaagugcucaacaaucugcaggucagcccccuuaacucucggagaaaagcuaagcgcaaaaaggaugaggaaccuucccuguuuagcgacgaagauaugaauaccgccugucgguaucucaacgaggaggaaaaacugacacuguucaaggagcuuucuaucaaaaaggaacucaagaaaaaggacgcucugaaacugcucuuugagaauuacaaggaacuggaccuuaacuacaaaguuaucagcggcaaugugaccauggccaaccuguauagagccuuccaggauauuaucucccucacggggaauggagaguuugacuuccaggcuaugcccgcggaggaagccgagaagacaguggaagagauuuuuggcgggcugggauacaagaccgcuuuccugcacuuugaugccucucuucaugacaaagaguucgaacgccagccugccuaucggcucuggcaucugcuguacagcuaugcuggcgaucaguccaagaccgggaucgaggcccucgucaaacggauucaagaacugugcggauuugagcccgaauacgcgcggauccuugcuaacauuagcuucaucccggacuauggcaaccugucuuccaaggccaugcgcaaaauccucccuuacaugcaggauggcuacgaguauagcgaagccuguucuaaggcuggguacagacacuccgccagcucccugacaaaggaggagauuaauaaaaagaacuauaaaacccaccuggacgaaaucaagagaaauucucuuagaaaccccauuguggagaaaauccucaaucagaugguuaacguggucaauagcgugauugauacauacuccaacaucgacgaaauccgcauugagauggcucgggagcugaagaagucuaaaccugaaagagaggauaugagcuuugccaucuccaaggcgacgaaagaaaccgagcgcauuaagggaauccuggaacaggaguucaaaauucaacacguuacaagaaaugacaucauccgguaucgccucuacgaggaacugaagcccaacggcuauaaaacccuuuacagcaauacauacauucccagagaggaucuguucucuaagaaguuugacaucgaacauauuaucccuaaagcccgccucuucgacgauuccuauagcaacaagacccuggagcugcgggacauuaauaucgaaaaagggaaccagacggcuuacgauuuugugcuuucuaaguauggagaggagggccucuacaaauaugaacagagagucgaggaguucaagaagaauaacgaacaggccgggaccaaaugccggaagcugcugaugcgcgaagcugacaucccguccgauuuucucaacagagaccugaaugauagccaauacauugccaaaaaggcgcacgagcuucugcgggagaucgugcccacagucaccgccacaaccggcucuauuacgaaccgccucagagaagacuggaaacuggugaauguuaugaaggagcugaacugggaaaaguaugauaaacuuggacugacagaggaguacaaggacaaagauggcaauaccgugcggcacaucaaggacuggacaaaaagaaacgaucaucgccaccaugcuauggacgcccucaccauugcuuucaccaagccuagcuuuauccaguaccugaauaaccucaaugcccgguccaacagagggggaagcauuuauggcaucgaacagaaggagcuggaacgcgagaauaacaaacuugucuucauucccccuauugaccccaagaucuuucggaaacaggccaaggaacaccugucuaauauucucaucuccauuaaagcuaagaacaaggugguuacgaaaaaugugaacaagacaaaaagcaaguccgggaccaacagaaaaguccaacugacaccgcgcggacagcugcaucuugagaccguguacggcaagauccggacauauaaaaccgaggaaaucaagguggggacgaagcugacagaggaacucauugcgaaaguugccgauaagaaaaucagagaggcucugaugcagcgccucucugaauacggcggaaauauuaagaaagccuuccaaaacaucagcaagcacccuauuuggcugaauggcucccacaccaagcauguccccgagaaagugaagaucguguuuuucgaggacgucuuuaccauccggaaagccauuacaccugauaucaagauugacaaagugaucgauucuaagauuagacggauccuucaggaacgccugaacgaguucgggggagaagcuagcaaggccuucuccaaucucgacgagaaccccauuugguuuaauagagauaaaggcaucgcgaucaagucuguuaaaauucgggggaucgcuaagggaaccgccauucgcgugaaaaaggacauccacggcaagacaauuaucgggaacaauggcuauccugucgccaacgauuacgugaauacgggaaacaaucaucacguugcuaucuucagagacaaagauggcaaccugcaggaacacauugugagcuuuuaugaggccaccgcgcgggcuauccagaaucugcccauugucgacagaaacuacaauuccgagaaggacuggaaauuccuuuuuagcaugaagcaaaacgaauacuucguguuuccgaacccuaauacaggguucaaccccucugagaucucccugaaagaugaaaagaauuaugcccucauuagccccaaccuguuucgcguucagaaacucucucauuacuauuacguguuccggcaccaucuggagaccaaugucgacacaaaccuucagcugaaggauaucaccuggaagagaaucacggccgugaauaaccugaccggagcugugaaaguccgcauugaccaccucggccggaucguugaugugggggaguauaaguga

SEQ ID NO: 4404 - RNA, 4176 nt, Artificial Sequence
  Cas9 variant
augaagaacuaccacaucggccuggacauugggaccagcuccgugggauucgccgcuagagaugacgauaauaaccucauccgggucaaaggcaagaauguuauuggggcccgccuguuuucugagggacagacagcgcaagaaagacggauggcucgcacgagcagacggcgcuauaacagacggaaauggcgccuuagacugcucgacgagaucuuccaugaugaaauuauccacaaggacgccgaguuuuucaaucggcugaaacaguccuuucuuucucccaaggaugaacgcaagcaguacuucggcagccugcucuuuccugagaccggggacuccgaguauuaccauaacggaaaucagacaaucuaucaccugagacaucggcugauuacccaagaugaaaaagccgacauccgcgagauuuaccucgcucugagacacaucauuaaguaucggggcaacuuccuugaugacacaccggugucuagcuuugaagccuccgaucugaaacucgcuagcuucgugcccaccaucaaugaccuguuugagacaauugacgucaacuacgaguucucuauggauaauaucaacgaaaucgaggacauucuucugaauaacaagcucagaaauuccgauaaaagcaagcagcugaccgaccugcucacggaaccuaucgugaacauugaugacaagucucuggagaaacaguuuaacaaggaacgcaccgauaucuccaaagagauugccaagagcguugugggcucuaaaaugaaugucaacaaacuucuguccuucgagagcuccgaagggucuaaaaucgcguucagcuuuuccgacgccagcucugaggauaagaugauggaacucuccgacauccuggaugacagccggaugaauauucuuaacauccugaaggugauuuacucuagaguucgccucaaucagaucauucccagcggaaugggccuguccgagucuaugguggcugccuaugacagccacaaacaacagcugaaggaucucaaaacacugcuuaacguccugccuuucaaugaacgguacgcugugaagaucgccuaugcggccuacaucgggaacauugacaaacagaaguuuaccaaguccgagaucaaagcuauugauaagcucaaagaaaagagcgccaucaugaaugugcuggacuucaaaucuggacauauuacaaacgaggagcuuuccaaugucaucaaggcuguuauuguggauaaguaucugaacgacgaagauuuugaguaccacggcaucguggaaaagaucaaucaggacauuagcaacgggucuuaucuccugaagcaaagaaauaaccagaacggaaauaucccccaucagcugcaccaaauggagcucgaucagauuaucgagaaccaguccaaauacuaccacuuccugggcgaacuuaauccuaacagcaaucgcaaccauauugccaaguauaaaaucuccgagcuggucgccuuucgggugccguacuauguuggcccccucaucaccccugaggagcaggagaagacgucuggggcuagcuucgcguggaugaagcgcaaaaaggacggagccauuacacccuggaauuuugaagagaaaguggauaaggaagagaccgcuuccagauucaucaaacggcugacagucaaggacaccuaccugcuuaacgaagaugugcucccugacaauucucugcuguaugagaaauuuaagguucucaacgagcugaauguggucaaggccaacaauaaaagacuuaccguggaagagaagcaaggcgccuucgacaaccuguuuaaaaagaugaaaacagucacggcuaagcgccucaagaauuaccuggugagcaaccacaaccauauuaauuccguugaaaucaccgggcugagcgauggagacaaauucaacaauucucuuuccacauauauugauuucaagaaaaucuuuggcgacaagaucgauaaccccgggcuccuggacgauuucgaggacauuaucgaauggagcaccguguuugaggaucggaaaauuuucgaggaaaaggucagaaaggacaucucuuggauuuccgagagcgaaaucaaaucugugguuagcaagcgguacuccggauggggccgccugagcaaaaagcuccugaauugcaucacaaacaaugagggcagaaacauuaucgaugaacuuugggaggagucugaaaccuuuauggaggccguguccaaaccggaagucaaggagcagauugacgggaucaauagcgauuucauuaagaacacggacaucgaguccgugcuggcggacgcuuacacaucuccucagaauaaaaaggccauucgggaaacccacaaacucgugaaggauauccagaaagccaugggaggccaagcucccgccagcaucuccauugaguuuaccagaaacccucaggacaaggggcagcugacacgcucucggcauagcgaaguuuccagaaaauauaaggagaucucuaaggaaauuagcaaaacccugaaugaugagcuuaaguccaaaaagaacagcauggacgucgauaaauacuaucucuacuucaugcagaugggaaucgaccuguaugaugggucuuccauugacaucgaugaccugaauaacuaccaaaucgaucacauuaucccccagagcuuuuauaaggacgacucuuucgauaaccgcgugcucacacacuacuccaauaaccagaagaaaggcaauaacacgccccugaauggccuuaacauuaaugacaagaccagagcuaucuggaaccaucugcgggaucucggacugauuaccaaaaagaaauacaauggccugacccuuaaggggauggaccagcucagcaaguauacaaaacacggauuuauccgcagacaacugguggagaccucucaggucaucaagcugguggccaacauucucuccgaugaguucagcacggacgauaccaaaaucauugaaguuaaggcgaaaaugaacucccagauccggcaaguguuuaaucuguacaagguccgcgaacuuaaugacuaucaucacgccguggaugcuuaccugacaaccuucauuggcggguaucucuacaacagauauccuaaucugcggaacauguucguuuacggagacuuuaagaaauucagcgccgauguggacaaucugaagacauuuaacuuccuucacgagaucaccaacccgucugauaaauuugaagaccgcauuuucgacgaaaagagcggcgagcugauccucgauagaaaacaugcuaucgaaacgauuaagaagaucuaccaguauaaauacaugcugauuacacgggaggucuccaccaagaaugggcagcucucugaccagacaguguauagcgccaaacgcaucaacaauguuaaggcgcccauuccugugaaaaaggauuuuaaccccgaacuguacggcuucagaaccggaaaugucgaccaccauauggugaucgugaaauauccuaagaaggauuccuacgacuauaaagucguuggcaucccccuucgguuugugcaaaagcugaaagagaccaaggauaacaaagacuacgaaaaucuccugaaccagauugugcagaugaagcugaauagaaagaaacaggauuucaucgucgugguugacaacgugauguacgggcaacuuauucaggauggaggccagaaguuuacacuggggucuagcacguaucgcuacaaugccaaacagcucgucaucgacaacggauaucugaagcucauugcugaugagcgguacaaaaauucccugaccgacgaggaaaagucuaaccaauauaucacacuuuacaaugagauccugaaggugguuaacggcagauucgacguguucgaugucaacagcuuucgcaaaaagcucaauaacgggguggacaaauucauuaagcugaauaccguugauaaacggaucauuaucaugaagauucuguccggccuucacuguggaccgagcaucgugccucugaaggaacucggccugacaacaccccucgggcagcugcagucuacguccggaauuagccuuucugagaacacaaucaucauuuaucaauccccuagcggccuguuugagagaaaaguccgccugggggaccucuga

SEQ ID NO: 4405 - RNA, 4176 nt, Artificial Sequence
  Cas9 variant
augaagaacuaccacaucggccuggacauugggaccagcuccgugggauucgccgcuagagaugacgauaauaaccucauccgggucaaaggcaagaauguuauuggggcccgccuguuuucugagggaaaaacagcgcaggaaagacggaucagccgcacguccagacggcgcuauaacagacggaaguggcgccuuagacugcucgacgagauuuuccaugaugcuaucgugcacaaagacgccgaauuuuucaaucggcugaagcaaucuagccuuucccccaaggaugagcgcaaacaguacuuuggcucucuccuguucccugaagugggggacggagauuauuuuagagacggcaaccagaccaucuaccaucugcggcaccgccugaugacacaggaugagaaggccgacauuagagaggucuaucucgcucugcggcauaucauuaaauacagaggcaauuuccuugaugacaccccggugagcuccuuugaagccagcgaccugaagcucgcuucuuucguucccacacugaacgaucuuuuugagaccaucaaugugaacuaugaacuguccauugacaaugucaaccaaaucgagaauauucuccugaacaauaaacugcgcaacagcgauaagucuaagcagcucacagaccugaucgccgagccugugaccaacaucgaugacaaaucccuuaagaaacaguucgauaaggaacggaaagacauuagcaaggagaucgcgaaagccguuguggggucuaagaugaaugucaacaagcugcucuccuuugaaagcuccgauggaucuaaaauuagcuucuccuucagcgacgcuucuuccgaggauaagaugcuggaacuuagcgacauccuggacgauucuagaaugaauauucucaacgugcugaaagugaucuacagccgcguccggcugaaucagaucauucccuccggcauggggcucucugagagcaugaucgccgcuuacgaccugcacaagcaacagcuuaaagaucugaagacgcuccuggacguugugccuuuuaacgagaaguaugccgugaaaauugcguacgccgcuuauaucggaaauauugauaagcagagauucaccaaagccgaagucaagacaaucgacaaacuucgcgauaagaaguccaucaccagcgugcuggacuuuaaaucuggccacauuacaaacgaggaacucaauaacguuaucaaggaggugauugucgauaaauaccugaaugacgaaaccuucgaguaucaugauaucguggagaagauuaaccaggacaucuccaaugggaacuaccugcucaaacaacggaauaaccagaacggaaauauuccccaccagcugcaucaaauggaacuugaucagaucaucgagaagcagagcaaguauuacccuuuucugggcaaacucaaccccaauucuaagagaucccacauugcuaaauacaagaucagcgaacugguugccuuccgcgugccguauuacgucggcccucugauuacgcccgaggaacaggagaaaacauccggggccucuuuugcuuggaugaagcggaaagaggacggagcgaucaccccuuggaacuucgaaaagaugguggacaaggagagcacagccuccagauuuauuaaacgccuuaccgucaaggauaccuaucuccugaaugaagacgugcugcccgauaacucucuccuguacgagaaauucaagguucuuaaugagcugaacguggucaaagcuaauaacaagcggcucacaguggaagagaagcaaggcgccuuugacaaucuguucaaacagaugaagacgguuaccgccaaaagacugaagaacuaucuugugagcaaucacaaccauaucaauuccgucaaaaucacagggcucagcgauggagaaaaguuuaacaacucucuguccguguacauugacuucaagaaaaucuucggcgauaagauugacgauagcaaacuguuugacgauuucgagaauaucauugaauggucuaccguguuugaggaccgggauaucuucgaggaaaagguucgcaaagacaucuccuggauuagcgagucugaaaucaacgcugucgugagcaagagauauuccggguggggacggcucagcaagaaacugcuuaauggcauuacaaacgacgagggcagaaauaucauugaugaacugugggaggagucugaaaccuuuauggaggccguguccaagccggaagucaaagagaagaucgacgaaaucaacagcaauuucauuaaaaacacggauaucgaguccgugcucgcggacgcuuacacaucuccucagaauaagaaagccauucgcgagaccuacaagcugguuaaggauauccagaaagccaugggagggcaagcucccagcuccauuucuaucgaauuuacccggaacccucaggacaagggcgagcugacaagaagccgccacuccgaaauugccaaaaaguauaaagagcuuucuaaggaggugagcaagaaacucaaugaugaacugaaguccaaaaagaacagcauggacgucgauaaauacuaucuguacuucaugcagauggggaucgaccucuaugauggaaccucuaucgacauugacgaucugaauaacuaccagaucgaccauauugugccccaauccuuuuauaaggaugacagcuucgauaauagaguucuuacacacuacucuaacaaccagaagaaaggcaauaacacgccccugaaugggcucaacaucgacuccaauacccgggagguguggaaccaucugauuggccugggacuuaucacaaagcgcaaauacaauaaccucacccugaagggcauggaucagcugagcaaauauacaaagcacggguuuaucagacggcagcucgucgaaaccucucaagugauuaagcugguugcuaauauccuuuccgacgaguacagcaaagaugacacgaagauuaucgaagugaaagccaagcugaacucccagauucgccaggucuucaaucucuauaaaaucagagagcugaacgauuaccaccaugcgcuggacgccuaucuuaccacauuuaucggaggcuaccuguauaaucgguacccuaaccuccgcaauauguucguguacggggauuucaagaaguuuagcgcuaaaauugacaaccuggagaccuucaauuuucuccacgacaucacaaacccgucugauaaguucgaagacagaauuaucgaugagaaaagcggagaagugauucuggaccggcgccaugccaucgagaccauuaagaaaaucuaucaauacaacuauaugcuuaucacgagagaagucuccacaaagaauggccagcugucugaucagaccguuuacagcgcucggagaauuaacaaagucaauucccccaucccugugaagaaggacucuaaccccgagcucuauggguuucgcacaggcaauguggaucaccacauggugauuguuaaauaccugaacaaggacaaauaugauuacaagaucauuggaaucccucugcgguucgugcagguccuuaaaaauagcaacgacaauaccgaguacaagaacauccugaauaagauugugcaauccaaacucaagggcaaaucuaccgauuuuagaguuauccuggacaacgugauguaugggcagcucauucaggauggaggccagaaguucacacuggggagcuccacguacaaauauaaugccaagcaacuugucaucaacauggacgacauucgcauccugguggauaaucgguacuuuaacagccucucugacgaugacgcguccggagaguucaucaagauuuauaacgaaauccugaaaguuauuaaugccagauuugaucuguucgacaucaacaaguuccgcgaaaaacuuaauaacggcaaggaguacuuugaaaaucugagcauugaugagaaaaaccaggugcuccugaagaugcucucugggcugcauugcggcuccgcuaauguccccaucaaggagcuuggacugaccacaccgcugggcaaacuccagauuccuagcgggaucgugcuguccgaagacgccaucgugauuuaucagucucccagcggacuuuucgagcggaagaucagacugaaagauauuuga

SEQ ID NO: 4406 - RNA, 4176 nt, Artificial Sequence
  Cas9 variant
augaaccugagaaauuaccccggcgaguauagcaucgggcucgacaugggaaccggcuccgugggguggucugucguugaugaaaagggaaaccugcuucacuucaaaaagaaaccuacauggggcagccggcuguuugacuccgugaugccggccucugaggcucgcgugcauagagggcagcggcgcagauacgaacggcgcagauggcggcucgaucugcuucaaggacuguucaagaaugagaugaacaaagucgaccccgaauuuuucaugcgccucaaucagagcagaacgauugagggcgauccuaucuuuaccaaguccuucacaaaggccgacuauuacgaucgguuucccaccauuuaucaccuucgcgcguaccugauggagucuaacgaaccugcugaccucagacugaucuaucuugccaugcauaauauuaucaaacaccggggcaacuuccugcgcgaggaagaaaagagccucuccgccaaacaugcugauagcaagaaagccgugacacaguuuguugacgcucugaaggaguggugcuucucuagaggguacgaauuuggaaaggaucccgccaaauccaucgagaagugucuuagcgacucuaaauccagccggucucagcuggcguccgaaauugccaaggcucucgccgugagcaccgaugcugccgcggccgacaaaaagcuggcugacaaucuggccaaagcuauggucggccuccaaugcgaguucaaguacguguuuggggaguucgauugugaguccacaaagcuggcccuuucugacgaugagaaacuggaacuccugagagccgcuugcccugacgauagcguugagcuucuggacgcgcucugugccguguauuccgcuuacguccugcagggacugcucagcuaugccccgggccagaccaucucucacaacaugauugccaaguacgaucuguauaaaacggaccuuaagacccugcgcgcucucgugcgggaauacgcccccggggcguaugaugaguucuuuagaggagcuacauaccacgacgccaauccugaugacuccagcaaagacuacucuuaugccgaugcugaaggcuacaccgccuauaaccugcauaagcugagcuacgacgauuucgcuaaggccgugaaaaagcugcucggcgggacagacgcggucaccgaugagcgcuaucugaauaugauggagcgguuugaaaaacagcaauuccugagacgccucaagacguccgacaacggagccaucuacuaucagcugcaccuugaggaacugacagcuauuaucaaaaaucagggccgguuuuacucuuuccucaaggaguacgaagggaaguuugagagccugguuuccuuccgcauucccuauuacgugggaccucugaccagcgugaacgccgcucaggauucucauaaccacaauagauuucaaugguccgagcggaaacccggcauggaaagagaggucaucacaccguggaacugggacaccaucauugauaagaauaaaagcgccgaaaacuucaucaugcgcaugaccggggacugcacauaucuugcgggagagaaggugcucccuaaacagucucugcuguacgaggaauuuuguguucucaaugagcugaacggcgugcggugguccgaugacggcgaugacuggcagagauucgacgccgcucaacgggaagggauuguccgcgagcuuuuucacaaguauagacgggugacguacaagaugcuggaagauuggcucguuagagagggagacgccaaucaucccaucgugaaaggcgggcagggagagaccggccuggaaagcaagaugggguccuaucuguucuucgcuaaaggcauuuuuggacuuggcgagcucucuccugccgaauaccccgccaucgagaagaugaucaaauggaacacacuguucgaagaucgcagcauucugaaggagaaacucgaggacgaauuuggggagcggggaaauggcaugcuggaugcuucccagaucaaggcgauuugcaagaaaagauucaccggguggggacgccuuucugaacaguuucugacaggccucaaggucgagagccccgccgggagagcuguguccaucauggacguccugcgggaaggcaacccuuguagcgagcgcagacaaggagagaccgugguuaugauggaagcccugcgggaugagggccuuggguuccagaaaaagauugacgaacacaaucgcaacuacuauggacagcauggcaaagaucucggggugaaugagcugccgggaucucccgccaucagacggucccugaaccaggcuauccgcauugucgaggaaaucgccagcauugcgggccacgcuccugccaauaucuuuauugaggugacgagaggggaagacgccggcaagaagggaaaacggacaguuaagcgcugggauaaaaucggcgaggcucucaagaaacugaaggaagaggggguggccgucgaggugauggacgauuucaaggaacaaaaagcgauuaacgcuaaccuugacgagagacugucucucuaccugaugcagaauggaaagugccuguauuccggcaaagccaucaaccuugaaaagcuccuggccgggagcggagaguacgaaguggaccauaucauuccccgggcuuauaucaaagaugacucuauugagaauaaggcccugguucucagagaggaaaaccagcacaagaccgaucagcugcuuaucgacaaaagcauucgcuggaagaugcgggagaccuggucccaacugcacgaugcuggccucaucggggacaaaaaguaccauaaucugcugagaagcaacaucaaugaaaaccagcuucgcggcuuuauugcccggcagcuggucgagacaucucagauggugaaacucgcgcaagcccugcucgaagcuagauucgccaaugaggagacccgcaucgugccugucaaggcuuccaugagccacaaccugcgggaagccgccgaucuugcuaaauguagagaggcgaaugacuuucaucacgcccacgaugcuuuccuggccucccgcauuggacucuuugugcagaugcggcaucccggcaucuaugaaaacccgauuggguacucucacguuaucaagaaguacgugcaggagcaaagcgaggucuucaaaaagacacauagaaugccuggauccgccggcuucgugaucaauucuuuuaugagcuccggguucgacaaagauacgggagaaguuuuuaaggacucuugggacgcugaggccgaaguggauggcauucggaaagcgcugaacuaucgccagugcuacaucagcagaaugccccagcaggacaccggcgcuuucuggaaugccacagucuauuccccucgggaucccaagauggggccuaagcuggcccuuagcaccaaacaaggacuggaccccaagcucuacggcggguuuucuucccagcaguucgcuuacuuuuucauuuaugaggccaaaaagaaaggaaagccgacauuucgcuucagccaggugccuguuuggcuggcggcuagaaucgaagccaacccccucgcccuggaggaguaugcucggggccuugccaagggggaaggacuggaguuugugucuauucaaagacccaaaaucuacaagaaacagcucaucgaagucaacggcgauaagcugauuaucaccggcgcuaaagaggugcgcuccggggccgaacuggcguucaaucaggacgagauuagcgccaucucuaugugcuccaaacuucgggcugccgaggcuggacuggauggcgccuucagcgaagagguguccgccauuuggaacagaaucagcaaugcuccuguccagucuugugggcgccuccugcggcaacucacgcugccgaaguaccagagcaacuuugacuccucuagcaaugaagagaaggcggccguugugcuuggacugauugcucugcucaacggcaauaacagaaucguggaucuguccggggucggaggcucuagccacgccggcgccaugaugauguccuaucccaaacuucuggacgauccuaaggugcccuucuuuaucauugaccagucuguuaccgggauguucgaacgcaagacacgggugggacucuga

SEQ ID NO: 4407 - RNA, 4176 nt, Artificial Sequence
  Cas9 variant
augaagaaaauccugggccucgaccuggggaccacaagcauuggaugggcccuugugaacgagaaggaaaauaacgaggaacaguccucuaucauuagacugggcguccggguuaauccccucacgguggaugagaaaagcaacuucgaaaaggggaaagacaucaccacaaaugcugaucgcaccaagugcagauccgcccggcgcaaccugcaaagauuuaaacuucggcgcgaggcgcuggcugacugucucaagagacacggacugaugacagaugagaccccucugugcgaaacaaauaacucuauuaucuucaagaccuacagcaaucgggccaaagccgugugugagaagaucgcucucgacgauuuuguccgcgugcuguucaugauuaacaaaaagagaggcuauaaguccucucggaaacuuaauacggacgaugaagggacccugguugacggaauggauguggccaagcuccuguacaacgagcagaucacaccgggcgaguaucuucugcgccucuuuaaaaagggcaaaaagaccagacccgacuucuaccugagcgaucugaaagcugaacucgagcggauuugggacuuucagcgcacauucuauccugaaauccugugcgacgcccuuaaggaggaucugaaggggaaauccagaacccagagcucugcgauuuucuacgccaaguauaaagucuccacggcuaagaucgccggaaaagacaagcggcuccaagaacugacauggagaaccgaugcccuucgcaagcagcugacaauugacgagguggcuuacguuaucuguagcaucaauggcgagauuaacgggucuucccagcggcucagcaugaucucugauagauccaaacugcuguacuucaaucaucagaccauuggacaauaucucaugcagcgccuggaagagaaccccaacgcgggccuuaagaauaucauuuucuaccggcaggacuaugaagaugaguucaacgacaucuggaauagccaggccaccuaccacaaagaacugacaccugagcucaagaaagagcugaaggauaucaucuuuuaucaaagagggcuuaaguccugcaaauggcugauuaacuacugugaacucgagcaugaagagauugaagugaagacgcccgagggaaaacugcgcaagaucaccauuggcucuaaaacaugcccuaagagcuccccgcuguuccaggaguucaagaucuggcagguccucaauaaccugcaagugagcccccuuaauucucggagaaaagcuaagcgcaaaaaggacgaggaaccuucccuguuuagcgaugaagacaugaacaccgccugucgguaucucaaugaggaggaaaaacugacacuguucaaggagcuuucuaucaaaaaggaacucaagaaaaaggacgcucugaaacugcucuuugagaacuacaaggaacuggaucuuaauuacaaagugauuagcggcaacgucaccauggccucccuguauagagccuuccaggacaucauuucucucacggggaauggagaguuugauuuccaggcuaugcccgcggaggaagccgagaagacaguugaagagaucuuuggcgggcugggauacaagaccgcuuuccugcacuuugacgccagccuucauggcaaagaauuugagcgccagccugccuaucggcucuggcaucugcuguacuccuaugcuggggaucaaagcaagaccggaauugaggcccucgugaaaagaauccaggaacugugcggcuuugagcccgaauacgcgcggauucuugcuaacaucucuuucaucccggacuauggcaaucuguccagcaaggccaugcgcaaaauucucccuuacaugcaggauggguacgaguauucugaagccuguuccaaggcuggauacagacacagcgccuccucucugacaaaggaggagaucaacaaaaagaccuauaaaacacaccuggacgaaauuaagcggaacagccuuagaaaucccaucguggagaaaauucucaaccagauggucaaugugguuaacuccgugaucgauacguacggcucuaucgacgaaauucgcaucgagauggcucgggagcugaaaaagagcaagccugaaagagaggauauguccuuugccauuaauaaggcgaccaaagaaacagagcgcaucaaggggauucuggaacaagaguucaaaauccagcacgucaccagaaacgacaucauucgguaucgccucuacgaggaacugaagcccaauggauauaaaacacuuuacagcaacaccuacauccccagagaggaucuguucucuaagaaguuugacauugaacauaucauuccuaaagcccgccucuucgacgauuccuauagcaauaagacgcuggagcugcgggacaucaacaucgaaaaaggcaaucagaccgcuuacgauuuugugcuuucuaaguauggggaggagggccucuacaaauaugaacagagaguugaggaauuuaagaagaacaaugagcaagccggauccaaaugccggaagcugcugaugcgcgaagcugacauuccgagcgauuuucucaacagagaccugaaugauucucaguacaucgccaaaaaggcgcacgagcuucugcgggagauugugcccacagucaccgccacaaccggcagcaucacgaaccgccucagagaagacuggaaacuggugaacgucaugaaggagcugaauugggaaaaguaugauaaacuugggcugacagaggaguacaaggacaaagauggaaacaccgugcggcacauuaaggacuggacaaaaagaaaugaucaucgccaccaugcuauggacgcccucaccaucgcuuucaccaagccuuccuuuauucaguaccugaacaaucucaacgcccggagcaauaagggcgggucuaucuauggaaucgaacagaaagagcuggaaagagagaacaauaaacuuguuuucauucccccuaucgaccccaagauuuuucgcaagcaagccaaagaacaccuguccaacauccucauuagcaucaaggcuaagaauaaaguggucacaaagaacgugaauaaaacgaaguccaaaucuggcaccaaccggaagguucagcugacaccgagagggcagcugcaucuugagaccguguacggcaaaauccgcacauauaagaccgaggaaauuaaggucggaacgaaacugacagaggaacucaucgcgaagguggccgauaaaaagauucgggaggcucugaugcaaagacucagcgaauacggcgggaauaucaaaaaggccuuccagaacauuuccaagcacccuaucuggcugaacucuagccacaccaaacaugugcccgagaagguuaaaaucgucuuuuucgaggacguguuuaccauucgcaaggccaucacaccugauauuaaaaucgacaaggugauuaauuccaagauccggaacauucuucaggaaagacugaaugaguucggaggcgaagcugccaaagcguucucuaaccucgaucagaaucccaucugguuuaacaaggacaaagggaucgcuauuaagagcgucaaaauccggggaauugccaauggcaccgccauccgcgugaagaaggauauucacgggaacacaaucaucggcaauaacggauauccuauucccaaugacuacguuaacacgggcaauaaccaucacguggcuaucuucagagaucgggacgggaaucugcaagagcacauugucuccuuuuaugaagccaccgcgcgcgcuauccagaaccugccgauuguggauagaaauuacaacagcgagaaagacugggaguuccuguuuucuaugaagcagaacgaauacuucguuuuuccuaaucccaacacaggauucaauccccuugagaucgaccuccggaacgaagagaauuaugcccugaucuccccuaaccucuuuagagugcagaaacugagccauuacuauuacgucuuccgccaccaucuugagaccaauguggauacaaaccugcaacugaaggacauuaccuggaaacggaucaaggccauuaauaaccucacgggcguugugaaagucagaaucgaucaccuggggcgcauuguggacgugggagaauauaaguga

SEQ ID NO: 4408 - RNA, 4176 nt, Artificial Sequence
  Cas9 variant
augaagaaaagaaucgacgauuacauucugggccucgacaucgggaccaacagcugcggaugggccgugacagauaagaaaaauaaccugcuuaagcugcggggcaaaacggcuauugggucccaccucuucgaggaaggacauaccgccgcggaccgcagaggcuuucggacaacccgcagacggcugaagcgcagaaaguggcggcuucgccugcucgaggaaaucuucgcugagcccauggccgaagucgauccuggguuuuucguuagacugcaccagucuugggugagcccgcuggacaaaucccggaagaaauaucaagccauuguguuucccacagcuaaggaggaucaggaguacuaucagaaauacccuaccaucuaucaucuccgcgacgcccugaugacacaggauagacaauucgaccuucgggaaaucuuucuggcuauucaccauaucgucaaguaccgcggaaauuuccuccaggauaccgccgugaaggacuuugaggcgucuaaaauugaaguuggccccauccugacgaacauuaauaacgccuucgcugauaagaucguggagggccaggaccuuauugagcugaaugucgccaacgcugccgaaaucgaggcggugaucagagggaaagacgccgauaagacccucuauaaaauggacaagguuaaaaagauugcuaagcugcugacagauagcaccgccaaagaacagaagaauguggcuaaacaaaucgccaacgccauuaugggauacaagacacagcucgagaccauccugggcaaagaaauugacaagaaugauaaggcucagugggaguuuaaacuuuccgacgcggaugacaagcuggaugcccuccugccugaccuugaugagucugaccagacggucguggcugaaaucgagaaacuguucagcgccaucacacucuccaccauuguggacgaaaacaagagccugucucaauccauggucgagaaauacaauaagcaccaccaggauuauaagcugcucaaagccuacaucgaaagccugcccgaccgggcucaggccaagaaacuucugcucgcguaugaucuguacguuaacaauagacaugggcaccuucuggaggcuaagacagaguuuaaacaagacucuacccucaccaaggaagauuucuauaagacagugaaagacaaccuggaugacuccgagcuggcccauaagauugcccaggaaaucgcugccgauaacuucaugccuaaacagcgcacgaauagcaacggagugauuccguuucagcuccaccaaaucgagcuggacaagaucauugcuaaucagucuaaauacuaucccuuccuugccgcggaaaacccugucgaggaucaccggaagcaggcccccuacaaacuggacgagcucgugagauuucgcguuccuuacuaugugggccccaugaucaccgcugaugaacaggagaagacauccggaaagagcuucgccuggaugguccggaaagaacaagggcagauuaccccguggaauuuugagcagaagguggacagacaggaguccgcuaacaaauucaucaagcgcaugacaauuaaagacaccuaccugcugggcgaagauguucuuccugccaauucucuccuguaucaacgguuugaggugcugaacgaacucaauaacaucagagucaauggcagccgcauuuccguggaccugaagcagcagaucuucaacgaucuuuuugaggaaaagaaaacggucacagagaaggcgcugaucagcuaccucaaacagaaucugcaucugcccaccguggagauuaaggggcuugccgacccuaccaaauucaacucuucccucgcuagcuauuaccaccugaagaaucugcauguuuuugauaaggaacucgccgacccccaauaucagaaagaguucgaaaagaucauugaguacucuagcaucuuugaagauaaaaagauuuuccaggacaaacugcacgcugaguucaaguggcuuacacccgcccaauuuaaggccaucuccaccuggcggcugcagggauggggcagacucucucgcaaacugcugguggagcuucaugauacaaacgggcagaacaucauugaacagcucugggacagccaaaagaauuucaugcagaucgucacggagccugauuuuaaagaagcuauugcgaaggagaaccagaauaucacccaggaaaacggaguggaggagauucuggccgacgcuuacacauccccggccaauaaaaaggccauccggcaaguugugaaagucguggcugaugugguuaaggccgcgagcggcaaggcucccgcccaguucgccaucgaauuuaccagagacccugacaaaaacccccagcugucucacauucgggggacaaagcuccugaaggcuuaucaggagaccgccggagaacuugucgaucaaaaucugacgaacucccucaaggaggcgaugaccagccgcaaacugcugaaggacaaguacuuccuuuauuuuaugcagacaggcagagaugcuuacaccggcaaaaagaucaauauugacgaggugucuacaaacuaucagaucgaucacauucucccucaauccuucaucaaagacgauagcuuugacaaucgggugcugaccgccacgccccugaacgccgaaaaguccgaugacgucccguacaaaagauucgcuaauaacuaugugucugaucucaagaugacaguuggggagauguggaagcauuggcagaaagccggaaucauuaauaagcacaaacugggcaaccuucugcucgacccugaccgccugagcaaguuucagaaauccggguucaucaaccggcagcugguggaaaccucucaaauugucaaacuugugagcguuauccugcagaauaaguaccccgaugcugagauuaucacagugaaagccggagacaacuccgcgcucagacagcgccuggaucucuacaagagcagagacgucaaugauuaucaucacgccauugacgcuuaccugucuaucguguguggcaacuuucuuuaucagguuuacccuaaauaucggcccuacuucguguaugggcaauucaagaaauuuucccaggauccugaccugcagaaggaucucaucaagcacuucaaaggcuuuaccuucauguggccccugcugcagaaggacaauagcgaacgcaaagcccuugaggagauuaaggaaaacaauucugauagaaucgucuuuuacaaacauccggacauuuucgauaagcugcggaaggcuuacaacuauaaauacaugcucgugucccgcgagaccagcacagaaucuagcuccauguuuaauaugacgaucuauccuagaggagagcgggaccgcaagaaaaccagaaagcugauucccaaaggcaacgggcucgaccccaagaucuacggaggcuauagcgggaauacagaugccuacauggugaucgucaaaauugaaaaggccaaggagucuaucuauaaaguuauuggaaucccuaugcgggcucuggcgggccuuaagcaagccaaaaaccaggggaauuacaaggaggaacugcacaaagugguggagccgcagauuaugcucgacaagaacggcaagcccaaacgcggagucgaaggcuucagagugguuaaggaucaugugccuuuuaaacaggucgugcuggacggggauaagaaauucaugcuguacuccgcuaaguaugagaccaaugccaagcaacuuacacugagccaggaaaccaugcggaucguuacggacaaccucaaaaaguccgaggaucaggacaaacugcucgugaaggccuacgaugagauccugcaaaaagucgaccaguaucuuccccuguuugaugugaacaaguucagaaauucucugcaccucggacgcgcuaaauuccuggaccuugccguuaacgauaagaagauuacacugagcaauauccucaacggccugcaugacaaucucguggucccuaaccugaaaaauauugggaucaagacccccuuuggacuuaugcaguccccuucuggcauuacccugagcuccaacgcgauccugauuuuccagucucccacagggcucuuugaaaaacgggugagaaucgcugaccuguga

SEQ ID NO: 4409 - RNA, 4176 nt, Artificial Sequence
  Cas9 variant
auggagaacaagcaguacuauaucggccuggacguggggaccaauagcgucggaugggccguuacagauacguccuacaaccuccugagagcuaaaggcaaggacauguggggagcccggcuuuucgaugaagcgaaaaccgcuguggagcgcagaacaaagcggaccucucgcagacggagcgaacgcgagaaagccagaaaggccaugcugaaggaacucuuugcugacgagauuaauaaaguggaucccaacuucuuuauccggcuggaggaauccaaguucuuucuugacgaucgcucugagaauaacagacaacgguauacacuguucaaugacgccaaauuuaccgauaaggacuacuaugaaaaauacaagacaauuuuccaccuccgcagcgcucugaucaacuccgaugagaaguuugacgucagacugguguuccucgccauucugaaucuuuucucucaucgggggcacuuccugaacgcgagccucaaaggcgauggggagauccagggaguugacaucuuuuauaaugaccuguacgaagugugcgaggaauuugagauugaucuuccucagaucuccaacauugacaauuucgaaaagauccugagccagaaaggcaagucucgcaccaaaauucucgaggagcuguccgaagaacugagcaucucuaagaaagaaaagauuaaguacucccuccugaaacuuaucuguggcaugaagaucaaagucguggauauuuaugccgacgaggauauccaagaagacgauaagaaaaaggaccugggguuuagagagagcgauuacgagaagucuucccucgaaguuaaagagauuaucggagacgaucauuucgaacugauugagcgggcuaaggccgugcacgacaucggccuucuggcuaacaucauugggaauagcaaauaucucugcgaagccagagucgaggcguacgacaaccaucacaaggaucugcagaaaaucaaggagcugcucaagaaauaugacauuaaggccuacacggauauguuucgcaaaaugaccgacaagaacuauuccgcuuacgugggaucugugaauagcaacaucgccaaagaacggagauccgucgauaaucgcaagauugaggaccuguacgaauauaucaagaaaaucgcucuuaagaacauuagcgaugacaaugaggauaaaaucgagauucugaagaaaaucgaaacaggcgaguuccucaagaaacagcugaccgccucuaacgggguuauuccgaaucagcuucaaucccgggaacugagagccauccucaagaaggcugagaacuaccugcccuuucugaaagaaaagggagagaaaaaucucacagugagcgagaugauuauccagcuguucgaauuucagaucccuuauuacgugggcccccuugacaagaacccuaaaaaggauaagaaugcgaacucuugggccgucauucccagcggcgggcgcauccugccuuggaauuucgaggacaaaguggauguuaagggaucccggaaagaauuuauugagaagauggugagaaaauguaccuaucucucugaggagcacacgcugccgaagcagagccugcuuuacgagaaguucaugguccucaacgaaaucaauaacauuaaaaucgacggcgagaagaucuccguggaagcuaaacaaaagauuuauaacgaccuguuuaugaaagggaagaagguuagccagaaagccaucaagcaggagcugauuucucucaauaucauguccaaagauagcgugcugucuggaauugacacagucugcaacgccuaccuuuccagcaucgcuaaguuccgcggcguguuugaugaaaaugucaacaaucaauccaccaucgacaugauugaggauaucauuuuccugaaaacaguguacucugacgagaagcgguucguuaaagaagagaucguggaaaaguauggggaugagauugacaaggauaaaaucaagagaauccucggauuuaaauucagcaacuggggcaauauuuccaagucuuuucuggagcuggaaggcgccgacgucgggaccggagagauccgcagcauuauccagucccuuugggaaaccaacuucaaucucauggagcugcugagcucucgguuuacauacauggaugaacucgagaaaagagugaagaagcuggagaaaccccuuuccgaauggacgauugaggaccuggaugacauguaucucagcucuccuguuaagcggaugaucuggcaguccaugaaaauuguggacgaaauccagaccgucaucggcuacgcgcccaagcgcauuuucguggagaugacaagaagcgaaggggagaaagugcggaccaagucuagaaaggaucgccugaaagagcuguauagcgcuaucaaggaagacuccaaacaauggguuaaggagcuugaugccaaagacgaaagcuacuuucggucuaagaagauguaucucuacuaccugcagaaaggaagauguauguauuccggcgaggucauugaacuggauaagcucauggacgauaaccuguacgacaucgaucauauuuauccucgcagcuucgugaaagacgauucccuugacaaucuggugcucgucaagaaagagaucaacaauagaaagcagaacgaccccaucacaccgcagauucaagccucuugccagggguuuuggaaggugcugcacgagcagggcuucaucagcaaugaaaaauacucccggcugacccgcaagacgcaggaguuuucugaugaagagaaacuuagcuucauuaacagacaaaucguugagacaggacaggcuaccaaguguauggcccagauucuccagaaauccaugggcgaagacguggaugucguguuuucuaaggcucggcugguuagcgaguuccgccauaaauucgaacuguuuaaguccagacucaucaacgacuuccaccacgccaaugaugcguaucugaacaucguggucgggaauagcuacuuugugaaguucacccggaacccugccaauuuuauuaaagacgcucgcaagaaccccgauaauccugccuauaaauaccauauggacagauucuuugagcgggauguuaagucuaaauccgaaguggcuuggaucggacaaagcgagggcaacgccgggacaauugcgaucgucaagaagaccaugucuaaaaauagcccccuuauuacaaagaaaguggaggaaggacacggcuccaucacgaaggagaccauugugggggucaaagaaaucaaguucggccgcaacaagguugagaaagccgacaagacacccaaaaaggcuaaucugcaggccuacagaccuaucaaaaccucugaugaacggcucugcaacauucugagauauggaggccgcacauccaucagcauuuccggguacugucugguggaguaugugaagaagcggaaaaccaucagaagccuugaggcuauuccggucuaccugggacgcaaggacucucucagcgaagagaaacugcucaauuauuuucgguacaaccugaaugauggcgggaaggacuccgugucugacaucagacuuugccugcccuucaucagcacgaacucccucguuaaaauugauggauaucuguacuaccugggcgggaagaacgacgaucgcauccagcuuuauaaugccuaccaacugaaaaugaagaaggaagagguggaauauauucggaaaaucgagaaggccgucucuaugagcaaauuugacgagauugauagagaaaagaacccugugcucaccgaggagaaaaauaucgaacuguacaacaagauccaggacaaguucgagaauacaguuuucuccaaacgcaugucucucgugaaguauaacaaaaaggaucugagcuuuggcgacuuccuuaaaaauaagaaguccaaauuugaagagauugaucuggaaaagcaguguaaaguccucuacaacaucauuuucaaucugagcaaccugaaggagguggaccuuucugauaucggaggcuccaaaagcaccgggaagugccggugcaagaaaaauauuacaaacuauaaggaauuuaaacugauccagcaaucuauuaccggacucuacuccugugagaaggaccugaugacgaucuga

SEQ ID NO: 4410 - RNA, 4176 nt, Artificial Sequence
  Cas9 variant
augaagagaaacaaugacuacuauaucggccuggauauggggaccaacagcgugggaugggccacaacgaauccccagggccggcuccugcgcuucaacaaaaaggacauguggggguccagacuuuuugaggaagcuaaaaccgccgcgaagacacggaccuuccgcacaucuagacggcgcuacgauagaguccggcaacgcauugaguuucugcaggacaucuucgcuccuauuaucgccaaaaaggauuuugaguucuuuaugagacucaaggagagcaaauuccaccuggaagacaagaaaaccgauggaaaguuugcccuuuucaaugacgcugauuuuacagacguugaguauuucgaucgguacccgaccauuuaucaucugcgcgccgcucucaucaaacccaaccacaucacggacccuagacugcuguaccucgccauucaucacaucauuaagaaucggggccauuuucuguucgcggggaccgauauggaguccauccgcucuuuccagauuguguauacacagcuuagcgaacaccugaaguccaucaaccucgacuuugagcugcccguggacgcccaagauaaauucgcugccauucuucugaaugaaaagcucaacaaaagagacaagaaaaagcagcugaaagagcugugcccucacaaggauaagcggcucgaguacgcuuuuaaugccaucaucggaggcaaaaccaagcugaaagacauuuucggcgucgaagaguacgaugaagggacaaagaaagcgguggacuuugagaaggccgauuaugacgaagauaaggacgagaucgagucuguuauuaaagaaaacauccaugugcuuaaugcucugaaggccgucuacgauuggaccauucucacgaacauccugggagacuaugcuuacaucagcgagucccagguggcccuuuaugaagcccacaaaaaggaccugcgcauucucaaaagccugaucaagaaguacgcuaaaucucaguaugcggaugccuucagacaugagaauguuaagggcaacuacgcuaacuacgugggguccacaaauuaugacaacaaacaacccgucauugauaauccuagcgugacccaggaagacaucaacaaguacuuugccgauauucugcucucuaucacaccggacgaguccgaucgggagagcuaucaguacaucaccgaaagacugcacaaaggagaggcccuucccaagcugcgcaccaaggcuaauucugugcucccucaccagauucauaaaaucgaacuggagaagauucuugccaacgcggcuaaaaauuuccccuuucugcaagaaaaggacuccagcggcuauacagccgcccagaaaaucgucaagauuaugauguuccggaucgaguacuauguugggccucucaacacguaccaccauguggaucagggaggccacgcuuggauggugagaaaagccgagggcaagauuacccccuggaauuuugacgaaaaggucgauaaagaggcuuccgccgaaaaguucauccgcaacaugacaaauaaauguaccuaccugaucgggaaggacgugauuccgaaacaaucucugcucuauagccgguacaagguucugaacgagcuuaauaaccugaaggugaauggagcgccuaucuccgucgcccucaaacagaagauuuaugaggaacuguuuaaaaagcaagugaacguuacauucaaccagcugaaaaccuuccuuaagacgcagggcgaggaugcugacgaaaucauucucagcgggguggacgaggccgcucauaaguuuacaaauaaccugcagaccuaccacaaauucagagccauccugcgcgauaagaucgaauuugagccccagcggucuauggucgaggacauuaucagauggaaaugccucaugggagaugacauuaccauguggaagcacaaaaucgaaaaggaguauggcgaucagcuguccgaagaacaacuuaagaaaauuacacgccugaauuucaacggguggagccggcucucucaggaauuucugaccgacgugccuggagucgauaucgagagcggcgagguguacuccggcaucauggacgcgcuguggagaacaaaugaaaacauuaugcagcuucucucuagccgguucacguuugccgcugagguuaagaaacagaaucaagggaccggacgcaucgaaaagauuacauaugaugaggugaugaaagacaccuaccugucccccgccgucaagagaagcguguggcaggcuaucacacugguugaagagauucggaaaaucagaaaggccgaucccaagcgcaucuucguggagaugacccggcagccugacgccaaaaaggaaagaaaacucucucgcagaacgcagcugcuuaacgcuuaccgggcgauuggcaaugauaucgccgaguaugaaaaggagcaugucuccacccugauuacacaacucgagagcaaaaaggacgaagaccugcgcagaaagaaacuguaccuuuauuuuacccagauggggcgguguauguacacaggagagcgcaucgaucucucuucccugcugagagacaccaacagcaauauuuaugauaucgaccacauuuacccgcggucccucacgaaggaugacucucuggauaacacagugcuuugcaaaaaggaaaucaaucugaaaaagggcaacaaguauauccaucgcguguucaccgacaaagagcucaagaaacaguacggguacuggaaggcucugaaagaaaagaagcugauuagcgagagaaaauuuucccggcuuaugcgcacaaccgaucucaccgccgacgagcuggccggcuucaucucuagacaacugguugaaacaagccagauggucaaggcuacggccgauauucucgagaaaaucuaucccaaugugaccauuguguacgucaaggcgcggacaguguccgacuuuagacacgacuaugaacugccuaaaguucgcgcucuuaacgauugucaccaugcccacgacgccuaccugaacaucguggucggaaauguguauuacgagaaguucaccaagagccccuuccgguuuaucgcuaaccagaaaggcaagggggauauuaaauauaaucucuacagacuguucgacaaggauguuaaagugggagaccgcaucauuuggaacgccaaggaagaucuggcgcgggucaaagcuacacuugagagagacaccgugaauguugugcgcaugccugucgagcagcggggccaauuuuucgaugccacgauccagaagaaggggacaaccaaaaacaugcuggugcucccccugaagggaucugacgaaagacuccaggauaccuccaaauacggcuauuacgugcgcccgagcgggaugucuuuuauggucguucagcaugaggugaagggcaaaucccgggugacaauugaaccugcccugcuugucuauaagaauaagcugaaaagcgaggacgauuacgcuaaguauugcgaagacgugcucaaacugcaaaagcccaaaguucuguucaagaacaucaaguuuggaucuaaaauccuuuucgacggcuacccuuuucugcucaaggggagaaccgagaaucggauuaucauggccgaugcucagagccuguuccucggaaaccaggagcugaaaauucuuaagcgcgugacaaaaaucuccgacgauauugaccacaaggucgaaagcagaaucaagauuacggaugaggaauggaccacacuguggaaaucugugguugagcagaucgugaccggcaaguuucggaaucgccucgggacacugaacggaauccugcaaggcagaaaaauuaaacuuuccaaggacgaggaagcccggcugaaugagcucgauagcaaggaccaggaaaccuuccugucccagauccuccuggagagauuccuucaauuuucuacggaagagaaaacccgccugcugcuccaggucauuagcuucuccgggaacacaaccggcguggaucugcggcuuaucggaggcucuagcgggacaggaaccauuaagacaaauaagaacaucaccgaccauuccguuauccugauuaacgagucucccacgggccucuuuacaaauagaaccgugcugaaccagccuuga

SEQ ID NO: 4411 - RNA, 4176 nt, Artificial Sequence
  Cas9 variant
augaagagaaacaaugacuacuauaucggccuggauauggggaccaacagcgugggaugggccacaacgaauccccagggccggcuccugcgcuucaacaaaaaggacauguggggguccagacuuuuugaggaagcuaaaaccgccgcgaagacacggaccuuccgcacaucuagacggcgcuacgauagaguccggcaacgcauugaguuucugcaggacaucuucgcuccuauuaucgccaaaaaggauuuugaguucuuuaugagacucaaggagagcaaauuccaccuggaagacaagaaaaccgauggaaaguuugcccuuuucaaugacgcugauuuuacagacguugaguauuucgaucgguacccgaccauuuaucaucugcgcgccgcucucaucaaacccaaccacaucacggacccuagacugcuguaccucgccauucaucacaucauuaagaaucggggccauuuucuguucgcggggaccgauauggaguccauccgcucuuuccagauuguguauacacagcuuagcgaacaccugaaguccaucaaccucgacuuugagcugcccguggacgcccaagauaaauucgcugccauucuucugaaugaaaagcucaacaaaagagacaagaaaaagcagcugaaagagcugugcccucacaaggauaagcggcucgaguacgcuuuuaaugccaucaucggaggcaaaaccaagcugaaagacauuuucggcgucgaagaguacgaugaagggacaaagaaagcgguggacuuugagaaggccgauuaugacgaagauaaggacgagaucgagucuguuauuaaagaaaacauccaugugcuuaaugcucugaaggccgucuacgauuggaccauucucacgaacauccugggagacuaugcuuacaucagcgagucccagguggcccuuuaugaagcccacaaaaaggaccugcgcauucucaaaagccugaucaagaaguacgcuaaaucucaguaugcggaugccuucagacaugagaauguuaagggcaacuacgcuaacuacgugggguccacaaauuaugacaacaaacaacccgucauugauaauccuagcgugacccaggaagacaucaacaaguacuuugccgauauucugcucucuaucacaccggacgaguccgaucgggagagcuaucaguacaucaccgaaagacugcacaaaggagaggcccuucccaagcugcgcaccaaggcuaauucugugcucccucaccagauucauaaaaucgaacuggagaagauucuugccaacgcggcuaaaaauuuccccuuucugcaagaaaaggacuccagcggcuauacagccgcccagaaaaucgucaagauuaugauguuccggaucgaguacuauguugggccucucaacacguaccaccauguggaucagggaggccacgcuuggauggugagaaaagccgagggcaagauuacccccuggaauuuugacgaaaaggucgauaaagaggcuuccgccgaaaaguucauccgcaacaugacaaauaaauguaccuaccugaucgggaaggacgugauuccgaaacaaucucugcucuauagccgguacaagguucugaacgagcuuaauaaccugaaggugaauggagucccuaucuccguggcgcucaaacagaagauuuaugaggaacuguuuaaaaagcagguuaacgugacauucaaccagcugaaaaccuuccuuaagacgcaaggcgaggaugccgacgaaaucauucucagcggggucgacgaggcugcccauaaguuuacaaauaaccugcagaccuaccacaaauucagagcuauccugcgcgauaagaucgaauuugagccccagcggucuaugguggaggacauuaucagauggaaaugccucaugggagaugacauuaccauguggaagcacaaaaucgaaaaggaguauggcgaucagcuguccgaagaacaacuuaagaaaauuacacgccugaauuucaacggguggagccggcucucucaggaauuucugaccgacgucccuggaguggauaucgagagcggcgagguuuacuccggcaucauggacgcccuguggagaacaaaugaaaacauuaugcagcuucucucuagccgguucacguuugcggccgaggugaagaaacagaaucaagggaccggacgcaucgaaaagauuacauaugaugaggucaugaaagacaccuaccugucccccgcugugaagagaagcguuuggcaggccaucacacugguggaagagauucggaaaaucagaaaggcugaucccaagcgcaucuucgucgagaugacccggcagccugacgccaaaaaggaaagaaaacucucucgcagaacgcagcugcuuaacgccuaccgggcuauuggcaaugauaucgcggaguaugaaaaggagcauguguccacccugauuacacaacucgagagcaaaaaggacgaagaccugcgcagaaagaaacuguaccuuuauuuuacccagauggggcgguguauguacacaggagagcgcaucgaucucucuucccugcugagagacaccaacagcaauauuuaugauaucgaccacauuuacccgcggucccucacgaaggaugacucucuggauaacacagugcuuugcaaaaaggaaaucaaucugaaaaagggcaacaaguauauccaucgcguuuucaccgacaaagagcucaagaaacaguacggguacuggaaggcccugaaagaaaagaagcugauuagcgagagaaaauuuucccggcuuaugcgcacaaccgaucucaccgcugacgagcuggccggcuucaucucuagacaacuggucgaaacaagccagauggugaaggccacggcugauauucucgagaaaaucuaucccaaugugaccauugucuacgugaaggcccggacaguuuccgacuuuagacacgacuaugaacugccuaaagugcgcgcgcuuaacgauugucaccaugcucacgacgccuaccugaacaucgucgugggaaauguuuauuacgagaaguucaccaagagccccuuccgguuuaucgccaaccagaaaggcaagggggauauuaaauauaaucucuacagacuguucgacaaggaugugaaagucggagaccgcaucauuuggaacgcuaaggaagaucuggcccgggugaaagcgacacuugagagagacaccguuaaugugguccgcaugccuguggagcagcggggccaauuuuucgaugcuacgauccagaagaaggggacaaccaaaaacaugcuggugcucccccugaagggaucugacgaaagacuccaggauaccuccaaauacggcuauuacguccgcccgagcgggaugucuuuuaugguugugcagcaugaggugaagggcaaaucccgggucacaauugaaccugcccugcuuguguauaagaauaagcugaaaagcgaggacgauuacgccaaguauugcgaagacguucucaaacugcaaaagcccaaagugcuguucaagaacaucaaguuuggaucuaaaauccuuuucgacggcuacccuuuucugcucaaggggagaaccgagaaucggauuaucauggcugaugcccagagccuguuccucggaaaccaggagcugaaaauucuuaagcgcgucacaaaaaucuccgacgauauugaccacaagguggaaagcagaaucaagauuacggaugaggaauggaccacacuguggaaaucuguuguggagcagaucgucaccggcaaguuucggaaucgccucgggacacugaacggaauccugcaaggcagaaaaauuaaacuuuccaaggacgaggaagcucggcugaaugagcucgauagcaaggaccaggaaaccuuccugucccagauccuccuggagagauuccuucaauuuucuacggaagagaaaacccgccugcugcuccaggugauuagcuucuccgggaacacaaccggcguugaucugcggcuuaucggaggcucuagcgggacaggaaccauuaagacaaauaagaacaucaccgaccauuccgugauccugauuaacgagucucccacgggccucuuuacaaauagaaccguccugaaccagccuuga

SEQ ID NO: 4412 - RNA, 4179 nt, Artificial Sequence
  Cas9 variant
augaaaagcauccugggccucgaccuggggaccacauccauuggaugggcccuugugaaagagucugaaaacgauaaugaaaagagcgaaaucgucaaacugggcguuagacucgugccccugacgaccgacgagcggacagauuucgaaaaggggaaauccauuaccacaaacgcugaccgcaccucuaagagaagcaugcggcgcaaucuucagagauacaagcugcggcgcgaggcccucguguccgagcugaaaaaggaacacuggaucgaugagggauauagauuuucugaagacggcccugggagcacauucuccacccugcggcuccgcgcgaaagcugccgaggaggaaauuagccugcaagaucuugccaagguccugcuccagaucaacaaaaagagaggauacaagucuucccggaaacugaauagcgcugaggacggccaggccaucgauggcaugucuguggcuaagguucuuuaugaccgcgggcugacgccgggagaauacguguaucagagaaugcucgauggccaauacgccauucccgaguuuuauaaauccgaccugcaggcggaauuugauaagaucuggaaccugcagaaaagcuacuacccugagcucaccgccgagcuguaugacaaacuuacagacaaaaauaagucucagaccugggcuauuugccgggaugaacuggggguccaaggauuuaaguccagcuucacaggcaaagagcgccucaaggaagccuacuuuaacagacagcaggcuuccaaacagaagguggaccuggagguucuuaccugugugcugcaagauaucaaugggcagaaagccucucucagcggacugcuguccgcgauuagcgaccggucuaaggaacucuauuucaacagaaugacggucggccagaugcuggugcgccaaauccaggaggaucccaaucggucccuuagaaacacaguguuuuaccgccaggacuauauugaugaguucgaaaagaucuggagcguccagucucgguuucauccugagcugacccaagaaagaaagaagaaacucaaggacaucauuaucuucuaccagcgcccccugaaaagccagaagggccuuauuucccugugcgaguuugaaucucgggagguugauaucagcguggacggggugauuaagaaaaagaaaaucggaccuagagucuguccgcgcuccagcccccucuuccaggaguucaagguguaucaaacaguuaauaacauccuggugaauggcgaaccucuggaugacaacgaccgggagaaacucgucggggaacuggccuuuagagagaagaugaagggacaggaugugcuuaaacugcucuacaagaccucuaaaggcaugcgcauuaacuucgaggaaguugaggggaaucggaccauggcuacaauccugaaggccugcgagaaaauuguggagggacugggcuacgacacgagagaucuuuccaagaucaccgcuagcgaaaaagucucucggauugaggagaucuuugccaaggaaggcuucaaguccgacuuucuccacuucgauagcucccugcccucuccugaguuugaaagccaggccuccuauucucuguggcaucuccuguacagcuaugagaacgacaaauccgugagcgggaaugaaucucuugucgagaagaucaaaaagcuguguuccauggaugaggcuagcgcgaaaauucucucuggaugcacauuccuguccgacuacggcagccugucugcccgcgcuaugagaaagauccuucccuauaugaaggaugggcucgaauacagcgccgccugugcuauggccggauaucggcacuccaaaagaagccugaccaaggaggaacuggacucucgcguguacguugaucggcucgagcugcuuccgaaaaacucccugagaaauccuguggucgaaaagauucucaaccagaugaucaaugugguuaacagcguggucgacacauacggcaaacccgaugagauucgcaucgagauggcgagagaacugaagaaguccgcuucugagcgggaaaaagcccaaaaggacauugccgcugccagcaaagugaaugaguccaucguggcuacccugaaggggucuccuuucuucaucgacagccccucccgcaacgauauuaucagauaucggcuuugggaggaacucaaacccaauggcuacaagacgcuguauucuggaacauacauuccuaaggagcgccuguuuagcaaagacuucgauaucgaacauauuaucccgcaggcccuccuguuugacgauuccuucgcgaacaagaccaucgagagcagacagugcaauauugaaaaaucuaaccggaccgccauggacuauguuaaguccaaauacgauagcuucggcguccaggcuuauaucgaccgcgugaaggggcuuacaggagugucuaaaaccaagauuacaagacugcucauggaguccaaggauauccccgaggacuuuauuaaucgggaacugcgcgauagccaauacaucgccagaaaagcucgggagauccuggaaucuauggucaaguucgugguuccuacgaccggcuccgugacagccagacuucgcgaggacuggcagcucgucaacgugaugcgggaacugaacugggauaaauacgagaagcuggggcucaccagcuuuagagaggaccgcgacggacgggaaauucccguuaucgaggauuggacaaaaagaaaugaccaccgccaccaugcgauggaugcccugaccauugcuuucacgcggagacaguuuauccaauaucuuaaccaccugaaugccaagauugacaccguggauaagacagacaucgaucuccgcgacuacaaccuggaagauaucuccuucgacggccugcgggauggggacaaauuuggcauugucaaggcccuucagaaaaaguaucuguacaaagacgauaagcagaaguauagauucgugccucccaugccgcucgacgaguuucggaucgaagcuaaacgccagauugaggauguucuggugagcuucaaggccaaaaauaaggucuguaccaaaaacgugaauacaaccaaggugagaggaggccaacagcggaagauccagcucacgccucgcgggccccugcaugaggacacaauuuacggaaaaagacuucaguaugucaccaaggaagagaaaguuggcgggucuuuugaugaagcuaagaucgcgagcgugugcaaaaaguccuaccgggaggcccugaugagacgccucauggaguguggaggcgacccuaagaaggcuuucacagggaagaacucucuggagaaaaaucccgugugggucgaugaauuucacagcggcgaagugccucugcggguuagaaccguguccauggccucugucuacaccgugcgcaagagcguuggacaaucccuuaacauugagaaagugcuggacaagcacaucaaagaaauccuccgggccagacuggaggaguauggcgggaaugcuucuaaggccuucagcaaccucgaugaaaaucccauuuggcugaacaaggagaaaggaaucgcggucaagcgcgugacaauugacuccggcaaaaauccgaucccucuucggagcaagcuggauaaagacgggcagauuaucuacggagaaggccagaacccccaggagucugauuucguugugcccgggggcaaccaucacgcugccaucuauagaacgccuuccggaaagcuccaagacgucguggugagcuuuuacgaagccgucucucgcaagaaucugggccuggagguuauugacagaaacuucaaaaaggaugaggggugggaauuucuuuucacccugaaacagaaugaguauuuuguguucccgaaccccgcuacaggauuuuccccugaagacuacgaucucaccgaccccgccaauaacgcgaucauuagcccuaaucuguaucgggugcagacagucuccgugggcgauuaccgcuucagacaucaccucgagaccacgguugaagacaacgagaagcugcgggauaucgcuuggaaacgcauugggcccucuggacuugugggcgccgucaaggugagaaucgacaaucugggccggauccuggccguuggggaguacgauuga

SEQ ID NO: 4413 - RNA, 4179 nt, Artificial Sequence
  Cas9 variant
auggagaacaagaauuacagcaucggccuggacauugggaccaacuccgugggaugggccgucaucacagaugacuauaaaguucccucuaagaaaaugaagguguucggcaauacggauaaacacuuuauuaagaagaaccucaucggggcucugcuuuucgacgaaggagccaccgcggaggauagacggcugaaacgcacagcuagacggcgcuacaccagacggaagaaucgccucagauaucugcaggaaauuuuuagcgaggaaaucuccaaacuugacucuagcuucuuucaucggcuggaugacuccuuccucgugccuaaggauaaacgcggcucuaaguacccgaucuuugccacacuggaggaggaaaaggaguaucacaaaaaguuccccaccauuuaccaucugagaaaacaccucgccgacagcaaggagaaaacagaucugcggcuuaucuaucuggcucucgcccauaugauuaaguaccgcgggcacuuucuguacgaagaguccuucgacaucaaaaacaaugauauucaaaagaucuuuaacgaguucauuagcaucuaugacaauaccuuugaaggaucuucccuuagcggccagaacgcucaggucgaagccaucuucacggacaagauuucuaaauccgcgaagagagagcgggugcugaaacucuucagcgaugaaaagucuaccucccuguuuagcgaguuccugaaacucaucguuggcaaucaggccgacuuuaagaagcacuucgaucuggaggaaaaagcuccucuucaauuuuccaaggacacauacgaugaggaccuggaaaaccuccuggggcagauuggagauggcuucaccgaccuuuuucugguggccaaaaagcucuaugaugcuauccugcugucugggauucucacagucaccgaccccagcacgaaagccccucuguccgcgagcaugaucgagcgcuacgaaucucaucagaaggaucuugccgcucugaagcaguucaucaaaaauaaccuccccaagagauauaaugagguguuuuccgaccaaagcaaagacggauacgccggcuauauugaugggaagacaacccaggaggcuuucuacaaauacaucaagaaccugcuuucuaaguuugaaggagccgacuauuuccuggauaaaauugagcgggaagacuuucucagaaagcagcgcacauucgauaacggcagcaucccucaccagauucaucugcaagagaugaaugccauccugcggagacagggcgaacacuacccguuccucaaagagaaccgcgagaagaucgagaaaauucugaccuuucggauccccuauuacguugggccucuugcuagaggaaaucgcgacuucgcguggcugacccggaacuccgaucaggccauuagacccuggaauuuugaagaaaucguggacaaggcuucuagcgccgaggaguucauuaacaaaaugacaaauuaugaucucuaccugccugaagagaagguccugcccaagcacucccuucucuaugaaacguuugccguguacaacgagcugaccaaagugaaguucaucgcugaaggccugcgcgacuaccaauuucucgauagcgggcagaaaaagcagauugucaaucagcuguucaaagagaagcggaagguuacagagaaagacaucauccauuaucuucacaacguggauggauacgacggcauugaacugaaggggaucgagaaacaauuuaaugccucucucuccaccuaucaugaccugcugaagauuaucaaagauaaggaguucauggacgauccgaagaacgaagaaauucuugagaauaucgugcacacacucaccaucuuugaggacagagaaaugauuaaacagcgccuggcgcaguacgauagcaucuucgacgagaaggucauuaaagcucugacgcggagacauuauacaggauggggcaagcucucugccaaacugaucaacggcauuugcgauaagcagaccggggacaccauccuugauuaccugaucgacgauggaaagauuaaucggaacuuuaugcaacucaucaacgacgauggccuguccuucaaagaaauuauccagaaggcccaggugguugggaaaacagacgacgugaagcaggucgugcaagagcugccuggaagccccgcuauuaaaaagggcauccuucaguccaucaaaauuguugaugaacucgugaaggucaugggguaugccccugagucuaucgugauugagauggcucgcgaaaaucagaccacagccagaggcaagaaaaacagccagcaacgguacaagagaaucgaggacucccugaaaaaucuggcgcccggacucgauucuaacauucugaaggaaaaucccacggacaacauccagcuucagaaugaucgccuguuccucuacuaucugcaaaacggcaaagacauguacaccgggaagccucuggauauugaccagcuuagcuccuaugauaucgaccacaucauuccgcaggccuuuaucaaggaugacagcauugacaaucggguccucacaucuuccaaagauaacagaggaaagagcgacaaugugcccucucuggagguugugcagaaacgcaaggcuuucuggcaacagcugcucgauuccaaacugaucagcgagagaaaguuuaacaaucuuaccaaggccgaacggggcgggcuggacgagcgcgauaaagucggauucauuagacggcagcucguggaaacacgccagaucaccaagcacguugcucaaauccuggacgccucuuuuaacacggaggugaaugagaaaaaccagaagauuagaaccgucaaaaucauuacacuuaagagcaaccugguguccaauuuccggaaggaauuugagcuguacaaagugcgcgaaaucaacgauuaucaucacgcgcaugacgccuaccucaaugcuguugucgccaaggcuauucugaaaaaguauccuaaacucgagcccgaguucguguacggcgauuaccagaaguaugaccugaagagauacaucagccgguuuaaaccuucuaaggaaaucgaaaaagccaccgagaaguauuucuuuuacuccaaccuucugaauuucuucaaagaggaagugcacuaugccgaugggauuaucgucaagcgcgagaacauugaauacagcaaagacacaggcgagaucgcuuggaauaaggaaaaggauuuugcgaccauuaaaaaggugcucuccuauccccagguuaacaucgugaaaaagacggagauucaaacacacggacuggacagaggcaaaccgaaggggcuguucaauucuaacccuagccccaagccuuccgaggacucuaaagaaaaucuuguccccaucaagcagggacuggauccucggaaauacggcggguacgccggaaucagcaacuccuaugcugugcucguuaaggccauuguggagaaaggcgccaagaagcagcagaaaaccauccuggaauuucaagggauuucuauccucgacaagauuaauuucgagaacaauaaagagaacuaccugcuuaagaaaagauauaucgaaauccugagcacaauuacccuccccaaguacucccuguuugaguucccggauggcacccgccggagacuggcuagcauccuuucuacaaacaauaagcgcggagaaauucauaaaggcaacgagcugguccucccugggaaguauacgacccugcucuaccacgccaaaaauaucaacaagaaacuggaacccgagcaucuugaguauguggaaaagcaccggaaugacuuugcgaaacugcuggaguguguucucaacuucaaugauaaguacgugggagcucugaagaacggcgaacgcauuagacaggccuuuacagacugggagaccgucgauaucgaaaaacuuugcuucuccuuuaucgggcccgagaauagcaagaacgccggacuguucgagcucacaucucagggcuccgcuagcgacuuugaguuccugggggugaaaauuccucgguacagagauuaugccccgucuucccuccugaaggcgacccuuauccaucaaagcauuacgggccuguacgaaacacgcaucgaccuguccaaacucggagaagauuga

SEQ ID NO: 4414 - RNA, 4179 nt, Artificial Sequence
  Cas9 variant
augaacaauaacaauuacagcaucggccuggacauugggaccaacuccgugggaugggccgucaucacagaugacuauaagguucccucuaaaaagaugaaagugcucggcaauacggauaagcacuucauuaaaaagaaccugaucggggcccuucuguuugacgagggagcuaccgcggaagauagacgguucaagcgcacagcuagacggcgcuacaccagacggaaaaaucgccucagauaucugcaggagauuuuuagcgaagagauguccaagguggacucuagcuucuuucaucggcuugaugacuccuuccuggucccugaagauaaacgcggcucuaaguacccgaucuuugccacacucgccgaggagaaagaauaucacaagaaguuccccaccaucuaccaucugagaaaacaccuggcugacagcaaggagaaaacagaucuccggcugauuuaucuugcccuggcucauaugaucaaguaccgcgggcacuuucucuacgaagaguccuucgacauuaaaaacaaugauauccaaaagauuuuuagcgaguucaucucuauuuaugacaacaccuuugaaggauccagccugucuggccagaaugcccagguggaggcgaucuucacggacaaaaucuccaagagcgccaagagagaacggauucuuaaacuguucgcuuacgagaagucuaccgaucucuuuuccgaauuucugaaacugaucguuggcaaccaggccgacuuuaagaaacacuucgaucucgaggagaaggcuccucugcaauuuagcaaggacacauaugaugaagaccuugagaaucugcucgggcagauuggagaugacuucgccgaucuguuucuuguggcgaaaaagcuguacgacgccauccuccuguccggcauucugaccgucacagauucuagcaccaaagcuccccucuccgccagcaugaucgaacgcuaugagaaccaucagaaggaccuggcugcccuuaaacaguucauccaaaauaaccugcaggaaaaguacgacgagguguuuucugaucaguccaaggacggguaugccagauacauuaacggaaaaacgacacaggaggcuuucuacaaguauaucaaaaaucuccugagcaaguuugaaggcucugauuacuuccuugacaaaauugagcgggaagauuuucugagaaagcaacgcaccuucgacaacgggagcaucccucaccagauucaucuccaggagaugaaugcgaucauccggagacaaggagaacacuaucccuuccugaaggaguacaaagagaagauugaaacaauccugaccuuucgcauuccuuauuacguuggcccgcucgcccggggcaacagaaauuucgcuuggcugacccgcaacuccgaucaggccauccggcccuggaauuuugaggaaauuguggaccaggccucuagcgcugaggaguucaucaacaaaaugacaaauuaugaucuuuaccugccugaagagaagguccuccccaaacacucccugcuguacgaaacguuugccguguauaacgagcuuaccaaggugaaauucauuagcgaagggcucagagacuaccaguuucuggauucuggacaaaagaagcagaucgucaaucagcuguucaaagagaagcgcaaaguuacagagaaggacaucauucaguaucuccauaacguggauggcuacgacgggaucgaacugaaaggaauugagaagcaauuuaaugcgucccuuagcaccuaucacgaccugcucaagaucauuaaagauaaggaguucauggacgauccuaaaaacgaagaaauccuggagaauaucgugcauacacugaccauuuuugaggaccgggaaaugaucaagcagagacuugcucaguacgccucuauuuucgauaaaaaggucaucaaggcccucacgcgccggcacuauacaggcugggggaaacuguccgcuaagcugauuaacggaaucugcgacaaaaagaccggcaaaaccauccucgauuaccugauugacgauggcuacagcaacagaaauuuuaugcagcuuaucaacgacgaugggcuguccuucaaggacauuauccaaaaggcccaggugguuggaaaaacaaaugaugugaagcaggucgugcaggagcuccccggcucuccggcuauuaaaaaggggauccugcaaagcaucaaacugguugacgaacuugugaaggucaugggacaugccccugaguccauugugaucgaaauugcgcgggagaaccagaccacagcccgcggcaaaaagaacucucagcaaagauauaagcggaucgaggacgcucucaaaaaucuggcccccgggcuggauagcaauauucucaaggaacacccuacggacaacauccagcugcagaaugauagacuuuuccuguacuaucuccagaacggcaaagacauguacaccggagaggcucuggauauuaaucaacuguccagcuaugacaucgaucacaucgucccccaggccuuuauuaaggacgauucucuugacaaccgcgugcucacauccagcaaagauaaucggggcaagucugacaacguucccucccuggaagugguccagaagagaaaagcguucuggcagcaacugcucgacagcaagcugaucucugagcauaaauuuaauaaccuuaccaaggccgagcgcgggggacuggaugaaagagacaaagugggcuucauucggcgccagcucguugagacaagacagaucaccaagcacguggcucagauucuggaugcccgguuuaacacggaagucaaugagaaggacaaaaagaaccgcaccgugaaaaucaucacacuuaagagcaaucugguguccaacuucagaaaagaauuuaagcuguacaagguucgggagauuaaugauuaucaucacgcucacgacgccuaccucaacgccgucguggcuaaagcgauccugaagaaauacccuaagcucgagccgggguucguguauggagauuaccaaaaauaugacauuaagcgcuacaucagcagaucuaaggaucccaaagaagucgagaaggccaccgaaaaauauuucuucuacuccaaucugcuuaacuuuuucaaggaggaagugcauuaugcugacggcacaauuguuaaacgggagaauaucgaguacagcaaggauaccggggaaaucgccuggaacaaagagaaggacuucgccacgauuaagaaagugcugucccucccucaggucaauaucgugaagaaaacagaaauucagacccacggccuggaucgcggaaagcccagaggccuguuuaacucuaauccuagccccaaaccguccgaggaccggaaggaaaaccuuguuccuaucaagcaagggcuggaccccagaaaauacggaggcuaugcugggauuucuaauagcuacgccgugcucgucaaggcgaucauugagaaaggagcuaagaaacagcagaagacagugcuggaguuccagggcaucuccauccucgauaagauuaacuuugagaaaaacaaggaaaauuaucugcuugaaaaaggguacaucaagauucugucuaccaucacccucccuaaauauagccuguucgaguuucccgacggcacacgccggagacuggccuccauucuuagcacgaacaauaagcgcggagagauccauaagggcaacgaacugguuaucccugagaaauacaccacacuccuguaucacgccaagaauauuaacaaaacccucgaacccgagcaucuggaauacguggagaagcaccggaaugauuucgcuaaacuucuggaguacguccugaacuuuaaugacaaguaugugggggcccucaaaaacggagaaagaauccgccaagcguucauugauugggagacaguggacaucgaaaagcuguguuuuucuuucauuggcccgagaaauuccaagaacgcugggcuuuuugagcugaccagccagggaucugccuccgauuucgaauuucucggcgucaaaaucccucgguaccgcgacuauacgcccagcucucugcucaaugccacacugauccaccaguccauuaccgggcuuuacgagacccggaucgaucugagcaagcugggcgaggacuga

SEQ ID NO: 4415 - RNA, 4179 nt, Artificial Sequence
  Cas9 variant
augaagaacuaccacaucggccuggacauugggaccagcuccgugggauucgccgcuagagaugacgagaauaaccucauccgggucaaaggcaagaauguuauuggggcccgccuguuugcggaaggaaaaacagcucaggagagacggauggcccgcacgucuagacggcgcuauaacagacggaaguggcgccuuagacugcucaaugauaucuuccaugacgaaauugugcacaaagauaaggacuuuuucaaccggcugaagcaaagcuccaucucucccaaagaugaccgcaagaaauacuuuggcagccuucuguucccugagcucuccgauucugaauuuuaucauaaugggaaccagaccaucuaccaccugagacaucggcugaugacaagcaaugagaaggccgacauucgcgagaucuaucucgcucugagacacauugugaaauaccggggaaacuuccuugaugacaccccggucuccagcuuugaagccucugaucugaagcucggcuccuucauccccacacugaaugaccuuuuugagaccauugacgugaacuauguuuucaauagcgaaaacacaaaucagaucgagucuauucugcucaacaacgaucugagaaauuccgacaagagcaaacagcugguggaucuccuguaccgcaacgucucugacguggaugacaagucccuugagaaacaauuuaauaaguuccggaaagauaucagcaaggaaaucgcuaaauccuucguuggcucuaaguuuaacgugaauaagcugcucgccuacgagaccgacgaugggagcaaaauuucccugagcuucucugacgcguccagcgaugacaagaugcuugaacuggccgacaaccucgaugacgagagaaucaauauucugaacgcucugaaagucaucuauucucgcgugcggcucaaucagauuaucccuaacggaaugggccugagcgaauccaugaucgccucuuacgagcuucacaagaaacagcugaaugaucucaagaagcugcuuaacgugcugcccuuucaugagaaauaugcugucaagguugccuacgcggccuauauugggaauauggacgcucagaaauucacgcaagccgaacucagcaccaucgagucccugaaggaaaaagauagcauuaagaaggugaucgacugcaaaacaggacacauuaccaacgagucucugaucuccgugaucaaucagauugucgugaacccuuaccucgaaaacagcgauuuugagcugaucgacauuguuaagaaaaucgaucaggacauuaagaauggcgaguaucuucugaaacagagaaacaaucaaaacgggaauaucccccaucagcuccaccagauggaaauggaucaaauuaucgagaagcagucuaaguacuacccuuuccugggagaacugaacccgaaugagaaccgccggcacaucgcuaaauauaagauuuccgaacuuguggccuuuagaguccccuacuaugugggcccucucaucacacccgaggagcaggccaaaaccagcggcgcuuccuucgcguggaugaagcgcaaagaagacggggagauuacgccuuggaauuuugaucagaagguugaccgggaagccacagcuucuagauucaucaaacgccugaccgugaaggacacauaccuguuuaacgaggauguccuccccgacaauagccugcuuuaucaacaguucaaggugcugaacgagcucaaugucgugaaaguuaacaauaagcggcugucccaggccgaaaaacagggagccuuuaacgaucuguucaaggugaccaaaaccgucacagcuaagagacuuaagaacuaccucgugucuaauuucaaccaucuggacacgauugagaucaccggccugagcgauggggaaaaauuuaauaacggacucacauccuauguugacuuccaaaagaucuuuggcgauaaaauuaauaaccuggagcuuauggacgauuucgaaagccugaucgaguggucuaccguguuugaggaccggcacauuuucgaagagaagguccgcaaugaaaucaacuggauuuccgagagcgaacucaaacagcugguggccaagagauacucuggguggggacggcuguccagcaaacuucucgugggcaucaauaacgaugagggcagaaauaucauugagcagcuguuugaaacaucugagaccuucauggaagcgaucagccgcccggagguuaaaaagcagauugacgaaaucaacuccgauuuuauuaaaaauacggacaucgagagcguccuggcugacgccuacacaucuccucaaaacaagaaagccauccgggagaccuauaagauugugaaggauauccagaaagcuaugggagggaaggcccccgaauccauuagcaucgaguucaccagaaauccugaagacaaaggcgagcucacacgcuccagacauucugagauuagccggaaguacaaagaacuguccaaggagaucucuaaagaacuuaacgaugagcucaagagcaagaaaaacuccauggacauugauaaguauuaccuguauuuuaugcagauggggaaagaccuguacgauggaaagucuaucgacaucgaugaccugaauaacuaucagauugaucacaucgugccccagagcuucuacaaagacgacuccuuugauaaucgcguccuuaccuacuauacaaacaaucaaaagaagggcaacaauacgccccucaacgggcugaauauuagcaacgaaaccagaaaacuguggucucaucuccacgaccugggccuuaucuccaagcggaaauaccugaaucucacaaugcagggacuggauagccugucuaaguauaccaaacacggcuucauucgcagacaacuuguggagacaucccagguuaucaagcugguggcuaacauccucagcgacgaguucucugccgauaauaccaagauuaucgaagucaaagcgaagaugaacucccagaugcggcauagcuuuaaucuguacaaaauucgcgagcucaacgacuaucaccaugcccuggaugcuuaccuuacgaccuucaucgggggauaucuguacaauagauacccuaagcuccggggcauguuuguguauggggacuucaaaaaguuugauguuaacgacgccaacaaugugaagacacugaacuuccugcacgauauuaccaauccguccgacaaauuugucaaccagaucuacgaugaacaaagcggagagcuuauccuggaccgcaagcacgcuauugaaacaaucaaaaagauuuaucaguacaaauucaugcucaucaccagagaggugucuacgaaggacgauaagcugagcgaccagacaguuuauuccgccaaacggauuaauaacguggcgucucccaucccugucaagaaagauagcaaucccgagcucuacggcuuuagaaccgggaacguggaccaucacauggugauugucaaguauccuaaaaaggauuccuucguuuacaaaguggugggcauccccauccgcuuuaugcaggaacugcggucuagcaagaaucaauccgaguacgaaaacacacuuaaucagauuguccaggccaagcugaacagaaagaaguucgacuuccgcgugguuguggauaaugucauguauggacagcucauccaagacggcgggcagaaauuuacccugggaucuagcaccuaccgguauaacgcuaagcagcuggugcuugauauggacucccugcgcauucucagcgaugagaaauacagaaauucucugacagacgaugaaaagaacuccgaguucaucaacauuuaucaacagguucucaauguggucaacgagaaguuugacguguucgacguucggggcacgagagauaaacugaccaaggggcuugacaaauuucugaauaucacaagcaacgauaaggaaaucgugcugcucaaaauucugucuggacuucauuguaaugccgcucgcgucaagaucaacgagauuggcaucaauaccuccuucggggaacugcagacaacccacggcauugugcucagcgagaacuccuacaucaucuaucagucuccgagcggacuguuugagcggaaggugagacucaaagaccuguga

SEQ ID NO: 4416 - RNA, 4179 nt, Artificial Sequence
  Cas9 variant
auggccaacaagaccugguaccugggccucgacaucgggagcgcuuccgugggaugggccgcgacagauacgggcuauaaaauuaucagaaagaauaaaaagcggcuguggggaguccgccuuuucgaggaagcuaaaaccgccgaggacagacggggguaccgcucuagcagacggcgccuggccagacggaaguggcgccucaaccugcuugaagaacuguuuacauccgaaguuaagaaaguggaugagaauuucuuucucagacugaaggagucucaguaucacuacgaagacaaaacccauaaggugcccuaugcuauuuucaacgauaaagacuacacagauaaggacuauuacaaggauuacccuaccaucuaucaucugcggagcaaacucaugacagaggaaaauccggacauucgcaaggucuuucuggccauccaccacaucauuaaaaacagaggccauuuccuucugcaagggcaguccuuuaaggauggaaaucucaacaaucugaucaaagagcuucuggagcucgacauucugcacgugggcuucgaaguuaccgaggaaguggucgauaagaucgcugacauuucucuggagaaaaagacgagcaaggacaaacucaacgauaucaaggaacuguaccccaaagagaagcagcuucuggagguguuucggcucauuuucggcgggaaaaccucccuggacaaacuuuuugccaucgaugaauauaaggagcuggacgcggccaucaaaagcguuucuuucaaggaaaagauuuacgaggaagugcgccacgauuaugagcagguccucuccaauuacaucgagcugcuggaccucgcuaagcugguguaugauagcauuauccuuucugacauuaaaaaggaaggaaagacacuguccgagagcaaaguggaacucuuugagaagcauagagaugaccugcuuaaacugaagaaccucgucaaaaaugauucuaagcuguccgaagacaagaaaguugagcuguacgcccucaucuucaaggaggacaaagauaagggcaccaacuacgugaauuauauccggaaaagcgaagaggggaagggaugcaacuacgaagacuucaaaaaguuucuggugaaggagcuugcuaaacuggaggaauccucugucaagacagagauuaucaaagaucucgaacuggagcaauuccugccucuucagagaaccaaggacaacagcgugguucccuaucagauucacaaagaagaacucgugaagauccuggauaaugccgcgcgcuaccauuccuuucugaacgagaaggacgaaagcggcuauaauguccgggagaaagugauucagcuccuggaguucagaaucccuuacuauguugggccccuuaacucuuccaagaaagccaaggagggaggcuuugcuuggagcgugcgcaauacgggcuacgaaaacacaccugucaccccguggaauuacucuaaagugaucgaugagagcgccuccgcugagaaguucauuacaaaccugaccaauaaguguaccuaucucaaaggggaagacguccugcccaagucuagccugcuuuacuccgaguuugcccuccugaacgaacugaaugcccucaaauaugauggaaaccggaucagccuggaggcuagaaauacaauuaucgaaaaacuuuucaaacaacagggcaagaaggugacgaaaaccucuauuaagaaccugcucaaagcggagggguacaucgacggaaagggcgagauuacagggaucgauaucaccguuaaaaaugaccugaaguccuaucgcgauuuuaaaaagauucugggaaacaaguucaacagcgaacacguggagaauaucauucuuuggaucacacucuacggcgaaucucggaaacugauuaaggccaaaaucgaguccgucuauggcgagguguacagcaaggacgaaaucaccaaaauguccagacugguuuacaaggacugggggcgcuuuucucggaagcuccugacggagcuugugagcaaaaagcuguauaacgaagagacaggagaaugccucaauauuaucggcgcuaugagacagaacaauauucuguucauggagcugcuugccgaucgcuuugacuacuccaaacagaucgucgaguucaacaaggaacuccaagaggaugugaccgaaauugccccugagauccuggacgaucuguaugugucucccgcuguuaaacggagcaucuggcagaccgucagaauuguggaggagcucaagaagaucauugggugugccccugcgaaaaucuucguggagacaacccgguccaaucaggaaaagaaaaagcccacagacagccgcaaaaagcaacuggagcuugcuuacaaggccgucaaaaaggaugugaaagaacuggagaaggaaauuggaacgaucaacuuugacguucucaaugauagacugucuuccguggagccgagcaaacugaaggccaagaaacuuuaucuguacuauacccagcucggccggugcauguacucugaggaaccuaucaacauuuccgagcuguucgacaauaacaaguacgauaucgaccacauuuauccccagagcaaaaucaaggaugacucuuuuacaaauaccguccucgugaaaagagaaagcaacgcugccaagacagaccgcuacccucugggguccgauauucagacccccagcaaucggagauucuggaaauuucuuaaggagaagggccugaucucugacgagaaauauaaccgccucguuagaacggaagaguucuccgaugaggaacugagcggauuuauugcucggcaacugguggaaaccucccagucugucaaggccguggcgagcauccuuggcgagcugaaccccgagacauccaucuguuacucuaaagccgaaaauguuagcuccuuccgccagaacuuugggaagauuaaaaagggagacagagauucuaagaauaacgaccagcucaucaaagugcgggagauuaaugauuaucaucacgcuaaggacgccuaccugaacgucguggugggcaaugucuaugauaccaaauucacacgcaacguuuuuaauuucaucaaggacaaaaaggaugggagaaaguacagccucaacaaaguguuuuacgaaaauguguccgacagcaagaccgucgcuugggagauggacaaaacgauucaucaaguggaaaagguuaugaacaauaacaauaucauggugacacggcgcaccucugagcagaaaggaggccuguucgaugccacagucuauaaggcgaagguggccgcuaaagccaaggacgggguuuacuauccucuuaaaaccuccaacagcguggucaaggauguggcuaaauacggcggauauaccucuaucggcauugccuacuauuccaucuucgaguacacaauuguuaacaagaaaggggaagagaagaucacgagaauuaucccgauccccauuuacaucagccagaauauuaaggacucuaccgcccugaucgaauuuggaaaaucccagauuuucugccgggcuuaugagaagaucaaagauuuuaagcuccuguaccgcaaacuguguauuggcagcaagaucaacaucaauaacuaucaauacuauauugggggaaaguccgacgaaagauucuacuaugauagcgcgauccaggugacacuugacaaaaagucugagaaauaccugaagauucucagcaaauaccagaauuggaagaaggagaacaaagauggcgaacugugggagaauaucaccaaggaaaacaauauugagcucuauaacaaacuggucgagaagaugaacuccgaaaucuuuacaaagaagaagucuaauaaauacaaugagcuuaacagcgaagagauccggaauaacuucauuaagaucuccguggaggaacaggccaaagugcugcuggagauucucaaucugcuuaccaacaagaaaucuaucuuugaccucaagagcauugauaucaaagcugccagagggaagaucuccuucaaccugacgucucugauucaauuuagcaucauugaacaguccaucacaggcuucuaugagaaggaaauuaccaucauuggagacaaaggcaaugauauggagaacaauaacagcuga

SEQ ID NO: 4417 - RNA, 4179 nt, Artificial Sequence
  Cas9 variant
augaacaauaacaauuacagcaucggccuggacauugggaccaacuccgugggaugggccgucaucacagaugacuauaagguucccucuaaaaagaugaaagugcucggcaauacggauaagcacuucauuaaaaagaaccugaucggggcgcuucuguuugacgagggaaccacagccgaagauagacggcucaagcgcaccgcgagacggcgcuacacaagacggaaaaaucgccugagauaucuucaggagauuuucagcccugaaaucuccaagguggacucuagcuuuuuccaucggcuggaugacuccuuucucgucccggaggauaaacgcggcucuaaguaccccaucuucgcuacccuggccgaagagaaagaguaucacaagaacuuuccuacaauuuaccaucugagaaagcaacucgccgacagcaaagaaaaggcugaucugcggcuuaucuaucuggcccucgcucacaugauuaaauaccgcgggcauuuccuguacgaggaauccuuugacaucaagaauaacgauauucagaaaaucuucaaugaguuuauuagcaucuaugacaacaccuucgagggaucuucccuuagcggccagaaugcccagguggaagcgaucuuuacggacaagauuucuaaauccgccaagagagagcggguucugaaacucuuccccgaugaaaagagcaccggccuguucucugaguuucugaagcucaucguggggaaccaagcugaguucaaaaagcacuuugaccuggaagagaaagccccucuucaguucuccaaggauacauacgacgaugaccuggaaaaucuccugggacagauuggcgauggguuugcugagcuuuucgucgccgcgaagaaacuguaugacgccauccuccugagcggcauucugaccgugacagaucccuccaccaaggcuccucucucugccagcaugaucgaacgcuacgagaaccaccagaaagaccuggcugcccuuaagcaauuuauccagaacaaucugcaggaaaaauaugaugagguuuucuccgaccagagcaaggacggauacgccggguauauuaacggaaagacgacacaagaggcuuuuuacaaauacaucaagaaucuccugucuaaauucgaaggcuccgauuauuuucuugacaagauugagagagaagauuuccugaaaaagcagcggaccuuugacaacggcagcaucccgcaucagauucaccuccaagagaugaaugcgaucaucagacgccagggggaacauuaccccuuccugcaggagaacaaggagaaaauuaagaaaauccugacauuccggauuccuuauuacgugggaccccucgccagaggcaauggggauuuugcuuggcugacccgcaacucugaccaggccauccggccuuggaauuucgaagagauugucgaucaagccagcuccgcugaagacuuuaucaacaagaugaccaauuaugaucuuuaccugcccgaggagaaagugcucccgaagcacucucugcuguaugaaacauucgccguguacaacgagcuuacgaaagucaaguuuauugcggaaggacucagagacuaccaguuccuggauagcggccagaagaaacagaucguuaaucaacuguuuaaggagaaacgcaaggugaccgaaaaagacaucacacaguaucuccacaacguggauggguacgacggaauugagcugaagggcaucgagaagcaguucaaugcuucccuuagcaccuaucaugaccugcucaaaauuaucaaggauaaagccuuuauggacgaugccgaaaacgaggcuacacuggaaaacauuauccacacccugacgaucuucgaggaccgggaaaugauuaagcagagacuugcccaauacgauucucucuuugacgagaaagucaucaaggcucugauucgccggcauuauacaggcugggggaagcuguccgccaaacucaucaauggaauuugcgauaagaaaaccggcaagaccauccuggacuaccuuaucgaugacggguauagcaacagaaauuucaugcagcugauuaacgaugacggacucucuuuuaaagauaucauucagaaggcucaggugguuggccgcacaaaugacgugaagcaaaucguccacgagcugccugggucccccgccauuaaaaagggcauccugcagagcaucaaaauuguggacgaacuuguuaagaucaugggacauaccccugaguccauugugaucgaaauggcucgggagaaccagacaacggccagaggcaaaaagaacucucaacagcgguacaaacgcauugaagaugcucucaagaaucuggcccccgggcuggacagcaauauccucaaggaguaccccaccgauaacauucagcugcagaaugacagacuuuuccuguauuaccuccaaaacggaaaagauauguauacaggcgagccucuggacaucaaucagcuguccucuuacgauaucgaccacauugucccgcaggcguucaucaaggaugacagccuugauaaccgggugcucaccuccagcaaagacaauagagggaagucugacaacguccccucccuggaagugguucagaaacgcaaggccuuuuggcaacagcugcucgauagcaagcugauuucugagcggaaauucaacaaucuuacaaaggcugaaagaggaggccuggacgagcgcgauaaagugggguuuaucagacggcagcucgucgagacccgccagauuacgaagcacguggcccaaauccuggacgcuagauucaacaccgaaguuacagagaaagauaagaagaaucggaacgugaaaaucauuacccugaaguccaaucuugucagcaacuuucgcaaagaguucaagcuguauaaagugagagaaaucaaugacuaccaucacgcccaugaugccuaucucaacgcugugguugcgaaggccauucugaagaaauacccuaagcucgaacccgaguuugucuacggcgacuaucagaaauacgaucugaagcgguauaucucucgcagcaaagacccuaaggauguggagaaggcuacagaaaaauacuucuuuuauuccaaucuucugaacuucuuuaaggaggaagugcacuacgccgacggaaccauugucaaaagagagaauaucgaauauagcaaggauacgggcgagaucgccuggaacaaagagaaggacuucgcuacaauuaaaaaggugcucucucugccccagguuaauaucgugaagaaaaccgaaauucaaacacacgggcuggaccggggaaagccgcgcggccuuuucaacuccaauccuagccccaaaccuuccgaggauucuaaggaaaaccugguccccaucaaacaggggcucgacccuagaaaguacggaggcuacgccgggauuagcaacuccuaugcggugcugguuaaggcuaucauugagaaaggcgccaagaaacagcagaagaccgugcucgaauuucaaggaaucucuauccuggauaaaauuaauuucgagaagaacaaggagaauuaccuucuggaaaaaggcuauaucaagauucucagcaccaucacacugcccaaauacucccuguuugaguucccggacgggacgcggagacgccuugccucuauucugagcaccaacaauaagcggggagaaauccauaaaggcaacgagcucgucaucuccgagaaguauacaacccugcucuaccacgcuaagaauauuaacaaaacacuggaaccugagcaucuugaauauguggagaagcacagaaaugauuuugccaaacugcuggaaagcguucucgacuucaacgauaaguacgugggggcgcugaaaaauggagagcgcauccggcaggcuuuuauugacugggagaccgucgauaucgaaaaacuuuguuucucuuuuauuggccccagaaacuccaagaaugccgggcuguucgagcucacgagccagggcucugccuccgacuuugaguuccugggagugaagaucccccgcuaccgggauuauacaccuagcucucuccugaacgcuacccuuauccaucaguccauuaccggccuguacgaaacaagaaucgaccugagcaagcucggggaagauuga

SEQ ID NO: 4418 - RNA, 4179 nt, Artificial Sequence
  Cas9 variant
augaacaauaacaauuacagcaucggccuggacauugggaccaacuccgugggaugggccgucaucacagaugacuauaagguucccucuaaaaagaugaaagugcucggcaauacggauaagcacuucauuaaaaagaaccugaucggggcucugcuguuugacgagggagccaccgcggaagauagacgguucaagcgcacagcuagacggcgcuacaccagacggaaaaaucgccucagauaucugcaggagauuuuuagcgaagagauguccaagguggacucuagcuucuuucaucggcuugaugacuccuuccuggucccugaagauaaacgcggcucuaaguacccgaucuuugccacacucgccgaggagaaagaauaucacaagaaguuccccaccaucuaccaucugagaaaacaccuggcugacagcaaggagaaaacagaucuccggcugauuuaucuugcccuggcucauaugaucaaguaccgcgggcacuuucucuacgaagaguccuucgacauuaaaaacaaugauauccaaaagauuuuuagcgaguucaucucuauuuaugacaacaccuuugaaggauccagccugucuggccagaaugcccagguggaggcgaucuucacggacaaaaucuccaagagcgccaagagagaacggauucuuaaacuguucgcuuacgagaagucuaccgaucucuuuuccgaguuccugaaacugaucguuggcaaccaggccgacuuuaagaaacacuucgaucucgaagagaaggcuccucugcaauuuagcaaggacacauaugaugaagaccuugagaaucugcucgggcagauuggagaugacuucgccgaucuguuucuuguggcgaaaaagcuguacgacgccauccuccuguccggcauucugaccgucacagauucuagcaccaaagcuccccucuccgccagcaugaucgaacgcuaugagaaccaucagaaggaccuggcugcccuuaaacaguucauccaaaauaaccugcaggaaaaguacgacgagguguuuucugaucaguccaaggacggguaugccagauacauuaacggaaaaacgacacaggaggcuuucuacaaguauaucaaaaaucuccugagcaaguuugaaggcucugauuacuuccuugacaaaauugagcgggaagauuuucugagaaagcaacgcaccuucgacaacgggagcaucccucaccagauucaucuccaggagaugaaugcgaucauccggagacaaggagaacacuaucccuuccugaaggaguacaaagagaagauugaaacaauccugaccuuucgcauuccuuauuacguuggcccgcucgcccggggcaacagaaauuucgcuuggcugacccgcaacuccgaucaggccauccggcccuggaauuuugaggaaauuguggaccaggccucuagcgcugaggaguucaucaacaaaaugacaaauuaugaucuuuaccugccugaagagaagguccuccccaaacacucccugcuguacgaaacguuugccguguauaacgagcuuaccaaggugaaauucauuagcgaagggcucagagacuaccaguuucuggauucuggacaaaagaagcagaucgucaaucagcuguucaaagagaagcgcaaaguuacagagaaggacaucauucaguaucuccauaacguggauggcuacgacgggaucgaacugaaaggaauugagaagcaauuuaaugcgucccuuagcaccuaucacgaccugcucaagaucauuaaagauaaggaguucauggacgauccuaaaaacgaagaaauccuggagaauaucgugcauacacugaccauuuuugaggaccgggaaaugaucaagcagagacuugcucaguacgccucuauuuucgauaaaaaggucaucaaggcccucacgcgccggcacuauacaggcugggggaaacuguccgcuaagcugauuaacggaaucugcgacaaaaagaccggcaaaaccauccucgauuaccugauugacgauggcuacagcaacagaaauuuuaugcagcuuaucaacgacgaugggcuguccuucaaggacauuauccaaaaggcccaggugguuggaaaaacaaaugaugugaagcaggucgugcaggagcuccccggcucuccggcuauuaaaaaggggauccugcaaagcaucaaacugguugacgaacuugugaaggucaugggacaugccccugaguccauugugaucgaaauugcgcgggagaaccagaccacagcccgcggcaaaaagaacucucagcaaagauauaagcggaucgaggacgcucucaaaaaucuggcccccgggcuggauagcaauauucucaaggaacacccuacggacaacauccagcugcagaaugauagacuuuuccuguacuaucuccagaacggcaaagacauguacaccggagaggcucuggauauuaaucaacuguccagcuaugacaucgaucacaucgucccccaggccuuuauuaaggacgauucucuugacaaccgcgugcucacauccagcaaagauaaucggggcaagucugacaacguucccucccuggaagugguccagaagagaaaagcguucuggcagcaacugcucgacagcaagcugaucucugagcauaaauuuaauaaccuuaccaaggccgagcgcgggggacuggaugaaagagacaaagugggcuucauucggcgccagcucguugagacaagacagaucaccaagcacguggcucagauucuggaugcccgguuuaacacggaagucaaugagaaggacaaaaagaaccgcaccgugaaaaucaucacacuuaagagcaaucuuguguccaacuucagaaaagaauuuaagcuguacaagguucgggagauuaaugauuaucaucacgcucacgacgccuaccucaacgccgucguggcuaaagcgauccugaagaaauacccuaagcucgagccggaguucguguauggggauuaccaaaaauaugacauuaagcgcuacaucagcagaucuaaggaucccaaagaagucgaaaaggccaccgagaaauauuucuucuacuccaaucugcuuaacuuuuucaaggaagaggugcauuaugcugacggaacaauuguuaaacgggagaauaucgaauacagcaaggauaccggcgagaucgccuggaacaaagaaaaggacuucgccacgauuaagaaagugcugucccucccucaggucaauaucgugaagaaaacagagauucagacccacgggcuggaucgcggcaagcccagaggacuguuuaacucuaauccuagccccaaaccguccgaagaccggaaggagaaccuuguuccuaucaagcaaggccuggaccccagaaaauacgggggauaugcuggcauuucuaauagcuacgccgugcucgucaaggcgaucauugagaaaggggcuaagaaacagcagaagacagugcuggaauuucagggaaucuccauccucgauaagauuaacuuugagaaaaacaaggaaaauuaucugcuugagaaaggcuacaucaagauucugucuaccaucacccucccuaaauauagccuguucgaguuucccgacgggacacgccggagacuggccuccauucuuagcacgaacaauaagcgcggcgaaauccauaagggaaacgagcugguuaucccugaaaaauacaccacacuccuguaucacgccaagaauauuaacaaaacccucgagcccgaacaucuggaguacguggagaagcaccggaaugauuucgcuaaacuucuggaauacguccugaacuuuaaugacaaguaugugggcgcccucaaaaacggggagagaauccgccaagcguucauugauugggaaacaguggacaucgagaagcuguguuuuucuuucauuggaccgagaaauuccaagaacgcuggccuuuuugaacugaccagccaggggucugccuccgauuucgaguuucucggagucaaaaucccucgguaccgcgacuauacgcccagcucucugcucaaugccacacugauccaccaguccauuaccggccuuuacgagacccggaucgaucugagcaagcugggggaagacuga

SEQ ID NO: 4419 - RNA, 4182 nt, Artificial Sequence
  Cas9 variant
augaagagagugaccgaggacuacauccugggccucgauauugggacaaacagcugcggaugggccgucacggacaaaaagaauaaccugcuuaaacugcggggcaagaccgcuaucgggucccaccucuucgaagagggacauacagccgcggaucgcagaggcuuucggaccacacgcagacggcugaaacgcagaaaguggcggcuucgccugcucgaagagauuuucgcugaacccauggccaagguugacccuggguuuuucgugagacugcaccagucuugggugagcccgcuggauaaaucccggaagaaauaucaugccaucgucuuucccaccgcuaaggaggacaaagccuucuaccaaaaguauccuacaauuuaccaccuccgcgaugcucugaugacccaggacagacaguuugaucuucgggagaucuuccuggccauccaucacauugugaaguuucgcggaaauuuccuccaggacacgcccguuaaagauuuugaagcgucuaagaucgaggugggcccuauucugagcaaaaucaacggcgccuucgcugaaaagauugucgaggaccaagaucccaucgagcuuaauguggccaacgcugccgaaauugaggcgguuaucagagggaaagacgccgacaagacccuguauaaaauggauaaggugaagaaaaucgcuaagcuccugacagacuccaccgccaaagaagagaagaaugucgcuaaacagauugccaacgccgugaugggauacaagacacaguuugaaaccauccugggcaaggagauugauaaaucugacaaggcucagugggaguucaaacucacggauggggacgcggaugacaagcuggaagcccuucugccugaucucgacgagaaugaucaaacaaucauugcugaaaucaaaaagcuguucagcgccaucacccuuuccacaauuguggacgagaacaagagccugucucaguccauggucgccaaauauaauaagcaccaucaggacuacaaacuccugaaggcuuacaucgauacccugcaggaccggagcauugccaaaaagcuccugcuugcguaugaucuguacguuaacaauagacacggacgccuccuggaagcuaagaccgaguuuaaacaagacggcacacuuacgaaggaggauuucuauaaaaccgugaaggacaaccuggaugacucugaacucgcccggaaaaucgcccagaagauugcugccgauaauuuuaugccgaaacagagaacaaacuccaacggggugauccccuuccaacugcaucagaucgagcuggacaagauuaucgcuaaucagagcaaguacuauccuuuucucgccgcggaaaaccccgucgaggaucaccgcaaacaggccccuuacaagcuggacgaacuugugcgguucagaguucccuauuacgugggaccgaugauuaccccugaugagcaagagaaaacaucuggcaaguccuuugcuuggaugguccgcaaagaagacggccagaucacccccuggaauuucgagcagaagguggaccggcaggaaagcgccaacaaguuuauuaaaagaaugacgaucaaggauacauaccugcucggggaggacguucugccugcuaauucccugcuuuaucaacgcuucgaggugcucaacgaacugaauaacauucggaucaauggaucuagaaucagcauugaucugaaacagcagaucuuuaacgaccucuucgaggaaaagaaaaccgucaccgagaagucccugacaagcuaccuuaagcagaaucugcaccuccccaccguggaaauuaaaggccuggccgaucccacaaaguuuaacucuucccuggcgagcuauuaccaucuuaaaucucuccacgucuucgacaaggagcuggccgauccucaauaucagaaagacuucgagaagaucauugaauacagcuccaucuuugaggauaagaaaaucuaucaggacaagcugcaugcugaguucaaauggcucacgccggagcaguuuaaggccauuucuaccuggcgccugcaaggguggggacggcuuagcuguagacugcucguggaacugcacgauacaaauggccagaacaucauggagcagcugugggacucccaaaagaauuucaugcagauuguuaccgagcccgauuuuaaggacgcuaucgccaaagaaaaccagaacgugacacaggucaaugggguggaggaaauucuugccgacgcuuacaccagcccugcgaacaagaaggccauccggcaaguugugaaagucguggcugaugugguuaaggccgccggaggcaaaaagcccgcucaguucgccaucgaguuuacgcgcgacccugauaaaaauccccagcucucucauauuagaggcaccaagcugcugaaggcguaccaggaaacagcuggggagcucgucgaccaaaaacugaccgauucccuuaaggaggccaugacaagccggaaacugcucaaggacaaauauuuccuguacuuuaugcagaccggaagagaugccuauacgggcaagaagaucaacauugacgaagugacaaccaauuaccagaucgaucacauucugccgcagucuuucaucaaagacgauuccuuugacaaccgcgugcuuacagcuaccccucucaaugccgaaaagagcgacgauguccccuauaaacgguucgcgaacaauuacguguccgaccugaagaugaccguuggggaaauguggaaacacuggcaaaaggcuggaaucauuaacaagcauaaacugggcaaucuccugcuugauccugacagacugaacaaguuucagaaaucuggguucaucaaucgccagcucguggagacaagccaaauugucaagcugguguccguuauccugcagaacaaauaucccgaugccgagauuaucacggugaaggccggcgacaauucugcucuuagacagcggcugaaccucuacaagagccgcgaugucaacgacuaccaccaugccauugaugcuuaucuguccaucaucugcggaaauuuccucuaccagguguauccuaaauacagacccuauuuuguuuacggcaaguauaaaaaguucagccaagacccggaucugcagaaagaccuuauuaagcacuuuaaaggguucaccuuuauguggccucugcuccagaaggauaacucugaacggaaggcccccgaggaaaucaaagagaauaacuccgaacgcauuguguucuacaagcaccccgacaucuuugacaaacugagaaaggcguacaauuauaaauacaugcuggucagccgggagacaaccacagagucuuccagcauguucaagaugaccauuuuuccucgcggagaaagagaucggaagaaaacgcgcaaacuuaucccgaaaggcaacgggcuggaccccaagaucuauggaggcuacucugggaauacagaugccuauauggugauugugaaaaucgacaaggcuaaggagagcauuuacaaagucaucggcguuccuaugagagcccucacccggcugaaccaggcuaagaaacaaggaaauuaucaggaggaacuccaucaggugcuggaaccccagauuaugcuugauaagaacggcaaaccuaagagaggggugaagggauuccgcgucaucaaagaccacgugcccuuuaagcaaguugugcuggauggcgacaaaaaguucaugcucuacuccgcccaguacaaaaccaaugccaagcagcuggcucugagccaggagacaaugcggaucgucaccgauaaccuuaaaaagggggaggaccaagauaagcugcucgugaaagcguaugacgaaauucugcagaagguugauuguuaccucucucuguucgacacauccaauuuuagaaacggacuucaucugggccgcaauaaauucaucgaccuggaggugaacgauaagaaaauuacgcucagcaacauccugaaugggcuucacgacaacaugguccugggcaaucucaagaacauuggaaucggcaccccucuggggcagaugcaagaaaaguccggaauuacacucucucccgaggccgugcugaucuuucagagcccgaccggccuuuucgaaaaacggguuaagaucgcugaucuguga

SEQ ID NO: 4420 - RNA, 4188 nt, Artificial Sequence
  Cas9 variant
augaagaaagagaucaaggacuacuuccugggccucgauguggggaccggaagcgucggcugggccguuacagacacggauuauaaacugcuuaaggcuaacagaaaagaccugugggggaugcggugcuuugaaaccgccgagacagcggaagugcgcagacuccaccggggagcucgcagacggauugagcgcagaaagaagcggaucaaacugcuucaggaacuguucucccaagagauugccaagaucgaugagggcuuuuuccagcgcaugaaagaaucucccuuuuacgccgaggacaagaccauucuccaggaaaaugcucuguucaacgauaaagacuuuacagauaagaccuaucauaaggccuacccuacaaucaaucaccugaucaaggcuuggauugagaacaaggugaaaccggaccccagacuccuguaucuugccugucauaauaucauuaagaaacgggggcacuuccuguuugagggagauuucgacagcgaaaaccaguuugauaccuccauccaagcccucuucgaguaccugcgcgaagacauggaggucgacauugaugccgacucucagaaggugaaagaaauccuuaaggauagcucccugaaaaauucugagaaacagagcagacucaacaagauucugggccugaaaccuuccgacaagcagaaaaaggcuaucacgaaucucaucagcggcaacaagauuaauuuugccgaucuguaugacaaccccgaucuuaaagacgcugagaaaaauucuaucuccuucagcaaagaugacuucgaugcccugucugacgaccucgcguccauucugggggauagcuuugaacuucugcucaaggccaaagcuguuuacaacugcucugugcuguccaaggucaucggagacgagcaauaccugagcuucgccaaggugaaaauuuaugaaaagcauaaaaccgaucucacaaagcugaaagcuguuaucaagaagcacuuuccuaauaacuacaaaaagguguucggcuauaaccaggacaaugaguccaaaaacaauuacucuggguaugucggaguguguaagaccaaaaacaagaaacuugugaucaauaacagcgucaaucaggaagauuuuuacaaguuccugaagcccauucucuccgccaaaagcgagaucaaggagguuaacgacauucuggccgaaaucgagacaggcaauuuucuuccuaaacagauuucuaaguccaacgcugaaaucccguaucaacugcggaaaauggagcucgaaaagauccugagcaaugcggagaagcacuucucuuuucugaaacagaaggaugagaaagggcucagccauuccgaaaagauuaucaugcugcuuaccuucaaaauucccuacuacaucggaccuauuaacgacaaucacaagaagucuuuucccgaucgcugcuggguggugaaaaaggagaaaagcccuuccggcaagacgacacccuggaacuucuuugaccauaucgauaaagaaaagaccgccgaggaguucauuacaagcagaaccaauuucuguaccuaucugaucggcgaaucuguccucccgaagaacucccugcuguacagcgaguauacagugcuuaacgaaaucaauaaccuccagauuaucauugacgggaaaaauaucugcgauacgaagcugaaacaaaagauuuacgaggaccuguuuaaaaaguauaaaaagaucacccagaagcagaucucuacauucauuaaacacgaaggaaucuguaacaagaccgacgagguuauuauccucggcauugauaaagagugcacauccagccugaaguccuacaucgaacuuaaaaauaucuuugggaaacagguggacgagauuucuaccaagaacaugcuggaagagaucauucggugggcuacgaucuaugaugaaggagagggcaaaacaauucucaagaccaaaaucaaggccgaguacgggaaauacuguagcgacgaacaaaucaagaagauucugaaucugaaauucuccggauggggcagacuuucucgcaaguuucucgagaccgucacaagcgaaaugccuggcuucuccgagcccgugaacaucauuaccgccaugcgggaaacacagaauaaccugauggagcugcucagcucugaguuuaaauucacggaaaauaucaagaaaauuaacuccggguuugaggaugcugaaaagcaguucagcuaugacggacugguuaagccucuuuuucugucucccuccgugaaaaagaugcucuggcagacccugaaacuggucaaggagaucagccacauuacacaagcgcccccuaaaaagaucuucaucgagauggcgaagggcgcugaacuugagccggccagaaccaaaacacgccucaagauucugcaggaucuguacucuagcugcaaaaaugacgccgaugcuuuuuccagcgaaauccaguaucucucugggaagauugagaacgaagacaaucugcggcuuagauccgauaaacuguaccucuauuacacccagcugggaaaguguauguauugcggcaaacccaucgagauugggcauguguucgacacgagcaacuacgauaucgaccacaucuacccucaauccaagauuaaggacgauucuaucagcaaccgcguccuggugugcuccucuuguaauaaaaacaaggaggacaaauauccccuuaagagcgaaauucaguccaaacagcggggcuucuggaauuuucuccagagaaacaauuucaucucucuggagaagcugaaccgccucacccggacaaccccuauuagcgaugacgaaacagccaaguuuaucgcuagacaacugguugagacccgccaggccacgaaaguggcggccaagguccuugaaaagauguuccccgagacaaagaucguguacuccaaagcugagaccguuagcauguuucggaauaaguucgauauuaucaagugcagagaaauuaacgacuuucaucacgcccaugaugcuuaucugaauaucguggucggaaacguguacaauacaaaauucaccaacaauccguggaacuuuauuaaggagaaacgggacaauccuaagaucgccgauaccuauaacuacuauaaaguguucgacuacgauguuaagcgcaacaauauuacagcgugggaaaagggcaaaacgaucaucaccgucaaggacaugcucaaaagaaacacacccauuuacacccggcaggccgcuuguaagaaagggggacuguuugaccaaacaaucaugaagaaaggccuggggcagcacccucuuaagaaggagggacccuucucuaauauuuccaaauauggcggguacaacaaggugagcgccgcuuauuacacccugaucgaauaugaggagaaaggcaauaagauuagaucucucgaaacgaucccucuguaccucgugaaagauauccagaaggaccaggauguccugaaguccuaucuuacagaccugcucggaaagaaggaguucaaaauucuggugcccaagaucaaaauuaacagccugcuuaagaucaauggcuuuccgugccacauuaccgggaagaccaacgauucuuuccugcuccgcccugccguucaauuuuguugcuccaaugacgaagugcuguacuucaaaaagaucauccgguuuagcgagauuagaucccagcgcgagaaaaucggaaagacaauuagccccuacgaagaucucucuuucagaagcuauaucaaagagaaccuguguaagaagaccaaaaaugacgaaauuggcgagaaggaauuuuacgaucuucugcagaaaaagaaccucgagaucuaugacaugcugcugacaaaacauaaggauacgauuuacaaaaagcggcccaauuccgccaccaucgacauccuugucaaggggaaagagaaguucaaaucucugauuaucgaaaaccaguuugaggugauucucgaaauccugaaacucuucagcgcuacacgcaauguuuccgagcugcaacacauuggaggcucuaaauauagcgggguggcgaagaucggcaacaagaucuccucucuugauaauugcauucugaucuaccagagcauuaccggaaucuuugaaaagagaauugaccugcucaaggucuga

SEQ ID NO: 4421 - RNA, 4188 nt, Artificial Sequence
  Cas9 variant
augaagaaagagaucaaggacuacuuccugggccucgauguggggaccggaagcgucggcugggccguuacagacacggauuauaaacugcuuaaggcuaacagaaaagaccugugggggaugcggugcuuugaaaccgccgagacagcggaagugcgcagacuccaccggggagcucgcagacggauugagcgcagaaagaagcggaucaaacugcuucaggaacuguucucccaagagauugccaagaucgaugagggcuuuuuccagcgcaugaaagaaucucccuuuuacgccgaggacaagaccauucuccaggaaaauacacuguucaacgauaaagacuuuaccgauaagacauaucauaaggcuuacccuaccaucaaucaccugaucaaagccuggauugagaacaaggugaaaccggaccccagacuccuguaucuugcuugucauaauaucauuaagaaacgggggcacuuccuguuugagggagauuucgacagcgaaaaccaguuugauacguccauccaagcccucuucgaguaccugcgcgaagacauggaggucgacauugaugcggacucucagaaggugaaagaaauccuuaaggauagcucccugaaaaauucugagaaacagagcagacucaacaagauucugggccugaaaccuuccgacaagcagaaaaaggccaucaccaaucucaucagcggcaacaagauuaauuuugcugaucuguaugacaaccccgaucuuaaagacgccgagaaaaauucuaucuccuucagcaaggaugacuucgaugcucugucugacgaccucgccuccauucugggggauagcuuugaacuucugcucaaggcgaaagccguuuacaacugcucugugcuguccaaggucaucggagacgagcaauaccugagcuucgcuaaggugaaaauuuaugaaaagcauaaaacagaucucaccaagcugaaaaauguuaucaagaagcacuuuccuaaagacuacaagaaaguguucggcuauaacaagaacgagaaaaauaacaauaacuacuccggguaugucggaguguguaagacaaaaucuaagaaacuuaucauuaauaacagcgugaaucaggaagauuuuuacaaguuccugaagaccauccucuccgccaaaagcgagauuaaggaggucaacgacauccugacggaaauugagacaggcaccuuucuucccaaacagaucucuaaguccaaugcugaaaucccuuaucagcugcggaagauggagcucgaaaagauucugagcaacgccgagaagcacuucucuuuucugaaacaaaaggaugagaaagggcucagccauuccgaaaagaucauuaugcugcuuacauucaagaucccguacuacauuggacccaucaaugacaaccacaaaaagucuuuuccugaucgcugcuggguuauuaaaaaggagaaaagccccuccggcaagaccaccccuuggaauuucuuugaccauaucgauaaggacaaaacagccgaggcuuucaucacgagcagaaccaacuucuguacauaucuggugggcgaaucugugcuccccaaguccagccugcuguacucugaguauaccguccuuaaugaaauuaacaaccuccagaucauuaucgaugggaaaaauauuugcgacaucaagcugaaacagaagaucuacgaggaacuguuuaaaaaguauaagaaaauuacacaaaagcagaucuccaccuucauuaaacacgagggaaucuguaacaagacggacgaagugauuauccucggcaucgauaaagagugcacaagcucccugaagucuuacauugagcuuaagaauaucuuugggaaacagguugacgaaauuagcaccaagaacaugcuggaggaaaucauucggugggcgaccaucuaugaugagggagaaggcaaaacaauccucaagaccaaaauuaaggccgaguacgggaaguacuguuccgacgagcagaucaaaaagauucugaaucugaaauucucuggauggggcagacuuagccgcaaguuucucgaaacagugacguccgagaugccgggcuucagcgaaccugucaacaucauuaccgcuaugcgggagacacaaaauaaccugauggaacugcucucuuccgaguuuaaauucaccgagaauaucaagaagauuaacagcggguuugaagaugccgagaaacaguucucuuauaauggacuggugaagccccuuuuucuguccccuagcguuaaaaagaugcucuggcagacacugaaacuggugaaggaaaucucucacaucacccaggccccucccaagaaaauuuucaucgagauggcuaagggcgccgagcuugaacccgcgagaacgaaaacccgccucaagauucugcaagaccuguacaacaauugcaaaaacgaugcugacgccuuuagcuccgagaucaaggaucucagcgggaaaauugaaaaugaggacaaccugcggcuuagaucugauaagcuguaucucuacuauacacagcugggaaaguguauguacugcggcaaaccgaucgaaaucgggcaugucuucgacaccuccaacuaugauauugaccacaucuacccccagagcaagauuaaagacgauuccaucucuaaucgcgugcuggucugcagcuccuguaacaagaauaaagaggacaaguacccucuuaagucugagauucagagcaaacaacggggcuucuggaacuuucuccagagaaauaacuucaucucccuggaaaagcugaaucgccucacacggaccacgcccaucucugaugacgagacagccaaauuuauugcuagacagcugguggaaacccgccaggccacaaagguugcugccaaagugcuugagaagauguucccugaaaccaagaucgucuauagcaaagcggagaccguguccauguuucggaacaaguucgauauuaucaaaugcagagagauuaaugacuuucaucacgcccaugaugcuuaccugaacaucguugugggaaaugucuauaacacaaaguucacgaauaaccccuggaauuuuauuaaagaaaagcgggacaacccgaagaucgccgauaccuacaacuauuacaaaguguucgacuaugaugugaagcgcaauaacaucacagcuugggagaaaggcaagaccauuaucacaguuaaagacaugcucaagagaaauaccccuauuuacacgcggcaagccgcguguaaaaagggagggcuguuugaccagacaaucaugaagaaaggccuggggcagcacccccuuaagaaagaaggagccuucagcaacauuucuaaguacggcggguauaauaaagucuccgcugccuacuauacccugaucgaguacgaagagaagggcaacaagaucagaagccucgagaccauuccucuguaucucgugaaagauauccaaaaggaccaggaugugcugaaaucuuaccuuacagaccugcucggaaagaaagaaauuaagauccugguccccaagauuaaaaucaauucccugcuuaagaucaacggcuucccuugccacauuaccgggaaaacaggagauagcuuugugcugcgccccgcuguucaguucuguugcucuaaugacgaggugcucuauuuuaagaaaaucauucgguucaacgaaaucagaucccagcgcgagaagaugggcaagacgauuagcccguacgaggaucuguccuuuagaagcuacaucaaagaaaaucucuguaagaaaaccaaggccgacgagauuggggaaaaagaguucuaugaucugcuucaaaagaaaaaccuggaaaucuacgacaugcuccugacaaagcauaaggauaccaucuauaauaaacggccuaacucuacaacccugggaaugcuuacgaagggccgcuacgaguuuauuaaucugaaacccaaggaccagaucauugucaugcucgagauccugaaacucuucugcaccacaagagaagccauugaucuggggcuuaucaagggcaagcccgcugcgggaguggccacccugggcaaaaagaucagcaacccugacaauuguauucugaucuaucaguccauuacagggaucuuugagaaacggauugaccuccugaagguuuga

SEQ ID NO: 4422 - RNA, 4188 nt, Artificial Sequence
  Cas9 variant
augggcgacaccgugaagaacuaccacaucgggcuggauauuggaacaagcuccgucggcuucgccgcuagagacgaugacaauaaccucauccggguuaaagggaagaaugugauuggaacgcgccuguuuucugagggccagaccgcccaagaaagacggauggcgcgcgcuagcagacggcgcuauaacagacggaaauggcgccuuagacugcucgaugagaucuuccaugacgaaauuauccacaaggaugccgaguuuuucaaucggcugaaacaguccucucuuagccccaaggacgaacgcaagcaguacuuugggucccuccuguucccugaggugggagauucugaguauuaccaugacggcaaccagacaaucuaucaccugagacaucggcugaugacccaagaugaaaaagccgacauucgcgagaucuaccucgcucugagacacauuaucaaguaucggggcaauuuucuugaugacacaccggucagcuccuucgaagccagcgaccugaaacucgcuucuuuugugcccacccugaacgaucuuuucgagacaauugacguuaauuacgaguuuuccauggauaacaucaaugaaauugaggacauccugcucaacaauaagcugagaaacagcgauaaaucuaagcagcugccugaccuccugaccgaacccaucgugaauauugaugacaagucccuugagaaacaguucaacaaggaacgcacggauaucagcaaagagauugccaagucugucgugggguccaaaaugaacguuaauaagcugcucagcuuugaguccucuggaggcuacaaaaucgcguucagcuucuccgacgccagcucugaagauaagaugauggagcuguccgacgugcuugacgauagccggaugaacauucugaauauccucaaggucaucuauucuagagugcgccugaaccagauuaucccuagcgggaugggacuguccgaaucuaugguggcugccuacgaccuccacaaacaacagcugaaggaucuuaaaaagcugcucaauguccugcccuuuaacgagcgguaugcuguuaaaauugccuacgcggccuauaucggcaauauugacaagcagaaguucaccaaaagcgaagugaagacaaucgauaaacuuaaggagaaauccgcuaucaugaacgugcuggacuuuaagagcgggcauauuaccaaugaggaacucucuaacgucaucaaggugguuauuguggauaaauaccugaaugacgagaacuucgaauaucacuccaucgucgagaagauuaaucaggauaucagcaacggaucuuaccugcucaaacaaagaaauaaccagaacggcaauauuccucaucagcugcaccaaauggaacuugaccagaucaucgagaaccaguccaaguacuauccguuucugggcgagcucaaucccaacagcaaucgcaaccacauugccaaauacaagaucuccgaacugguggcuuuccggguuccuuauuacguggggccccugauuacaccugaggaacaggagaagaccucuggagccagcuuugccuggaugaaaagaaaggaggauggcgcuaucacgcccuggaauuucgaagagaaagucgacaaggaagagacagcgucccgcuuuauuaaacggcuuaccgugaaggauacauaucuccugaacgaagacguccugccggacaauucucuccuguacgagaaauucaaggugcuuaacgagcugaauguugugaaggccaacaauaaaagacucaccgucgaagagaagcaaggggcuuuugauaaccuguucaaaaagaugaaaaccgugacagccaagaagcugaaaaauuaucuuguuagcaaccauaaccacaucaauuccguggaaaucacgggacucagcgacgucgauaaguuuaacaauucucuguccaccuacauugacuucaaaaagaucuucgaugacaaaauugauaacccugaccugcucgaugacuuugaggauaucauugaauggagcacaguguucgaggaccgcaagaucuuugaggaaaaggugcggaaagauaucucuuggauuuccgagagcgaaaucaaggccguugucucuaaaagauacagcggcugggggcggcuguccaagaaacuucugaauggaauuaccaacaaugagggccgcaacaucauugacgaacucugggaggagagcgaaacauucauggaggcugugucuaagcccgaagugaaggagcagaucgacggcaucaauuccgauuuuauuaaaaacaccgacaucgagagcguccuggccgaugcguauacguccccucagaauaagaaagcuauuagagaaacacauaagcuggugaaagacauccagaaggccaugggagggcaagcccccgcuucuauuagcaucgaguucacccggaacccccaggauaaaggccagcuuaccagaucccgccacucugaaguuagccggaaguacaaggagauuuccaaagaagugucuaagacacucaaugacgagcugaaaagcaagaaaaacuccauggaugucgacaaguauuaccuguauuuuaugcagauggggaucgaucucuacgacggaagcucuaucgauauugacgaccugaauaacuaucaaaucgaucauauuaucccucaguccuucuacaaggacgauagcuuugacaacagagugcuuacccacuacucuaauaaccagaaaaagggcaauaacacaccgcugaaugggcucaacauugaugacaaaacgcgcgccaucuggaaucaccugagagaucugggccuuaucaccaagaaaaaguauaacggacucacacugaagggcauggaccagcuguccaaauacaccaagcauggguucauucggcgccaacucguugagacaagccaggugaucaaacuggucgcuaauauucuuucugaugaauuuuccaccgacgauacgaagaucauugaggugaaagccaagaugaacagccagaucagacaaguuuucaaucuguauaaggugcgggaacucaacgacuaccaccaugcggucgaugccuaucugaccacauuuaucggaggcuaccuguauaaucgcuaccccaaccuuagaaauauguucguguacggggacuucaaaaaguuuuccgcugacguggauaaccugaaaaccuucaauuuucuccacgacauuacaaacccuagcgauaaguucgaggaccggaucuuugaugaaaaaucuggagagcugauucucgaccgcaagcacgccaucgagaccauuaagaaaaucuaucaguacaaguauaugcugauuacgagagaagucagcaccaaaaacggccagcuuuccgaucagacaguuuacucugcuaagcggaucaauaacgugaaagcccccaucccugugaagaaagacagcaaucccgagcuguauggguuccgcacaggcaacgucgaucaucacauggugauuguuaaguacccgaagaaagacuccuaugauuacaagguggucggaaucccucucagauuugugcaaaaacugaaggaaaccaaagacaauaaggauuacgagaaccugcuuaaucagauuguucagaugaagcugaaccggaaaaagcaggacuucaucguggucguggacaauguuauguauggccaacucauucaggaugggggagaaaaauacacccugggcucuagcacauauaaguacaacgcgaaacagcucgugaucaauauggacaagacgagaauccuggaggauaaccgcuaucuuaauucccuggacgagggggaagucucugagaagcucgugaacauuuacaaugauaucaugaaaguggucaacagccgguuugaccuguucgauauuaacaaguuuagagaaaaacugaaugacggacuuaacaaguucaaaaauaucuccaacgagcagaaggaggaaacccugcucaagauucugagcggccuccauugcgggucugccaauguucccaucaaagagcugggccuuacaaccccucugggaaagcugcaacuccccuccggcaucgugcugagcgaagaggcuguggucauuuaucagucuccuuccgggcuuuucgaaaacaaagugcgccugaaggaucucuga

SEQ ID NO: 4423 - RNA, 4188 nt, Artificial Sequence
  Cas9 variant
augaagaaagagaucaaggacuacuuccugggccucgauguggggaccggaagcgucggcugggccguuacagacacggauuauaaacugcuuaaggcuaacagaaaagaccugugggggaugcggugcuuugaaaccgccgagacagcggaagugcgcagacuccaccggggagcucgcagacggauugagcgcagaaagaagcggaucaaacugcuucaggaacuguucucccaagagauugccaagaccgaugagggcuuuuuccagcgcaugaaagaaucucccuuuuacgccgaggacaagacaauccuccaggaaaauacccuguucaacgauaaagacuuugcugauaagacauaucauaaggccuacccuaccauuaaucaccugaucaaagcguggaucgagaacaaggugaaaccggaccccagacuccuguaucuugccugucauaauauuaucaagaaacgggggcacuuccuguuugagggagauuucgacagcgaaaaccaguuugauacguccauucaagcucucuucgaguaccugcgcgaagacauggaggucgacaucgaugccgacucucagaaggugaaagaaauucuuaaggauagcucccugaaaaauucugagaaacagagcagacucaacaagauccugggccugaaaccuuccgacaagcagaaaaaggcuauuaccaaucucaucagcggcaacaagaucaauuuugccgaucuguaugacaaccccgaucuuaaagacgcugagaaaaauucuauuuccuucagcaaagaugacuucgaugcccugucugacgaccucgcguccauccugggggauagcuuugaacuucugcucaaggccaaagcuguuuacaacugcucugugcuguccaaggucauuggagacgagcaauaccugagcuucgccaaggugaaaaucuaugaaaagcauaaaacagaucucaccaagcugaaaaauguuauuaagaagcacuuuccuaaagacuacaagaaaguguucggcuauaacaagaacgagaaaaauaacaauaacuacuccggguaugucggaguguguaagacaaaaucuaagaaacuuaucaucaauaacagcgugaaucaggaagauuuuuacaaauuccugaagaccauucucuccgcuaaaagcgagaucaaggaggucaacgacauucugacggaaaucgagacaggcaccuuucuucccaaacagauuucuaaguccaaugccgaaaucccuuaucagcugcggaagauggagcucgaaaagauccugagcaacgccgagaagcacuucucuuuucugaaacaaaaggaugagaaagggcucagccauuccgaaaagauuaucaugcugcuuacauucaagauuccguacuacaucggacccauuaaugacaaccacaaaaaguuuuucccugaucgcugcuggguugugaaaaaggagaaaucucccagcggcaagaccaccccuuggaacuuuuucgaccauaucgauaaggaaaagacagcugaggcguucauuacguccagaaccaauuuuuguacauaucuggugggcgagagcguccuccccaagucuucccugcuguacagcgaauauaccgugcuuaaugagaucaacaaccuccagaucauuaucgacgggaaaaauauuugcgauaucaagcugaaacagaagauuuacgaagaccuguucaaaaaguauaagaaaaucacacaaaagcagaucucuaccuuuauuaaacacgagggaaucuguaacaagacggacgaaguuauuauccucggcauugauaaagagugcacauccagccugaaguccuacaucgagcuuaagaauaucuucgggaaacagguggacgaaauuucuaccaagaacaugcuggaggaaaucauucggugggccaccaucuaugaugagggagaaggcaaaacaauucucaagaccaaaaucaaggcugaguacgggaaguacuguagcgacgagcagaucaaaaagauucugaaucugaaauuuuccggauggggcagacuuucucgcaaguuccucgaaacagucacgagcgagaugccgggcuuuuccgaaccugugaacaucauuaccgccaugcgggagacacaaaauaaccugauggaacugcucagcucugaguucaccuuuacagagaauaucaaaaagauuaacuccggguucgaagaugccgagaagcaguuuagcuaugacggacugguuaaaccccuuuuccugucuccuuccgugaagaaaaugcucuggcagacccugaagcuggucaaagaaaucagccacauuacgcaggcuccucccaagaagaucuuuaucgagauggccaaaggcgcggagcuugaacccgcuagaaccaagacacgccucaaaauucugcaagaucuguacaauaacugcaagaaugacgccgaugccuucucuagcgagaucaaagaccucuccgggaagauugaaaacgaggauaaucugcggcuuagaagcgacaaacuguaucucuacuauacccagcugggaaaguguauguacugcggcaagccgaucgaaauugggcauguguucgauacaucuaacuaugacaucgaccacaucuacccccaguccaaaauuaaggaugacagcaucuccaaccgcguccuggugugcucuagcuguaauaaaaacaaggaggauaaauacccucuuaaguccgagauucagucuaagcaacggggcuuuuggaauuuccuccagagaaacaauuuuaucagccuggaaaaacugaaccgccucacccgggcuacgcccauuuccgacgaugagacagccaaguucaucgcuagacagcugguugaaacccgccaggccacaaaaguggcggccaagguccuugagaaaauguuuccugaaaccaagaucguguauucuaaggcugagaccguuagcauguuccggaauaaauuugacauugugaagugcagagagaucaacgauuuccaucacgcccaugacgcuuaccugaauauugucgugggaaacguguauaauacaaaauuuacgaacaaucccuggaacuucaucaaggaaaaacgggauaauccgaagauugccgacaccuacaacuauuacaagguuuuugauuaugacgucaaacgcaacaauaucacagcgugggagaagggcaaaaccauuaucacagugaaggacaugcucaaaagaaacaccccuaucuacacgcggcaagccgcuuguaagaaaggggaacuguucaaucagacaauuaugaagaagggacugggccagcacccccuuaaaaaggaggggccuuucuccaacaucagcaaauacggaggcuauaauaaggugucugccgcuuacuauacccugauugaauacgaggagaaagggaacaagaucagaucccucgaaaccauuccccuguaucucgucaaggauauccaaaaagaccaggaugugcuuaagagcuaccugacagaccugcucggcaaaaaggaguuuaaaauccugguuccuaagauuaagaucaauucucugcuuaaaauuaacggauuccccugccacaucaccggcaagacaaaugauuccuuucugcuccgcccggccgugcaguucuguugcagcaacaaugaaguccuguauuuuaaaaagauuauccgguucucugagaucagaucccagcgcgagaaaauugggaagacgaucagcccuuacgaagaccucuccuuuagaagcuacauuaaggagaaccuguggaaaaagaccaaaaaugaugaaaucggagagaaggaguucuaugaccuucugcaaaagaagaaccucgaaauuuacgauaugcugcugacaaaacauaaggacaccaucuauaagaaacggcccaauucugccacaauugauauccuugugaagggcaaagagaaguuuaaaagccugaucauugaaaaccaguucgagguuauccucgaaauucugaagcucuuuuccgcuacccgcaaugugucugaccugcagcacaucgggggaagcaaguacuccggcgucgcgaaaauugggaacaagaucucuagccuugauaacuguauccugauuuaucaguccaucacgggcauuuucgagaaaagaaucgaccugcucaagguguga

SEQ ID NO: 4424 - RNA, 4188 nt, Artificial Sequence
  Cas9 variant
augaacgccaauagagagauggcuuacuauaucggcauugacauggggaccggaagcgugggcauggccaucacagaugaaaacuacaaucugcucaaggucaaagggcaggacuauugguucguucgggaguuugaaacggcgaacacccaaauuaagcgcagaaugcaccggaucuccaaacgcagacugcggcgccaucaggugagaguggcucuuauucggucuuacuucgccgaggaaauccugaagaaugauccccucuuuuucauccgccaggacaacagcauuuauuaccuggaggauaaagacuccguccuuaagacaaaggauugccuguuugccgacuauaauuaccacgauaaaaacuacuauaaggacuacccuaccaucuuccaucucagacaggcuuuuauuaaagauacagugaaggacgaugagaaucacacccgguaugcccgccugcuguaccucgcuaucauuaacauguucgaacauagaggacacuuucugcuuaauucuguuagcgaggacaucaacaaagaaauggugaaggacgccggcgagggguucacacuguaucuccaagagcggauuaaggaaaucaaaccggucuccuacucugauauccuggacgugcuuguugagaagaauauuagccgcuccgaaaagaaggagagaaucguggaacuguuuggaauuaaaaagagcuguaaaaacggcauggagaucauuaagugccucuguggccuggaggcgaaugucgccaucauguucaaccuggaugacaucgaaaacaagcucaccauuguggugucuaaagaugacuaugaggauaagcuggcugaaguccagccccuuguugacgaggaauccuuugagcugcucagccggaucaaacagcuguacgauuacucucagcuucaauccauucugaagggguauaaagagaaggaagacggagaggauaaguaccucagcgacgugagaguggaacuguaugagaaacacaaggccgaccugaaacuccugaagaaagucuacaagcgcgaucuugacaagaaaggcaagaucugcgaagggaaaaauauucagcggucuuccaaguauaacuucauguucagaagcggaaaagauggcacguacuccgcuuauaccaauucucugaacagcuuuuguuccaagacaaucgagaauaaguaccgccggaacaugaaaaauagagaccgcgccagccucuacgauaccaucaagaaagaccugucugggauugagaacgaugacgugaagaaaauccuucgggauauugaaacagagaaguuccugccuaaacagaucaccggagaaaauggcguuauucccaaccagauccaugcgaaggagcucaaggccauucugaaaaaugcugagaagcaucugccuuuucucacggaaaaagacgauuccggccugacagugagcgagagaaucaucucucuuuuccgcuauugcauucccuacuauaucgggccugucggaaaggacagccggaccggcugggccuccauuaaagaagaggggcaaaucuuuccguggaacauugaacagaagaucgauguggacaagacaucugaggaguucaucaccagacugauuaaaaccuguacauaccucagcaaugaaaagguugugcccaaacagucccuggucuaugagcgcuacugcgugcugaacgaaaucaauaacauuaagauccggggaaaaagaauugacccucaacuuaagcaggagaucuuuaaggaacucuauaucggcagcaaaugugggaagaaagucacgcggaagaaccugugccaguaccuggugaauaaaggagcuauugaggaggauucugaaaucuccggcauugacaaggaucucaacaccuacaugagcucuuauggcaagauguaccagaucuucggggacaaaauuaagcgcgaugacaucaaagagguugccgaagagaucauuuauuacggaacaaucuauggcggggccaaggaaauguuuaaaaagaaaauugagcaauacguguccgaggauauccuggacgaagcucagaugaaucggauucuuggauucaaguuuaaggauugggcgagacugagcaaaaaguuccucuaucuggagggcuacgacaaagggaaccagaaucagcugaccacacuuaugcaagcccucugggauuacaaccugaauaccauggaacugaugaacucccccauguuuacguucaaggagacacucgagaaacagaagaauaagauggaaaaaguccugugugacuucgaguaugaagaucuugacgaguacuauuuuucugcuccugugaagagaaugguuuggcagaccaucgccugccugaaagaagugguccagauuaugggccacaaccccaagcgcaucuucaucgagaugccgcgggccgacgaggaaaaaggagagcaaggcagaaaggcuagccgcaagaauagacuccugucccuguacgaagagauugaagaugagcggccuuggaaaaaggagaucgaaaacgccgcggagucugggcgccuuaauagcaaaagaauguaucucuacuaucugcagaugggaaaggacgcuuacaccggcgaagauauugacaucgaggaucuguuugacaacuccaaauacgauauugaccacaucuauccccggagccucacagaugacaauucucuggaaaacaaccuugugcugguguccgccaccaucaaucaggauguuaagaagaacgacuacccuauucccuaugacaaaauccgcgggaauagcaaggucagagagcucuggcgguuccugcacgagaaaaaguuuaugaacgaugaaaaauacaaucgccugaugucugacgugccccuuacacaggagcaacucgccggauauauugcuagacagcugguggaaacggcccagggcaccaaggggaucgcugauauuaucaaguccgucaucccugacgccgauauuaucuacagcaaagcgaagaacgugucugacuuccggaaacgcuauggcaugcucaagagcagacugacaaaugauuuucaucacgccaaagacgcuuaccugaacguuguggucggaaauguguacuucaccaaguuuacacaaaacccgcggaaauauauuaaggaugagaaugacaucgagaacaagaaauacaauuauaaccuuuccaagauguacgauaaagacguuauuagaaauggcaagguggccuggaucgcucagaacgggaaaaaggccggaaccauucagacgaucaagaaagucauggaucgcaacacccccaucauuacacggcaggcguucgaacaaagaggcgagcuguaugaccuccagccuaucagcaagcauaaagccaagaaagaaaauuacgugcccauuaaggcuaccaacgagaagaugaaagacguuacaaaguaugggggauuuaccucucugaauccugccuacuucguguuugucgaauacggcuccgcuaaaaagcgccagcggugcuucgccguggugcacagcuauugggccuccucuaucaaaaacaaugaggaucuggucacgcaucuuaaggacagaggguacgagaaccccauuguuaucgcugauaagaucaaaaagaauagccugauuaaauauaacggcuacuuccucuauaucgugggaauggacgcgcgcaaacagguggaauuuuccaaugccacaucuaugugucugaacaauaacuucauucaauacauccagaaaauugagaaggcuaauacccucaucgccgaagccaaaaagcggagaccguauaucgaugagagcauuacagcugaacgcaacaucgcccuguacaaugagcuuaagaaaaagcaccuggacuccauuuuuaaaaaccacccuaagggcaucgggucuguccucgagagcggagaaggcgcguucgugcagcugucccuggagcagcaaauugggauccuuuacagcauuauccaguuuucuuccuucaaaaagggaaccuuuagccugacccucaucggcgggcccaaggaaguuggccggauuagaaucucuggaaauaugccuaaagcucgggagcugaagcucauucauuauuccaucacaggcauguacaaaaaggaaauuaaccugcuugauuga

SEQ ID NO: 4425 - RNA, 4188 nt, Artificial Sequence
  Cas9 variant
auggagacccaggccagcaaccaacugaucuccucucaccucaagggcuaccccauuaaagacuauuucguggggcuggauaucggaacaagcuccgucggcugggcuguuacgaauaaggccuacgaacuucugaaauuuagaucucauaagaugugggggagccggcuguucgacgagggagaauccgcgguggcucgcagaggcuuucggucuaugcgcagacggcuggagcgcagaaaacuucggcugaagcuccuggaagaacuguucgccgaugccauggcucagguggacccuaccuuuuucaugcgccucagagagagcaaguaucacuacgaagauaaaacaaccgggcauuccagcaagcacauucuguuuaucgacaaaaacuauacagaucaggacuacuauaaggaguacccgaccauuuaccaucuucgggucgcccugaugaaaucuggaacagaugacauccgcaaacucuuccuggcugugcaccacauccuuaaguauagaggcaauuuucuguacgaaggcgccaccuucgauuccaacgcgagcacgcucgacgauguucugaaacaggcccuggagaauauuaccuuuaacugcuucgacucuuccgcugccaucgggagcauuggacaaauccucauggagcugggcaagacaaaaucugacaaggcuaaagccauugaacggcuuguggauaccuauaucauuacagacgaggucgauaccuccgggaagacgcagaaagaacaggugaaggaggacaagaaacgccucaagagcuuugcgaaucucguucugggacuuuccgccucucugacagaucucuucggcagcguggaagaccuggaugaggaccugaaaaagcuccagaucaucggggauaccuacgacgagagacgggaugaccuggcuaaagucuggggagacgaaauucauaucauugaugacuguaaguccguguaugaugccaucauucuuaugagcaucaaggagcccggccugacaaucucugaauccaaagugaaggcuuucaaaaagcacaaagacgaucucgccauucuuaagagccuucugaagucugacagaagcaucuacaacaccauguuuaaagucgaugagaagggccuccauaauuauguucacuacauuaaacaagggcgcaccgaagagacauccugcaaccgggaggacuucuacaaguauacgaaaaaggugguggaaggacugccugauucuaaggacaaagaguacauccugagcgaaauugagcuccagacccugcuuccccugcagagaaucaaggauaauggcgucaucccuuaucagcuccaccuggaggagcugaaagugauucuugccaagugugggcccaaauuuccuuuccucaacgagguugcugacggauuuuccguggcggaaaagcugaucaaaaugcuggaguuccgcauuccguacuaugucggcccccucaauacacaucacaacguggauaaugggggauuugccugggcuguucggaaggccagcggcagagugaccccuuggaacuucgacgacaagaucgaucgcgaaaaaucugccgcugccuuuauuaagaaccugacaaauaaaugcaccuaccuucugggcgaggacguccuccccaaguccagccugcuguauucugaguucaugcuucucaacgaacugaauaacgugcggaucgaugggaaaccucuggagaaggcggucaaggaacaucucauugaggcuguguuuaaacaagaccacaagaaaaugacgaagaauagaaucgaacaguuccugaaagauaacaauuacauccccgagaagcauaagccggagauuacaggacuugacggcgaaaucaaaaacgaucuggccuccuaccgcgacaugguucggauucucgggaauaacuuugaucugagcauggccgaggaaaucauuaccgacaucaccaucuucggagaguccaagaaaaugcugagagaaacacuucgcaauaaguucucuagccggcucgaugacgaggcuauuaaaaagcuguccaagcugagauaucgggauuggggccgccucucuagaaaacugcuuaacgugaucgaggggugugacaaggccggcgacggaaccccugaaacaauuaucauucugaugcggaauuuuagcuacaaccucauggagcugcugggcgauaaauucuccuuuauggaaagaauccaggagaucaaugcuaagcugauugaagggcaaaucgucaacccccacgacauuaucgaugaccucgcccugagcccugcggugaaacgcgccguuuggcaggcucugcggauuguggaugagaucguccacaucaagaaaacgcuccccgccagaauuuucguggaggugacccgcucuaacaaggcugaaaagaaaaagaaagacuccagacagaagcggcugagcgaucuuuaugccgcgaucaaaaaggacgaugcccugcucucuggacugacaaaugaggaauuuggcgggcugaaguccggacuugcuaaauacgacgaugccgcucugcgcagcaagaaacucuaucuguacuauacccagaugggcagaugcgccuacacaggggagguuauugaccucucucaacugaacaccgacaauuacgauaucgaccauauuuauccccggagccuuacgaaggaugacuccuucgauaaccugguccucuguaaacgcaccgccaaugcucaaaagagcgacacauacccuaucucuaaggagauucagaaagcgcagaaggccuuuuggaucuuccugaaacagcagggccugaucuccgaaagaaaguaugagcggcuuacccgcauuacaccgcugaccgcugaugaccucagcggauuuaucgccagacagcugguggaaacgaaccaguccgugaaagccgcuacaacccuccugcggcgccuuuaccccggcgucgaugugguuuucgugaaggccgagaaugucacagacuuuagacacgauaacgacuucauuaaggugcggucucugaaucaucaccaccaugcgaaagaugcuuaucucaacaucguuguggggaaugucuaccacgaaagauuuacccgcaacuuccgggccuucuuuaagaaaaauggagccaacagaaccuauaaucuggcuaagauguucaacuacgacgugaaaugcacaaacgccaaggacggcaaggcgugggcuguuaaaacgagcauggauaccgugaagaaaaugauggacuccaaugauguccgcgugacaaagcggguguacgagcaaaaagggcagcugucugacauuaaccuuaccaaggccagcaaagucaaggccgauaucuaucugccuaucaaggcuaaugaccccauuaugucccagaacaugaaauacggaggcuauucugauaucaagaaugccuacuauacaauuaucgaguacagcgacaaaaagaacaauuccauuaaggcuuuuaucccuauccccauuuucaucgccaccaagacgcucacaaagcaggcgcugcucgaauauauuaaaaccguucugccgaaggccaacaaucuuagaaucauuuacaaaaagguguacaacgaucaacugcugaaaaucgacggguuuaauuauuaccucggcggacgcagcaacgaucgguucuguauugacaaugcuauccagcugaucgugccucuugagauucaguuuuauaucaagcuggucgaaaaguucaccgccauuaucucugagaacaaaaauauugcucucaaggccuccagcgugaaaucuagaaaccccaucaacaaucaaguugaaaacaucacacuggaguacacccagaagcucuuugauuaucugguguccaaauucaaugagcuuauuuaccugaagaugcgcggcaacaagcugacagacgucaauaacaucgggcggaaacaguuuauuaagcucagccuggaagagagaugcaaagcccuugcugaacugcucaauaucuucacgaacaugaauaagaaacugucucucuccaccauuaacgugagcgcgucccggaagguugugaauuucaaaaucagcucucuggacgaguuuaagaucgucaacgaaagcauuacaggacuuuauucccaugagaucaccauuguguga

SEQ ID NO: 4426 - RNA, 4188 nt, Artificial Sequence
  Cas9 variant
augaaccugagaaauaccacagacgaguacaacaucggccucgauauggggacgaauagcgugggaugggccgucaccgacaagguuggcgcuauugcccacuucaaagggaugcccacacugggaucccggcuuuuugaugcggcucagaccgccgccgaagcucgcgcccauagaggccaacggcgcagauaugugcggcgcagauggcggcuggaccuccugcagucucuuuuccaggaugagaucgacaagguggauagcgaauuuuucauucgccugagacagucccggcuccacgucgaggaccgcgaagaugggcaugcugacuacaaauggccuaucuuuaacgauucugacuucacagagguggauuauuacaagagauuuccgaccauuuaucaucugcggaaauggcugaucgagacagaccaaaaggccgacauccgccucauuuaccuggcgguucacaauaucgugaagcacagaggaaacuuccuucgggaaaauaacaaaaaucugagcuccagaaacgccgaucccgcugaggccgucggccaccuccgccuggcucuuaauaacuggugccuggaacggggcuaugagugugccuggaagucugggggaaaugacaacgcgauucucaaugugcugaucgauggcgagaaaagacgcagcgaccagguucgggaaauugccaagcugaccgggaucgauugcggagacgcuaaacaguccagacaguguaacgaggccauugcuaaggccaucgugggccucaaggccgaaaugaaaaacaucuuuggggaguucccugcugaaaagacgcugauuuaccuuagcucugaugacgaugucgagguggugcgcgacgcgugccccgaugacuccgucgagcuguuucaagcccucugugaacuguacgcugccuauauccuucagggacugcucagcuacgccccuggccagaccauuucuguuaauauggugaaaaaguaugaccgguacggcgaggaucugcaucugcucaaagaacugacaagaaccuaugcuuccaagcgcuacgacgccuucuuuagaggggagacauaugaaggaagcucugauuacguggucgacaaagcgcagggcuacaccagauauaaccuugggacgacacaacuguccuacgaugacuuccagaaggcugugaaggaacucuucaaaggaaccgaugcccugcaggacgagcgcuaucaaggcaugaugguugccuuuggggaacagcgguuccuuagacggcugaagacaagcgauaauggauccaucuacuaucagcuccaccuggaggaacugcaugcuauucucgagaaccagggcaaacacuaccccuuucugcuugccgaagaggacaagaucgagucucuggugagcuuccgcaucccuuauuacgucggcccgcucaccagagaaaaugcugccguggggcacgauggaaaagagcgguuugcgugguccagcagacgcgacggcauggaacaugccguuauuacccccuggaacugggaggagaucauugaucgggacaagucugcugaagacuucaucauuagaaugacaggggauugcacguaccugcaaggagagccugugcugcccaaguguucccuucucuaugaagaguuuugcgcccugaaugaacugaacggcgcucacuggaccaucgacgaggaugacgagcgcagauucgaugccgcgcagcgggaacgcaucaugugugaccucuuuagaagcacacggaaagucaccuacaagaaagugucugauuggcuggagcgcgaagacagcuucgucggggccagagugcauggcggacagggcgagcacggguuugaaucccagcuuggaucuuauauuuucuuuugcaaggauguuuucaaaacagacagccuggaugaggcugacuacccuaugaucgagcaaauuauccucugguccacccuguucgaagaucgggacauucugcgcagaaagaucgaggaagccuauggcgaccggcuuacgacagagcagauuaaggugaucuguaaaaagcgcuuugcuggguggggaagacucagcaaaaagcugcugaccggcaucaaagucgauaccgacacagggcggaagucuauuaucgaugugcucagagaaggcaaucccaacgacggacagcgcucccggaccaugguuuucauggaggugcugagagaugagggccuuggguuucagaaggccgucgacgauuucaaucgcgacuacuuuagcgaacauaacaauggacugauggaugugaacgaccucccgggcucuccugccauucggagauccaucaaucaagcugugcgcauuguugaugagaucgucagcaucgcgaaaaaggaacccgccaacauuuucaucgaggugacacgggaggaagacgacccucggaaaaaggggaaacgcacgaagcggagauaugaugcuauuaaauccgcccuggagguguuuaagaaggacgauccccagcuguggaaagaacuuaccaagaaagacucuaacaauauggaugagcggcucagccuguacuucaugcagcgcggaaagugcauguacuccggcagacccaucaaaauugaggagcugcacacagggaaguaugaggucgaccacaucaucccucggucuuacauuaaggaugacagccucgaaaacaaagugcugguuuaucgcgaggaaaaucagcauaagaccgauacacuucugaucgacuccagcauuagacggaaaaugggcaaguacuggagaaugcuccacaacgccaaacugaucggagauaagaaguuucgcaaucuguuccgggaccauauugaugacaaaaccaugaagggcuuuguggcuagacaaaucgucgagacgucucagauggugaaacuuguucagacccuccuggaagcccgcuauccgggggcgcggaucgugcccgucaaggcuaacauuucccacgaccugagagaugccgccggacucgugaaaugccgcgaggcuaaugacuuccaccaugcccacgaugcguuucuggcuugucggguuggccuuuucauccaaaagagacauccuagcguguacgacaaccccauugggcuggcccacaucaugcgcgauuaugccagagcucaggcccgggaguacaagaaaucucauuaccucgcucacacaaagggauucauugucaauuccuuucugagcucuggcuucgacaaagaaaccggggagguguuuaaggaugacugggaugccgaagcggagguggaaggcauccgcagaguccugaacuaucggcagugcuucauuagccgcaugccuguugaggccacaggaaccuuuugggaccagacgaucuacucccccaaauguggcaagaaacuuacacugccgcucaagagagggcuggauccugaccgguauggaagcuacucuagagagcaauucgcuuacuuuuucaucuaugaagcccgcgaucucaagcacgagcggcauauucugcaguuugcucaggugcccgugagagucgccgcccacaucgcuaaagacccuucccagcuugaaagcuaugcggugaagcuggccggccaagcuaaucucgccuucguucgcauugugcggagacggauccugaaaaagcagcugcuugagcugaacggggaccgccucauuaucaccggagucagagaggugcggaaugccacagaauuugcuuucucccuggaugaggaaacccucaucgagcgcugcguucagauugccaaagugggcucucugaucggcgucgugaacgacgaagaugaggagcagcuuagcgcggaccugaaugaacucuucuccucucugguuaagagagggcccaagcuguguaaccggcuuuacgcucaacugaaacucgauaaguaccugagcaaauuugacgagcucacccugacagauaaggccaaagugguccuucagcugauugccaucacgaacggauccauuaauauggcugaccugucugcccucggcagcuccaaguaugcggggugcaugcaagugagcuacuucaagcagcugaacgcuccuaucggagaagugaauaucauugaucagucugucaccggcauguuugagcgcagaacacauaucgggcuuuga

SEQ ID NO: 4427 - RNA, 4188 nt, Artificial Sequence
  Cas9 variant
augaaggagaucaaagacuacauuaucggccuggauauugggaccaacagcugcggauauguggucacagacaagcagaauaacauccucaaacugaagggcaaaacggccauuggggcuagacuuuucaaggaaggacaagccgcggcugaucggcgcuccuuuagaaccacacggcgcagacuggcccggcgccacuggagacucggccugcuugaggaaaucuucgaccccgagauggaaaagaucgauccuaauuucuuccggcgccugaaagagucugacuacagcccgaaggauuccagaaaacaguuuaacgccauuguuuucaagucuaucaaagcugacaagcgguuuuauaagaaauaccccaccauuuaucaucuccgcaaugcccugaugcacgauaaccagaagcaugaccugagagagaucuucauggcugugcaccauauugugaaauaccgggggaauuuucuccgcgaagauagcgucaacgccuucaaggcggccaaauuuucccugagaggagaggacggcaucggcccuguggauaaacuuaaugaccugcucaaagaaauuuauucugaguacagccccgagcuggcuacaaacaaucuuuccaagaucgaagacaucauuaaggauaaaaaccuguacaagcaggacaaacucaagcaaguugccacccugcugaucaaagaggcugauagcaaggacaaggccaaacucaauaaggauauugcgaaacagguggccaacucuuucaugggguauauguuucggcuggacacacuuuucucccugaccgaugucgacgugaaggauuacaaacucaaguucagcgacgcuaauaucgaugaaucucuggacgaccuuacgucccugcucaccgaugcccagauugaguuuguucuggaacugcagagcaucuauaacacaaucgugcucaacgagauugucccugacggaaugucucuguccgagagcaugaucaagaaauacgaugaccacaaggaagaucuuaaaauuuucaaggaguauaucgacucccugucugaucaaaagaaggcuaagaaacuccugagcgccuacaaucuuuaugugaacuacagaaaguccgaccugguggaagccaaaaaucucuuuaagaacaaaaaggucggcgauaaaaauuucgcugacguuauuagcaacuuugagguguucgggaaguuugugucugauaaucuggacgauuccgaacuggcgaacaagaucaaagcccgccucgaccugggagaguuccuucccaagcagcggaccaaucagaacggcgucaucccuuaccagcugcaccaaguggagcucacacagauucuggaaaaacaggggaaguauuacccguuucugaucacccccaauccuguugagagccauagaaacaaugcucccuaugaaauuucugagcuugugagcuuccgcgucccuuacuaugugggaccccucaucgacaaccaauccauuaaagauaagcagaauaagaacaaauuugccuggaugguucggcagaagcagggccaaaucacgccguggaaccuggaagagaugguggacacaaccgagucugccaaucaguucauuaaaagaaugacacgcaaggauaccuaccugcucgcugaagacguccugccuaaaagcucccuuguguaucagaaguuuaugauccuggaugagcucaaccggaucaagauugacggcaaaaagcugaccagcgaacugaaacacgauaucuucgagaaacuuuucaaaaagcagaagucuauuaaucucgacaaccugaaaaauuaccugcucgucgaggggaacauccccggacugauugaaggccuuuccgaugggaucaauuuuaacaauagcuucucuacauacaucgacuauagaaacauuuuuggagaugagaucgacaauccuaacaagcaagccgauuucgaaaagaugauugagugguccacgguguuugaagaccgcaagaucuucaaacggaagcugaaagagauuaccuggcucacaagcgagcagaucaagcagguuuccucuaagagauacagcggcugggggcgccuguccaaaaagcugcuuacccagaucacagacgaaaauggagugaacauucuccaacggcuguggaaugagcccgaaacccugacggagguccucgcgaaccccgugaucaaaagaaagauuguugaagcuaacucuagcuuuacaaaagccaaggauaugaaggacauccugguggaggccuauaccuccccucagaauaaaaaggcuauucggcaggucaugcgcgugguggaugacaucaucgccgcugcccauggcaaaaagccgagccagauugcgaucgaguucgccagagaagaucaagacaacccccagaugaccaaaucucggaaggcucagcuugaucaaauuuacgccaagaucuccgacgaguuucuggaugacgcuguuaaaaaugaacucaagaacaugaaagauaauaagccucuggccaaagacaaggucuuccuguauuuuaagcagaugggcagagacgcguacagcggggagaaacuuucucucgauaaccugcaggacuaugauauugaccacaucuacccccaguccuucauuaaggaugacagcuuugauaaucgcgugcuggugcaacgggccuacaacaauggaaaaucugacaacgucccugugcuccuguucggcaauaagaucgcugccgggcuuggaaucacaauuagacagauguggaaaaaguggcuggaacucggccugaucagcaagcgcaaauucaacaaucugauuaccgaucccgagaagaucuccagaaacauggcuagcggguuuguuaaucggcagcuuguggagacaucucaggucauuaaacugguggccaacauccuccaagccaagcugccggacacggaaaucauugagguuaaggcuuccuauaacagcauccuccgcaaggaauuuaaucuguacaaauccagagaggugaacgauuaucaccaugcgauugacgccuaccuuaccacaaucgucggcaauuaucuguaccagguguauccuaagcuccggcccuacuuuguuuacggacaguucaagaaauuuggcaaggcugagaaccaggaagaugacccugugaaaaagauuaaaaaguucaauuuuaucuaucaacugaucugggggaaggacgaugccauuuguaucucucacaccaaccagcaggucuucagcaaaaaggacauuaucgauaaacugacaaccgccuacaauuuuaaguauaugaacauuucccaugcuguguacacgcgcaauaacaauauguucaaacaaacccuuuuucccaucauugagagaacaaccgccaagacaaagucucugaucccuaaaaagcucgaccggcccaccgauaucuauggaggcuacagcaacaauaacgacgcguaucuggcucucgugaaagucgauaagaaacgcggguccgaauacagaguugugggcauuccgaugcgggccgccgcuaugcugaaggccucuaagaauuacgacgaggaucuucgcaaagugaucgaaccuauggucauguucgacaagaacggaaaagcgaagagagggauugagggcuuccgggugcugguuggaaaaaugcccuuuaagcaggcugugcucgauggcaauaaaaaguucaugcugacggggacagucgacacccccaaccugaagcagcuugugcugagccagcaaaacaugaaauauauccucgauuacauugaggacguugacugcagaaagcacaaauuuggagauaaggugcagaauccugacaaaugucugcucgaagucuucgaugagaucaucgaaauuguggacaaguauuuugagcuguucgauucccgcgacuuucgggaaaaacuuagaaacagccgcaauaaauucaucaagcuggaggccucuaaaaaggccgauacaauucuggcuauccucaaaggccugcaggccaaguccacccgggcuaccauuaaggagcuuaacaucagcgacuuugggagaaucauuacaucuuccaucagcccggaagcccagcugauuuaccaaucucccacgggacucuucgagcgccggguuaaagugaaggaucuguga

SEQ ID NO: 4428 - RNA, 4188 nt, Artificial Sequence
  Cas9 variant
augagcaagaaauaccagaacaccaaguauuacgugggccuggacaucgggacauccucugucggaugggccguuacggaugcuaauuaugagcuccugaaagugaacggccacaagaccugggggagcagacuuuucacagaagccgagaccgcgcuggaacggcgcacacauagagcuacccggcgcagacuccaacggcgcaaacagagacuggaccuucuggaugagcucuuugccgaggaacuggccaagguggacccccaguuccugcuccggcugaaggagucccaguaccacauggaagauaaaucuacagacgauaaguauguccuuuuuaaugaccaaaaccgcaccgauggagaguucuuuacggaauacccuaccauuuaucaucugagaagcgagcucaugcagggcaaaaaggaggacauccgggcuguguaccuggcccuucaccauauuguuaaauaccgcgggcacuuccugcucccgggagauaauuaugacaugcagggcaaccuguccgaacugaucaagagacucuuuaaguucauugaggaaacacuguuuaucgaggaucuuggccugaccgacgaaauccagucuaaaauugaggagauccuccugacaaagaccaaaacgcggcuugaccgccaaaaggaaauugugaaacuguucaauacaaagcaccagaaacucgaugacaagcagaagaaacugcuggaggcuaucuuuaagcucugccuggggcuuaaaggaaacauggucaauauuuucggcgauaagggggaauacggaaucgacuuuaccgauguggaggacaaaaagaagaaaguugaauuuagcgccgauuaugacaacaauauuaacgauuacguggacuucuuuggcgaguauuucgagcugcucgaaaucacaaagaaaaucaaugauaccgucauuuucuccgagauccugguggacgggaagggauucagcgaaucuaaagugauuuccuacgagaagcaucagcaagaccuuagaaagcugaaaacccuccucaagagccuggauaaaacacugggcuauaaguacggcgaagggcuguaccagaaaauccuucuggacgaugucaagucuaacuauguuaauuacuccggaaacagccagaagcucaaaaaguguacgaaagacgaguuuuauggcuucauuaagucuaaacugaacuccgugaccaagaaagagaaggugagcgaagcgcaacagaaggagaucgcccagauccuggcugauauggaauuuggggacuaccuuccccuccagcggacaaccgauaauggagucauuccuaaccaacugcacaaaaaggagcugaucgagauuaucgaacagcagacaaaauaucaugacuucuuuaaugauguggacgagaacggccucaccauuaaggauaaaaucaucucccugaugacguuccggauucccuacuauguugggccucuuaaugacuaccacaagguggccgauggaacaggccacgcuuggaucgaaaagaaaaaggacggcaaaauuuaccccuggaacuuugacgagauggucgauaccgaagccaccgcggagaaguucaucaaaaaucugacaaacaagugcaccuaucucaagggggaggacgugcugccuaaagaaucuaagcuguacagcgaguuuaugcuucucaaugaacugaacaauauuaaaaucgauaaccagaagcuggacccgaaacucaagaugaagaugguuuccgagcuguucaugaaaaagaaugaaaagauuacaaagaaaaagaucguggauuaucuucgcagcaucggacaagccaacggcaaugagauggucucugggauugaccgggagaucaaauccgaucugaagacgauucauaagauccagcacuacuaucaggacgcuagccucgaaauggccgagaacauuaucagauggaacaccaucuucaaugauucuacaagcgacauucugaaagauaagaucaccaaggcuuacggagacgugcugacacccggccagauuaaggggcuuuccaaccucgccuguaaagauuggggcaagcugucugaaaaguuucugaccggaauccgcugcgacgucggcgaguucaaaaauauuagcaucauccaagccaugcgggacacgaacaauaaccucauggaacugcuuuccaauaaguaugaguuuauggauaaaauucaggaguacaacaaggaauacuauggggacuucaccuuuaaagcugagccuagcaucauggaugaccuguacgugggacccggcccuaagagagcgauuuggcaggccguucgcaucguggaagagauuaagcggaucauggggcaugaucccgagaaaaucuuccucgaaacaaccagaacaaaucgcgcuccgaaggucaaaaacaccaagcgguaugacgcccuggagaaaaaguacgaaucugugaaggagcacgaauaugccgagguuaaaaaggaguuugaaauugagaaaaaugauucccugaacaucaagaaacuuuuccucuacuuuacgcagcugggacauuguauguauagcgacgaaaagauuccuuacaaugagcuguucacaaacagauacgauaucgaccacauuuauccccgcucuaagacccgggauaauuccauggacaaccucgugcuggucaaagcugaaugcaacagagacaagaaagauaauuacccuaucaaacuuaaaacaaacauucaacagaagugucaggugcggugggccuaucugcgcgacaaaaagcucaucaccgaggagaaguacaauagacuggugcggaaaacaccccugaccgaagaugagcuuagccaauuuaucgcgagacagcugguuuucacgucccagucugucaaggcuaccgccgaaguguuuaaacgccucuaugaggacagcaagauuugcuacgugaaagccgaaaacgucuccgauuuccgguauggcucuacaagaaagaugagcaaggacgaucagccccaaccuuucaucaaaaaucgcgacgugaacgauuuucaccaugcuaaggacgccuaccugaauauuguuguggggaacgucuacgaugugaaauucacccagaauccgacaagauuuaucaaggcuaacaaagacuauucccucaauuacauuuuccgguaucccguuaacaagaagggcgagaaugugugggauccugagcagagcaugaaaaucgucgaaaagacccugaaaucuaacgacgugcgcguuacgaaacuugugaaacccaucacauccccuauuagcaaugagacccugcacaaggcccucaaguguaaacccggaucuuaccugccgagaaaguccagcaaaggcaccccucuggcggacgucacaaaguaugggggauacgagaaaaucaagaacgccuauuacucuauuuacaaauauaccuacaugaagaagaaagaaugcauggaggaauuucuucuggugcccaucccuauucaucucgugaacaaugaugaggaacugcccaaguauaucaacgacaaaaucgcugagcgggccaagaaaaagaagcucgaaacagucgaguguauuguuaaagagcuguaccagggcacgcuugugcgcaucaauggguaugauuacagaauugcuggaagcuccggcaagcaauucgaacugcacaacgggaucaaucucauuguggagccuugggucgaaaaagugcugaaggagaccgacaaauuuguuagaaagagcaacucuaagcuggauaaaaagcagcagaaagaaaauacaaccgagacacuuaucgagaagcagcugaacgacguguucgaauaucucugccgcaaacugaaucaaggcauuuuuaagaacaauaagcacacccuccccgccaaacugcuuggagauuccauccagaagagauucgaggacgcgagcaucgaagaugaguuugaagucauuaaagagcugaucuccgccauugcuaagaacccgcagaauuucaaaacgauccaaaaggugcuggacauuucuggcagcuccaucccucgguucaaccucaaacugaccaagaauaacguugaugaguuuaucauuaagaaugaaucugugacagggcuuuucacccaugagaaagucaucuuucgcaaguga

SEQ ID NO: 4429 - RNA, 4188 nt, Artificial Sequence
  Cas9 variant
augaagaaagagaucaaggacuacuuccugggccucgauguggggaccggaagcgucggcugggccguuacagacacggauuauaaacugcuuaaggcuaacagaaaagaccugugggggaugcggugcuuugaaaccgccgagacagcggaagugcgcagacuccaccggggagcucgcagacggauugagcgcagaaagaagcggaucaaacugcuucaggaacuguucucccaagagauugccaagaucgaugagggcuuuuuccagcgcaugaaagaaucuccccucuacgccgaggacaagaccauucugcaggaaaauacacuguuuaacgauaaagacuucaccgauaagacauaucauaaggcuuacccuaccaucaaucaccucaucaaagccuggauugagaacaaggugaaaccggaccccagacugcuuuaucuggcuugucauaauaucauuaagaaacgggggcacuuucucuucgagggagauuuugacagcgaaaaccaguucgauacguccauccaagcccuguuugaguaccuucgcgaagacauggagcuggacauugaugcggacucucagaaggucaaagaaauccucaaggauagcucccugaaaaauucugagaaacagagcagacugaacaagaugcucggccugaaaccuuccgacaagcagaaaaaggccauuaccaaucuuaucagcggcaacaagaucaauuucgcugaucuguaugacaaccccgaucucaaagacgccgagaaaaauucuauuuccuuuagcaaagaugacuucgaugcucugucugacgaccuugccuccauccugggggauagcuucgaacuccugcugaaggcgaaagccguguacaacugcucuguucucuccaaggugauuggagacgagcaauaccugagcuuugcuaaggucaaaaucuaugaaaagcauaaaacagaucuuaccaagcugaaaaaugugauuaagaagcacuucccuaaagacuacaagaaaguuuuuggcuauaacaagaacgagaaaaauaacaauaacuacuccgccuaugugggggucuguaagaucacacacaaaaagcucgugaucaaaaauucugcuagccaggaagauuucuacaaguuucugaagaccauucuuuccgccaaaagcgagaucaaggaggugaacgacauucugacggaaaucgagacaggaaccuuccuccccaaacagauuucuaaguccaaugccgaaaucccuuaucagcugcggaagauggagcuggaaaagauccucagcaacgcugagaagcauuuuucuuuccugaaacaaaaggaugagaaaggccuuagccacuccgaaaagauuaucaugcugcucacauuuaagauuccguacuacaucgggcccauuaaugacaaccauaaaaagucuuucccugaucgcugcugggucguuaaaaaggagaaaagccccuccggaaagaccaccccuuggaacuuuuucgaccacaucgauaaggaaaagacagcggaggaguuuauuacgagcagaaccaauuucuguacauaucugaucggcgaaucugugcugcccaaguccagccuucucuacucugaguauaccgugcugaaugaaaucaacaaucugcagauuaucauugacggcaaaaacaucugcgauauuaagcucaaacagaagaucuacgaggaacuguucaaaaaguauaagaaaaucacacaaaagcagauuuccaccuuuaucaaacacgaggggauuuguaacaagacggacgaggucaucauucuuggaaucgacaaagaaugcacaagcucccugaagucuuacaucgagcucaagaauauuuucggcaaacagguggaugaaaucagcaccaagaacaugcuggaggaaauuauccggugggccaccauuuaugacgagggggagggaaaaacaauccugaagaccaaaaucaaggcugaauacggcaaguacuguuccgaugagcagauuaaaaagauccuuaaucucaaauuuucuggguggggaagacugagccgcaaguuccuggaaacaguuacguccgagaugccgggcuuuagcgaaccugugaacauuaucaccgccaugcgggagacacaaaauaaccucauggagcugcuuucuuccgaguucaaauuuaccgaaaauauuaagaagaucaacagcggcuucgaagacgccgagaaacaguuuucuuauaaugggcuggucaagccccucuuccuguccccuagcgugaaaaagaugcuguggcagacacuuaaacucguuaaggagauuucucauaucacccaggcuccucccaagaaaaucuuuauugaaauggccaagggagcggagcuggaacccgcuagaacgaaaacccgccugaagauccuccaagaucuguacagcuccugcaaaaacgacgccgaugccuucagcucugagauucaguaucuuuccggcaagaucgaaaaugaggacaaccugcggcucagaagcgauaaacuguaccuguauuacacacagcuugggaaguguauguauugcggaaagccgauugagaucggccacguguuugacaccuccaauuacgauaucgaccauauuuacccccagucuaaaaucaaggaugacagcauuuccaaccgcguccucgugugcucuagcuguaauaaaaacaaggaagacaaauauccucugaaggcugagauccaauccaagcagcggggguucuggaacuuccugcagagaaauaacuuuauuucucucgaaaaacugaaucgccuuacacggaccagccccaucuccgaugacgagacggccaaguucaucgcuagacagcuggucgaaacacgccaagccaccaaaguggcggccaagguucucgagaaaauguuuccugagacaaagauuguguacagcaaggcugaaaccgucucuauguuccggaacaaauuugauaucauuaagugcagagagaucaaugacuuccaccaugcccacgaugcuuaucugaacauugugguuggcaauguguacaacaccaaauuuacaaauaaccccuggaauuucaucaaggaaaaacgggacaacccgaagauugccgauacguauaauuacuauaaggucuuugacuacgaugugaaacgcaacaauaucaccgcgugggagaagggaaaaacaaucauuaccgugaaggacaugcugaaaagaaacacaccuaucuacacccggcaggccgcuuguaagaaaggcgaacuuuucaaccagacgauuaugaagaaggggcugggacaacacccccucaaaaaggagggcccucuguccaauaucagcaaauaugggggauacaacaagguuucugccgcuuauuacacacucauugaguaugaagagaaaggcuccaagaucagaagccuggaaaccaucccccuuuaccuggucaaggauauucagaaaaauaaggacgggcucaaaucuuaucugaccgaccagaucggcaagaaagagauuaagauccugauuccuaagaucaaaaucaacucccuucugaagauuaauggauuucccugccauaucacaggcaaaaugggggaggccuucgugcuccgcccggccgugcaguucuguugcagcaacgaugaagcucuguacuuuaagaaaauuauccgguucaaugagauuagaaagcaacgcgaaaagaugggaaaaaccaucuccccuuacgaggaccucagcuuuagaucuuauauuaaggauaaccuguguaaaaagacaaaagcggacgaaaucgaggagaaggaguucuacgaucuucugcagaaaaagaaucucgaaaucuaugacaugcugcugacgaagcacaaagauaccauuuacaagaaacggcccaacagcgccacaaucgacauucuugucaagggcaaagaaaaguuuaagucccugaucauugagaaucaguucgaagugauccucgagauccugaaacucuuuucugcuacccgcaacguuagcgaucugcagcauauugggggauccaagaaugccggcaacgccagaguggggaauaaaaucucuagccuugacaacugcauucugaucuaucaauccauuacaggcaucuucgagaagcggaucgaucugcucaaaauuuga

SEQ ID NO: 4430 - RNA, 4188 nt, Artificial Sequence
  Cas9 variant
augagcuucaagaaaauccugggccucgacgugggggucgccuccauuggaugggcuguugugagagagaacgaagagaaucccaacuuuaauaccaucacaaagcugggcgugcgggucgugccuauuacgucugaugaaaaacuuaacuucgagaaggggaaaagcaucaccuccaaugccgaacgcacacuggcgagaucuagccggcgcaaccuccagagauuucggcugcgcagaaagaaucuuauugcuauccugcuccaaaaccagaucauuaccccgacaacaccccugacagagaagggaaaauucaccacguuugagacccugaagauccgggccaaagccacaaaggagaaaauugaacucgaggagcuggcucgcguucuucugcacaucaauaagaagagaggcuacaaauccucucggaaggugaaaaacagcgaggacgggaaggccauugauggaauggaagcugccaaaauccucuaugagaauaagcugaccccuggccaguacacauaucagcuucuggaaaaaggcuccaacaagauucccgacuucuacugcagcgaucuccaaaucgagugggaagucaucuggaauuuucagaagcaguucuauccuaaccugcugaccgaggacuuuaaaaaggagcucaaagggauuggacagcgcgcgacggccgcucuguuccuuaagaaauacggcaucuauacagcccugaauaaggggaagagagaagagaaaaagcuccaggcuuacaaauggcggucuaaguccgugagcgagaaaauucccguugaagaacuggccuacgugaucgcggagauuaacucucauaucaccaacuccagcggauaucuuggcacaaucucugaucgcuccaaggagcuguacuuuaaucagcagaccauuggggaaaaccucuaugcccaggucgcuaagaauacccacgccaaacugaagaaccaaguguuccugagacaggacuacagcgcugaguuugaacagaucugggagacacaagccaaauuccauccucagcucacgccggaacugaagaaaaagauucgggauuccaucauuuucuaucagagaaaacuucgcucucagaaacggcugaucagcaucugugaguuugagaauagagaaauugagaucauuaagaacggcaaaaagaaaaagaaaaagaucggacucaaggccgcucccaaauccagcccucuguuccaagaauuuaagauuuggcaagugcuuaauaacaucgucauuaaacaggagggcaaggaccgccugcucaccugggaggaaaaagagcugcuguucacagaacucaauaucaaggggaacaucucuggacagaaggcgcuggcccuucugaaacucucccccaaggauaccaagauuaauguuacaauccuggaaggcaaccacacccaggaacaacuguaccggguguaucuucgcauucucgggauggagggauacgacguguuugaucugcugaagaucccugagaaucaggacgaaauuaaacccgcugacagcaagaucucugccgccgagaucaaggaaacggucaaaagcguguucaagacaugcuccauuucuccgagcauccucgauuuugacccucugcuucccaacccugaguucgaaaaucaguccagcuaccaacuguggcaucuccuguauucuuacgagggcgauuccagccccucugggaacgagaaacugcuugaacuccugaagaacaaauuuggauucaagaaggagcacgcucugcuccuggccuccauuagcuauaccuacaucuauggcaaucuuuccucuaaagcgaugagaaagauuuaccccuauagcaaagaaaacaccuacuccgaggcuuguaugcuggccggcuaccggcacucuaagaaugcccucccuagagaggaacugguuaaauaucagcugaaggaccgccuugagauccucccgaaaaacagccugcggaaucccguggucgaaaaggugcugaaccagcucaucaaucugguuaacucccuuauggaugaguacggggcuuuugacgaaauuagacuggagauggcccgcgagcucaagaaaaaugcuaaggaacgggagaaauggagcaagaacaucgccgaugcgacaucuagaaaucagaaacaugccgaaauucugaagaaggacuucaaaaucuccaacccuagcaagaaugaucugauucgguaucgccuuuaccucgagcugaaagcuaacggauauaaugaccuguacaccaacacauauaucgauaucaacuaccucuuuacgcacagauacgacauugaccauaucauuccccaaucuaaggugcuggaugacuccuucagcaauaaaguccuugugccucggcaggccaaccuggaaaagucuaaucucaccgcuuucgauuauaucagccaccagggcaaggagaaagaggaacacuaccugaacgucauuacagagcuguauaagagaggguccaucagcgaaaccaaauacaagaaucuucagaaaaagggaaacgagauuggcgaaggguuuaucaaucgcgaccugaagaacacacaauauaucgugcggaaagccagagagauucucucucugaucacccccaauguugugacgaccacaggcgagauuaccgcgaagcuccgcaaagauuggaaccugaucaauuccaugaaggaacuuaacauggacaaauucagaaaugcccggcugacagagcucgucgaaaacagccgcggagagaagaaggaaauuaucaucgauuggaauaaaagaaacgaccagcggcaucacgcuauugaugcccuggugguugcuuuuaccacgcgcaaccaugugcaguaccugaauuauaugaacgccagagaggacgagucccacaagcaacauucucacauccuuagcauugagaaaaagaucaaauacgauaaguuccacgaaaauggcucccggcagucucgcuuuauuuacccgacaagcaacuucagagaagaggccaaaaagaagcugaaagagauccucgucuccuauaagaccaaaaauaagguggugacaguuaacaucaauaaaccuaagaagaaagggggauacucucccaagcaugaacugaccccucggggcccccuccacaaagagaccauuuaugggaugauccgcauucugcauacaaaggaaaucaaagucagcuccaaacuuaacuuugagacgguggugcggauucagaauccuagauacagaaacgcucugcucgaacgccugaaggacaauuucaacgaucccaagaaggcguuuagcggaaccaauucucugaccaaaaacccggucuuccuuaccgccaauuccacagagaccgugccugagaagguuacgauccagugguuugaaaaaguguauacaauucggaagcccaucaaccccaccaauuucaagaacgagaaaaacaucgaaaagguccuggacccuaccauuagaacacuccugaaaaagcgccuccaagaguacaauggcaacgcuaaagaagccuuuagcgaccuggagaagaauccgaucuggcuuaaccaggagaaagggauuugcaucaagaccgugacaauuacgggcaucucuaauguugaaucccugcacaccaagaaagaucacuucggaaaggagcugcucgacaucaacggcaaucccauuccuguggauuucgucagcacagggaacaaucaucacguggccaucuaugaagacucugagggaaaccugcaggaaaaaguuguguccuuuuacgaggcugucgagcgggugaaucagggccuucccgugauugauacccuguacaaccucgaccugggguggaaguuccucuuuacaaugaaacaaaaugaaauguuccuguuuccugccgaugacuucgaucccaacgacaucgauauuuaugacgagaagaaucuuauccugaucagcaagcaucuguuuagaguccagaaacucuccagcaaggauuacuguuuccgccaccaucuggaaaccucuauuaacuuuaacgacccugcgcuuaaaggaaucacguggcggagagagagccccaauggccugcgcaaccucguuaaggugcggcugaaucaccucgggaaaauugugcacaucggcgaguga

SEQ ID NO: 4431 - RNA, 4188 nt, Artificial Sequence
  Cas9 variant
augaagaaagagaucaaggacuacuuccugggccucgauguggggaccggaagcgucggcugggccguuacagacacggauuauaaacugcuuaaggcuaaccacaaagaccugugggggaugagaugcuuugaaaccgccgagacagcggaaaagcggcgccucuucagaggagcucggcgcagaauugagcggcgcagaaagcggaucaaacugcuucaggaacuguuuucccaagagauugccaagaucgaugaggacuucuuucagcgcauggaagagucucccuucuacgccgaagauaaaaccauucuccaggagaauacacuguuuaacgacagagauuucaccgacaagacauaucauaaggcuuacccuaccaucaaucaccugaucaaggccuggauugagaacaaggugaaaccggauccccggcuccuguaucuugcuugucauaauaucauuaagaaacgcggccacuuucuguucgaaggggacuuugauagcgagaaccaguucgacacguccgugcaagcccucuuugaauaccugagagaggacauggaacuugauaucgacgcggauucuaagaaaauuaaggagauccugaaagacagcgcccucaaaaauuccgauaagcagaaccggcugaauaaacugcucggacugaagucuagcgacaaacagaagaaagcucuuaccaaccugauuuccggcaauaaggccaacuucgcugaucucuaugacaauccugaucugaaggacgccgagaaaaacagcaucucuuucuccaaggaugacuuugacgcgcuuagcgaugaacuggccucuguccucggcgacuccuucgagcugcugcuccgcgcuaaagccguguacaauugcagcguucugucuaaggugaucggggaugaacaguaccuuuccuuugcuaaagucaagauuuaugagaagcauaaaaacgaccugacaaagcucaaagaagugguuaagaaauacuuccccaucgaguauagaaacauuuuuggauacaagcaaagcgagaauaacaauuguaacuauucccgguacgugggcgucugcaagucugggagcaaaaagaaagugaucaauaagaccgccucccaggaagauuucuauaaauuucugaaggacauucuucugaaaagaagcgaugugccugaggccaacggaauccucacagaaaucgagaccggcacguuccugcccaagcagauuucuaagaauaacgcugaaaucccuuaccagcugcgcaaaauugagcucgagaagauccugacaaaugcggaaaaauuuuucuccuuucuuaagcaaaaagacgagaacgggcugagccacucugaaaagauuaucaugcuccugaccuucaagaucccguacuauauuggacccaucaauacaagccacaaacaguacuuuccugaucgguccugggucauuaagaaagagaacgcuccccaggagaagaucaccccuuggaauuucuucgaccauauugauaaagaaaagaccgccgaggccuuuaucacaucuagaacgaacuucuguaccuaucugauuggcgaaagcguucuucccaaaaauucccuccuguacagcgaguauacagugcugaacgaaaucaacaaucuccaaaucauuaucgacggcaagaacauuugcgaugugaagcugaaacagaagaucuacgaggagcuuuuuaaaaaguauaagaaagucacccagaagcagauuucuacauucaucaaacacgaagggaucuguaauaagaccgacgaggugauuauccugggaauugacaaagaaugcacguccagccucaagucuuacaucgagcugaaaaacauuuuuggcaagcaaguugaugaaaucuccacaaagaauaugcuggaggacaucauucgcugggccaccaucuacgaugagggggaaggaaaaaccauucuuaagacaaaaaucaaggcugaguaugaaaaauacuauagcgacgagcagauuaagaagauccucaaccugaaacuguccggcugggggcggcucucuagaaaguuccuggaaagcaucaccuccgagauuccgggauuuaucgagccugugaauauuaucacagccaugcgcgaaacgcagaacaaucuuauggagcugcucucuagcaaauucaaguuuaacgaaaauauuaaaaagaucaacuccggcuucgaggauaccgacaagcgguuuagcuacaauucucuggucaaaccccuguuccuuuccccuagcgugaagaaaaugcucuggcagacacugaagcugguuaaagagauuucucauaucacccaagcgccucccaagaagaucuuuauugaaauggcuaaaggcgccgagcucgaacccgccagaacaaagacccgccugaaaauccuucaggaucuguauaacuccuguaagaaugacgcugaugccuucagcucugagauucaguaccuccuggggaaaaucgaaaacgaggacaaccugcggcuuagaagcgauaagcucuaucuguacuacacgcagcugggaaagugcauguauuguggcaaaccgauugagaucgggcacguguucgacaccuccaaguacgauaucgaccacauuuauccccaaagcaaaaucaaggacgauucuauuaauaaccgcguccucgugugcuccagcugcaauaaaaacaaggaagacaaauacccucugaagcccgagauccagcuuaagcagaaaaaguuuuggaauuuccugcagcggaacaauuuuauuuccaucgaaaaauucaacagacucacacggaccacaccuaucucugaugacgagaccgcuaaguuuauugcccgccaacuggucgaaacgagacaggcgacaaaaguggccgcuaagguucuggagaagaucuuccccgagaccaauauuguguauagcaaagccgaaacagucuccauguuucggaacaaguucgauaucauuaaauguagagagaucaaugacuuucaucacgcucaugaugccuaccuuaacauugugguuggaaauguguauaacaccaaguucaccaauaacccguggaacuuuaucaaagaaaagcgcgacaauccuaagaucggcgauacauacaacuacuauaaagucuucgacuacgaugugaagcggaauaacauuacggcgugggagaaagaaaagaccaucauuacagugaaaaccaugcugaagagaaauacacccaucuauacccgccaggccgcuugcaagaaaggggaacucuucaaccaaacgauuaugaagaaaggccugggacagcacccucucaagaaagagugucccuuuucuaauaucagcaaguacggcggguauaacaaaguuuccgccgcuuacuauacauucaucgaguacgaggaaaagggaaauaagauuagaucucuggagaccaucccucuuuaccuggagaaagacauucaaaagagccaggacggccucaaaggguaucugaccgaucagcugggaaagaaagaaaucaagauucuuguccccaagaucaaaaucaacucccugcucaagauuaauggcuuuccgugccauaucacagggaaaaccggcgccagcuucgugcugcggccugccgugcaguuuuguugcucuaacgacgagguccucuacuucaagaaaauuauccgcuuuaaugaaauuagaucccagcgggagaagaugggaaagacaaucagccccuaugaagaucugucuuuccgcuccuacauuaaagagaaccuuuguaagaaaacgaagaaugacgagaucggcgaaaaagaguuuuauggguuccugcagaagaagaaccucgaaaucuacgauaugcugcugauuaaacacaaggacaccaucuauagcaaaagacccaauucuacaacccuugauaugcugauuaagggacgguacgaguuuaucaaccucaaaccugaagaccaaauucgcgugaugcuggagauccucaagcuguucugcacaaccagagagguuaucgaucuuggccugauuaaagggaaguccgaagcuggagugacgacccugggcaagaaaaucagcaaccucgacuccuguauucugaucuaccagagcauuacagggaucuuugagaagcggaucgaucuucugaaaauuuga

SEQ ID NO: 4432 - RNA, 4188 nt, Artificial Sequence
  Cas9 variant
augaagaaagagaucaaggacuacuuccugggccucgauguggggaccggaagcgucggcugggccguuacagacacggauuauaaacugcuuaaggcuaacagaaaagaccugugggggaugcggugcuuugaaaccgccgagacagcggaagugcgcagacuccaccggggagcucgcagacggauugagcgcagaaagaagcggaucaaacugcuucaggaacuguucucccaagagauugccaagaccgaugagggcuuuuuccagcgcaugaaagaaucucccuuuuacgccgaggacaagacaauccuccaggaaaaugcucuguucaacgauagagacuuuaccgauaaaacauaucauaaggccuacccuaccauuaaucaccugaucaaggcuuggaucgagaacaaagugaagccggacccccggcuccuguaucuugccugucauaauauuaucaaaaagcgcgggcacuuccuguuugagggagauuucgacagcgaaaaccaguuugauacguccauucaagcgcuguucgaguaccugagagaagacauggaggucgacaucgaugccgacucucagaaagugaaggaaauucuuaaagauagcucccugaagaauagcgagaagcagagccggcucaacaaaaugcugggccugaagccuuccgacaaacagaagaaagcuaucaccaaucucauuagcggcaacaagaucaauuuugccgaucuguaugacaaccccgaucuuaaggacgcugagaaaaauucuaucuccuucagcaaggaugacuucgaugcccugucugacgaccucgcguccauucugggggauagcuuugaacuucugcucaaagccaaggcuguuuacaacugcucugugcuguccaaagucaucggagacgagcaauaccugagcuucgccaaggugaagauuuaugaaaaacauaagacagaucucaccaaacugaagaauguuaucaaaaagcacuuuccuaacgacuacaagaaaguguucggcuauaacaagaaugagaaaaacaauaacaauuacuccgcuuaugucgggguguguaagacaaaaucuaagaaacuugugauuaacaauaccgucaaccaggaagauuuuuacaaguuccugaagcccauccuccuggccaaaagcgagaucaaggagguuaaugacauucuuacggaaaucgagacaggaaccuuucugccuaaacagauuuccaagagcaacgccgaaaucccguaucagcuccgcaaaauggagcuggaaaagauucugucuaaugcugagaagcacuucuccuuucucaaacaaaaggaugagaaaggccugagccauucugaaaagaucaucaugcuucugacauucaaaauucccuacuacaucgggccuauuaacgacaaucacaagaagucuuuucccgauagaugcugggugaucaaaaaggagaaauccccuucuggaaagaccacccccuggaacuucuuugaccauauugauaaagacaagacagcggaagccuucaucacgagccggaccaauuucuguacauaucucgugggcgaguccguccugccgaagaacagccugcuuuacucugaguauaccgugcucaacgaaauuaauaaccugcagaucaucauugauggcaaaaauaucugcgacauuaagcugaaacagaagaucuacgaggaacucuuuaaaaaguauaaaaagauuacacaaaagcagaucuccaccuucaucaaacacgaggggauuuguaacaagacggacgaaguuaucauucugggaaucgauaaagagugcacaagcucucuuaaguccuacauugagcugaaaaauaucuuuggcaaacagguggacgaaaucagcaccaagaacaugcucgaggaaauuaucagaugggcuaccauuuaugaugagggggaaggaaagacaauccugaagaccaaaauuaaggccgaguacggcaaauacuguuccgacgagcagaucaagaagauccugaaucuuaaauucucuggguggggacgccucagccggaaguuucuggaaacagucacguccgagaugccuggcuucucugaacccgugaacauuaucaccgccaugagagagacacaaaauaaccugauggaacuccugagcuccgaguuuaaauucaccgagaauauuaagaaaaucaacagcggcuuugaagauguugagaagcaguucucuuaugacucccuugugaagccucuguuucucagccccucugucaaaaagaugcuguggcagacacugaaacuugugaaggaaauuucccacaucacccaggcucccccuaaaaagauuuucaucgagauggccaagggggcggagcucgauccgguccgcacgaaaacccggcugaagauccugcaagaccucuacaauaacugcaaaaaugaugcugacgccuuuagcucugaaauuaaggaucugagcggaaaaaucgagaacgaagacaaccuuagacugcgcuccgauaagcucuaucuguacuauacacagcugggcaaauguauguacugcgggaagcccauugagaucggacauguguucgacaccagcaauuaugacauugaucacaucuacccucagucuaagaucaaagacgauuccauuagcaaccggguucuugugugcuccucuuguaauaagaacaaagaagacaaguacccccucaaagccgagauccagagcaagcaaagaggcuucuggaauuuucugcagcgcaacaauuucauuucccuggagaagcucaaccggcugacaagaaccucuccuaucagcgaugacgaaacggcuaaauuuauugcccgccagcuugucgagacacggcaggcuaccaagguggccgcgaaaguucuggaaaagauguuccccgagacaaaaaucguguauuccaaggccgaaaccgucucuauguuuagaaauaaguucgauaucauuaaaugccgggagaucaacgacuuucaucacgcucaugaugccuaccucaauauugugguggggaacguuuauaauaccaaguucacaaacaauccguggaacuuuaucaaagagaagcgcgacaacccuaaaauugcugauacguacaauuauuacaaggucuucgacuaugacgugaagagaaacaauaucaccgccugggaaaaaggcaagacaauuaucaccgugaaagauaugcugaagcggaacacacccaucuacaccagacaagcggccuguaaaaagggagagcuguuuaaucagacgauuaugaaaaagggccuugggcagcacccucugaagaaagaaggaccccucagcaacaucuccaaguacggcggguauaauaaagucagcgcugccuacuauacacugauugaguacgaagagaagggaucuaaaauccgcucccucgagaccauuccucuguaucuugugaaggacauccaaaagaacaaagauggccucaagagcuaccucaccgaccagaucgggaaaaaggaaauuaaaauccugauucccaagaucaagauuaauucucugcuuaaaaucaacggcuucccgugccacaucacaggaaagaugggcgaggcuuucguucugcggccugccgugcaguuuuguugcuccaaugaugaagcccucuauuucaaaaagauuaucagauuuaacgagauucgcaaacagagagagaagauggggaagaccaucagccccuacgaagaccugucuuuccgguccuacauuaaagauaaucucuguaagaaaacaaaggcugacgagaucgaagagaaagaauuuuaugaucugcuucaaaagaaaaaccuggagauuuacgacaugcuccugacgaagcauaaggauaccaucuauaaaaagcgccccaauagcgcgacaaucgacauucuggucaaaggaaaggagaaauucaagucccuuaucauugaaaaccaguuugaggugauccuggaaauucucaagcuguucagcgccaccagaaauguuucugaucuccagcacaucggcgggagcaaaaacgcuggaaacgcccgggugggcaauaagaucuccucucuggacaacugcauucuuaucuaccagagcauuacagggaucuuugagaaacgcauugaccugcugaagaucuga

SEQ ID NO: 4433 - RNA, 4188 nt, Artificial Sequence
  Cas9 variant
augaagaaagagaucaaggacuacuuccugggccucgauguggggaccggaagcgucggcugggccguuacagacacggauuauaaacugcuuaaggcuaacagaaaagaccugugggggaugcggugcuuugaaaccgccgagacagcggaagugcgcagacuccaccggggagcucgcagacggauugagcgcagaaagaagcggaucaaacugcuucaggaacuguucucccaagagauugccaagaucgaugagggcuuuuuccagcgcaugaaagaaucucccuuuuacgccgaggacaagaccauucuccaggaaaaugcucuguucaacgauaaagacuuuacagauaagaccuaucauaaggccuacccuacaaucaaucaccugaucaaggcuuggauugagaacaaggugaaaccggaccccagacuccuguaucuugccugucauaauaucauuaagaaacgggggcacuuccuguuugagggagauuucgacagcgaaaaccaguuugauaccuccauccaagcccucuucgaguaccugcgcgaagacauggaggucgacauugaugccgacucucagaaggugaaagaaauccuuaaggauagcucccugaaaaauucugagaaacagagcagacucaacaagauucugggccugaaaccuuccgacaagcagaaaaaggcuaucacgaaucucaucagcggcaacaagauuaauuuugccgaucuguaugacaaccccgaucuuaaagacgcugagaaaaauucuaucuccuucagcaaagaugacuucgaugcccugucugacgaccucgcguccauucugggggauagcuuugaacuucugcucaaggccaaagcuguuuacaacugcucugugcuguccaaggucaucggagacgagcaauaccugagcuucgccaaggugaaaauuuaugaaaagcauaaaaccgaucucacaaagcugaaagcuguuaucaagaagcacuuuccuaauaacuacaaaaagguguucggcuauaaccaggacaaugaguccaaaaacaauuacucuggguaugucggaguguguaagaccaaaaacaagaaacuugugaucaauaacagcgucaaucaggaagauuuuuacaaguuccugaagcccauucucuccgccaaaagcgagaucaaggagguuaacgacauucuggccgaaaucgagacaggcaauuuucuuccuaaacagauuucuaaguccaacgcugaaaucccguaucaacugcggaaaauggagcucgaaaagauccugagcaaugcggagaagcacuucucuuuucugaaacagaaggaugagaaagggcucagccauuccgaaaagauuaucaugcugcuuaccuucaaaauucccuacuacaucggaccuauuaacgacaaucacaagaagucuuuucccgaucgcugcuggguggugaaaaaggagaaaagcccuuccggcaagacgacacccuggaacuucuuugaccauaucgauaaagaaaagaccgccgaggaguucauuacaagcagaaccaauuucuguaccuaucugaucggcgaaucuguccucccgaagaacucccugcuguacagcgaguauacagugcuuaacgaaaucaauaaccuccagauuaucauugacgggaaaaauaucugcgauacgaagcugaaacaaaagauuuacgaggaccuguuuaaaaaguauaaaaagaucacccagaagcagaucucuacauucauuaaacacgaaggaaucuguaacaagaccgacgagguuauuauccucggcauugauaaagagugcacauccagccugaaguccuacaucgaacuuaaaaauaucuuugggaaacagguggacgagauuucuaccaagaacaugcuggaagagaucauucggugggcuacgaucuaugaugaaggagagggcaaaacaauucucaagaccaaaaucaaggccgaguacgggaaauacuguagcgacgaacaaaucaagaagauucugaaucugaaauucuccggauggggcagacuuucucgcaaguuucucgagaccgucacaagcgaaaugccuggcuucuccgagcccgugaacaucauuaccgccaugcgggaaacacagaauaaccugauggagcugcucagcucugaguuuaaauucacggaaaauaucaagaaaauuaacuccggguuugaggaugcugaaaagcaguucagcuaugacggacugguuaagccucuuuuucugucucccuccgugaaaaagaugcucuggcagacccugaaacuggucaaggagaucagccacauuacacaagcgcccccuaaaaagaucuucaucgagauggcgaagggcgcugaacuugagccggccagaaccaaaacacgccucaagauucugcaggaucuguacucuagcugcaaaaaugacgccgaugcuuuuuccagcgaaauccaguaucucucugggaagauugagaacgaagacaaucugcggcuuagauccgauaaacuguaccucuauuacacccagcugggaaaguguauguauugcggcaaacccaucgagauugggcauguguucgacacgagcaacuacgauaucgaccacaucuacccucaauccaagauuaaggacgauucuaucagcaaccgcguccuggugugcuccucuuguaauaaaaacaaggaggacaaauauccccuuaagagcgaaauucaguccaaacagcggggcuucuggaauuuucuccagagaaacaauuucaucucucuggagaagcugaaccgccucacccggacaaccccuauuagcgaugacgaaacagccaaguuuaucgcuagacaacugguugagacccgccaggccacgaaaguggcggccaagguccuugaaaagauguuccccgagacaaagaucguguacuccaaagcugagaccguuagcauguuucggaauaaguucgauauuaucaagugcagagaaauuaacgacuuucaucacgcccaugaugcuuaucugaauaucguggucggaaacguguacaauacaaaauucaccaacaauccguggaacuuuauuaaggagaaacgggacaauccuaagaucgccgauaccuauaacuacuauaaaguguucgacuacgauguuaagcgcaacaauauuacagcgugggaaaagggcaaaacgaucaucaccgucaaggacaugcucaaaagaaacacacccauuuacacccggcaggccgcuuguaagaaaggggagcuguuuaaucaaacaaucaugaagaaaggacugggccagcacccucuuaagaaggaagggcccuucucuaacauuuccaaauauggaggcuacaauaaggugagcgccgcuuauuacacccugaucgaguaugaggaaaaagugaacaagauuagaucucucgagacgaucccucuguaccucgucaaagacauccagaaggaucaggacgugcugaaguccuaucuuacagaucugcucgggaaaaaggaaauuaaaauccugguucccaagauuaaaaucaauagccugcuuaagauuaacggcuucccgugccacaucaccggaaagaccggcgacucuuuugugcugcgcccugccguccaauucuguugcuccaaugaugaggugcucuacuuuaaaaagaucauucgguucaacgagaucagaagccagcgcgaaaagauggggaagacaauuucccccuacgaggaccugagcuuuagaucuuauaucaaagaaaaucucuguaagaagaccaaagccgaugagauuggagaaaaggaguucuacgaccugcuucagaaaaagaaccuggagaucuaugauaugcuccugacaaaacauaaggacacgauuuacaauaaacggcccaacagcaccacacugggcaugcuuaccaaggggcgcuaugaauuuaucaaucugaagccuaaagaucagaucauuguuaugcucgagauccugaaacucuucugcacaaccagagaagcuauugaccugggacuuaucaagggcaagccggcggccgggguggcuacgcugggcaaaaagauuuccaaccuggauaauuguauccucaucuaccaaucuauuaccggaaucuuugagaagcggauugaccugcuuaaagucuga

SEQ ID NO: 4434 - RNA, 4188 nt, Artificial Sequence
  Cas9 variant
augaagaaagagaucaaggacuacuuccugggccucgauguggggaccggaagcgucggcugggccguuacagacacggauuauaaacugcuuaaggcuaacagaaaagaccugugggggaugcggugcuuugaaaccgccgagacagcggaagugcgcagacuccaccggggagcucgcagacggauugagcgcagaaagaagcggaucaaacugcuucaggaacuguucucccaagagauugccaagaucgaugagggcuuuuuccagcgcaugaaagaaucuccccucuacgccgaggacaagaccauucugcaggaaaauacacuguuuaacgauaaagacuucaccgauaagacauaucauaaggcuuacccuaccaucaaucaccucaucaaagccuggauugagaacaaggugaaaccggaccccagacugcuuuaucuggcuugucauaauaucauuaagaaacgggggcacuuucucuucgagggagauuuugacagcgaaaaccaguucgauacguccauccaagcccuguuugaguaccuucgcgaagacauggaggucgacauugaugcggacucucagaaggugaaagaaauccugaaggauagcucccucaaaaauucugagaaacagagcagacugaacaagaugcugggccucaaaccuuccgacaagcagaaaaaggccauuaccaaucugaucagcggcaacaagaucaauuucgcugaucuuuaugacaaccccgaucugaaagacgccgagaaaaauucuauuuccuuuagcaaagaugacuucgaugcucucucugacgaccuggccuccauccuuggggauagcuucgaacugcuccugaaggcgaaagccguuuacaacugcucugugcuguccaaggucauuggagacgagcaauaccucagcuuugcuaaggugaaaaucuaugaaaagcauaaaacagaucugaccaaacuuaaaaauguuauuaagaagcacuucccuaaagacuacaagaaaguguuuggcuauaacaagaacgagaaaaauaacaauaacuacuccggguaugucggaguguguaagacaaaaucuaagaagcugaucaucaauaacagcgugaaucaggaagauuucuacaaauuucucaagaccauucuguccgccaaaagcgagaucaaggaggucaacgacauucuuacggaaaucgagacaggcaccuuccugcccaaacagauuucuaaguccaaugcugaaaucccuuaucagcuccggaagauggagcuggaaaagauccugagcaacgccgagaagcacuuuucuuuccucaaacaaaaggaugagaaagggcugagccauuccgaaaagauuaucaugcuucugacauuuaagauuccguacuacaucggacccauuaaugacaaccacaaaaagucuuucccugaucgcugcuggguugugaaaaaggagaaaagccccuccggcaagaccaccccuuggaacuuuuucgaccauaucgauaaggaaaagacagccgaggaguuuauuacgagcagaaccaauuucuguacauaucucaucggcgaaucugugcugcccaaaaauucccugcuuuacagcgaguauaccguccucaacgaaaucaacaaucugcagauuaucauugacgggaaaaacaucugcgauacaaagcugaaacagaagauuuacgaggaacucuucaaaaaguauaagaaaaucacccaaaagcagaucucuacguuuauuaaacacgagggaaucuguaauaagacagacgaggugauuauccugggcauugacaaagaaugcaccuccagccuuaaguccuacaucgagcugaagaacaucuucgggaaacagguugaugaaauuucuaccaagaauaugcucgaggaaaucauucggugggcuacaaucuaugacgagggagagggcaaaaccauucugaagacaaaaaucaaggcggaauacgggaaguacuguagcgaugagcagaucaaaaagauucugaaccuuaaauuuuccggauggggcagacucucucgcaaguuccuggaaacggugaccagcgagaugccgggcuuuuccgaaccugucaauaucauuacagccaugcgggagacccaaaacaaucugauggagcuccugagcucugaguucaaauuuacagaaaacaucaagaagauuaauuccggguucgaagacguggagaaacaguuuagcuaugauggacuuguuaagccccuguuccucucuccuuccgugaaaaagaugcuguggcagacccugaaacuugucaaggagaucagccacauuacgcaggcuccucccaagaaaaucuuuaucgaaauggccaagggcgccgagcucgaccccgugagaaccaaaacacgccugaagauucugcaagaucucuacaacaauugcaaaaacgacgcugaugccuucucuagcgaaaucaaggaccuguccgggaaaauugagaaugaagauaaccuucggcugagaagcgacaagcucuaucuguacuauacccagcugggaaaguguauguacugcggcaaaccgaucgagauugggcaugucuuugauacaucuaacuaugacaucgaccacaucuacccccaguccaagauuaaagaugacagcaucuccaaucgcgugcuuguuugcucuagcuguaacaagaauaaagaggauaaguacccucucaaggcggaaauucaguccaaacaacggggcuucuggaacuuccugcagagaaauaacuuuaucucucuggagaaguucaaucgccucacccgggcuacgcccauuagcgacgaugaaacagccaaauuuaucgccagacagcugguggagacccgccaggcuacaaaggucgccgcucgggugcuugaaaagauguucccugagaccaagaucguuuauuccaaggccgagaccgugucuauguuuagaaacaaauucgacauugucaagugccgggaaaucaaugauuuucaucacgcgcaugacgccuaccugaacauuguggugggaaauguuuauaacacaaaauucacgaauaaccucuggaauuuuaucaaggagaaacgcgauaaccccaagauugcugacaccuacaacuauuacaaggucuucgauuaugacgugaaaagaaauaacaucacagccugggaaaagggcaaaaccauuaucacagugaaggacaugcugaaacggaauaccccgaucuacacgagacaagcugccuguaagaaagggggacuguuugaucagacaauuaugaagaagggccuugggcagcacccucugaaaaaggagggacccuucagcaacaucuccaaauacggcggguauaauaaggucagcgcggccuacuauacccucauugaauacgaggagaaaggcaacaagauccgcucucuggaaaccauuccucucuaucuggugaaggacauccaaaaagaucaggacguucuuaaguccuaccugacagaucuccugggaaagaaggaguucaaaauccuggugcccaagauuaagaucaauagccuucugaaaauuaacggcuuuccuugccacaucaccgggaagacaaaugacucuuuccuccugcggcccgcuguccaguuuuguugcuccaacgaugaagugcucuauuucaaaaagauuaucagauuuagcgagauccgcucucagagagagaaaauuggaaagacgaucuccccguacgaagaccugagcuuccgguccuacauuaaggagaaucuuuguaaaaagaccaaaaacgaugaaaucggcgagaaggaauuuuaugaccugcuccagaaaaagaaucuggagauuuacgauaugcugcuuacaaaacauaaggacaccaucuauaagaaacgcccuaacagcgccacaauugauauccugguuaaggggaaagagaaguucaaaucucucaucauugaaaaucaauuugaggugauccuggaaauucucaagcuguucagcgcuaccagaaacgucuccgaccuucagcacaucggaggcucuaaguacagcgggguggccaaaauuggcaauaagaucuccucucuggacaacugcauccugauuuaucagagcaucacgggaauuuuugagaaacggaucgaucuccugaagguuuga

SEQ ID NO: 4435 - RNA, 4191 nt, Artificial Sequence
  Cas9 variant
auggacagcuccaagcagggccugagacgguaccaccucgggcuggauaucggaaccaacucuauuggcuggacagccaucgacgaucauuucagccuucugcgcgugaaagggaagaaugcuauuggagucagaacguuuaaagagggcgaaaccgccgcggaccggcgcggguucagaacagcucggcgcagacucucccggcgcagauggcggcugcaauuucuugaugaguucuuugcccccuaucuggccgaaguugacccuaacuuccucgcucgccugaagcagucugauaucagcgccaaagacccggcuaagaaucaggaguacaugggaaagcugcucuuucccgaucaggaagccgcguccgacggcaacggcuauccuacccugauucaaaugagaaaagccaugcccgcugagaaggccgcugauuucccuguguuuaauaucuaccagcuucgguaugcccugaugaacgagaaacgcaaguucgaccucagagaaaucuaccuggcggugcaccauauugucaaauaucgggggaauuuucuuaacaauacaucuguggauaaguucaaggccgaccagaucgacuuuaacaagagcuucgagacccugaaugaucucuucagacagguucaacccauugcuccuuuucagaucgaccugacaaagguggaugaacugggaaaacuccugcuugacaccaagcagaaaaagcuggaucgccagaaagccgucgcuaagcuccugccgcuuauugaggacggcacggauaaggagaucgugaaagcccaccaacagaccgcccgggaaauuuccaagcugauccucggguacaaagcuaagguuggacugauccugcagaacaaucucgaccaaacacuggauaugagcaccgagaacucugacgaucagcuuaugcagauugcggaagaacuggacgacuaccagauggaacucaucaaucaacugucccuucuguauagccagauuaugcucaacgagaucgugcccaacggcgagacagucucugccuccaugcugaauagauacuauaaacaucgcugccagcugaaggaacucaaggauuacggggcugcccaggacaaaaagacccgggagcaacuggaucaccuuuaugccgaauacauuggacagaucccuaaagacagcaaguucgauuuuacgaaagaccugaagaagcucauggauaaaucugaccugggccagaagaucaaagaugagauugaagcuggcgacuaucugcccaagcagagaacauccgccaacggggugaucccucaccaaaugcaucagcaggagcuugaucagauuaucgagaaucaaaaagaauacuaccccuggcucgcggagccgaacccuguggaaaagaauauuaagaacgcuaaauauaagcuggaccagcuggucagcuuccgcguucccuacuaugugggaccuaugaucacccucgccgaucagcagaaaacauccaaggccucuuuugcuugggccgugcggaaaaaggcuggcaaaaucacccccuggaauuucuacgacaugauugacagagaaaagagcgccaacaauuuuaucaagcgcaugaccaacaaagauacauaucugcuuuccgaagacguccugcccgcgagcucucuccuguaccaaaaguucacggugcugaaugagcuuaacaauauucggguuaacgggagaaaacuccagccugcccugaagcaggcuaucuauaccgaucuguuucaaaaacgcaagacagugaaucucaagacccugacaaacuuccuugccauucacgagccgacccugacgaaacccaagaucgaaggacucuccaacggccggagcuuuaauucuagccuggggacauacauugacauguccaaaauccugggagauucucuugacgaucucaacuacagagacgauaucgagaagauuaucgaauggagcaccgucuucgaggacuccgagauuuauggcgugaaacugcaggaaauccaguggcugaccaaugagcagcgggaaaagcucguucgcaagagauaccaaggcugggggcggcugagcaaaaagcugcuuacaggaauuaccgaugagaacggccagagaaucaucgaccucaugugggauacaucuaaaaauuuuaugcagauugugcaucagccugucuucgaggagcaaaucgcugagcugaaccagcagcugcuucaagacgccgacaaggcgccccucgaaguggucgaugacauucuggccgaugcuuauacguccccucagaauaaaaaggccauccgccaggugguuaagguggucgcugacgugguuaaagccguggggaacgcccccgcuagcauuucuaucgaguucgcgcggaaugaagauagaaacaaggagcugaaaaauucccgcagacacagcaucgaaaagcucuaccacgagaccgccgagaaacuggucaagcagacaaaccuucuggaggagcucggaaaugugaaagaccugaacgaucgguauuaccuguauuuuacccaagcuggccgcgacauguacgaugggacaccgauuaauaucgacgaaauuuccacccauuacgagaucgaucacauucuuccucagucuuuccugaaggacaacagccucgacaacagagugcugguuaagaaauccgaaaaugccgccaagucugaucggguccccgcuaaacucuauggcgccaagaugcgcgcguuuuggaaacagcugaaggagagccagcuuaucuccaacagaaaguaccugaaucucacgaccgacccugagcaaguggauaaauaucagaugcagggauucgugcaucggcagcuggucgaaacacgccaaaucauuaagcuggcugccaacaucuuuggcagccuuuaccccgacucugccgugauugagaccagagcugaacugacaaaacagcuccgggagaaguucucccuguauaaaguucgcgaugugaaugacuaccaccaugccgucgaugcguaucucaccgcuuuugccgggcacuaccuguaccagagauauccuaaacuucggcccauguucguguacggagacuaugccaagaucuacgcugaugaccugaaaagacuccgcagcguuaaccuguuucacgaucuggagaaggaccaguauaauucuggcacggccgugaacccggaaacaaaagagaagauugucgauguggacuggcuuuccgacuacguuagcaaaauccaacauuucaaguauaugcugauuucuaaggcuguguacacccagcacgggcagcucuacggagccacaauccugccugucgcgcaaguggauaaaaucagcgcccccauuggcaucaaggacgauaaacccguggacauuuauggggcuuacaccaaugaagucgccgcuuauauggccaucguucgggugaacggcaagaaaccuaaguacaagguggucuccgugccgguuagaaugcuccagcgccugaaaauggccgagcagaagggacaugaucaguauaugcaaacccuucacgacgugcugcugcggaauuuuacaagccucaaaaagaacagaaaaacgggccugaaggaagcugucgugaaagauuucgacguucuugugcccuguguccgcuacaaucagcuggugauugauggggacaccaaguuuacacucggaucugcgaccuaucagcacaacgccaagcagcugguucucugcaaucauucccuggagacacuugcuaacaacuucgaguacgugcggaaacacccugaugaagccgacgagagaaugaucaugcuguacgaugacauccuggaccaagucaaucauuauuucacccucuacgauaagaacaaauuucgcgaaaagcugaaugccggccgggacaaauaucuuaagcugcccacguucagccaguuugagaacaauaagaaaacagcuauugggaaguccgaagccaucauuaacauccucagaggacugcacgcgaaugcugccauuaccaaccucaaaugucugggcgugucuaccccuuucgggcagcuucagagccccuccggcaucgagcugucugagaaugccaagcugguguaccaaagcccuacaggacucuuuucccgggaaguccugcuuaaagaucuguga

SEQ ID NO: 4436 - RNA, 4191 nt, Artificial Sequence
  Cas9 variant
auggccaaccugagaaauuacaagggcgacuauaacaucgggcucgauaugggaaccggcagcguggggugggcugucacagacuccgagggaaaacugcuucacuucaagaaacagcccacguggggcucucggcuguuugauagcgccgaaaccgcggcuuccgcccgcauuccuagagggcaacggcgcagauacguucggcgcagauggcggcucgaccugcuucagcagcuguuccaggaugaggugucuaaggccgacccggaauuuuucauccgccucagacaaagccggcugcugaaagaggaucgcgaagagggacauagagacuauaaucacccccucuuuaacgauuccgacuucacagagaccgauuacuauaaucgguuuccuacaauuuaccaucugcgcaaguggcuuauggaaaccgacgagaaggcugauaucagacugguguaucucgccgcucacaacauugucaaacaucggggcaauuuccugagacaggaaaacacaucucuuagcgccaagaaugcgcgcccccuggacgcccuccgggaguuuagauccgcucugguggacuggugcgccgagcugggcuacgaauguaacccugaugagagcggggaaaucucuaaugagauccucuccguucuggaagaggagcacguggcuaacagcgacaaaaagaaacgcauuucuucccuuaucggagucgccaugaaugaaggcgcgaaggagagcaaggccugcaacgaugcucuggccggggcuauggugggacucaaagccgaauuuaagaauguuuuuggcgagauuucugccgaacagaccuccaucuaccugagcaacgacgaggcuguggaugcgcuucgggaggggauucccgacgaaggacuggaacucuucggcaaacuguguuccgucuauucugccuacgugcugcagggccuccugagcuaugcuccugggcaaacgaucuccgugaacauggucgccaaguacgaaaaauauggaaaugaucuuaagacccugaaagcccucguuugcgaguacgcuagagccgaauaugacagcuuuuuccgcggcgaguucuaccgggaucaggacgggcacgagcugaacauuuacaaugcgucuaaggcucagggauauacaagauacaaccuuggcaccuccaagaugagcuaugaagauuuugagaaagccgugaagaaacuguucgccgggacagcugccgaagaggacggacgcuaccuccagaugaugaaggaguuuggcgaacaacgguuccugagacgccugaaaaccucugacaauggcagcaucuauuaccagcuccaucuggaggaacuuacggcuauccuguccaaccaggggaagcacuauccguuucucguggaggaugccgaaaagauuaaaucucuggucagcuuccggauccccuacuacgugggaccucugacagacagaaaugcgcggaaggauaaacauggcaagaaccgcuuugccugguccgagagaaaaagcgggauggaggacgcuguuauuacccccuggaauugggaugaagugaucgaccggggaaagucugccgaggcuuucauuacaagaaugaccggcauguguaccuaucuucaaggggaagauguccucccuaagugcucccugcuguacgaggaauuuugugugcucaacgagcugaauggcagccgcuggggaauggacggcgauaaagagcaccgguucgacgccgcggauagagaagccaucaucgaggaacuuuuuaagaaaaagaaaacaguuaaguauaaggacguggcuaacuggcuggagcgcgaagccgggagaaugaauguccacgugaugggaggccagggggagacgggauacgagucuaaacucuccagcuauuacuucuuucggcgcgauauuuucgacgucgaggagcuggacagagcugauuaucccaugaucgaacagauuauccuguggaacacccuuuucgaggaccggcgcauucucaaggagaaacuggaagaugccuacggcccgaaggggaauggcagacuggacgaugaccagaucaaaaagaucugccggaaacgcuuuacaggauggggcagacucuccaagaaguuccugaccgggauuaaaguggauacagacuguggaccucggucuaucauggauguucuucgcgagggcgaccccaacgccggguuuagaggaaagaccauggugaugauggaaguccugcgggaugagaaccucggcuuccaacagaaaguggacgaauuuaauaagaacuacuucgggcagaaaggcaaggcucuggagguuaaugagcugccuggaagccccgcgauuagacgcucccuuaaccaggccauccggauuguggaugaaaucgcuaagauugccggcaaagaccccgagucuaucuuuaucgaagucacgagagacgaugagcucgacaagcgcgggaaacggacaaagagacgcuaugaugcccugaaagaagcucugaccguguucaagaaggaggacccugagauuugggccgaacuccaagcgaccagcccguccgaucuggacgagcggcuuacacuguacuuuaugcagagaggaaaaugccucuauagcggcgaacccaucgauauuaauaagcugucuuccggggaguacgaaguggaccauaucauuccucgcagcuauaucaaagaugacucucuggagaacaaggcucuuguuugucggaaauacaaucaguccaagaccgaugccaugcuccuggaccccagcaucagacggaagaugcgcucuuauugggacaugcugcucgaugccaaacugauuggaccuaagaaacacagaaaccuucugcgggaccauaucgaugagaaggcuaugaaaggcuucgucgcccgccagcucguggaaacaagccaauccgugaagcuggcggggagccugcuuucugucagauaccccaaugcuaacauugugccgguuaaagccuccaugagccacgaccugcgggaggccgcuggcuuugugaagugcagagaagccaaugauuuccaucacgcucacgacgccuaccucgcgugccgcaugggacuguuuauccagaugcggcauccuaaggucuaugagaaccccauugccaugacgagagugaugcagaaauacgcucagcaacaguccaaggaguucaaucgcaaccaccggguuccuggcaccucuggguucaucgugaauagcuuuauguccucuggauucgauaaagaaacaggcgagaucuuuaaggacaccuggaacgccgaaacagagauugaagggaucagaaaagcucucaacuaucgccaguguuacauuagccggaugcccauggaggauaccggagccuucuggaaugccacggucuauuccccuagagaccccaagaugggcccgaagcuggcgcuuccucugaaaaagggccucgaucccaaaaaguacgggggauuuucuagccaacaguucgcuuauuucuucguguacgaggcccgcgacaaaaaggauaagcagguuuuuagauucgcugaagugcccgucuggcuggccucccagaucgagagcgacaaaauugcccuggaacgguacgcuaccggccuugccgaggcggaaaagcugaaauuugugcgcaucgagagagcuaagauccucaaaaagcaacugauugagaucgacggggaucgguucauucucacaggaaagaaagaaaugcgcaacggcagagagcuggcccuuucucagaaggaaacccugaaucucaucguggccggggacgagaacgcuucccuggaugaccggggaaaugccagcgaugcggucuucgacgcuauuguuagacagggcgaugaaaucggccugcgccuuuauaaacagcugaagauugccgagaucgccgagcgguacagaucugugggggcugacgccaaagugggagcugucaugucccuccugagcucuaucaacgccuccagcaauauggugaaccucuccaugguuggcgggagcaaguaugcgggaaaucugcaaccuaacuacucuaaucuucugagcgauccggaaacaaacuuugugauuaucgaccaguccgucaccggcauguucgagcgccggacgagaauugggcuguga

SEQ ID NO: 4437 - RNA, 4191 nt, Artificial Sequence
  Cas9 variant
augaccaagcccuacagcaucggccuggacauugggacaaacuccgugggaugggccgucaucacggaugacuauaaaguuccugcuaagaaaaugaaggugcucggcaauaccaacagagauuacauuaaaaagaaucugcuuggggcccuccuguucgacggaggcgagacagcggaagggcggcgccugaagagaaccgcucggcgcagauauacacggcgcaaaaacagacuucgguaccugcaggagaucuuugccgaagagaugaugcaaguggaugaaucuuucuuucagcgccucgacgauagcuuccuggucgaggaggacaagcagggauccaaauauccgauuuuuggcacccugaaggaagagaaagaauaccacaagaaguucaaaacaaucuaucaucucagagaggagcuggccaauucuaaggaaaaagcugaucuucggcugguguaccucgcccuggcucacaugaucaaguuucgcggccauuuccuuuacgagggggaccugaaagccgaaaacaccgauguucaggcgcucuuuaaggacuucguggaggaauaugauaaaacgauugaggagagccaccuguccgaaaucaccgucgacgcccugucuauucucacagagaaggugagcaaguccagcagacuggaaaaucuuaucgcucauuaccccaccgagaaaaagaacacacuguuuggaaaucucauugcccugucucuuggccugcaagcuaacuucaaaaccaauuuucagcucuccgaagacgccaagcugcaguucagcaaagauacguaugaggaggaccuggaagggcuccugggagagguuggcgaugaauacgcggaccuuuucgugucugccaagaaccuguaugaugcuauccuccuguccgggauucuuacagucgacgauaauagcaccaaggccccucugucugcuuccauggugaaacgguacaaggagcacaaagaagaacucgccgccuuuaagcgcuucaucaaagagaagcugcccaagaaauaugaagagaucuuuaaggacgauacaaagaacggauacgcuggcuacgugggcgcggacaagaaacugagaaagcggagcgggaagcucgccaccgaagaggaguucuauaaauacgucaagggcauucugaauaaaguugaaggagcugauuauuuucuugacaagaucgacagagaggauuuccugcgcaaacagcggaccuuugacaacggguccauuccucaccaaauccaucuccaggaaaugcacgccauucugagacgccagggagagcauuaccccuuccugaaggaaaaccaggauaaaaucgagaagauccuuacauuucggauuccuuauuacgugggcccgcucgccagaaaggggucucgcuucgcuugggccgaguauaaagcggacgaaaagaucacgcccuggaauuuugaugacauucuggauaaagaaaagagcgcugaaaaauucaucacccggaugacacugaacgaccucuaccugccugaggaaaaggugcuucccaagcacuccccucuguacgagaccuuuacagucuauaaugagcucaccaaagugaaguacguuaacgaacaaggagaggccaaauucuucgauacgaauaugaagcaggaaauuuuugaccacguguucaaagagaacagaaaggucacaaaggauaaacugcugaauuaucuuaacaaggaauuugaggaguuccgcaucgugaaucucaccggccuggacaaagaaaacaaggccuuuaaugcuagccugggcaccuaccaugaucuccggaaaauccuggacaagucuuuccuugacgauaagguuaacgagaaaauuaucgaagacauuauccagacacugacccucuuugaggauagagagaugauucgccaacggcugcagaaguauuccgacaucuucacaacgcagcagcugaaagaacuugagagacggcacuacaccggguggggacgccucagcuauaagcugauuaauggcaucagaaacaaagaaaauaagaaaacaauccuggauuaccucauugacgauggguacgccaaccggaacuuuaugcaacugaucaaugacgaugcucuuucuuucaaggaggaaauugccagagcgcagaucauuggagacguggaugacaucgccaacgucgugcaugaucugcccggcagcccggcuaucaagaaagggauucuccaguccgucaagaucguggacgagcugguuaaagugaugggccacaauccuaccaacauuaucauugagauggcccgcgaaaaucagacaaccgacaagggacggagaaacucucaacagcgccugaaacuucuccaggauagccugaagaaucuggacaaccccgucaauaucaagaacguggagaaucagcaacuccagaacgauagacuguuucuuuauuacauccagaauggcaaagacauguauacgggggaaacccuggauauuaacaaucucucccaguacgacaucgaucauauuaucccucaggcuuucauuaaggacaacagccuggauaaccggguucugacacgcucugacaaaaauagaggaaaguccgaugacgugcccagcaucgaggucgugcacgaaaugaaaucuuuuugguccaaacuucugagcgugaagcucaucacccaacggaaauucgacaaccugacaaaggccgagcgcggcgggcucaccgagaaugauaaagcgggauucauuaagagacagcugguugaaacgcggcaaaucacaaaacacgucgcccaggugcuugacgcucgcuuuaacgccaagcaugaugagaauaagaaagugauuagagacgucaagaucauuacccugaaauccaaccucgugucucaguuccggaaggauuuuaaauucuauaagguucgcgaaaucaaugacuaccaccaugcucacgaugccuaucugaacgccgugauuggcacagcucugcuuaagaaauaccccaagcuggcgagcgaguuugucuacggggaguucaaaaaguaugacgugagaaaauuuaucgccaaguccgauaaagagaucggcaaggcuaccgccaaguacuucuuuuauucuaaucucaugaacuucuuuaaaaaggagguuaaauucgccgacggaaccguggucgaacggccugauauugagacaagcgaagacggcgagaucgcuuggaauaagcagacggauuucaaaauugugagaaagguucuguccuacccgcaagugaacaucgucaagaaaaccgaggugcagacacacgggcucgaccgcggaaagccccggggccuguuuaaugccaacccuagccccaaaccuaagcccgacucuuccgaaaaucuuguggggauuaaaagaaaccuggauccgaagaaguauggaggcuacgcggggaucagcaacucuuaugcuguccucguuaaagccaucauugagaagggcgugaaaaagaaagaaaccauggugcuggaguuccagggaaucuccauucuggaccgcaucacauuugaaaaggauaagcgggccuuccuucugggcaaaggguacaaggacauuaaaaagaucaucgagcucccuaaauacagccuguuugagcucaaggauggaucuagacgcaugcuggcuagcauucuuuccaccaauaacaaacggggcgaaauccauaaggggaaugagcuguucgucccccagaaguuuacgacacugcucuaucacgccaaaagaauuaacaauccuaucaacaaggaccauauugaauacgugaaaaagcaccgcgaugacuucaaagagcugcuuaauuauguucuggaauuuaacgagaaguacgugggagcgaccaagaauggcgagcggcucaaagaagcugucgccgauuucgacagcaagucuaacgaggaaaucugcaccuccuuucugggggccgugaauagcaaaaacgcuggccucuucgagcugacaucccuuggaucugccagcgauuuugaguuccugggcguuaagauucccagauaucgggacuacaccccuuccucucugcucaaagauagcauccugauccaucaauccauuacagggcuuuaugagacgcgcaucgaccugucuaagcucggagaggacuga

SEQ ID NO: 4438 - RNA, 4191 nt, Artificial Sequence
  Cas9 variant
augaagagagugaacgaggacuacauccugggccucgauauugggaccaauagcugcggaugggccgucacagacaaaaagaacaaucugcuuaaacugcggggcaagacggcuaucgggucccaccucuucgaagagggacauaccgccgcggaucgcagaggcuuucggacaacccgcagacggcugaaacgcagaaaguggcggcuucgccugcucgaagagauuuucgcugaacccauggccaagguugacccuggguuuuucgugagacugcaccagucuugggugagcccgcuggauaaagaccggaagaaauauaacgccaucgucuuucccacagcuaaggaggaucaagccuucuacaaacauuaugcuaccauuuaccaccuccgcgacgagcugaugacacaggauagacaguuugaccuucgggaaaucuuccuggccauccaucacauugugaaguaucgcggaaauuuucuccaggauaccccuguuaaggacuucgaggcguccaaaaucgaagugggccccauucugucucacaucaacaaugccuuugcugagaagauugucgaggaucaagacccuaucgaacuuaacguggccaaugcugccgacauugaggauguuaucagaggcaaagacgcggaaaagacgguguacaaacuggauaaggucaaaaagaucgccaagcuccugaccgacagcacagcuaaagaggaaaagaacguggccaaacagauugcuaaugccaucaugggguauaagacccaguucgagacaauucuggauaaagagaucgacaaguccgauaaggcccagugggaauuuaaacucucugacgcugaugcggacgauaagcuggacgcccuucugcccgaccucgaugagaccgaccaaacgguggucgcugaaauugagaaacuguucagcgccaucacacuuuccaccaucguugaugaaaacaagagccugucucaguccaugguggagaaauacaagaagcauaaaaaggacuacaaaaagcucaaaaaguauauuaauacacugcaggaucagaccaaggccaaaaagcugcuccuggcuuacgaccuuuaugugaacaaucggcacggaagacugcucgaggccaaaaagaccuucgaagauaaaaagaaaaagaaggcgcugacaaaagacgaguuuuacaagaucgucaaagauaaccuugacgauagcgaccuggcucaugaaauucaacaggagaucgccgccgauaacuucaugccuaagcagcgcacgaauagcaacggcgugauuccguuucaacuccaccagaucgaacuggacaaaaucauugcuaaucaggggaaguauuaccccuuccuggccgcugagaacccuguugaggaccaccggaagcaggcccccuauaaacucgaugaacuggugagauuucgcgucccuuacuacgugggacccaugaucaccgcggacgagcaagaaaagacauccggcaaaucuuucgccuggaugguucggaaggaggaugggcagauuaccccguggaauuuugagcagaaaguggacagacaggaaucugcuaacaaguucaucaagcgcaugacaauuaaagauaccuaucuucuguccgaggacguccucccugccaauagccugcuguaccaacgguuugaagugcuuaacgagcucaauaacaucagaauuaauggaucccgcaucucugucgaucugaagcagcagaucuucaacgaccuguuugaagagaaaaagacggugacagagaaaagccucaccuccuaucugaagcagaaucuucaucugcccaccguugaaauuaagggccucgcugauccuacaaaauucaacagcucucuggccuccuacuaucaccuuaagagccugcauguguuugacaaagagcucgcggauccccaauaccagaaggacuucgaaaagaucauugaguauucuagcaucuucgaagauaagaaaauuuuucaggacaagcugcacgccgaguucaaguggcugacccccgagcaguuuaaagcuaucuccacauggcggcuccaaggcugggggagacugucucgcaaacuucuggucgaacuccaugacacgaauggacagaacaucauggagcagcugugggauagccagaaaaacuucaugcaaauugugaccgaaccugacuuuaaggaugccaucgcuaaagagaaucagaacguuacacgggccaauggcguggaagagauucuggccgacgcuuacaccuccccggcgaacaagaaggccaucagacaggucgugaaagugguugcugaugucgugaaggccgccgggggcaaaaagcccgcucaauucgccauugaguuuacacgggacccugauaaaaauccccagcuuagccacauccgcggaaccaagcuccugaaggcguaccaggaaacggcuggggagcugguggaccagaaacucaccgauucucugaaggaagccaugacauccagaaaacuucugaaggacaaauauuuccucuacuuuaugcaagccggacgggaugcuuauaccggccagaagaucaacauugacgaggucagcacaaauuaccagaucgaccacauucugccucagucuuucaucaaggaugacuccuuugauaacagagugcugaccgccacgccccuuaaugcggagaaaagcgacgauguuccguauaagcgcuucgcuaacaauuacguguccgacaugaaaaugacagucggcgaaauguggaagcauuggcaaaaagccgggauuaucaacaagcacaagcucggaaaucugcugcucgauccugaccggcugaacaaauuucagaagucuggcuucaucaauagacagcuuguggagaccagccaaauuaucaaacugguuuccgugauucuccagaacaaguaucccgaugccgaaaucauuacagucaaagcuggggacaacucugcccugcgccagagacugaaucuuuacaagagccgggaugugaacgacuaccaucacgcuaucgaugccuaucuguccauuaucuguggaaauuuccucuaccagguuuauccuaaauaccgccccuauuuuguguacggcaaguauaagaaauucagccaagacccugaccugcagaaggaggucaucaaacacuuuaagggguucaccuuuauguggccccuccugcagaaagauaacucugaaagaaaggcgccggagaagauuaaagagaauaacuccgaccggaucguguucuacaagcauccugauauuuuugacaaacuucgcaaggccuacaauuauaaauacaugcuggugagcagagaaaccacaacggagaacucuggccucuucgaugucaccaucuauccccggggagaacgcgaccuggcuaagacaagaaagcugauucccaaauccaauggccuugauccuaagaucuacgggggauauagcggcaacaccgacgccuacaugguuaucgugaaaauugauaaggggaaagagucuaucuauaaggugauuggagucccgaugcgggcucuggccagccucaaucgcgccaagaaacagggcaacuacaaggaggaacugcaccaagugcucgagccccagaucauguuugacaaaaaugggaagccuaaaagauccguuaagggcuuccggauuaucaaagaucaugugcccuuuaagcaggucgugcuggacggagauaagaaauucaugcuuaacagcucuacauacgaaaucaaugcuaagcagcugacccucacgccugagacaaugagaauuguuaccgacaaccugaaaaagggcgaagaccaagaucagcugcuugugaaagcguaugacgagauccugcagaaggucgaucaguaccucccccuguucgacgugaacaaguuucgcaauucccuccaccuggggcgggccaaauuccuugaucuggcuguuaacgacaagaaaauuacccugacaaauauccucaacggacugcaugauaaucuugugaccccugaccugaagaacauuggcaucaaaacaccccucgggaagcugcaagucccgagcggaauugugcucuccucugaagccauccugaucuuucagagcccuacgggccuuuucgagaagagagugcgcauugccgaucuguga

SEQ ID NO: 4439 - RNA, 4194 nt, Artificial Sequence
  Cas9 variant
augaaggacuacaacaucggccuggauauugggaccagcuccaucggauucgccgcuauugacgaugacaauaaccucaucagagugaaaggcaagaaugucauugggucucggcuguuugccgagggaaaaacagcggcugaacgcagaggcuuccggacggcccgcagacgguauaaccgcagaaaguggcggcuuaaacugcucgaugagaucuuuuacgaagagaucauucacaucgaccccgaguucuuuaaucgccugaagcagagcuccauuucuccuaaggaugagagcaaaaaguauuucgggucccuucuguuuccggacaaaaccgauucugccuacuaucaugacggaaaccaaacaaucuaccaccucagaaaucggcugguucaucagaaggagaaagcugauauucgcgaaaucuaucuggcccucagacacauugugaaguaccggggcaacuuccuggacagcacccccguguccagcuuugaggcugauaaucuuaagcuggacgaacucgucccugugaucaacgacauguacgagaauaucgauauugacuucucuaucaacguugauaauauuuccgagaucgaaaaagugcugcuugacaaccaucucaagagcgccgauaaacaggaccgccugaaggagcugcuguaugauaaucccgaauacccugacgauaaagucaagcagaaagagauuucuaaguuuagaaaggaccucgauaaagaaaucaucaaggugauuguuggcuauaaauucaacgcguacaagaucgugaacuauauucccgacgacggguccaaauuuagcuucucuuucuccgaugagagcuccgacgauaagcuggacgaucuuucugagguccuggacgauagccaaauggaaauccucaauacacugaaggugauuuacucccgggugagacuuaaccagaucaucccuaauggaaugggccugagcgagucuauggucgccaaauauaaccgccaccacgaacagcucgaggaccugaaggaacugcucgauguucugccgaaugacgagaaacgguccauugaguacgcuuacaccgccuauaucgggaacguggauaagcagaaauacaauaacaaucuuguggcuagccugaaggaccuccccauuaagggagauaucaacaaaaagauucaagccgucuuugaauaugcgaaaggccauaucucuagccaggaccuguacgacgugauuaagacaaucaucauugauaaauaucuugaggacgaauccuucgaguaccacgaucugguugaaagaaucucuaaugacauugauaacaaggacuaucuccugaagcagcgcagcucccagaaugggaacaucccucaucaagugcaccagauggagauggauaaaauuaucgccaaucagagccaauacuaccccuuucugggaguccucaacccuaacgagucucggagacacaucgcuaaguauaaaauuuccgaacuggugagcuuccgcguucccuacuaugugggcccgcuuaucaccccugaggaacaggagaagacgucuggcaaacauuuugccuggaugaagcggaaagaggcugggaagauuacccccuggaauuucgaagagaaggucgacaaagaagccacagccgcuaaguuuaucaaaagacugaccgugaaggauacauaccuccugaacgaggacguccugccugauaauucccuucucuaucagcaguucaaagugcugaacgaacugaauauuguuaaggugaacaauaagcgccucacccugagcgagaaacaaggagucuacaacgaccuuuuuaagaauacgaaauccaucacagugaagcggcugaaaaacuaucucaucucuaauuacaagcaccuggagaacauugaaaucaccggccugagcgauggggacaaguucaauaacucccuuggaacauacaaugacuuuaaaaagauuuucggcgcgagaaucgaugacguuaacuauucugccgauuuugagaacauuaucgaauggagcaccguguucgaggaccgcuccauccucaaagaaaagcuggagaaagauauugacuggaucacccccgaggaaauuaaggcugucguggccaagcgguacagcggguggggaagacugucugccaaacuccugacagagcuucuggaugacgauggccagcggaucauugacauccucuggaaugauuccauuacguucauggaagcugugagcaagcccgagaucaaagcccagauccagaacauuaaucgcgacuuuaucaaggcgaccgacauugaaacaguucuggaugaggcuuauaccucuccucaaaacaaaaaggccaucagagaggucuacaaacuggugaaggacauucagaaggccaugggcgggaaagcuccguccagcaucucuaucgaauuuacacggagccccgaggauaauggauccgugaccaagacgagauauaacaauaugcagaacaaauacaaggaacuuggcaaagagcucagcgacgaucugucugcccagcugaaggaguauaaggggcgcauggaccaagauaaauuuuaccucuacuucaugcagaugggaaaggaccuguaugauggcuccacaauuaaucuugacgaucugaacagcuaccagaucgaccauauugucccucaguccuuuuauaaagaugacucuaucgacaaucgggugcucacccacuacaccaacaaucaaaagaaagggaaccauacaccccugaauggccugaacauugaugcucagacccagaaccuuuggaagcaccucaauaagcugggacugaucagcaaaaagaaacuccaaaaccugugcuucaaggacaucaaucagcuuuccaaauauacaaagcacggcuuuguuagacgccagcugguggaaacgucucaggucauuaagcucguggccaacauccugagcgaugaguucgcgaaugacgggaccaaaauuaucgaaguuaaggccaaaaugaacucccugaugagagauacauuuaaucuuuacaaggugcggcaacugaacgacuaucaucacgcugucgaugccuaccucaccacauucgugggaaaauaccuguauaagcgcuacccuaagcucagaucuauguuuguuuauggcgacuucaaaaaguuuagcgcugaggaugaccugaaagauauuaagaccuucaauuuccuucaugacaucacgaaccccaaagaauccaauaaggagaaaauuuacgaugaaaagagcggggaacugauccucgaccggaagcacgccaucgagaccauuaaaaagaucuaucaguacaaauuuaugcugauugugcgcgaagucucuacaaaguccggacagcuguucaaacagaccaucuauagcgcgaagaagacaaacggccuuaaaucugccauuccggugaaguccaaucuggagccuagcaucuacggguacagaucuggcaacguggaccaccauauggucaucguuaaaauuaagaaaggaaccaaguauuccuuuaaggugaucggcauuagcgcucgggccauccaagaacucgagauugcuaaaaagaucgggaauuaccgcgauaaacuguaugagguggucuccgacagacucagccagucuaugaaaagcguggaauccuuccggaucauucuggauaacaucauguacggacagcuuauuguugacggcaaugauaaguuuacgcuggggucugccgacuaucgcaagaacagcagacagcucgugcuguguacaaacucccugaagauccuuaaagaugaggacuacaugaaucggcugucugauauucaaagaagcaagcucaugguccagguguaugacgaaaucauuaaaaucaugaagaacaaauacucccuguucaucucuaauaccgagaagcuccuggaaaaacgcgauauuuucugcggacuuagcuucgacgagcagaagaucguuauuuggaagaucauuaucgaccugcacaacggccccuuuacaaaaauccaagagcuggggauuaauaacaagaugggcaccuuccagaccaaacauggaaucauucucacagaaaaugccaucgugauuuaccaguccccuagcggccuguuugagcggaaggucagacuuaaagaucuguga

SEQ ID NO: 4440 - RNA, 4194 nt, Artificial Sequence
  Cas9 variant
augaagaaagugcugggccucgaccuggggaccaacagcaucggaugggcccuugucaaugaggcuacaaaggaagagaaaaaggaaggcaaauccucugagauuaucaagcuggggguuagagugaacccccucacgguggaugaaaagaccaauuucgagaaaggacggccucugagcacaaacgccgaccgcacccuuaagagauccgcgcggcgcaaucugcagagauacaaacuccggcgcagaaaccugauugagauccugauuaagaauggcuuuaucacaaaagauaccccgcucacagaaaccgggaaggacacgacccaccaaacacugaaacuucgggcuaaaucugccaaggagaaagucgaucugaaggacuucgccaaaauccuccugaccauuaacaagaaacgcggauauaagagcuccagaaagguuaauucugaugaagacggccuugcuaucgauggcauggccguggcuaaacaucuguacgagcagaaccucacacccgggcaguaugugcugaaucugcuccagaagaacaaaaaguacgucccugacuuuuaucggagcgaucugcaagaggaauuuaaaaauauuuggaacaaucagaagaccuacuauuuugacauccuuacggauacacuguucgaggaacucaaggacaaaaacaagucccagaccugggccauuugcaaaaagcccuuugacaucgcgggaauuaaacagaucggcaaggccagcgauaagcgccuggagagauacaaauggcggacagaagggcuuacccaaaagcugaaccucgaguaccuggcuaucgcccugcaggagauuaauaacgacaucaauaaaucuuccggauaucucggcgcuauuagcgaucgcucuaaggaacuguucuuuaacaaagagaccgugggggaaaaucuuuacagacagcugguuaagacaccucacacgucccuccggaaccagguguucuauagacaagacuaccuggaugaguuugaaaccaucugggagacacaggccaaguucuauccccagcuuacccauacacugaaagaggaaauucgcgacgucaucaucuuuuaccaacggaagcucaaaagccagaagucucugauuuccuucugucaguucgagagcugggaacagaccuauaucgagaaagaaacgggaaaguccaaaacaagaaccgugggccgcaaggugauuccuaagucuagcccgcuguuucaagaguucaaaaucuggcagaaucucaacucccuggaguuucggaauagcgaugaaggcgagauuaucgaguucaucaaacuugacgaggauauuagacagaccgucuuugaggaacugaaccuccgcgggaaucugaaacccaacgacguucugaagauccuuggaaauuacauuucucucggcaaagugucccaguggaagugcaacuucgaggaaaucgaggggaaucggacaaacgcggcccuguacaacguguaucaaauuaucgcugaaaaugagggauacggcuuugauugggccaagaaaaccgcuagcgagauuaacaaggaacugaaaaauaucuucccucagcucgggaucgacgccucuauucuggacuuugauuucacacaggccaacuuugacaagcagacgagcuaucaacuuuggcaucugcucuacuccgcugaggaagauuucaaaaucucugaggaagacaagguccuguauggaaauagcuccgugagccugaagaaaaagcuccaccagaaauacggcuuuaagcccgaguauaccaaacuucugacaaacauuucucugcagccugauuacggcaaucucuccgcgaaggccaucuguaacauucugcccuaccuuaaggagaauaacguuuauagcgaggcuugcgaccugaccggguacaaucacucuaacuuccucacagccgaagaacaggccaaaagaccgcugaagccuauccuggagcuucucaaaaagaacucccugcgcaaucccguggucgaaaagauccugaaucaaauggugaacguugugaaccaggucauugagaccuauggaaagccugaugagauccggauugaacucacgagagagcugaaaaagagcgcuaaggaacgcgccaauaugaccaaauccaucgcggacgcuacacggagaaacgaugacuaccggaagaccauuaucaaagaguucggcauccccaaucccacaaagucugaugugguccgcuauagacuuuggcaggagcuggccagccggggguacaaagacauuuuuaccgauacggaaaucaagccucaagaacucuucuccaacaagauugacaucgaacacauuaucccgaaagcccugcuguuugacgauucuuucagcaauaagacacuugcuuuuaaaaaggacaaccucaaaaaggccaauagaaccgcuuaugauuucaucgccaacgacuacgcgcccaaucuggagaacuacauugaacgcguggagucccugcauaaggaucggaaaaucacaagagccaagcgcaauaaacuccugaugcuucagagcaagcugccugacggauuuauugagagagaucuccggaacucucaguauaucaccaaagaagcuaagaagaugcuguacgagguuugucgcaccguggucuccacaagcggcucuauuacggacaaacugagagaagauugggaccuuaucaaugugaugaaggagcugaacuuccccaaauauaaggcccucgggcugaccgaaaagauugagcgguacgauaucggcgcugagaagaugaaggaaguugagaucauugaagacuggaauaaacgcaacgaucacagacaucacgccaucgacgcgcucacaguggccuuuuccacccacagccauauucaguaucugaaccaccuuaaugcucggcgcgacgagggacauaagaaacacgccgcuaucauugccaucgaaucuacaaucaccgagaaggagggcaacaaaaagagacgguucauugccccucugcccaauuuucgccuccaagcuaaagaacauaucgagagcauucuggucuccuucaagaacaagaauaaaguggugacgaacaauaucaacaagacaaaaagaauuaagaaagauaaguuuaauaccaagguucagcugaccccgcgggggcagcuucacaaagaaacaaucuacggaaagaucaaacagccucuggagaagcacauuaaacucaacaagagcuucacccuggagcaagcgaagcucaucauugacaaaagacagcgcgaaaagguccugaaucaucuugagaaauaugcccacaacucugauaucgcuuucaauuccaagacacugaaaaagaacccccuccugauuagcgacgaaccucugaaggaggugcuuugcuuugaagagguguucacgauccggaaagauauuuccuacgacaauuuuaagaacgagaaacagcuggauaaggucaucgacgaaaaagugaagcaggcccucaaagagagaaucaaucaauacaacggcgauuuccgcgaagccuuuucugacauugagcggaaccccaucuggcugaauaaggcuaaggggauuuguguuaaaagagccaccaucaagggagugagcaacgcggaaccucuccauacagcuaaaaaucaccugggcgaggagguccuuaccgaaaacaaggagcagauucccguggauuauguuuccacagggaauaaccaccauguggccaucuacgaagacgaggacggcaaucugcaggaaaaagucgugucuuucuaugaggccguuauccgcgugaacgagggacugccgauuaucgauaaggaauacaauaagagccucggcuggaccuuuaaauucacgaugaagcaaaacgagauguuugucuucccuuccgaagacuuuaaucccaccgagauugaucugcuugaccagaaaaacgcuucucugaucagccccaaucucuuccgggugcagaaguucacaauuaaagauuauuucuucagacaccaucuggagaccacaguggaaaacaauaacacccucaagaacacaaccuggcgccgggaggggcuguccggaaucuacggcaucauuaagaucagacuuaaucaccugggggaaauuguccagguuggagaguauuga

SEQ ID NO: 4441 - RNA, 4194 nt, Artificial Sequence
  Cas9 variant
augaacgagaauaaggaaugguuccugggccucgacaucgggaccgccagcgugggaugggcugccacagauacgaacuacaaucugcuuaaacugaagggcaaaaaguccuggggagucagacucuuugacgaggcgcagaccgcuaaagaacggcgcgauugcagaucuaagcggcgcagacuggcccggcgcaaguggagacuugggcugcucgaggaacuguucgccgaggagauuaacaaaaucgaccccaacuuuuucaugcggcugcgcgaaagcaaguauaaaguuuccgauaagacaggcaaugugccuucuauucucuuuaaugagaaaaacuacaccgacaaggaauauuacagaaauuauaagacaaucuaccaucugcgggcugaucuuauucacaaaaacaauccggacauccgcgagcuguuccucgccauccaccauauucugaaguauagagggcacuuucuuuucgcuggacaacaguuuaaaggcagcgagaucaaggauaacauucgggaacugcuccaguacaauucccugaacaucaaaauugacaucaccgaugagcugauuaauaacaucgccgaaauccuccugaagaaaaagaacucuacagacaagauuaucgaguucaaaaagcuguuugcggaugaaaaacagcuuauugaggcccuccgccuggcucuuggcaauaagacccaacuggccaaacucuucgacaucgaggcuuacaaggaacuggacauuagcaucaagacgaucuccuuuaaagagaagauuuaugaagaugugagaagcaacuacgaggaaauccugggggaguauauuaucguccucgacaccgccaaacugauuuacgaugcgaucauccuuucuaagauuaaaaucaagaauaugacaauuuccgagagcaaggugguuucuuaugaaaaacauggaaaggaccugaaacagcucaagcaccugaucaaagaggauuguaaacuuuccaagaaggaaaagcggcagcuguucgagaacauuuucgugaaagaagacgagaagggcgccaauuacgucaacuauaucgggaaaaauaacgcuggaagcucuaaguccagcugcuccuacgaggauuuuaaaaaguuccucaccaaggaacugaaauguugcgaggaaucuaagcugaaacaggacauucucgccgagcuggagcuugaaacauuucugcccagacaacgcaccaaggauaauagcgugauccucuaccagauccacaaagaggaacuggagaagauucugaacaaugcuguucaguaucauccuuuccuuaacaauacggacgaauacggcaucuccauuaaggagaaaaucauucagcuccuggaguuucggauccccuauuacguggggccucugaacacaagccacaaggucggagauggcggcuucucuugguccgugagaaauaaaggguaugaacauaucgccgugacccccuggaacuuuaacaaggucauuaauaaagaggaaagcgccaagaacuucaucgagaaucucacaaaccaauguaccuaccugcuuuaugaagacguucugccuaagcacucucuccuguacagcgaguuugcucugcuuaaugagcucaacuccauuaauuacggaggcaaacgccugaccguggaacaccggaaccugaucauugagagauucuuuaagcagucugcgccgaaagccacagggaaggaacucaaaaaguuccugaugagcgagggagugaucgacggcaaggaugaacuuuccggguuugacgucagcaucaaaaaugaucugaagucuuaucgcgacuucaaaaagauucucggagauaaauucgacuccgagaagguggagaaaaugauccgguggauuacgcuguuuggcgaaagcaagcagcugcuuguugauaagaucaccaaagaguacggcgacauuuauucucucgaagagaucaagaaaaucuccgggcugacauacaaggauuggggaagacugagcgagaaacuccugaccgaaauuguguccucucaacuuuaugacgagagcacaggcgaaugcuucaacaucauuaaugcuaugcgcaacaauacccugcucuuuauggagcugcuggggacgaacuacgauuauuucgaaaagaucaauauuuacaaccggagacuucgcaaggagaucacagagauuacaccccauauccucgacgaucuguacgucuccccugccgugaaacggucuaucuggcagguugugagaauugucgaagaacugaagaaaaucauuggaagcgaacccaagcggaucuuuguggagaccacccgcuccaacaaagaaaagaagggcgacgacgggagaaaagauagccggaagaaagcccuccuggagcuuuauaagaaaauuaagaccucugacaucgucgagcuggaaaaggcucucggccacacaguggauuucgacaaaaagaaacaggaucugacggacaucgauaauaacaagcugaaagccagaaaacuuuaccuguauuacacccagcucggacgcugucuguauacaggcaaggcgauugaccucaauaaccugcuuuccagcaauucugaguacgauguugaccauaucuauccucaauccaagaccaaggaugggagcuggaacaaucuggugcucgucaacaaaacagaaaauucuaagaaaagcaacggacugauuuccgagagcauccagcggaagaauaaacacuuuuggagauuccugaaggcuaagaaccuuauuucugaagagaaauacaagcgccugaccagaacggaggacuuuaccgaugacgaacucuccggcuucaucgcccggcagcugaucgagacaagccaguccgugaaagccguuucucaaauucuccagaaucugaaccccaccacagaaaucugcuuuagcaaggcugagaaugugcaugacuuccgccaggaguuugggaaaauuaaggucggaaagagacggaaccuuaccgaggagcagcaaaaagaagccaaggagggccagcugaucaaagugcgcgaucucaacgaccugcaccacgcuaaggaugccuaccugaauauugugguugggaacgucuaucauaucaaauucacgagaaauccgaagaacuucauucggaaaaauuccaagaaccgcgaauacacacuuaauacccuguuuuauucugacaagaucgagagaaacggcgagguggcgugggaaaaaggaaagacagagaaaaucgugagcuccgucauguguaauaaccucauuaaugugacccggcgcaccucugaacagaagggcgcccuguacgaugcuacaaucuauaaggccaacgcugccaaagaggggagcuacuauccuguuaagacgaaaaauaagaaccucaaagacgugaccagauacggaggcuucacauccauuaagaucgcguacuauagcauuuuuaaauacgauauccggaauaaggacaaggucaaagaaaacaucaagauuauccccauuccuaucuauauuucucagaauaucaaaaccgaucuggaccuuaucaacuucgccgagaagcaaauuaaacugaagaagggggagaacaucgaaaaucugcagcucauuuacaaaaagcugaacaucggagcucuugugaaaauugauuauuaccccuauuacguuggcgggaagacaaaugacaacuuuuacaucgacggcgccgugcagguccugcucuccagcgauauugagagauaucugaaagaagugguuaaguucgugaauuuucaacgcgagaacaaggaagcuaaagucucuaaggagcacaucuccagcgaggaaaauaucgagcucuacaacacccugcuuugcaaaaugacggccaagauuuucacacauaccaaaaauaacaaguauaaugaccuggcccaggauaaggcuaaaaacaccuuuaagaaucugucucucgaggaacaguguaaagugcugcuugagauccugaaccuccugacaaauaagaaaaccacauucgaccucucccugauuaacgaaaaggcgagccgggugaaaugcggauuuaaccuucugaaucagaagcaauucuccaucauugagcagagcgucacgggccuguacgaaaaggagaucaaaaucauugaagauuga

SEQ ID NO: 4442 - RNA, 4197 nt, Artificial Sequence
  Cas9 variant
auggagacccaggccagcaaccaacugaucuccucucaccucaagggcuaccccauuaaagacuauuucguggggcuggauaucggaacaagcuccgucggcugggcuguuacgaauaaggccuacgaacuucugaaauuuagaucucauaagaugugggggagccggcuuuucgacgagggagaauccgcgguggcucgcagaggcuuucggucuaugcgcagacggcuggagcgcagaaaacuucggcugaagcuccuggaagaacuguucgccgaugccauggcucagguggacccuaccuuuuucaugcgccucagagagagcaaguaucacuacgaagauaaaacaaccgggcauuccagcaagcacauucuguuuaucgacaaaaacuauaaugaucaggacuacuucaaggaguauccgacagucuaccaucuucggucugaacugaugaaauccggaaccgaugacauucgcaagcucuuucuggccgugcaccacauccuuaaguacagaggcaacuuccuguaugagggcgcuacauuugauagcaaugccucuacccucgacgauguuaucaaacaggcgcuggagaacauuacguucaauugcuuugacuguaacuccgccaucagcucuauugggcaaauccugauggaagcuggaaagaccaaauccgacaaggccaaagcuauugagcaucucguggauacauacaucgccaccgacacagucgauaccagcuccaagacgcagaaagaccaggugaaggaagauaagaaacggcugaaggcguucgccaaucuuguucugggccucaacgcuucucugauugaccuuuucgggagcguggaggaacuggaggaggaucucaaaaagcugcagaucacaggagacaccuaugaugacaaacgcgaugaacuggccaaggcuugguccgacgagaucuacauuaucgacgauugcaagagcgucuaugacgccauuauccuccugucuauuaaagaacccggccuuacaaucuccgagagcaaggugaaagccuuuaauaagcacaaagaugaccuggcuauccucaagucucugcuuaagagcgauagauccauuuacaacaccauguucaaaguggacgaaaaggggcugcauaauuauguccacuacaucaaacaaggacggaccgaggagacaucuuguaacagagaagauuuuuacaaguauacgaaaaagauuguugagggccucagcgacuccaaggauaaagaauacauccugagccagauugagcugcagauccuccugccucuucagcgcaucaaggacaauggcgugauucccuaucaacugcaccucgaggagcugaaagcgauccuggccaagugcgggccuaaauuccccuuucuuaacgagguggcugauggauucucugucgccgaaaagcucauuaaaaugcuggaguuucggaucccuuacuaugugggcccgcugaacacccaucacaauguugacaacgggggauucgccugggcugugagaaaggccuccggccgcgucacacccuggaauuuugaugacaagauugaccgggagaaaagcgcggcugccuucaucaagaaccucaccaauaaauguacauaccugcuuggggaagaugugcugccuaagucuucccuccuguauagcgaguuuaugcugcuuaacgaacucaauaacguuagaauugacggaaaaccccuggagaagguggucaaggaacaucugaucgaggccguguucaaacaggaucacaagaaaaugaccaagaaucgcaucgaacaguuucucaaagacaacggcuacauuuccgagacgcauaagcacgagaucacaggccuggauggggaaauuaagaaugaccuugcuucuuaccgggauauggucagaauccugggagacggcuucgaucgcagcauggccgaggaaauuaucaccgacaucaccauuuucggggaguccaaaaagaugcuccgggaaacacugcgcaaaaaguuugcuucuugccuggaugacgaggccaucaaaaagcucaccaagcucagauaucgggauuggggaagacugagccaaaaacugcucaacggcauugaggggugugacaaggcgggcgacggaacaccugaaacgaucauuauccugaugcggaauuucuccuacaaccuuauggagcugcucggcgauaaauuuagcuucauggaacgcauccaggagauuaaugccaagcugaccgaagggcagaucgugaacccccacgacauuaucgaugaccuggcucuuucuccggccguuaaaagagcuguguggcaggcccuccggauugucgaugagguggcgcauaucaagaaagcccugccugcuagaaucuuuguugaggugacacgcuccaacaagaaugaaaagaaaaagaaagacagccggcaaaagagacugucugaucucuaugccgcuauuaaaaaggacgauguccugcuuaacggacugaauaacgagaucuucggcgaacucaaguccagccuggccaaauacgacgaugccgcucugcgcucuaagaaacuuuaucuguacuauacccagauggggagaugcgcguacacaggagagauuaucgagcucagccugcucaauaccgacaacuacgacauugaucacaucuauccccggucccugacgaaggacgauagcuuugacaaucuugugcuguguaaacgcaccgccaacgcucagaagucugaugccuacccuauuuccgaagagauccagaagacacaaaaacccuucuggaccuuucucaagcagcagggccugaucagcgaaagaaaauaugagcggcugacacgcauuacgccccuuacggccgacgaucuguccggguucaucgcuagacagcucguggaaacaaaucaaucuguuaaggccgcgaccacacugcuccggcgccuguacccuggcgucgacgugguguuugucaaagcugagaacgugaccgauuucagacaugacaauaacuuuauuaagguucggagccuuaaucaccaccaucacgccaaggaugccuaucugaacaucguggucggaaauguguaccaugagcgcuucaccagaaacuuccgggccuuuuucaaaaagaacggcgcuaauagaacauauaaccucgcgaaaauguuuaauuacgacguuaacugcacgaaugcuaaggaugggaaagccugggacgugaagaccuccauggacacagucaagaaaaugauggauucuaacgacgugcgcguuaccaagcggcugcuggaacagacaggagcccuugcugaugccaccauuuacaaagcuacgguggccggcaaggcgaaagacggggccuauaucggaaugaagacaaaaagcuccgucuucgcugaugugucuaaguacggcgggaugaccaagaucaaaaaugccuauagcauuaucgugcaguacaccggcaagaaaggagaggucauuaaggaaaucguuccgcugcccauuuaucucacaaacagaaauaccacagaccaggaucugaucaacuacguggcuuccaucauuccucaagccaaagacaucagcauuaucuauggcaagcucuguauuaaucagcuggugaaggucaacggguuuuacuacuaucuuggaggcaaaaccaauucuaaguucugcaucgauaacgccauucaggugaucguuuccaaugaguggauccccuaccugaaagugcuggaaaaguuuaacaacaugcgcaaagacaauaaggaucucaaggcuaacgucgugagcacccgggcgcuggacaauaaacacacaauugagguuagaaucguggaggaaaagaacauugaguucuuugauuaucuugucucuaaacugaagaugccuaucuaccagaaaaugaaggggaauaaggccgcugaacucuccgagaaaggauauggccuguucaagaaaaugagccucgaggaacaaucuauucaucugaucgagcuucugaaccugcucaccaaucagaagacaaccuuugaagugaaaccccuggggaucacggccucccgcagcaccguuggcuccaagauuagcaaccaggacgaguucaaagugaucaaugaaucuauuacaggacuuuacagcaacgaggucaccaucguguga
